United States Patent 11,001,841 (CCCTC-BINDING FACTOR (CTCF) RNA INTERACTOME) - sequence listing, part 22

SEQ ID NO: 55138 - DNA, 1993 bp, Homo sapiens
tcttgggaagtttgcaaagaaagcgaaggagcctgccctgtaactgttgacaacatctccctccctctctccctttgttgagaaagaatgaatagttggttgtgttgctccctctgcgtcgcggtggggagaggcgagggaaggcaaaggaagggagggacggtgggaaggaggttccgatagatcgtacagcccaactgtccttacccacttaggccgctgagggcgccgccgctttaaaacggtgtaatcaggtgtagacactcgtcgaggaggaggttgagcggactccgaagcatctggcaaggcggcgtgttccgtggggcggcgggtcgggtcatggttggggttaactcgcttgaagcaaggtgcaaaggagaaaaaccattttcctaacctcatatctgttttcgcttaaagctgttagctgagatggaaagtagagccgtgcattcagattgttttaaaccttgactttatctcccaaggctacacagacctccccaaggaaagtacgctggccgagggaaggtcattttgggagctgatagcctcccttgtgttgcctgggactgagttgagatcctggaggctgggagaggcctcagtgctgggggtggggcccagctcaacacaggtccaagtgggaaggggctacccgggtaacaatgggaagcccacaggcaaagcgcttgtctgcgggcgtgccagggggtattgaggataacgtaaagaccttgccaagccaggggatcccacaccactccaactccaactttctctaaagtgctgctgagaaggctggcatttccaggatgactaaccaaggtctaaatctcctgttcatataggcagaactgcttgtcaaatggatgctaatcttaagaaccttatcgggtaaatcctgtactgtgttgcttgaaatacaatccatggaggaattattcatacttgaatcatttggctagacttcataagtttacttcaaaaataaagagatactcttaattcctaaacccaagcaaaacttcattttaagtggataagccaattgaatatgtgtggttgtttcatctcctctctccatctgactctccagagaagttataaaactacagatccaagttgtaaattctctgtcatggggcagccgagacggttacatttccagagtttaaaatataatgaaaagttcttaaagctcacatcagataaccattatgagttaaacttgaaaatatcccgtttcagaaataaaagagtaaaatccaaacaagtgggctgcttatctctgcctcagcttgcaagatcatcagtttctttgagacatcattgtaaagcaagtgagttgggcctcagttcacaaacatttcaaagcccagcgactgaccaggcccaggaaggcagcacatgtggtaaagtttgtcagcctcgctcttgttcctgatgttcacatgagtctcagattttcatatcaagatgcagagtctttgacttttgtataatatttcaaaatctggcattagactgagtcaggacattgtgtttgttttcctgcacagtagagagaagtcagatggccagagtctcacctgggcttttttctaaagactgcatgtaggctcacttggtttgcctgtacgtgtgtctgtgtctgtgtccgtgtccatgtcctacttggcttggtgtctttgcatctattgttctaggttaaaacgtttccctccccatccttcccagttgcagtcttcatttgtgaactctcagagttacttcctttgtgaaccctcagtataacagagatacagtgactcttatctgacaagatagataagagcagcccctgtcctgcttagaggggacctgctatttactaagtgtttgcagtatttcaagaactttgtatacacaatcacttttaatctttacaacaatcttatgaaatagctgttaagtcattttttaaaatgagaaaccgtcaggttgagtaact

SEQ ID NO: 55139 - DNA, 1066 bp, Homo sapiens
ccgaatttctgaggtatccgggctctggtggactgaggggggcgacgcgccccgcgccgcagcatcctccgagagctcgtcttgccgccagcacctgcctccaaggacgccgcgcagctgccccgagcccgcgcgcccggggcccgcgactgcgtgggcggaagccgggagggtgtcagcacgcgtgggagcgctgggagcatgcgtatgcgggtgcatgtggtcggagggcgcgcgctcgagcgcggccgcggggtttcctggtggctgcgagcggtggggacggcagcgggcctggcgccgctgcccagaagggtgcggtcgccacgaatctgagaggcggctgggtgggggccggcaggtttccagtgcccgcagtgatccccatccgcaagaccccgaagccctttgaaatagacggtcaaagccgcgtggttgctctgcgactgcagcggcgagaccgaacgcccggcccccgttcctattagctcacagcagtcccggccccgcctacggaggattcgcagggcggccgctgggcgcgctttctcggctcggccacagcccgtttctgcaccaaacccgccagccgcggcccaccctgtgcttcacccatacccgcccctgcccagcatcgccaggcctcaaatgcagaatagtctctggcagagttcaaagagggaaagggaagtcctgggaagagtccagtgtggtagggattttacagtcttacttaaccccaagacgaagctatggggcgggtacatacacaccaccgtcccctttataatataaagaagggaaactgcagctaagagaggttaaaaaactcgtgtagggacgcccagctagtgagcgtggagaactgtgatgaatcatattttgttatgtttgcaaactaacacgttagctttcacggtttcatgaatgctgacagaacacaccagacttctgagtcagagataaaagactattacaacaaaagcaatagccagagtatcaccatttttgagttggctccctggaccccagttctcacaggaacgaagcacacgggcccagatgc

SEQ ID NO: 55140 - DNA, 1197 bp, Homo sapiens
aattggtcactttgtcttcagagcgtctatagtgttttgttcagcacatgttatgctttaatattttagttactttttgtggagcttccttaagactgcaggctctgcactgcaggaaccagatgttctttgtttccctaacatgtaacacagtgcctggtgcatagtgatcactgtaaattttattcagttgagtgtatgaacaaatacagaatgatcactaagtaggccaaactggcagcctttgtgatgacctaggaaaccaaataggtatgtagtagaatttatgtgtctaattcattgatttgggaaactagaacaaaaagtatatattatctgttccacttttctcctttagttacactgtgcatcatgaatttagtgtttagcaaagaaattttggatctactataaactactgaagaaacataatagcaccactatgctacttttttttttttgctttaaataaatggcaaaatttacattactattagtgtaatgtaagcttgttctttccattcctttctctaaatataattagagctacactgaagtatgaaagcatcttggcactcaatgcatgacttatttcaatcaattgttcacagattggaaccattgttgacaatccagctgatttctaccattcacgaattcccaagaagcaaaggaaaagaactattgtggaagaactgctggctgattctgaattcagaaggtaaaggaattcatatttattttataatatgtatactttgctttaaaaatgtataaacttataaattttcaaataatttaaaaataactcatttataataacccataacatattaacatgaatatatatttttatgaaaaataatttagtgcaaatctctttaatgtctggcttaactaaagacagaggctcatacctgcttctgcagataacatacatcacgtagcccctggaaaacactacactcatgagagaacgagggtgaaaaaagcgattaatgccttagtattcttgagaaaatagtttttacctaatgaatcccttgaaagggtctactccacagaccacactttgaaaaccattggtcgcttctaagaaatatatatatcatactgtgcattttcaggataagtgtgactttttgttttgcttagtcctgatttttgtgtttttatccctcaaaaatgtttaaagca

SEQ ID NO: 55141 - DNA, 1050 bp, Homo sapiens
ctaaagagttgggattataggcatgagccatcgtgcctggccttttttttcttttttctttttttttttgggagggagctgggtttggggggagacagggtctcactctgtcacccaggctggagtgagtggcacagtcatagcttgctgcagcctcaagctcctggcctcaagtgatccttctgccttagcgtcctgagtagctgggactacaggtgtgtgccaccatgcccaactaatttcttttctttttttttttttttttacagtcagggtcttgctatgttgaccaaggtggtctaaaactcctggcctcaagtgatcctcctcccttggcctcctcaaagcactaggattataggtgtgagccactttgccaggctgactaaaaattttaaaacttacagaagtttaaactgttgaaaaacttatataacattctgacattattttaaaaccaattttatgtttttatagcttctgcagaaagccgtcattacacctgattttgaaaaaaaccactgtgttccaccatatagtgaatcaaagtatcaacttcagaaaaaacgcagagtaagtacagtgacttaattaaaatgcttagatatgtttggctatatattttcagcttatacaacataactgcacaattaaactgtatctgttggtctatatatgagtccaaagaaaataattacagatttctaagggctgtaaaatatagtaccataaacacattatgtatagattttcacatctttgcagccacaatagtgcatctataagtagaggttttttaaaaaaatatatatatatatagattacttctatctgccatttcgactagttatccagagagcttgaaggaaagttgaggatggtattctagtaatgttactgtaatatggagcaccctggcacatggtaggcactaactaaatacttgttgtatgaatgaaacaaaattaaataacttgtaggagttttctaaagaatagtattttgttttattgtagaaataacacaaggttctggatccttgtatgagtg

SEQ ID NO: 55142 - DNA, 2403 bp, Homo sapiens
agtaactccaacaaaggagtcttacactgaagaaatagtgtctgaagcagaatctcatgtttcaggtatttctagaattgtgcttcctacagaaaaaactacaggagccagaagaagtaaggctaaatctctgacagatccaagccaagaatctcatacagaagctatatctgatgctgagacatcaagctcagacatttcattctctggaattgcaactagaagaaccaggagtatgcagaggaaattaaaggcacaaactgaaaagaaagatagtaagattgtaccaggaaatgagaaacagatcgtgggtacacctgtgaattcagaggattcagataccagacaaacttcccatttacaagcaagatctctttctgagataaataagccaaatttctataataatgactttgatgatgatttctcccacagaagttcagaaaatatattaacagtgcacgaacaggccaatgttgaatctcttaaagaaacaaaacagaattgtaaggatttggatgaagatgccaatggaataacagatgaggggaaagaaattaatgagaaaagttctcagctgaagaatctttctgaacttcaggacactagccttcaacagttagtttctcagagacattcaaccccccaaaataaaaatgctgtatcagtgcactctaatctgaactctgaggctgtaatgaaatcattaactcaaacatttgcaactgtggaagtaggcagatggaataacaacaaaaagagccccataaaagcaagtgacttgacaaagtttggtgattgtggtggtagtgatgatgaagaagagtccacagttataagtgtcagtgaagacatgaacagtgaagggaatgtagattttgaatgtgataccaaactatacacgtctgcgcccaacacatctcagggtaaagataattctgtcttactagttctcagcagtgatgaaagccaacagtctgaaaacagtgagaatgaagaggatactttatgttttgttgaaaatagtggccaaagggagtcattaagtggagacacaggaagtctgtcatgtgacaatgcattgtttgtaattgacacaactcctggaatgagtgctgataaaaatttttacttggaagaggaagacaaggcaagtgaggttgccattgaggaagaaaaagaagaggaagaggatgaaaaaagtgaagaagattcatcagaccatgacgaaaatgaagatgagtttagtgatgaagaagacttcctaaatagcacaaaggctaaactgtaagtttttcctttatttttataagtttttgatacatgtatttcaagtggttaatttaccataaaaatatgaaatgttagcctggggaatgagaaaatcactgccttgggttcttcatggaatggctcattcatttgacattatggagccaggtgttgggtgtgcacctgtagtcccagccacccagggaggttgaggtaggaggatcacttgagtcccaagagttcaaggctgcagtggtcactactgcactccatcctgggccaacagtgagaccctgtctcaaaaaataaaataaaatgatgaaaaatatatttatttagagttttttttcaggaattcctcataaaaataagatgcttttttttctttattgtggacaatacaagggaagagaagaataagtgattttttaaaatgccatcttatatgtttccattttgatttaattacttgatctttaagtgatgatttctttttcagtctgaagttgacaagcagcagcatagaccctggtctgagtatcaagcagttgggtggtttgtatattaattttaatgcagataaactacagtctaacaagagaaccctaacacagatcaaggagaaaaagaaaaatgaggtaagttaattgtgctgttaggttttcacagaactaaccaatcacttttagaaattagtccttggtaaaagacttaattttcctacagtgaaaccacattggcctaatgtgttagttttttccttctctctaaaacagtcatttctttttacaataaaatcctatctatgaatgataatgctttaaaaataaatcaatacagggtcagtgttcctcatcttacacccaccaattatgatcccaggggttttgtttttttcccttttcttgctatacttttagttcttaagttcttaactagtgtagactgttgagaatctgaaagctgtgaatgcctgcctgcctcttccacccggaaaaaaatgcacatgtgcatatagacattttacatataatttcagaaggaattactgttaaggtaactttacccaaacccttagctttagccaacaccttgcactgttttctcctaaatctatattttctagccttg

SEQ ID NO: 55143 - DNA, 1057 bp, Homo sapiens
tcaaaaaaaaaaaaaaagctgtatctgttgatagaagtaatgaaaaggactggggcatgtggaaggaagtgggactgagtagcaggttaaggataagaaaaacttccctgaagaaattagctttagactagggtcagatgacaaggtgtggtaggcattctgggcagaaacccttgtttgcctggtttgtaaatatgcccctattgaatgatggagtagttaatatgtaaactttagaagttcaaggaaaacatcttcaaaagcttattcttatagaaaggaatggcttctgttgagataagcgtaggttaagtttggaaaagtcataaaaagatgaaagcttgctaatttcctctaaatatatcaggatatggtcatatgtagttccgctaccagagaagtcaacaaaagctttaacatgtttcctcagcaatgactaaatgtgtaaaatgtcatgcaagattttgatgtgtctgctggtccattattttaaggttcatgttttacaatgaacattacttattttgattattttccctctttctttgctcactgttgattcttgcattctattcaagttttttttttttgttttttttttttttgagacagggatctcactctgtttcttaggctggtgtactgtggcatgatcatggctcactgcagcctcaacctcccaggcttaagccatcctcccacctcagcctctcaagtagctgggactacagacatgcaccaccacacctggctaacttttatttttgtagagacaggatctcgctatgttgcccaggctggtcttgaactcttggactcaagtgatcctctcaccacagcctcccaaagtgctgggattacaggcatgagacacagtacctagcctccttagtaattctttaccaaaggtctttagtgacagtaaattttctagatcccatttgtctgaaatgtctttattttgcactcaacctttgttttttgtttttgtttttgttttttatagagatcagttttcattatgttgcccagattggagtgcagtggttattcacag

SEQ ID NO: 55144 - DNA, 1019 bp, Homo sapiens
taaataagctatgaactttgatgtacactataaatctccttaattctataaatttgtgtctgtaacctgaatagtttgaaaacttctttaaaaatctcttgtatttcatccgggcgcagtggctcacacctgtaatcccagcactttgggaggccgaggtgggcagatcacgaggtcaggagtttgagaccagcctgaccaacatggtaaaaccccatctctactaaaatacaaaaattggctgggcgtggtggcactcgcctgtaatctcagctacttgggaggctgaggcaggagaatcgcttgaacccgggaggcggaggttacagtgagccgagatcacatcactgcactccagcctgggcgacagagcgagactccatctcaaaaaaaaaaaaaaactcttgtatctcaatatttttaaaccacaggcctaaataaaactaattttgctcaagttttctcaacctagggaaaaagaactatggttccatattcaaaataaatattatagacccttttcctaagtaggattttgtggtttactgattgggtaatttgatcattaaaattatgtgaaatctgcccgggcacacctcatgcctgtaatcccagcactctgggaggccaaggcagatgatcacctgaggtcaggagttctagaccagcctggctaacatggtgaaaccctgtatctgctaaaaatacaaaaattagccaggcgtggtggcgggctcctgtaatcccagctactttggaggcgaggcacgagaatcgcttgaacctgggaggcggagtttgcagtgagccgagatcacgccattgcactccagcctgggcgacagagcgagactgcgtctcaaaaaaaaaaaaaaaagaaaaattatgtgaaatcatgtgatttgcctgggaaaacttgtttagatattgagctacttatgccttctagcctttatattaattgtatgtaatgttattaaatatatatatagttcatctttacatttggaaatgcccaa

SEQ ID NO: 55145 - DNA, 1075 bp, Homo sapiens
ttcaagatatggatgaagatatatatatatatatgaagatatatactcatatacaccaaaaaagttgtaaggaaatgcatgacaatgttatatcatctccaattgataggattatcagttactttttttttctttagactttcctgtattttccctgactatacattagaatcacctggagatctttaaaaaactgcagatgtctaggctccactcaccaaaagttaagaattaaataggctggggtacaggtgtagatactttttaaataactgcctgggaatttctaatattctggttcagattcatagcacacacatgaagaataagcatattatatattaaatgttgaggtgtttcttttgttatgttaaatgcttacctacatactaaagtgcttttttgttttccaatttaacacgctggagttttgtttgttgttgtttcttttagaactgctttctgaagcaagtttccaagaagctcttcaggaaagcattcctgacattcaagcgcacgagtgggtgccgctgtggctactgcggtattcggtcattgtgaaaagtagaggaattatcaaatcaaaaggctacattttacaagctaaaagaaggggttcttaactgacttaggagcataacttacctgtaatttccttcaatatgagagaaaattgagatgtgtaaaaatctagttactgcctgtaaatggtgtcattgaggcagatattctttcgtcatatttgacagtatgttgtctgtcaagttttaaatacttatcttgcctccatatcaatccattctcatgaacctctgtattgctttccttaaactattgttttctaattgaaattgtctataaagaaaatacttgcaatatatttttcctttatttttatgactaatataaatcaagaaaatttgttgttagatatattttggcctaggtatcagggtaatgtatatacatattttttatttccaaaaaaaattcattaattgcttcttaactcttattataaccaagcaatttaattacaattgttaaaactgaaatactggaagaagatattttt

SEQ ID NO: 55146 - DNA, 1035 bp, Homo sapiens
accaaacattcagtttttcagtgtctcaagcttattctttgctgtgactactagttacagaatattaggtcataattcttgtgatcatccatatgcgatagtagtgagcaagtagaactggagaagaaaattttatgaagataagggagctactaaaaacttctgggacctaggaaacaagaagaaattttgttccctagaaagaggagcatgtagtagtagctgcaagctgcctaggaataaggcaggtcagagaaacccacttgtctgccacacagagcaagtaggtaaatgggcacttacacatttttgaaagatagaaatgttctaaatgaaaagtaaactatgaaataatctgttattttgaaaacaagtgaagaatatggacagaattcagtgggatactttgaaaacattagaaatatttgtttttatgatgtaagcatttattttctttgtgtcttccttcctatcagcctgttcagtccttggagttgcacagctggattctgtgatcattgcttcacctcctattgaagatggagttaatctttccttggagcatttacagccttactgggaggaattagaaaacttagttcagagcaaaaagattgttgccataggtacctctgatctagacaaaacacagttggaacagctgtatcagtgggcacaggtgagggatggcaggatcatgagcactccaggaagaacttgcccttttcagtctttgctgcacactgttgagcatcatgcacatagtggccacccctgcggggtgacttttccacatgtgggagttttgttttgtttctgcaggagttttgaggcaggttttatctaaatcatttgaggtttttgtttgtttttatttaaatatatctctgattgaactgaatgttaatcctggttaaaatgagtgacaaaaatactagaagatgtgtgttaaaacatttataccaaatgaattaaggccatttccttcagttctacttatgtgctgaaaacaataatacctaaagaaaaacctta

SEQ ID NO: 55147 - DNA, 1030 bp, Homo sapiens
ttacttaaactccaagatggagttataagaggtcagtgctggctattatataagagtcagaatagaacttcaacttgctgttcttcatgatgatgtcatcatgtcatgtaatttatgtgtcaaacttcagagcagtagaaagattaagatgaaggagatggaaaggataaagggaaggcttagaagcagcatccacccaaagcaagcataagcacccccttcctggtaagatactggtaagcaatgtgtgaggtcacctgggaatataaaaagaaacctgggcaagttacatgaagagaaagaaaatactgtaacacccattcaggaaatgtagtaagtgacaaattccagaaactgtactatactcaaggaatacaaaaatgaaaagatgcgccatctctgccctcaccttacaattagcatagcatagtcattaaaagcttgagctttgaagtttcggggtgtgcagattacaggctagtataatgttgggctaacaaagactttaacctccctgagtctcagttttctcttctataaaatggggatgtacctgtttctccggcttctttgtaaactggatgaaataacaaaagaagcacttagcacagtgtttgcctcaaagtaagttctaggtagctattatttgctaccatgttgttattattgtggttgttgctattttattattattgagatggataataataataaattacatgtaagatgagatagggtattgtctctttttaatctaattatagtaactaccatttattgagtcttgctttgtgccaggcactgtgcttggtactttatggttatattttctcatttaattctcaagacaatcctgcaagttaagtctgttactgcattgcattagtgatactaaataacttgaaggttgtcatacaaccagtaagtggttgaaccaggaatccactcaggtatgcctaactccaaaacccattttttcctgttaatttcacattgctgtttgtgttggaaaggacgtaaagcaacattc

SEQ ID NO: 55148 - DNA, 1043 bp, Homo sapiens
agtcaatatagcaaacatgtaatttacaagattaaaaataattaggcttgtgataaagtcaatgaatttcctacgtaattgtaacattagactgttttattatttgtcctgacattttgcagaatccaagattaattaaagaaatggtttcaagaagagggtgaatactataaaaatagacttaccttcctgaattgaggaattcatcaggaaagcctcaagtgtgcaaatgagccatccttccagagggaaatttcttagaattatcccacgatttgagccaaagcacttccgatagaatttttaacctctagttggttctgctccttccatttttactaatttttaagaaaatactatgacttataattgtatctggaatgattatcaactccttttcatccactgacttaaatttgattataaatatgctttacataaagatctagaccttataatttgaattcaagtgaattgttgtgactagcatgtaaattattattatggattgtaaatcttaacataggtagttctgtgcccttaaattgataaaccagttatctcttgtaatcatgtgtactaagatatacgtagtaaagtgattgtatcagtttttatcataagcagtcatagttcagatagttcagaagtttagtgtctgctgtttctattaggaaagtgcttttgcaattcaggggcttgcctctagttactcatttgtgttttcattgattgcccacagaagaatgcaaaacactgtgtccttggttatctaataaggcagtgatttcagattgccaggtttggcccattagtggtcataaatcagttcagtgagtcatggaccagtatattttttctaattaatatattggaagccattagagtgcctggcatgttgtgagcataaataccgctttatgactgttttgttccattatatgtatataggtctttgctcactatgtgaatgtatgtcttactttggactactatcaaataagtctgaaatacactttaataaagtatgtttgaattaattt

SEQ ID NO: 55149 - DNA, 1054 bp, Homo sapiens
gatgaagtagtattcatagtacacctaacttttagaatgttgacattagactctctattgcagtgaggcaaatgagtaagcactcaattttggctttggaataccctaaataccctgactttagtcattacacattttatgcacttatctgtgcgtctatgtatgctttatcagtacacattctatgcatgtaacaatatcattgtacattctatgcatgtaacagaatatcacatgtgccccataaatatgtacaaatataatctatcaattcaaaaattaaagttttgtaaaaactggaaaataaaaagactagtcactagttggaggtgacagagattaatctggaattacaaacttgttacctatttgttggccatttctgagcggatagtcatccactgcacattgtgcatattggtggtatgggacaattttagtatttaaaaaataacaaaatctttagatttaggagctatatgactttggaaaattactttaaagttggataataacaccttcctcatcaggttgttgtgagaattaagaggtaatatatgaaaacgctcaccatgcaggcatctatctccctgtcatctggttccatcagaaagataaatcttaattaagagaaaaaccttcctaaactatgtgtgtttagaaaaaccttcctaaatcagctgtgttcctaagtggtttctgctctcttctatgagatgttggtaacagaccatgcagcagcacacggcatccctctgagttaagtgctggacctgtgcccaggcctgttgttggggtcagtgcccatcaagagatgagaactcttgcttgtaactttagtaggaatctgagtctgtaccatattctgtgttcacgttccagctcagtgtgtatgttttgttttatttaaaccacctactttggctgtttctcccacagataaatatttctgtattcggtacatagactcttaatttcttccagtactgttggtggtagttcaatacagaattttgcacgtatattgatattattgggtgaaattttacctatc

SEQ ID NO: 55150 - DNA, 1063 bp, Homo sapiens
aaattagcagtttgggagaaggtccttgaaggtagcaaagcgaaaagaagaagggggcgcttgcgcataaacagctgcttctgagaacgaaaactacgtagcatttccgagtcccggtggccgctcaggctgccctttaaagagacgtgtaggaagcccaccctggggcggccgtgggcggagccgcgacctgaacgccgggagacctcaccaggcggaggcggtgtctacctcaccaggcggaggcggtgtctgcctcgcgctgtcctctgaccgccagggggagccctgccgcgcgctgcgctccgggccgcgccgccacgctctctcgacccgcgcgcccgccgcgcaccacccgtcgccacgcccgccgcaggccaagggccagtcacttgcgggccggcgtcccgcagcccattcgcgccccgcccctgccccgccgcgggatgagtaacggttacgaagcactttctcggctacgatttctgcttagtcattgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccgcagccccttcgctgcgcggcccctgggcggccgctgccatgggcaccgacagccgcgcggccaaggcgctcctggcgcgggcccgcaccctgcacctgcagacggggaacctgctgaactggggccgcctgcggaagaagtgcccgtccacgcacagcgaggaggtgagcgtggcgacactcgccgcggggctcccggggcaggcctcgggcggggccgggcggttccggcaagggagaagcgcccgcgggcgagggagggtggcagggcctcgcgcgcacctgggctccgcccgcggtcagatgctgaggcc

SEQ ID NO: 55151 - DNA, 1017 bp, Homo sapiens
accttgaattgtagtttatttccatttacttttcagagtcttgatttgtgcattctgttcagatttttaggtgaattcagtgggagacgggagaagttagcttactgcatctgaaccagaaaacttccttaaaatatttttgagtgtttaatattgtatctcatttattttccaaattttgattaattaatatattatttacttaaagaatcatgaaaggatttaaaagaattataaaatccaggatttgaaattaccttagaagtcatttaggccatttacttttgacaaattctcttcacctcaaacaatagctaataatagctaagattgactacgtacctgccagtgtattaagctcatggtctacattaattcatttaattctcacaaaaatcctatcaagtttttagctccattttactgatgagaaaactaaagtttagaaagccttctcaagatgcggtccttggaccagtcatattgccattactttgagagcctatgaggaatgcagaatcttgggtttcaacacagatccttagaaccataatctacatttggacaagatccccaaggtgattcatttgcacattaactttttcaatgcactggtttaaataaattataaataacttgatgaaggtcacctagcgtgcaagttacctttaggatcaagagagtaagcagtttacctttagctggagaatgctctaacatagccagttgctagaattaaactgtaccttatgcagtttgaattttctttgtttcttgaagaagttagggcacaaataagctatttattctgttatctgtacttttcaaatactatttatgcagagtcaagtatccttagggaatgcctgtctacattgaaaaggacttagaggctaattatcctatcatctggtatatcaagagagatgaagaggaaacatggcagtctttgaaataacattaagctaatcgaaatttagcacttattcagattgctacccttaaataccttcccca

SEQ ID NO: 55152 - DNA, 1029 bp, Homo sapiens
ctgaattttggagtttgtgaaagaatgtcttagagaaggcagtagtttattttacttgacaagaaagttcaccttttaggcaagtgtgtgtgtgtatgtgtactaattcaggcacctgatagcaaggataggcaaaagctttgtattattgatgaaatgtaattttacgaacaaattctgtaagattatatggaatatagtaaatataaatataaaatgctatttcaaatagaagcaaatattttatagacagtgtactaattataaattgtacatggctgtccattaaaatcaactgcctttgaatcactgaccagaacagattaacttcagaagtattattttgaaaacagaagatttcagaattttcagttatttcaacttagctttactatagtaaatatttgtttaaaatataaattctagtgttatttttttttctgtgatatttgtgaaggtagaagaagcaaatgaactttacaaagtttgtgtgacaaatgttgaagaaagaagaaatgatctagaaaataccaaaagagaaattttagcacaactccggacacttgttttccagtgtgatcttacccttaaagctgtaagtaatttcttcagtattttgaaggcaagaagaaaagaccatcaggcaaggcatggtggctcacacctgtaatcccagcactttgggaggctgaggtgggaggatcacttgagcccaaaagtttgaggttatagtgagcttcgattatgattacccactctagagtgggtgatcaagaaagagagagagagagagagagagagagagagaaggaaggaaggaaagaagggagggaggaaagaagggagggaggaaggaagggagggagggaaaagaaagagaagtctctatctgcagaaggggaaggtatgcctgataagttacaattcttacgggatttagattctgagattaatgaaatgtgttgagtttgcagattgattttcagtttttcatagtgatatacagtttgaatttcttttgatctgcct

SEQ ID NO: 55153 - DNA, 1080 bp, Homo sapiens
acttttcacaaacttcttgtagttactttctatgaatgtcctggattaatctcttcttgcttagtaacctagtgtattcatttttaatgcaaaatgatatataaagttttacatatagagcttaagggaaataacctgctagagtagatagataatatgagatatagactgatcaagaattgtgtaaagcttttaacttgatggataatagaaatatattttaagataaaaatacattatagtttgaaaccattttaagtttaaactctggccttttaattgtaaatttgtcacttgtattttttttaaaaaccagtttttattgactagtatcttaggatctcagtgcttctttgtttggagttatgatgtgatcacatttaacatatacttaccttgatatttttgttttcaggaaatttttcccctttagaactagacaacgtgctgttaaagaacactgactctatcgagctggctttgtcatatgctaaaacttggtcaaaatatactaagaacatagtttcatgggttgaaaaaaagcttaacttgggtgagttgccttttaaagcatctgatttagagtataataattaagttgtttctaactcattttttacagattatgagtaatagaattccaaattagtacctgtttcattataatgaataaaaccattatccagaaaagactcttcttacactagatggaattagtgagtatttactgtggaccaactactagacctagggacacaaagacaaatagaatactgtctctgccttcaaagaagtcatactctagtgggtaagaggaaatgcagtcagataatatggtcaggagataacagcaacaatagatgtatgagtagaaggcaatggaaacagagaagaaacattttaatagctaatatttcctcagtgttttacagttatcaaaatgttttcgtagtcattatcttatttacttcttacaaaaactctgagaagtaggcaagacaagaattgtttttcctatattacagctgagagagacaagacaggagatttcttaaggtcatatagcagatttgcttaaag

SEQ ID NO: 55154 - DNA, 1050 bp, Homo sapiens
tcctgtggttgggtccatttgacgtaggaaaatttgacatcattggaattttaacctttctgttaatggtaacacagtgcattgattggtcttaaataagctgactaatgtttataatttacattgttgacactgttacctaaattcacctttccacattttagatgaagttttggtatctaaaatgactgcattttttttttttaacaaaaatcagacttaattctgttttgctgatctgtaacatcttgaattaagggctaatcacagaattctgtctagttagaaatgaataatggagcatgagactctgttcctctaaagtaaaagattgtatatctctgacttgttcttagtacctgtctttcaatgtttagtgcctcttaggtctaaatttgatggcaaggataataaatagttacaaaaacagctcctattcttctatgataaatggcagtttcatttccatattcataatggtatgtctagatataaaaatgaagattctcagtgttatttatatgagacctcttggggctttatagaaatttgtaagatttcaataaatatttctatgtatatatataagttaaatacttattttctgatggacattttgaaaaaccaaaattgtatcttgtgcttgtactaaatttaagagttaatttctaatctgttattttcaggttgaaatgcccaaaatgactggaattgaagcctcaaagttttagtatttgagttttccttaaaacaacaatcacataagtgattcttttgagaatgtatacatattagaaaagttgttcatattcccattcattttaatagcttgattttgaagtctgattgtggatgattaaatggcagtaaagttacctaaagttattgtggaaagatatcctaactacattaagtattataatggtagtaaatttaccaaaatgataaatttgccatttatttaaagaaacatagctttgtaataacaatttgttcttaactaggttaattttttaaatttataaacaataaaatgtatacttcttgata

SEQ ID NO: 55155 - DNA, 1033 bp, Homo sapiens
atttttgttttgtttttgttgatgggaaggaagacttagatataataataatgctcaaaaattgccctagattcattttagaaatgatgtatgcatataaggattaatgttagataggtttgaaactagtttaaatgtagaagttagattctcagaaataatttgagattgacaaaaggacagtgaataaacaaactttaaaaattataaagtgtggtccccagtttaataatcaggaggagcaataatagaaatccaactttgatttcagttttatgtaatcttccctcagcttcatatacttttctttttgaaacataccattttagagagttttttaaaaatttatattttcacttcaaaacattgcaacaacccagagttatttttgtttctataaaaattaattgaaactttataagtttataagcctatctgcagatagttctaagtagttcattcctcatacgccaagcattgtgctatgatcagagaacacatggttagcaaatagacatacatggtcttgatttccatgagattatactctagctaggaagacatgatctatttgaactgtggtatgagcagtgatgaaaagtagaggatactatggaacatctcacaggagattctactctggtttgatggtagtggttttgctgggggatggggatggtccaggaacgtttctttgaggaggtaagctttgagctgagatcagagtgagtaaacaaaggagaaggaatattccaggcaaatagaattacatatagacaggaccctgagctgaacagttggtgtttttcaaactgtagggtcatgacctattatgtgtatgaaaccaagttggtgagttgcacccagcatttttaaaaatgaaatgggatggaatttttaaaaactcacatacatcccatggagccttacccagaagcatgccacacacaaacataatacacttaacatgtattattatgtaaaattatttcctggtgagagtcatcgtaaacaaatactgttggaagaatga

SEQ ID NO: 55156 - DNA, 1027 bp, Homo sapiens
gggaggagagcagagggcggggccggccgcgcaggaccgccccctggctcgcgccgccgcgccgcccgcgctctggagcccactttgtactttggcccggcgggagcgcgctcggcagcctccgtgggcggaacagttcccgggacgcgctctgcgcacgcgcggactccttcagggtctccggaaacgcggcgcggaggagctgttgctactcagccctgcgaggcgtcagtgctgcccctgcctcacccctaccctcccactcttcgcgcgcacaccccggctttcacaataactggatgagcgggcctggcctgcagcgacgacctagtgggccctgcctctccactcccgcggtgatgtaccgttaccaccctcttaaaggagcccaggaaggaggcggacggccccgtcacagagcgtgtagggaaaacacagcacagtgattatcaggacgaaaccaaacaatcggaactccgcagaggtgtagggagatgtgaggagaatgacacagatcaaagagctttttccaagccagtattttccaaaccgcgggttataatctctagcgcattgtgaaattggtttggtagatcgggatcatcaccctccgtttttaataaaattgagaatagaacaaaatagaaaagtttcacagtacatcacgtagtaaaggagttgtttagagaaatttcgatttcagtgttttgcacgtatgtatcgccagcggcgatgtaaaatgtatgcagatctggtcagaaaaaagtttgagaaacactgttctttgcaaagggacattcagaagtaacaatcgtgcgttgtattaatgctggcctcactcccagaatcagaagggctttgcagattacaacattcttctcctgtctgaccctatgttgcaggaattgttatcgccagcattgagcctagcatatatacagtaacagtgaatcgctgttttcagctgaggaaactggagaaaagcaagtgtgtcagaaaataagctcataaaacctcgcataatgca

SEQ ID NO: 55157 - DNA, 1057 bp, Homo sapiens
ttggcaggattgccgtctaaagtggtgagcccttggagtcggtgaaccctttggtcggtgaacatttggtcggtggcatttcatccggaaaggctggatcggttctgtcggacttagagggaaatgttttccttcctgggctctgtaggtgaaagatgagagtgtggtttaggtgaggatcaagctcctttttaatgacacgccactgcttccaccgcgggagaatttcagtgcttagatttaactttgggaggttatcagttcagaaaaagtaaaaaagagagagctgaattacggttgcgacatacaggtatgtatgtcacatacatgcaatttttatttgctggacaagtgaaagagaaaaggctacttcccaagcgttcttgccagtcattgaatatttcgtattaaatcttgacatactactttcatgaattttatttcattcattcctctgagcaggtactgttgcctcccgtgtttgatttgcctacaatatctaattagtagtaaaatttgggctaaaacacaaatagacttctagtttatagtaccctttccattaagttctttctagccgccttctgtttttatcttactagagtctgaagtgatgatctttcttttccttcctaaatccatttaacagagttgaaaatgatttgcagcatagtctgggcaataacagcgcttactcatttttcttctattcagtttgcttttaaaaggattaatttgggaaaataaaaagcaagtttttctgttggtttgtatgaactcccagttgcaaatagaagttacctgttacctgggaacatgccagtagaaagaagatgttaggtcctttaacttgaattctgtttttgcaaagaagtgtttcagggcatagaacaggtgttttaatatggaggaggggactcgaggacagccctacaagttctggattacttttatgattatatgtatatgtgatatagtatcacatacatgccacatacatatagtacacatagagcttgaagaatttttacaagtagaacacactcgtgtaatcagc

SEQ ID NO: 55158 - DNA, 1719 bp, Homo sapiens
ttttatgatactgtaggccaggggtccccaacccccgggctgtggactggtacaggttggtggcctgttaggacccagctgcacagcctgtgcaagcgagcattaccacttgagctccgcctcctgtcagatcagcaggggcattagattctcataggagcgtgaacctgttgtaaactgcacatgtgagggatctaggttgcacacttcttatgagaatctaatgcctgatgatgtgaggcaaaacagtttcatcctgaaaccatcccccaactcaaccccaatttgtggaaaaatcgtgttccgcaaaactggtccctggtgccaaaaaggttggagactactgctctaggtatcccctactctagcacttaccattctgtattgtactagtttgttttcttggcttttgcctacatcagatcctgagtttcttgagggcatgaactgagtcatctttaattccctagttcggctctgtcatgggttagacagtgtttatagagaggataaatgacataggatagttgaagaacttttaagcgtaattgacaggcatttggagatgcctagtacaaacatgaatagaaacattctttttgcagaagtaatagttgtgtacctgagcatatataacctgacctgggtagtgggaaatcagtgggccaattttagaaggcagggaatggtaccagtctgtatagccatagtattttattatctttaaaaaacagaacagaacaaagcagtttctttcgcttcttatcaatgcttgtcaaatagagttcggatttctcatcttggatttcagagcctccctcaatctggtcttactttacctggctaatcttatatgccattgcctgccaatgggtactctctgttccaaataggacagtttctacactgttctttgaacaggccacactcatttttggctttggagctttattcatgctgttactcatacctagaatatctttctatgatatccctgttctccaactcttgtcatccttgaagggttaggtcagggtcaccctatccatgaagtgttatttaactactccagatgatctaaatgatgatcacctcttttaaaatttctgaagcatgcatttaaatacctttattgttttatctattcattgcttgactggttataatctagctaggtctaccaaagtccacctgcttatggggtgagtttcctgcttttaaaagcccccctctgtaaatggtgggaacacagtttcctctcctaaatatttctcaggaatttcagggagcttgtgtttcttttagtgacatcttacttcgcttcctttggagcactttctgctctattttagaaggtacttacatcttgtctcttgagcctgtctctttggcgtctgccttgatttctctaaagaatcaatcacaaagcagatatttatagtagggctttattgaaaatttgggaggagtggtagggattatatcccagcatagtgaacagcttaaaatgcttttatttagaagttttttggacattcccactgctggaaatttcttgacttttttttttgtcctgagtctcagccctgttgcctgctgctgggcctttctttacccattgggtgtccttatatctccagcttcttactccctgcactacgttactgctaacccctctacaactttcctgcaaacttcaaaattcagctttccttcctt

SEQ ID NO: 55159 - DNA, 1016 bp, Homo sapiens
ttttagaacagcatcttaataaacaaaaacaacactcacgtttcagattttatatttttgtttcccaaaggatttatatcactgtatttccaagtcattgtcatgttaatgtctttcaaatcaacatctctgctcatgaacttcaaatctaagcattttaaaaaattgtcttctgaacatttccgtatacttagcttacgggatgtgaaatcaacatgtttatagtgaatccaattactgtttctctgaatgcttgttttactgttattctttattgtagtcagtgaaatcactgtcctccagtcacccagggtgcaatctgcctttgagacttggagaaaaatactttgccatttgagatatcagtttggagttgatagctgctaatacttcctctgtcttaagtttgtggtcttctctccctctcatttccatatgcagttagttcccaactcttatttattcccttacttgtcatttctagtaattttcatgcttctttcttccactctcatacccactgtctttgttcaggcattcatcatctctgatcttgggataatccttgggtgcctaatacattctaatcactgaggtcaaggtttcttagacagggtcaccatgtaatttattatcctaactggtacagttttgagactgaaagagtgcaattaattattatatcaggacaacagatgtaaacaaggaccattctgggcaaacttaattcagatggccactccattccaggaagataagtgctgaattttaaagacgagtagtaatcaaataagttgattgatgaagagtcctttaaagcaaaagagatagtatatgagcaaatagtggggtgagagagagcgcagtattaggttgaagcatgtgcagttgccattttataagtgagaaatggtcaaataattcagtttcacatagtttaacctgatagatgaaggtaacttgagcacagagtgtgcctcgtggcaggagatgaacctgaaaagaaggcaggagcc

SEQ ID NO: 55160 - DNA, 1005 bp, Homo sapiens
cacaatgttttcaaggttcatcatgttgttgtatcagtattgcattcctttttattgctgaatagtgttctttgtatgcatataccacattatgtttatcagttcatcagttggtggacatttaggttgcttctactttttggctattatgaataataacaatgctgctatgaaaatttgtgcacaagtttttatgtagagatatgtttttatttctcttgggtgtgtatctaggagtggaattgctgggtcatatgttaacgcagttgctttgttttagataaacattaatttattgcggtaaatgtcagcttattgggtttaacctactatctataccattagtctaatttttagtgcaattctcacatctggtatgttaagtagaagaattatctacaaatttaatttgcctttcctttctttcacagaactgctgatagtattgactatgtaaggaccaaggagattgctctgtgacatctcttaatctttgtttctggttattcagctgtgactacatccaactatagcaaaatctggttcttatttctccattgagaccacaataattttataagaaacatctaattcctttattaatttattaattcacttagtaagtcagtctttcagtaagtaataagtttccaccctcatggagcttacattctgcatatcagctagtatgctagttatggtatccttaacaaataagaaaattagaacaatttaacatgacgtactttcagtaaactgatgctggcttctagtgattagtgtctctcaagtcttccccaaccctccatgtcagtgtctgttctctgaatatcctggtgattgacatcaagattgttgttctttagtctctgtaatatttccttcctagtctttgaaaaatgtgataagatgtgcttatgtccacttctctggcatatctccagctccgtgatctctcatgtctaagttctatctgagtaatcaaatgttagttatctgaactta

SEQ ID NO: 55161 - DNA, 1070 bp, Homo sapiens
gagaagcttgcgagaattttatgtgtgtaaactcagtacagtaccatagttcatatgattttaatcccttttttcccccattaaatccttcatcttttttacctttaatcctcattctcttttttgttttactgtttatcatatttctaatgccataactgtcttttgctaccccaaaccttcccatcccacagcttaggacatgaaatgatacaaatatgtttgcctaaatttgtctgctactttttatgtgtaactcttcccttcataactaaattgaaagccctatgagggcatggacactattataaatttttctaacaaattaaaccaaatttattctacctaggcaaaattttaggcttcaattttggttagttgtataactgtatatgtgcagttactgtcatttttctttgttaaagttatatgtcaaaatataagaaaatcaacaatacactatgatctaggtaatctaagttacattcccagcttctgtccttgactaggtatatgaaggcaagtcctttgacctgcctaggattcacttttgaattctgaatgagaaagattaaatgaatctatgaggcttttttcatttatataatattcttgcgttccctttaaactatatttaaaattacttatagaaaaaatgtcagccaactatattgaaacttacataaagctttagatttggaaaccaaaaattgttaccaaggtaatatttctttgaactttctaaaatgcatgtatttaatttactatacctggtttattttagacaggttacttggtacttattgctgttatgctggtgtctcgaacatattgtgatgtttggatgattcaaaatgggacactaattgaaaggtactttttcaatcaccttcctcctatatgtatgaaatgctaatttgtctcatatttatgcattatctttataagcaacaaatagattctaagttaggtaaaagataacccaagtcaaattatgtgtttgttcatttacttaaaaaatacttagtgtttcccatgtgccaggcaatgtgctatactgtgatggggtc

SEQ ID NO: 55162 - DNA, 1061 bp, Homo sapiens
tatcaacttcatctttctatttccacccccgccctatacgttttgtagtttccagtgttcttgccttttttttttttttttttttgagatggagtcttgctctgttgcccaggctggagtgcagcggcgcgatctcagctcactgcaacctctgcctcctgggttcacgccattctcctgcctcagcctcctgaatagctgggactacaggtggccaccaccacacctggctaattttttgtatttttagtagagacagggtttcacagtgttagcctggatggtcttgacctcctgaccttgtggtcctcccgcctcggcctcccaaagtgctgggtcttcttgctttaatcaggattggttgcattttaggcccactgagtagcaatcacgtttgaatttgcttttatcattattttgggaatttctttcatctttgtatcctgaattaaataacctgtttctggattttttgtttttctcttcctcagtttactttctcgttttggcagatgcactctttttctgagtaaggatgaagggagataaatttttgagaccttgcagatctgaaaatgtctttcttctagtctcatacttgattgataatttagctatgtttgtgcattccaagttggaattcacttttcttcagaattttgagaacatcactctgttctgggtctcaaccttggctgcagaatgattggaatcatctggagaattttaagaattatgaatgtctgggccccaccactagagattctgattcaattaatcaaacctttttgaagcatctagtggattctgttgtgcagctccagggtgggtattgaggcctcttgccattccgattgctcagctatagctggagatttgttcctccctcaatctccccctcaatctttttttaaaaaattgttgatgttgtattactggatgtttgaaaatttcactgaacattggtatgaattttttttttttgttcattgtgctgggcactaggtgaactctttttccatctagaaacttattcttcatttgagaaattttcttgtgtt

SEQ ID NO: 55163 - DNA, 1023 bp, Homo sapiens
tgcatcttattaaaatctttaagggttttacttattaaattctttaaagacttatgatactaagttcctattttcagtttagttttgtaatttataatataattttcaatgtaaaccttcatactagataaaaaagggattatgtttggtttaatttcatttataatgtgtatatatattcatatacatatgtatgtgggtgaggggttttttggcattttttttttaaccttcagtccaggttttcttcagtgtttagcatcatcaatgaccattagatagcagtagcacccttctcctagttctaacaaccagaaatgattccagtcattgcaaaatgggtatgggcagggggcaacttggggagttggggggatttagaggggggaatgcaaatcatcctggttactttaggccataaactattacagtaacttgaactactaatttactttaagttaaattggaatttatggtctgaattttttacagataaattgtttagtctaaaatataagtgattttcttaggttggttctcattttaattttcttggcgctgtaagaatgtaatattctgaatttgtgggtaaaaatgagaagcttggttgtaaaatccagttatgttgaaattgccagaaattcttgtttaataaagctggaagctggggctacatagcttttagactttttaaaataaacaattggaataagcaacatagatatcaaagattaagattcagcaaagaccacttgagaaaatttgtaatgtaacgatggaaaatgttagtaaagatggctctagaaataatctggaaaatagcattagttggtgtaaaacctgtagtgttttttttttttaacaaatgcaaatatagtgtatatagaattccgttgtctagggttgtagtgctgatagtaggaaacagaaaatataaatgtctgaactcctaaaagcaagtctttacattggctagaaaggggatatatttgactttttgcccgtttaccaaaaaaaatgggc

SEQ ID NO: 55164 - DNA, 1050 bp, Homo sapiens
aagtcatcattttctggacttgtgtcctcctctctaaaaatcagttagggcaatcaataggatctcttctggctccaaacttttttgtttctatgtatttgagctaggtggtgtaatatgatttttttgttgttgttttatctttaaagtcacttgttttaaaatcacttttcttcttgctattttagagctttcacatattataaaatggggaatctggacaacagaatagctaatccagaccagctgcttacacaagatgtagaaaaattttgtaacagtgtagtcgatctgtattcaaatcttagtaaggtaagtttctctcctttttaaaagattatttgtttaattttttgaattttgaatctaagcaaatttatatagaattgattttgtggacataacagcagcatgtaaatatttaatgcttttataagaaaattagagttgttgtaatagttttaattattttaattttttctattatttttgtgaggtactttggcaaagaactgataatttagtgtcttataaggattttctaagaattttgcaggttgattccattaaaacaacagaaatttgaattctcatcttttgacctgtgtgcatccggccattgttagagattgactgtcaatttatgtttctaactccacacttataacactagactaggacttcctttctgcccatttctctgcttcagtatctttaattctaatagatcattagtaagtagtagtcaaaaaatttcacaagatgcaagtatatttcagttttctaattactgtttttcccattctcctcagaatattgccaaagctcctgactgtgataggccttagtcagttttccttcttctcactgatttctccagttcttatcttagtcatgttatctcaccacccttacagcttttgctgtagtcttcttattaaaccctcttctttgccattacctcttgcattgactatgatatgtagtaggcacctataaaatagtctgcccagcatcccctcccctcttcatctgagatgcttcagttcc

SEQ ID NO: 55165 - DNA, 1028 bp, Homo sapiens
acattactgagttactagtggttaattatcacagtagaggtatcttagttgatggaaagtgataaatgtttttcctacttgatggtcagtagacattgtgtaagctgttcccattttaagtttcttgagaggaaaactgttatctttcatgtattctttgatctacttactatcacagtacattgtacatagtgggacctctacatgttgataattatatattaaatgtttaatgacattttatagttaacatgttgtattagctatcattctagtgctttagttttaattctgtgtattctaatatttattttacagccatttttagacatagttttgtatatctttaagttaacgagtgcaattggagctcaggtgagtctgcttttatttcaacttttaaattgatataatataatatttgaaatacatattgtgaatagcttgatggcctgtaagaatttttgtagatctcaaagaatgtattttcacatgatttacctaacaaagtctggttataaaataatacttcattcgagattttagaagtactaatttttctttttaattttccttaaattaggtacttggaaaaattttgtggcattaaaaaccagacaaatgtattggccaggcgtggtggctcatgcctgtaatcccagcactttgggaggctgagatgggaggatcgcttgaatccaggagttcgagacaagcctggacaaaaagcgagacccgcttctttaaaaaataataataaaacagaagttcttaaaccatgaatatacttgtacttattgtttcaaagtaatgtctaaaaagagatatggagacatccattttaatatgaaattctaatgttaaaataacgatacatttagagtgggtgtaacagttccaagaatattttataatgtaaatggttggctatcccatgagccttattatccaagtctctgatatttgtgatggcaagaatcacttttaagttttctttgagttatcttattgaaatgtaactttagtca

SEQ ID NO: 55166 - DNA, 1042 bp, Homo sapiens
tagtcaaacaattatgatgcagcatgataaagtttagtaatagaagtttcaagaaagtatttagtgccaagaagaactggaggtgatatctgagctactttggggaggtaagtaaacatccattagattatgtcaggcttgccaaacataagaacaacctcactgaatggaaactgttcaggaaacatttatatattttagtatggcagagtatagggtatataggggaatgagggaagtgcctatgatgaacttggaaaggtatgcttcaagcatacctttctttttctcttgggatggtcaatgggtgatgaggtcacgtacaaagttattaatacatagtacagcagctggaagcaagatgtacacgcagggaaagacagagctcgttcagggggagctgaacttgaggcatctgcacagtattaaggtaaagatgtgtagtacttatttcttgggttcataagagtgataggactagaggtatagatttgagatgagaagagaactaaggaaggagtttgagggaatattaacattaaaaaagaaggcaagaaaaagaggtctaagaattattgtggaatcttaagagattatcaagaagagttccaacaggagagtgttagataacatagaaaaactgtgaactgcaattaggagtttttaggtgagcaaaatgtaggagagctgagggataagctacagtggtaagaggaaaagcccatgagtagtaaaagtgtagaggctactgtgtactttttcagaaaaaaaacaaagggaaaaaattacccagtagggcaatttctttcagtcattgaggttaattataaaaattgtacatgtttgtatctaagtgaatttattattatatcccagaactttgtgtatctttctctcccaataataatagggcccagcgagcatgatggcctacttggttgtttctgggctattcctaactcgacttcgaagacccattggtaagatgacaataactgagcaaaagtatgaaggagaatatagatatgttaattctcggctc

SEQ ID NO: 55167 - DNA, 1443 bp, Homo sapiens
tgttctgtcagcctaggtgacatcatagctcactgcatccttaaactgctggactcaagcaatcctcccacctcagcctcccaagtagctggggctacaggtgtgcaccaccacacctgcttaattttttatttttattttttgtagagatgagggtcttgttttatttcccaggttagtctcaaactcccagtttcaagcgatcctcctgccttagcctcccaaaatgctgagattatgggtgtgagccacagtacccagcaataataattttttaagtgaaaaaaaagtaatggtaaaaattggaagtaaacaaagtaaaaggtcccttcacaatacctcttcactgctctacctaatgctacatttacagacaaatagaaggcttataattagccaggagctattaatatttgagtctaaggaaatgttgattaagtatatgttaatttgatttaattacttcacagactgatttttttttttttttcaggttcgatctggggctaatgttctaatttgtggtccaaatggctgcggaaagagttcacttttccgtgttcttggtgaagtaagtacaagttggcctcaaaattttgcagtcttattttgccatactgtctaccactttgtaaattttacaattgttcttctcccttctctctctttaatagttatggcctctttttggaggacgtctaactaaacctgaaagaggaaaattattttatgttcctcaggtaagacctagcttgagttatctttgatctaaagatctttttgtttatttattttttcatgttgcttctaattgacttttgctctactactgtcagagaccttacatgacccttggaacacttcgagatcaagtgatatatccagatggacgagaagatcagaaaaggaagggaatttctgacctagtaagggaatgtttatatcctagatccactgaaaatactccagattatttattttaatcaattaagtattttaaatgccaggtagtttatcttaagctgtaaagccttccaaagctgtaaattgtgattttctaagctgaggtaagatgttaatcccttggcttaaaaagagtttaatcttaacctttacaccattgtttgttttctcattgccatcatccttttactgtgtacaatagtgttattctctttaagctactagacatattttgtcaagtttggtgtagatactaggagctgaaaggttcagggctaccttgtgccacattcttttctgaaatgtatcttttaagtggtacagacaatagaattatagtgattccagtttaaaaaataaaccactattaagaatgttggcttatattaagtttaatttcatctttaatcattttgctgaaaggtactgaaggaatacttagacaatgtccagttgggtcatatccttgaacgtgaagga

SEQ ID NO: 55168 - DNA, 1081 bp, Homo sapiens
tggctaccgaagtaaactgatgtactgaattccataatacataacattcaatttttaccacttctgtttagcgaacttgtatacttattttctgttcagattaaaaaaaaaaaaaaaaaactcagatatcctatacaacctttgcttgttctttttattctggtatctaaatactgagaagttcatttataattcagccttgacttgaaaacatagatagtttaatcttgacttgaaaaacacaaaaataaattcagaaaatgcttttagcacagtgtctcttttttaaagttttgccaagtgtggtttttaattgaatgaatttctcttttagaaaagttcagtaaaatctgtgtacctgacaaatgctaccaaacagccaggagaccttaaaagatactattcgtcttggaaaagattttaaggcatgggaaagtttcagattttcagatttctgggttaccttaaacctactcgtagaagtattctcctagctgccttataattgcttttgttatgattcttgccatcaaaacaacaacaacaacaatttgggctttttttcttaattattttcttttttatgtaacaaatattacagtgcctcaccatttgaggcacagaggaagatccttctggagaatcacattaacataatagtggttcttcgaagacccacagtaaagaaatccattggttcaaaaacatgattgaccacggaacatctttttctacataattcctattaacaccttccagaaactgcagtgggaaatggtagtttaatccgaagaataaaccaaagaataagaactttcatccatgagcaccacgctgcatgccaagacatatcaccgtgttctcataataagtttttactttttatataatgagaaaataagtatgaaacagcaatggtagtttgttttgcattaatagaataaaatatatctagcatttgtctctttctcccctttctgaatgattaacatttggcttaaaaccggtgatatgatagcatctggcattactttatgtaaagttttaacttttaaatttggtgtttaaaatcataatttgt

SEQ ID NO: 55169 - DNA, 2079 bp, Homo sapiens
catctcaaaaaaaaaaaaaaaagaaacaacgaaaaaagaaatgatggcttagctccatgtgaagatgatatttgaacattttaaaacactttaaataaactgttctctcctgtttattgccactgacaggagaggtttctctttacctctggtcctgcacccctctgagccatcctacccacagccttcagtcattgtcctaaagcctagctctaattccactgcctctccttttgtgcacacacacttctctgcttccctggccgttctctatcttggagaggcatttcaaacgccacttccaccagaaggccttgctactgcaccaactagttactatctcttcttcacccaaatcctggtagcactttggatctcccactttgcacttagggttcaccttccgttataatcattgccatcaatctcagcatcgtttttaggcacttctttccagccattgttcttacctccaactacatatcttttctggactgtgcattattcagtttattaaatgcccattaaatgtgtttagccattgtcaattactctgaaacgttcaggttttgacaaattctttcctaatgtaagtgtggtggaaagagtgaaagaaagtcaaattgcacaaaaataggatggtgtaatttggggttatgccgtcaattttgtccactgataaatgggatttgagctctccaagttgactagatgccctttatttttcagaaatattctacatcattggagctgtggtatttgtggtcatcatccttgtcatcatcctggctatatctctacacaagtgtagaaaggcaggagtggggcagagctggaaggagaactccccactgaatgtttcataaaggaagcactgttggagctactgcaaatgctatattgcactgtgaccgagaacttttaagaggatagaatacatggaaacgcaaatgagtatttcggagcatgaagaccctggagttcaaaaaactcttgatatgacctgttattaccattagcattctggttttgacatcagcattagtcactttgaaatgtaacgaatggtactacaaccaattccaagttttaatttttaacaccatggcaccttttgcacataacatgctttagattatatattccgcactcaaggagtaaccaggtcgtccaagcaaaaacaaatgggaaaatgtcttaaaaaatcctgggtggacttttgaaaagcttttttttttttttttttttttttgagacggagtcttgctctgttgcccaggctggagtgcagtagcacgatctcggctcactgcaccctccgtctctcgggttcaagcaattgtctgcctcagcctcccgagtagctgggattacaggtgcgcactaccacgccaagctaatttttgtattttttagtagagatggggtttcaccatcttggccaggctggtcttgaattcctgacctcaggtgatccacccaccttggcctcccaaagtgctagtattatgggcgtgaaccaccatgcccagccgaaaagcttttgaggggctgacttcaatccatgtaggaaagtaaaatggaaggaaattgggtgcatttctaggacttttctaacatatgtctataatatagtgtttaggttcttttttttttcaggaatacatttggaaattcaaaacaattggcaaactttgtattaatgtgttaagtgcaggagacattggtattctgggcaccttcctaatatgctttacaatctgcactttaactgacttaagtggcattaaacatttgagagctaactatatttttataagactactatacaaactacagagtttatgatttaaggtacttaaagcttctatggttgacattgtatatataattttttaaaaaggttttctatatggggattttctatttatgtaggtaatattgttctatttgtatatattgagataatttatttaatatactttaaataaaggtgactgggaattgttactgttgtacttattctatcttccatttattatttatgtacaatttggtgtttgtattagctctactaca

SEQ ID NO: 55170 - DNA, 1039 bp, Homo sapiens
agagtcaaatagctgtctggttcaaagtccagctgtgtgattttgagctagtcacccaatctcactttgtctcagtagccttatttgtaaaaacaaggcaaattacagagccatcccctgggttgctatgaggactcaaacatgcatcccaagtgctcggtgttgctaggtatgatggctcacacctgtacattcagcactttgggaggccgaagcagaaggatcagcctgggcaacatagcaggaccccatctctacaaaacaatgtttaaaaaaaagcaaagtgctcagcacagtgactgcatcattaggattgattgtagggctcctgatgttagcacagaacaccacagccaggaagcagtctatcttgttgggtgcaaattgtaacattccatttatgtttcttccttcttttctttctttagcactaagtcaggagattggaaaagcaaatgcttttacacaacagacacagagtgtgacctcaccgacgagattgtgaaggatgtgaagcagacgtacttggcacgggtcttctcctaccctgcagggaatgtggagagcaccggttctgctggggagcctctgtatgagaactccccagagttcacaccttacctggagagtaagtggcttgggctgtaataccgttcattcttgttagaaacgtctgaacattctcgtgatcttgtgcctttaggggctacaaaattaaaaatatttattctttttttctcagaaactggtatgtatcacagccctcttcacacattccagatgtggtaggaggttcacagaatgtgaactttggagctgatgacagtgtcatcaagtaactttctcccccagtctgtccccagaccctgttactgtcctcagtaaccggctgaatgtgtgttgggagagggcgggccagggaagcgggtagggataggaaatccaccaaggccggggttttagcttttccctatatatatatcatgtatcctgatttttctgtcccgttatcacactaaaaatcccagttgaggatttt

SEQ ID NO: 55171 - DNA, 1025 bp, Homo sapiens
atgtggtgcctcgttttccctgagattatgtattaattcaacctgtaaatgcaaaccatctaatagtcagcgagaccctatagccctgctgcttaatgggggcacacaagggcatgcagccctcgtaccaggcagactgtgttcatattaacagcatcgtggagaaactcatgctgggggacaggggagggagatgtaaatgctcagcagggagatctggagattcctggagcaggtggagttgggacctggccttgaacgatgggtctggctctggcagtcagtaatgccaaagggaagagcagcataactgtcactttccatgggacagaagtgtgtgaatcaagttgcagtgacgcttcacctatttattattttggtcatttagaagaatttcattgtcagtagaagtcctttaaatcatttccccttcagtgacgtctcacaaaagaaagatctgtctttagctttttagtctcagactttattagacagatactacctgtactcttattctgtaatctttgttgggatggattcacatcttgcaaaggaagggaggcatgtagtataatggggcaaacagacccagctctgccactcgttagatatgtgaccttctgcaagttgcttagtgcctgtgagcttcagtgtcctcatggataagaaagatccaacaccttcttggaaggattatatcaaatgaagtaacatgagtaaagggtccagcagaatacctggcatatagtggagtcaatgaatgattaataatattattaatagtggtcatgagagaatatatgtataacatgttattatgtagactcactatatagactctattctacatagaatatagaacattatataacaaacaactataataagtagactatagtaaacaacctcactttgtctcagttgcctcatcttgatggaaaactgctctttctctcctgttaccctgacagagagcgtctacattctaaaagaaagatatttaacaaaatggttgagtacagatc

SEQ ID NO: 55172 - DNA, 1039 bp, Homo sapiens
gcaacccacctaagctgcacgtcggagtcgcgggcctgggtgaatccgggggccttgggggacccgggcaactagacccgcctgcgtcctccagggcagctccgcgctcggtggcgcggttgaatcactggggtgagtcatcccttgcagggtcccggagtttcctaccgggaggaggcggggcaggggtgtggactcgccgggggccgcccaccgcgacggcaagtgacccgggccgggggcggggagtcgggaggagcggcgggggcgggcgccgggggcgggcagaggcgcgggagagcgcgccgccggccctttatagcgcgcggggcaccggctccccaagactgcgagctccccgcaccccctcgcactccctctggccggcccagggcgccttcagcccaacctccccagccccacgggcgccacggaacccgctcgatctcgccgccaactggtagacatggagacccctgcctggccccgggtcccgcgccccgagaccgccgtcgctcggacgctcctgctcggctgggtcttcgcccaggtggccggcgcttcaggtgagtggcaccagcccctggaagcccggggcgcgccacacgcaggagggaggcgacagtcctggctggcagcgggctcgccctggttccccggggcgcccatgttgtcccccgcgcctacgggactcggctgcgctcacccagcccggcttgaatgaaccgagtccgtcgggcgccggcgggagttgcagggagggagttggcgccccagaccccgctgccccttccgctggagagttttgctcggggtgtccgagtaattggactgttgttgcataagcggacttttagctcccgctttaactctggggaaagggcttcccagtgagttgcgaccttcaatatgataggacttgtgcctgcgtctgcacgtgttggcgtgcagaggtttggatattatctttcattatatgtgcatcttcccttaataaagagcgtccctggtcttttcctggccatctttgttctaggtt

SEQ ID NO: 55173 - DNA, 1037 bp, Homo sapiens
actgcgtaagatgagaagccattagagggtttggagcagaggagtggcataacttcaaagggtccctctagctagcgagctgacagcacacataggagacagaggtagaagcagggagaccacttaggagacccctgcaggatctcagaggagatggtgtgctgagccagcatggtagtaggtgggaagaggtcacattctgggtaataggatttgttgatagatacagtgtggggcacgaaggacaggagggggccaaggatgaccctgagaaattggaaggatagagtgtctttaactacatgctctcccatgaagggaatctggggcagtagatttgaacacgctaggagtgcggggcctgttagaccccaagtggagatgagtgagcttgggtttcaggtagacatctggctgaatagaaatgcattgctggtattcggagccacagcctagagcagatggcagaataaagggtaggtgggggtagcatgagggtggagaagaggcgctcccggggctgagcccaggaacaatgcaaggctaagagttcttctaagtttcctaccctctttcttaaaaaacctaatttcctaggctggtattttacaaatcttattccatttcattcagttctataacccccttaaattcttttcagaacaagacaaatgtatttgaaagcagtgcagtaatagtaatatcagttcatccctttgagaaatatttgttaagtgccagttatgtgtcaagcattaggagctggggataaccagacaaactgcctctcttgtgaaacagagtatatttgaggggaatgacagatacttgacatgtagataaacacatagttaggataacatcagatcctaacaggtgcaatatcagatcataacagaaactggaacagataaagaggtagagagtaactcaggacagggagtggtggcttcactgaggatatgctacttgaactgaaacataggtgatgagaaggagtcaggcaatgttccggcagaagagcattccaggatagg

SEQ ID NO: 55174 - DNA, 1026 bp, Homo sapiens
caagatcaatatacaaaaatcaattgtatttctgtatactatcaatgaccgtgtggaaaccaaaatttaaaacacagtattcatttacattatcacctcctcaaaataaaaaatatgtaagtataaccaacaaaacatgtacaggactgctgaaaacttcaaaatgatgatgaaagaaattaaagaagaagtaaataaatggaaaaacatattgtgtttatggattggcagattcaacatagtgaagatgccaattctccattagtttaacacaattctcctgaaattgacttattactttaacacaattcttatcaaaactccagcaaggtttttttgaagacttagacaagattattataaaagttacgtggaaaggcaatggattagaataattgaaacaatttcctgaaagaattaaatgggaggaatcactctatctgattaagatttacttcatagcaacagacaatagagacgatgtatattagtgaaggaacagatagatcaatgaaattgaatagaaaagccagaattaaatccacaaaagtacagtcaactgatcgtcaatggaggaagaatagccttttaaacagacagtgctggaaaagttggacatccttaggcaaaaagaaagaaaaaaatgaacttcaatctatatctcctatcttatacaaaggtaattcaaaattccttatagatttaaatgtaaaatgtaaaactataaaacttttagaaaacataagagaaaacctttaggagctagggcaaggtgaagagttcttagacatgacactaaaagcacaatcaacaaaagaagaaatccattaagttgtacttcatttaaattttaaaattttgctctgtgaaagactataaaagagatgaaaagacatgctatagactactagaaaatatttgcaaaacacacatatgacaaaggactcatatctaaaatacatgaactctcaacactcaacagtaccaggggctagggagtagggaattggggatgtgactacaaag

SEQ ID NO: 55175 - DNA, 1052 bp, Homo sapiens
aacaatcttgcatgcaatctagcatgcaaaaaagtcataggtcaacaaggctcgctcttctaataggaagaaggaagcaatctttatatgtgtgtctcttatagaggcccatctaaaaacaccttcatgagccaccctatgtgcagtgatttttccttcttcagaatttgcacaaacacctcaaagaattgttactgtgtggtgcactcagttgaattctatccaggcattcactaagccatactgtgtgttgggcactgtaccagcaatgggggttcagagattagcaaagtctgcttcctgtcccaaagaagcttccggcacaatcgggggagacagacaagcagatcattcctatgggtgtgcctagggtgctaggatggcacagaagagaggaatcccggtatagtctgggaacattggggtgggctcccaagttatcagacagatggggagatggacaggcaggcagatgaccactactgagttttgtgccaaacaccatgctgaatattatacacatcctctcactgaggcttctacaactccataaggccagttttattctttccaactcacctgaatctgggaggacaagtaggatcgggcaggtaagaggaaggggaaaggtgatcccaggttcagagaacatcatgaacagaagcagggaagtgtgcacaccgggactgtctggggacctgcaagcacaagtcatttgtattactggggcaaaaacttgactgagatcaaaatggaaaaggaaccagaagtaaccaaaagaatcaaccccagaaggttttgtttgccatgccaaaaatgacaacggtcttcagaccagtctctatggaagcctggcattcatggggctaggccatgagttactgcacatgtttggtgctaatttcattaaaatgtgtttcagataatattgtagcagatgctgtttgtaccctgcccatacttcctgctccttgacattgcattacacactagcccacttcaaactgccagcccttgcattgctttgactgagttttctttgacagacagag

SEQ ID NO: 55176 - DNA, 1041 bp, Homo sapiens
tgtcactataaaattttgcagagtttttttttttaatggttctcttattcttactgcatatttgaaaagtttagggtaaggagtttgtgaggaaaacctaggatttcttatttgcaagaaattattttattaattacatgacttactctgtttctggcataagcctctgttctcacttacggtgttttttcatttaactagttacattgtctaatggttaatatttgtggtgtaaaggatgatagctctaaatgagggtttgtcaacctttgcactgttgacattttgggccagataattctttgttgatggggaggggcctgtcctgttgagcagcatcccttgcaccccacccactagatgccagtagcccttccccctagttgtaacaaccaacagtatctccagacattatcaaatgtcccctggaagggggtgcaaaatcaccccttcttcactgttgagcaccattgctctgaagttatgacttatgcttttttctcttgcatcttctgttattaactttctcaatattttaaatgtatgtctcttaagtgctgcaaaatcagaccactctgaagtccactcaaagcatttttcactcacttgggtctgaagacaggcatgtccttcaatgcatctgattactcagagaagatttccctagcttgccagagaaattccctctttctccctcattcttcctctatacacaaggttggcacagatcaatcctaaaattccattcaccatgacttccaaaagcaagtaggcttcttgcttttaaagcctgtgatgtcctaccttctcagagttccctaggtgaacacataatcaaggccccactgtcagcctccctgcactagagggacccttgatttactgcatatgtacatttgggtgtggtcactttatgttatcataaagacaagtctctcctaagtgaacagacacccatcttttcttgcacaagtgtactttttttcttagcctccctccctttctctgtgtttggtgtctttatggacttgtgccaattta

SEQ ID NO: 55177 - DNA, 1052 bp, Homo sapiens
tgggcctgtcctcttcactagaaagcaagctctctgtggacaaagctgggccctataccgcccagtaagctccaggtccctaatgtaatgtatggcaggcagtgtgtgatctgtgaatactggttgaatcaagtttgaaaaaacatacgtatctgcaggcaagctgtgggtctacacggtttactctggtcatgtgactactatttcagaagatccatgaggtcaaatgactcagcaaaattttgcaggccaaataacaggaaatccgaacttcaaaagcacactccattaccactgatctaaaacacatgtgcctggagatccagtgctggagctggggagattttctacagcacacaccaaccgactgcccgcagcctgatactgggcctccaggagggactgataaaccacaggctcctccggtgtctggtcccccagcaagggcacttgcaaagcctgcagatccctaagcatgcatacagagctttgcctcccttttccaagaattctgtccgcctagactttccagatcatcaagacctgcccctacagacactcaaatttttaaaagtaaaatctattttgataaaacatattccaaaaggaatacaatcccacaattccccacctccttaagacctcttcttgatagatccaggctgacatcagatatattaattgctgtctttcgcacaggattgcccatcctactactggagaggtaaaaatcattgtgccctcaaataaaaattaccacaataataatagccaacatttatgagcactttctatgtacccagcacactaagagttactctgcatatattgtttcatttttgcttcgcaatatccctaaaaggtaggtgttatttttcccatcagtttccagatgagaaaaccaaaaagcagtgaggttaagttacttgcccaaggttgcaaattaaataatggagacaggccctaaccgaggccgttgggcccccaagcccacacaggtaagccctccactctgctgcctccctaggtacaatgagcctgaggtacaatga

SEQ ID NO: 55178 - DNA, 1052 bp, Homo sapiens
ttaaagggatgttttctaattttcaagtacttattgtcccttataaagtgatcttgtaaggtttttttcccccttcttggtctatgtttaatggttttttgtgattgaagcaatggggaacaactcttccttacagcgaagaaaacaaactccaagagtagtaaatcttcatgagacttattccttctccttttccttcttaataggtttatttatctggattaaaactcacattaagctttttttggagggtatttgcaaaaggcctacactaataacaagtgactttccaatggcattattagattatgagcttccttggaacagggagtatctttagttctgctgaagagtgcaggatgaaagttagacaaaaaataataataataataacacatttaacagttatgcagatattgctcaaaaactggcttttactagcagggtggcacatttctctattgacctgatatcagaaaaagcaaagcagtcttttaaagattcagacaaaatgtttctggaatacatctgttgaagaacatgggagaggataattatattagttgtattaggaaataataaattcgacctgcaaatatatagagtatttaaaaattctttcttgataacttttattcccatggagagtaattttcccaaatccactgaaatgagttcacataactcaatgtttgtaaatagcatccctctgatctcctacagagcaagtggaactgtattccaaccccagggccagaaacttgagaccatgtgccagtccatggcaccagagtccggtctgtccccatctctatggccactggtgcaaacatcaagaggagaagtggaggtggatgggcctcctcttctttttttaccctcccatggggatgggatgtaaaagtgggaccagaagaagacagaaataaacaagtgttctcctgttccctttaggagtctgaacatggaaaatagaggcccagaacctgccagaagacagcagtttctggcagacatccaggaaagccctcttgttgtgtcttcaaaggcaa

SEQ ID NO: 55179 - DNA, 1045 bp, Homo sapiens
agaagaaaaaaaggaaacatgaaaatatgtgagataaaataacagagcaatactcactgcatcataaatccggaggtggctaggctggaccaaaggggacatcaggtagaaagttaaagtgtctgtttttcccaattaagtttgtttaaatgatttaaatccttgaactacacactttcctaagctgataggaaggaactagtactgagtacattcgctcactggggcataaatctgagctgctggtgaaggttggaaactctggcatgtgaacctatcagaagccttcgtaaggaaatagccactgatgagttcgttgtgacagagggctgcaaaaccctgagacagcctgagttaggaaagaggcttcacctcccaggagaaagcaaaatgatctcatggaaacccaggacttactgataatcacctgtaaatgaagctctgcctacgcgtcactttgcaaggagaatcaatgtcaacataagcagacccgccttgagggaaaacaaggcaggctgctgtactgaggaacaggctgaactggggtgtgcctctcccatgcctgctgcccagcagtccaccctaaagataaaccagccccaactggctaagaccttattcctccacagcaaatgtgcacccaactaaacctctatggtggtttcagacaccagtatctgtaggaggccggcaagctgctcatttcagcccctttcaattcaagattctgggtgcccccaaagttcagcctatttacctctcccagatcatgggtacccacccctgttcccacctctgttggcagggcctcagcaggaggtctttccatttccaaaaaatggaaagaccctgaagtgaatcataagtcacagtgctctcttgggatccctgttacaggaagtagcgggaaacaagatgccttctcatccccatactggtgtcagctgtcaggaatgtggtttctcagaaacatactgggtgacagcctttgcagatactttaaggtgagaaagctcccaaaagggcagagaaagcccattcccac

SEQ ID NO: 55180 - DNA, 1022 bp, Homo sapiens
tgatttattttcaacccaaaagagtaatgcttaaggtacatgaaggaaaaccaaggcacatatatcaaagctctagagaatcaggtttcagttccactaaactatttccaccagcctcttcaatgattaggattttaaagctcaaaatagtttccacagcagtattacaatgatataaaaattacatgcatagaaaccctaaaaggaaatcacaaaaacataaatagtagatatttattaaatggtataattataggtattctttttactattgccattttttaagttttttatttaatggatgattattactttgtaataaaatgaattttttaaaagactgtttaaatgtatgatagatgatctcattttccttttagaattattcatattgcaaagtctacagtatattacacttagtggattttcactatgtctttcttttatctccccactatgtatttcttgaatgaaggaacagatgaatgagttttgaattctaataagaccaacatatggaaatttttgtcttaaagtgttgcgctcatattttccaaacagcgatcaaacttgagacctttgggcttcctcgaaaaagacctatcaaaagcttgttttagttgtcttaatcagttcttagttatttttgcttgtgaatacgagttttgaatataataaatggattgaattaaagaaaatatgtttaaacacattctgaaatgtattacttctctaatttctactatttaaaaattatgtctcctattgagaacaacattctgcaggcttctcaagaaatctcacttgttatcaacaaatatttggatcccatcagaacatttgtttttcatttgtaattgtatttactctggagtccttctgtgaactgtttggttatgactaataagttaggaacaattagctaaaattcattcaatcataggaatttacatttggaggggtcattaatggtcatttaagtccagcatttctcccaagcaagaatcccttctacagtcttg

SEQ ID NO: 55181 - DNA, 1044 bp, Homo sapiens
atgctaagaatctcactgactcccatggaagctgagtttgtttgtttttttaaatgcttatcttcatgcccatcaaagatgaaagttttattttgtttgcatgtacacttctaatccccagcacagaactcagcacatcaaaaatcttcagtaaatgttaattgcctgaataagtggaggtttgaatccattcattcatttagtgtattattgaatgtctactatgtggtgggtatttatctgaagcactgggggtacagcagtggacaagaaagacatggttcctggcccatgaggtgttttcactctagctggaaagactaatctacccatatttccctttcctacttaaatcttagacatatcatcagtaggcagatggaagcagccactattaggacaggttgaggaataagtagcaatttcttacacattcttagagattacttgagaacctccagggaagactacacttcctgtcaggctgggctggtggatgttcaagtcagtattgtttgaatattaaagaaatgtaaccttattttatccctatagctgatgcagcaggacattcaatacaaagagagagaagatgaagctgtattaacacatacatatatgttctacttattgatacatttatatatatgtatacacacacacatttattcttattcaaacacatacacactcacataaaaatggaaagatattcacctaattttttaaatgattatctccaagtagtgggattatagatttattcttttagtttttctatatttgacacattttcttcagcaaacaaatattacttaaataagcaaaacaattgtattaaacacacacacacacacacacacacacacccacacacagcaagtccggctaactggtcacgctgctgatgcctccatgctttgttcctgcaaatgccttctccctcctctctccctttcaacatcttcctcgccctgtaaataatctcagctcaagcatcatctccactagaaagctctcctgatgcccaccttccccagggac

SEQ ID NO: 55182 - DNA, 1179 bp, Homo sapiens
catgcagcaatctgcagtttctgttcctcgttcacagtttttattttcataaggccatgataggtacttcctccacccaatgtggtatatttaaattgtgaatcattatacaggaagtaaaaggaattcccaaagctctatacatatatcctttgggtttttttttaattaaatgaggtttcatgaatcaaaaataacacgtacaaattatgtaataaaaacaattcataaggcaggctttcaaagaaggacttagagtgattatctattgtaagtatcattgtgccaaacagttattactcacagggctgagggtggcttgcattctctctaaaaatagatctttccatgaaaacacataatatgttcttgttgctgttcgaggtaaaaactacaaaagaggatatttttatcctctaggcagttaactttcattccaaatagaaccaaccaaatcatttacaaaaggaaaaaaaaaggaacccagacatctggaaatttgctgtgtttcttttcctgcagtttacatttctgaaattcctttccttattacataaaaccatactctctaaccagtaatatccaataatgaatgtccccagtttgtaggcagtgacagtaaattcaagcatcaaaaacaaaagaaaaataaacaaaaagagagagacagagatcattcaaagaataaacagtccactctaacacatctttttctgtcatttctctcccaggctccacattgaaaggcagtgcagtgttgcaaaagagcctgatctgtaattagaaagggctgactgcaaatatctgtgtgagaacactggctccatcccttactaccgatgtgaccttgagcaagattcttaactagcggttccatttgctcatctgtaaagtgtggatgatggtatctctctcgtggcgtagtaggactaaattagatacatgaataaagtgcttagcaccctgcctagcacacggcagttagcaagtaggatccttgctcttagacttgagcaggattttgaggaaggaatggctgaaaactgagggaaaaaagaaaagaaagaagtgaatgacataaacaactgaaggaggcagttctgcctggtggcctgcccagatattggaaccctttgtccgtattgatgcatttgatactacatatttgcatcttggtgg

SEQ ID NO: 55183 - DNA, 1041 bp, Homo sapiens
ctgatgcctctcaggcaatgtactatggggtgcccacggctgggataatccatcccttccctttgagaaaggcaacaaccttcccatttccaggcaagactcacaacctcatactcactaggagtgtaactgagatttcccaacattgcatttctattcctgcgggaaacactcagtgcctttgtgatcagttttcagatggcaaataggatatttttctctttcttaaattggcatggttttaggcccagcacagtcagataataaagacttggcttttagccaattttatttgacaagaaacttgagaatttccaaaagcgtaatatgggcattgattcacagtgtctttaaaaactgtataccaaaacacacgtgcacatctagcgtgcaaatgccttgtaagcgtcatgtttttctacccgtcttggtctgctgccctgcttcctgtcatcgtgaacaggatgtgacccaacaggatgtagtgctcccttgttttctgttttccagctctaaataacgatgtctgggttggatgacttgatcattgacctctagtgaccatggacaaccagaggaaaatccacactcccataatctgagactcaaagcctggaaggtggctggactttctattctttctctaggttgctggtagtcttctctttctaagtaggtaaacttgggtgaacagcaggtaaaagccgaacagctgatccatcatctgactggatccgtaactgttcttctgcatctctgcagagctgtgctgctctagtggggagcactttggacaccgcaggagaatatgacagggaccatgggctgactcacagcccacccaccaccccaccactctccagcccccttgccgggcactccacttgaccatctgagatctcgggcacttgcctacctggatgtgtggagagggtctgatcctgaccatcacagctggctccttctaaagggctgtcgtttatttagtgcctatcaagggcctggccctgtgctgggacttcacagacccaacagtatatt

SEQ ID NO: 55184 - DNA, 1037 bp, Homo sapiens
aacacatttacaattaccagaattttaaaaataagatattataggccaggcgtggtggatcatgcctgtaatcccagcactttgggaggccgaggcaggcggatcacgaggtcacgagatcaagaccatcctggccaacatggagaaaccccatctctactaaaaataaaaacattagctgggtatggtggcatgcgcctgtggtcccagctacttgggaggctgaggcaggagaattgcttgaacctgggagatggaggttgcagtgagctgagatcgcaccactgcactccagcctgggtgacaagagcaagactctgtctcaaaaaaaagaatattatagaaaaatgaaatgggtattctcctcagcaaatagttctctcctccttcaattacttacaacatggagtatttattttagaaaagaatatcacaaaatggctattttctgcctccgatgtgatttaaaccttctcaagtctctttgtgtttgtgagcacctgctagttcagcatttttcaagcttcacttgcaaccagttataagactatgaaatacattatttttaaaaaggcaacagagtagtaactaagagtgtgaatcatatgtaataagggtaaatgttgttttgtgagatttctagttttgttttatatatgtaaggacatatgaaggtatgtgcatacaggagttgggatgtaataaatttcttactgtaagtcccaaacaagagttcaataaacaccaccctagaggattggaataatgctttgttttaattaaataatcattatttctcagggatttttcagagaggtctcctacattgtaaacatactcacatttttcaaaagaatgacaattcaaaatcaatacaagttttcctttagtacatctcagcatcataatggtggcaataaacactcattgtatttttccccttagccttctcaaaggtgtaaacatgagccattcgccatggcaatgcaaccaccgttccatcattacaactttattctacaaatatttgtaaggtg

SEQ ID NO: 55185 - DNA, 1036 bp, Homo sapiens
tgaaggattaaaatataaagtggaagcactctttcagaaggtagaataaaaagacaaagagacacaaaataagagagaaaggattaaaagaggataaatttgggagacccactatctgattaatatgagcccagaaatacagaacaaagaaaagaagaaagagaggaaattaacaaagaaaatttgccagggctggaggacacaagtaaaaagaagattccagaagcttcccgagggaaaaaagatcacaggcaaaggatcaaggacccagaataggatctgactttcaccagcaactctgaaccagaaaaacagtgaaggaaggctgtagaagtctagtgaaagattatttccaacctagaattgtatagccagtctatacctagtatagagttgtatacctattcttactaccagtcaagggtaaagaagaacaaagtcatgcacaggcagtcccaagatttccctgccctcatcctttctagcagggatgttccccactgaaactcatgtgtaagccagagaggaaaacatgagtttcagaaaacaggcttgagcagagcagagcaaggaattcccaggagggtagctgcgcagcaggcgtggaaagcgtccagtccaaggtagacaatgggctccaggagagatgtcaccatgaaaagaaaatggaactgagggaataccaggtgtgttcgaacacgttaagaaaagcattacacgttggtgaagcgttcggtgaggcccatggaaatccaagctaataaaaaaatgtgaaacaattaacttcagaaaaaaaaagttgtacaggaagggaatctaattggaatatgctacttagatcagttgtgaatattatttacagcacatattatttatgtatgaataacaaacactaagcattaactaaaagctttgatgtaattacattggaagaatgggaacatgagtgtgaggagattgggggagttaggctatgtaagaaaataaaaccagaatctttcatagtagaaaagtcagtagacaatatctgaagcca

SEQ ID NO: 55186 - DNA, 1037 bp, Homo sapiens
gatcatgccactgcactgaagcctgggcaacagagcaagactccgtctcaaaaaaaaaaaagaaccaatattctgccgggcacgttggctcatgcctgcctgtaatcccagcactttgggaggctgaggcgggtggatcacaggtcaagagatcgagaccatcctggccaacatggtgaaaccccgtctctactaaaaatacaaaaaaaaaaaaaattagctgggcatggtggcacgtgcctgtagtcccagctgctcaggaggctgaggcagaagaatcgcttgaacccaggaggtggaggttgcagtgagctgagatcgcaccactgcattctagcctgggtgagagagcgagactccatctaaaaaaaaaacaaaaaaacaaaaaccaaccttctaaagtctgtaagtcccatagacatccactgagttggcccagtatgccaggcaccatggtaaacatttggcatacacagtctaagtttatcttctctaggactctgcgtattaggtaggtattatccccattgtacaaatgaggaaactgagccccagaggatgaagagcatgtccagggtgacagcactactatgtggtcatcctcgtggctccaaaagctgtggcccactggctttgctgtgctgcctggagttccttgccaaggataagtgtaaagaggaggaaaccagggagtggcgctcactaatagggacgagcccatctatgtcatcttccttctgaggaagcttgaagtcagtaacagcccaggcattccccgtcctccgtgtttcccatgtcacaggtccactgtttaattttgccttccagaaagccaggccttgcttctgatttgctcctttccaccactgattatgcacaggtcaaatgggattaaaggatgtaacagcactccaactgggaaagagcttgggggatgaaggtgacacttcgacacggtcctctaacttggacctgcctcttcgttaggaatcattgttctggtgggctttccctgctgagtgcagagctttgctggc

SEQ ID NO: 55187 - DNA, 1069 bp, Homo sapiens
cttctttttctgcagatcactgcctcgtatttaatttagcaccatctctcataagtagtaaaaacagatttcgctctttggctaaaatgattaaaatttaaaaaggtattatactttctcatgcatgtgttgactccaaagagttttggggcccataagcatttatcttttcttatgtatcaggcccactgaaagaaggcattaaaagcactctgatagagaaattatatatgccttcctgcaggtaccataccactagcattttaccagattcaaccctgagtgcaacagagagatctagaattaacatctgaatgaatagggggaggagggaggaatcactcaagacacaggatacggattaaacatttctgcagcttcagcattagctaatttatacttattctgagtagaagctgcttgtcaggcagctggaagatggagtgcactaacattttcatcgtaagtccttgttctgagcatttgtatttgcctgggatgacagaactcaggattaacgtgccaaggtaatctgcagactctaacaaaatgtggaaatgattggccataataaggactaggaaacacgttttattggttgtggaagttaagagatcctaaaggctaacctttaaacaagcaagcaggaggtagtggcattcggcttttgatttattcccaaaattcagtgtgcatacttctttagcatcacaaaacaggtgggtggatatttctgtcttgaaattgaagctataaacacacaagacagatacgaggaaggattcccaagttggcattggtagtatctcaatattatgtcccaattctcactcccttgcttgggatccaagactccctccaggtacaggtggattagttttcagactttaatggactggtcacctgggactgtcccgagtggctgagaagcactgggggaagaacacaatgaggacgccctgtgtggctgtgagggcttcaaaacaatgaaatacatagcacaagtgcacatgtgagggccacaaagagcagaaccacaagctggagggagaggggaagagagggccca

SEQ ID NO: 55188 - DNA, 1108 bp, Homo sapiens
atgatcctagctactgggaaggctgaggcaggagaaacgcttgaacccgggaagcagaggttgaagtgagccgagatcgcaccactgcactccaacctgggtgacagagcgagactccgcctcaaaaaaaaaagacaaaaggctggaaaccatatccctgatagggcaccatgcttgccttagagattttcagtgagacgtcagatgaatttcctgcaaaaaaaaaaaagaaagttccacaaggaaattttggttttggacttacatagaatgtgcgtgaaatttgctttgaaaatctcaaaccagctgttgctggaaagctgctccagtttgggggcctgagtcttgtgcagggatgtggaaactcatttactcatattatttaactaggcatcttcaatcatcttgggttttcaaagccctgatgaccaatctattcattcatcctcaaagcacatctgtaggatgggtgggtgaagaatggcataattgttcttttatagactggaaaccaagatcaagggcatttcccccaggtcccctggtgaatccatgagacagagaccgttttattttaattttttaaattctaaccttctggacattacactatcaattttcattaggaaaaattgctatttaaaagcatggtggttacggtaagcacaggctctgtagccagactgtctctgtgctcaaatcccaattctaccactgactagctgttggtcttgggcaaatgatctaacctctctaagacctcaatttcctcatctataaaatgacttacagcacctaccgcaaagggatgttgggaggattaaagaacctactccctgtaaagcacagagaaaatgtgtaataaagagtggttattatcatccagacatcaccaaagatgatctcatttacaactgggaacacagaggcaactctttaagcacctgaggaggtgtggcaggggcctgtagttgctttacctgtaggctttaatccctcacacccacagggatccaggaaagggctttttagaccacctgccagcccccagcatcgtcttacagcagctccaccattgccgctcagcctctgtctctgcctcctctct

SEQ ID NO: 55189 - DNA, 1050 bp, Homo sapiens
attgtgcattaaaaaataacttatcgccagggtggtggctctcgcctgtaatcccagctactcaggaggccaaggtacaagaatcgcttgagcccaggaggcagaggttgcagtgagccaagatggcaccactgcactccagcctgggcaacagtgtaagactgtctcaaaacaagcaaataaaacccttatgctttacccatcatttccacatgtttgtagtgggacattcatattaaccataagtacctatttatcttttctatttgctgcaactatatgaaaatatatatggatataatcagactggaaaggactttgaaaatggtatttgttatgggtagagagagtaggtttattgtaactctagtttgcaaacactctgtattaatatattgccttaaaaacaattgttataagaattatcttttaaacaattctcttctgtttcagaatgcatatactacaactgctattaatgggacagatttctgtacatcagcaaaagatgcattcaaaatcttgtccaagaactcaagtcactttacatctattaactgctttggagacttcataatttttctaggaaaggtgagatatcttgactaaataaaggagcctgggattctgaaaattaagccatacaacaattggtttgaaagggaactatatttcttgagtacttactctatagtgggtgctgtgcttcattatctcatttaatcctcaatcccatgaggtatccctactttgcagaagagaaaatgaaggtttaataacctttccagggtactacaataggtagagccagaattttaatcttagtcttactctcttacctgtgatcagttctaccattctgattccctctttttcaggtctaaaatgaaaatgctactaatctcagaaaatgaacgtttgtgggtttctcattaagaatatatggaaagagtattgaaacctggactgggcacagtggctcacatgtgtaatcccagtattttgggataccgaggcaggcagatcacttgaggtcaggagtttgagatc

SEQ ID NO: 55190 - DNA, 1107 bp, Homo sapiens
gtactccagcctgggcaacagaacgagactctgtctcaaaagaaagagggatggtttctaaaaaaagttttaaagtgaataggcttattttggtgttaagtgaaaaagcagaataaaaagcttgtgagatattattacatttatataaatacaaaagctaggcacagataaaattacatataaccttcctactcgccattaactgggtttccttttgatacagcttttcattttttcctctatttcattctgccaaaatttctgacaagcattctttacaatagtgcacacacacgttgcacacaggaacgtatattaaaccattacttgtaactgacaaaaacatctaagcaactgattcataaagattttcaacaaactcttcttttgcacaggtgttagtggtgtgtttcactgtttttggaggactcatggcttttaactacaatcgggcattccaggtgtgggcagtccctctgttattggtagctttttttgcctacttagtagcccatagttttttatctgtgtttgaaactgtgctggatgcacttttcctgtgttttgctgttgatctggaaacaaatgatggatcgtcagaaaagccctactttatggatcaagaatttctggtaagcaaacatttcatttccaattgcaatctccatgctcgcaatcttgaaagttttgtaaagctgcacacacgaaagaggctcatacccagcctctctcttctagagggctctgaggcttctactacccccgggcctgaaagtgggatttgcgctgaactctccaaggctgaacccacctccctttctgagaaccttctccctgaagaagtgaagctgaacaagaatgctgatcagatggattcctaagtagcagcagcacttcttaccctgggcagaagatgtcctgaacacagtagttcagctccctttggtgctcatggcatgatctggccttttgggtggtctagaagtttaacagttgatctttttctaaagcatttttgcatctccaagcatgatgttcatacccactatattagggagagcacacttgtgtgctcctctgtgccagtattgacagatctgcaattct

SEQ ID NO: 55191 - DNA, 3641 bp, Homo sapiens
atactgttctcagtggggaagaaaaattaattattgtttccctgaactttgctgagttcaaattcctcattccacctttctccagctctgtccaaggacatgggagttacaggaataaaatgtggttcctttctggagaaaatgttggtgattttgaaactttaaaaagcccttgttaagctcccagagaaaacacttggcatttgctttcacattttatgtaaaacattcctggagtagaacagcatattgcttggcctaggattacttctgttgaaataaccgaagctggtacctcttaatttggttatctggggaaagagtagcagaggaaattattctgccactgtaatgacttttggtgtgtcagtccacctgttaaagtgtgtttaattcttctatgtatgagtttttatctatagtgactttaaaattttctttttaaagttagcacttgaaatttgtttgtagacacatagaagagttgactggagcctcagctcagtaacttgtcggttgtgccccttctgtctttttggtagcatggaaagttttgtttgtgttgtgtatattgttgacatctgataatttgtgcaattttatttttaacttaaaagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggtaagcaatacctttttatacgtgtacaagagtacacttaccttatttttattaaccagaagtttaaagtaggtattttttgtatagtttatttagagtatattccttcaggaatgtggactttgctgggaaagcaaaataatcaaaagaccttttcgatagcagcaaaagcatgatgtgtctcgtggtttttgttggcagttagaacagctggcctttctacctagccagcagaaaaaaagatatgtttattacagtgttcttgctccaaaatccaagtaaaatattgctcatttaaatgctgacttttttttttaaggagcccttaattaataggtaaaattacctggtgttccactaagaaggatttaactagcattcctattagatgtgtcaatataaggagatggaaatgcaacatggtgaaaataccagtataccacatccaagatagaaatatttccttgttaaaaatagatcaccagcacctcagaaggaagttcaacaaccatttgagaacagacaggtctcacatccaacaacagctgggatagggtttgaaaaacattttcttaccgagtccaagggagatttatcaaactttgcccttatggaacacatcctaccgggtgcggcattatgtctctcatagctgccactcacgtttacttttctacccactctgaacctggaagtgtgtgcttgatgtaagtagagagatgaagtatgagttactgtactctgaaaaagaggggagtggctgtgaagtggctggttcttctgtatctcagccttttgaaaagactcaagtccttaagatctgctcaacatagtttctgttgaatatattataaatttttgaaattggtaacccagataatgtatgtggtccccatgggcattcacatggaactttctggtgtggaagcattatgatttcacattctttatgtctcattctctcttaaatccagagtaggtagtaatgtctccattttgcagtttgagaaacctaaagctaaatttacgtgtttgaggccacatagtaattttatagcagagcaaggattttgaagaaaggtctcacctagctcaaaagccaatgaatattgcttcatggaagtgattcggtatcaggatattttggttaagctagctttacccctgaaccaaatgaaagttcatgtattactgttcatattcaatgtgaattctataatttataaattattcacaagaatagattctagctgctgttttaacttttatactatgttctaataccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaaccacaggctgattattttctggctagcttctagataggtagggtcagatttttttttaagtacctttttcctaggtactgttacaaggtacattaacattttatttacttcacacaacactgcactctatgcttaaggagattgaggcttaggaaaccattacacatagtaaatgacagaattctaatcattttctgacccttgcttatttcactgacttggctggcccagattcatcttaaattcaacttggaataatcttaaaatctttaggaatattgacaggaggggtggggaattttcctatcttagggtaagtaaacatgaataagaaacatgctaggtcagccataggatgtgctgcttggtaataagccagggtttatagtgaaacataaaccttcagtcctgacagagggaaggacaaacaatagctaggtgtcatagtgacaaaaat

SEQ ID NO: 55192 - DNA, 1064 bp, Homo sapiens
cttccctctgtcaggactgaaggtttatgtttcactataaaccctggcttattaccaagcagcacatcctatggctgacctagcatgtttcttattcatgtttacttaccctaagataggaaaattccccacccctcctgtcaatattcctaaagattttaagattattccaagttgaatttaagatgaatctgggccagccaagtcagtgaaataagcaagggtcagaaaatgattagaattctgtcatttactatgtgtaatggtttcctaagcctcaatctccttaagcatagagtgcagtgttgtgtgaagtaaataaaatgttaatgtaccttgtaacagtacctaggaaaaaggtacttaaaaaaaaatctgaccctacctatctagaagctagccagaaaataatcagcctgtggttcatatgaaagttcaaaaaaaatatttatttataaaaaatacaatgggataagtttatgctgagaaatgcagcaataaatacagttgaagaaaacagagcaactctacattgatacattggcacaaacaggaagagcaaatgcatcacccaggcctaaatgtccacaggccacttttgtacatgctcttttagaaacaccactctgaaaagatcttgttcgctaggtaagagaatgagtacacatataatcacaaatgcacactgatcatgactttatttaaaaattagcaaacaatactgtagaaacattgatatgtaaatttctaaaatgctgcatcttaaatttagttggcaaagaccacatttagcaataagcatgagtttagtcttccatgtagaaaccagatacactaaactgtaaaaaaaaaaaaaaaaaaaaaaagtttcctattgtttgaaaataccagtttaatataagattgtaaaaatgcatagatttttgcataaaagaactggctgtacaagagtactcccctttcacagtattcctttttacttcatatgcgagttattgattatgctgtaggatttaactattacagcactaaaaggcaactattgagggaagaggcagaaaaag

SEQ ID NO: 55193 - DNA, 1643 bp, Homo sapiens
gagagaatgagtatttagtaaccacaaatgtattctgaaattaaaataacacataatgaattatttattagtatgagtaattatacaccttttgacaaataaaattccaggcctggatagctctgatacagaatccttttaaaatatataaggaagatcttgcccataaaaactgaaaacacgtaactgcttaaaaatattaagactgtgatgtgacccacagtgagagacacactctcttcttgctctttcctgttccagagagagccatgcttagtatgtatttggttgaatccttgtcaaacagctttctgggcagcgtcttataactgtttatgaagacttggaattcttagaaattatgaatgtcaatatttagctccagaaattataaaactcttcttctttatagttggagaatattggcaactttattaaagctattcaggcttatggtatgaagccacatgacatattcgaagcaaatgatctttttgagaatggaaacatgacccaggttcagactactctggtggctctagcaggtctggtacgtacatgtctttaatggctggttaacagattcccaccacattggtgatgaattgcatcattgctttttcatgggggttcagaccaggtggggcggggcctgtctcttctgtaattagtagctttgtggaaaggctgctgacatcagctgcatcgtactagatagcttacttagaacactcacatttcaaatgatgcagtatattattgaacagccttaaatactttttatctctagtttgggcccctttgtctatggacatatcatttctttgttgttccttctgtgaaactctgttggccttttcagttagtgtgcatgtttctgtctaggctaaaacaaaaggattccatacaaccattgacattggagttaagtatgcagaaaaacaaacaagacgttttgatgaaggaaaattaaaagctggccaaagtgtaattggtctgcaggtaagtaatgtggtgttgcttattcaattacttattcaatatgattaattctcaccatgcaaaatattaagcctctcctaagaatagacagaagtactatagtactggggggggggtgtagtttatacaatttatatctatttataaagcccataagacagtgataattttttagaggaaacctcaggtatgccacctgacttgacaattatttctccaggaaacgaaaatttttaattgaatcatattgtcttttttttttttttaaaaaagaaaaatacacttttaaattttttattttatctttttttttttgagacagagtctcactcttttgcccaggctggagtgcagtgacgcgatctcggctcactgtaacctccacctcctgggttcaagcaattctcctgcctcagcctgccaagtagctgggattatgggaatgagccaccatgcccggctaagttttgtagttttagtagagataggatttcaccatgttggccaggctggtcttgaactcctgacctcaggtgatctgcccacctcggcctcccaaagtgcttggattacaggcgtgaactactgcacctggcctgttttatcttttatatatagatgggatctcactttgttgccca

SEQ ID NO: 55194 - DNA, 2491 bp, Homo sapiens
gtcaaagctgtagagccatttctccaacttgggtaaagggtgcaaaggatcaagaactgccatctccctaatgccacagtaatttagtgaaatcatttgccctctctcagtcaaagcagaagcttcatgccttggcgtggcggggaggggaaaagaggccctgaaaacagcccaggagtggtctgattatgtgccaggggatctctcaggctcaggtgcatggtgagccttcaagagggggacctggaatgtagacatttccacctacttgacctgggaaacgggatgtttttcctaccttgagaagttaaaaggctgttgtggcttttgatggacacaaaaaggaactgtgatcaagtgtacgctttgaatctgttttttaagactcagcgttggttttcactgttgggtgacttacaggtaagctggccaggttcgtaaatgtctgtcctgatcctggtgatcaggctctctcccttggaaaggacctgaatgcagcccacagtcctatatgctctggcactatgaacctagggcatttcccacagttctgcttggttcctccgtgagtggtgtagactggaacttgtgggacttctttgtgactaaaatgtcaagatgccatttcatttcttccaatgattaaacctccctatgtcttatggacacagcagacatttctaccttcattcccatttccaatgatgtaattgattcccaagctcatgatctctatctcctgagcatttcctatgtatacttggcattttcaccagtgctgaatgagaagacaaatgatactggatctttccttcttcccagctgtgggtttttttttggcagtggggcgggagacagggtctcactctgctgcccaggctggagtgcagtggtgtgatcatggctcactgtagcctcgatctcgtgggctcaagtgatcttcctacctcagccttccaagtcactgggatgacaggcatgcatcgtcaagcccagctgaattttttatttttagtagagacaaggtctctcaatgttgtgcaggctagtctcgaactcctgactcaagagatccacccagctcagtcccaaagtgccgagattacaggtgtgagccactatgcctgcctcagctgtgttctccataaccctgattgaccagccactttaaggggactccaggacaagggatagcttaagaacttgggcatgtgatttttttcacaatattttgtttaaattttattttttcaattattttaaattgaggtctggtcttattaaaaagggatctttcaaaacttatgtttaatagttttaccatgtataatagcatagcatttgtgttggtaagttggcctttatttttgaattctgcaagtaaaaagttaaactttcttttagttttatcacatgtttgggtgtcaggttcaattctagatactaagaatctgaatgaactagatgcttttcctgcctgtaagaagtctaataggatagagactacataaacagaatttaaatattgtacagtaattagtactgaggaaagtgtgtgtgtgtgtgtttagtatatagtgtgtatttggctgaatagaaggcaaataccagaactttccagtcaacaaaactattggaatgttatgtattggccaggtgagatactctgtaaaataactgcatgtgtcagaatcctttccccagctttttttggaatagggtgattaatgacttaaaccttaaagtttgagtgccatattgtaacataccattaaatccttgtcacttcctgtggatcatgaaatctgatgtctcttgattgatgttctctccttgtcagtcccagcctctccatggtctgttcaaaattttgtatgacacggtcttcaccaaaaatttgttattagttactgaagttgtaacggttaagtttgccattgagatctattgagtgtcatttactacacttcacagctgtggtcttaatggctagtgaaagcagagcgcgttgtgagtcggcagtttctgatgcttttgtgaaattcttctaaagtgagttaacctgtatttcagattgcttccaagtatgatcatcaggcagaagaagatcttcgcaattggatagaagaggtgacaggcatgagcattggccccaacttccagctgggcttaaaggatggcatcatcctctgcgagtgagttacagccctccagaatctgtttctgctcttccagttctttccacagccttctctctcactctccttctcagcccagggtgtcagaccttgatattctacagatatctttaatgctttcccttactgatgctaaagggagcaacttgatatttcaatccttgtttttgtgtgccagtaaataagatgtctctcatatttttcttttcagacttataaacaagctacagccaggctcagtgaagaaggtcaacgagtcctcactgaactggcctcaggtaacagccaaacca

SEQ ID NO: 55195 - DNA, 2200 bp, Homo sapiens
acagggtctccctctgttactcaggctggagtgtagtagcacagtctctgctcactgcagccttgacctcccaggctcaagtgatcctcccacctcagcctcccaagttgctggaaccacaggtgtgtgccatcatgcccagctaatttttgtgggttttgtagagacagggtctcactatgttgcccaggctagtctcaaaggactcaagtgatcctccagtgttggcctcccaaattgctggtgtgagccactgcacccgtcctagtaatttttgaagctttaatttcttgtcagtctcacaatatttgtatattgagtcataatgtttttgtatttacctgattatagacatttggaggggaaaaatttgtgctggttggtgccatatgctgataccttgatctgaagacacagttgtacctctgagaggaggacctggctttaaaatgctcctggactttacttctgtttacctgaggcgagcatgattttccacagcttttaaatgtctagttcctccgcatcaaatctttagcacgttcgtgccatggaatgagtcttagattctgtggtgacctcaagaaaagcatgcattctatcttgacatcactgtcccaaatgtaaaatgtttttctctagaattcccactcccaccccccataagatacatgcctgattttgtaaaatagttcctttgtcctttttgtcagcaacaatctgaaaaagaataagaattcgggatgcaaacacattctaagcagagagaagagctttagcaaagacagagaggcaggaaccagcctcaggaagagtggtaaagggagtggacagtggtgaaggctggcatcccaggtgagcctgtctgcagtggggttttctttgctattgcaaacaatggattgaacaagttgcagtggggtttggttaatagaatgctctgtacctggagctgataaaattggagggcgtgcatgctgttgtgtgtcaggtattgcggtgggttccattcctattgaacaggcttcatcctcacagtggccctggaaggaaggagtctacccacaagaaatggggtgacctgggttcagttacttgccaaggtcacactggaacttgggaacacagggttttgaagtttgacttgaaagcgtgtgatcttcagtaaatgtttataggattcattgcggagagacagggtagatgaaaatgttgaaacctgttcattgtccttgcatgagataccaagaatagcaagtgatagtgagaaggaaggagaggaggaatcttgatacttgagatggaaatctatttggttcctattttgggaccatgttagcccccattgttctctctttattttaaacaccctattttatatatatttttgtgaactctttaatacaccgtatttaatatttgtctctttctgctagaatgtaagcttttaggacagagactttgcctttgaactgtgcctgatatgaactagccatttagatgaaggacagaaagaaggattaatggagaaagaagatgaaagaagaatctaaggaacacacggaacacttgaaaaacagaagctaatgttgaatacgagtttacttagagagtttggagtaatgcaggattatcctggtggctcaaaacggggagccacagctgaaattagggagactgttgtaatcactggggacaataaccaggaattgtctgcttccaggtttgaacaagctctgtgatgataatacattgtgagaaggaatccatgtgaaaaacaagcagtcttcattcttcagtagattctggaatgtcctgggtgtaatgggggcatcagacagttcttgtacatgaatgtcatcactctacctcatggcagatgtgcccccatctttttttcaaatggtacttgagctgaatgctctcggcgtacaccgagaagtaccattcaacagcgcaggaatcgagcttttgggtcagctgtggaggtgctttttgaagctaggtctccctttactctttctccctttctgagggttcttagggggaagcttctcaaatttcagagccagggaggggcatggctgtttcccagcagctggtaggcttgtatctgctctagtgtctgccttcactgttaggacacataggccctcggggttgtgtttctgaaggtggtcttagtccagagctcttggat

SEQ ID NO: 55196 - DNA, 1996 bp, Homo sapiens
tacaaatgcgggaatgagtttgttagactcttaaatattctagtggtgagacaaagaaaacaaaaacttgaggaacatctctattttcacctctttttacctgtggggcttcagctaagatctcctttcagcaaaatctctacagatctctaaaattcaagacccggctggccttcttcccagtgagagaatgttctccaacaagctttcttggaggtcatctcttcctgcctgtgcttcattggcactcaaaacatgatatttttccatgcctgtttgcttctagtccatctctcaggaatttctccatatatttccctggcctgtcctctgtgtgtcactcagaataaatcaactctctcttctatatgacttccatctaaatatttagatgggagctaacctgcctctcctaaacttccaggtcatatgtagccactcctggctagccagtttctcataataggctatatatggtttttctaatcccttccccacctagtttactccttctagaaactgatgtcagcttatcagtgtcccttcagaatgcatcactcagaattgatcatagtattgccacagatgtggtttaacctaccagagtacactgggattggtaactgacttcctttgattacaaagctttagctcctcctgttttaaccaacagaatcacttggccaggtagacaaggtaactctgtgtagaagaaggattctaatccttgctttgtcaaattgacttctccagtctataaagtatggtgatgatcactctgggaggttttatggctcacatgaactccatgcgcacccgtttcttataaataatgctttccttggttacctcatggggctgttttgatttaaacaaataagcaatactattttatgaagaattgtataactatgcagaccaagatagtgttggctttttaacttactcaactcactgagtaagtgttactagttctaaaactttggggcaggatttgacatatattttgaataaactgtgtattaacgtaagaaagatccttctgattcccagtttccttaataagtatgccaagtagtttccaagtcattaatgaccaaaacagaagagaacacatctaaatccaaacattgaggtacacatcaccacgagtttcctctgccatgacataatcagcacagtgggcatggtgttccttctgactgtaccctccttctagggttactaaactggacttcaggagtgcgctagacataaggaacttttatgagaaagtaatgcaattatatccctagtgggccatctaagattaccagattggcagatcaaggagatgtgacgcccataaaaggcagtgacattcaaatgcagatgcctttccgaaacaagatagatctttaaatctgaggcatttccctaggctggtaatcctgtcagtgggtgaaaaatcatggattgagtgcccactatgtatcaggcatgggcatgaggattactaagatgaacaggagcctgacctcccctcaaggaggggacatgggcaggtgttcttggacatgccttgtgtgtccatgcagccttggtgatggctgcccttctccctgagtgcttgcttgcacactctctccccaagagtccactctaggagggcgcctgccgggctcttcagccagtaatagatccttgccctctgggtggggatggagtgggagcaggcttctctctaggttctagttactaccgtttgccaaggcttctctcacagtgagctgcttgatacccacttttttgttacttgttatttctgagtctagattcttctgggaatccagtgtctatacttgttcgctccttgtttagatttgaactttcaaaaatccactataaactatatgtgttctaagctttgcagtctaaaggtcattttctagacagagaagacaaaattgacattctgttagctctgcatctttctaccgtttgttatactctttgc

SEQ ID NO: 55197 - DNA, 1546 bp, Homo sapiens
tttaacaagaagctggaggaggagagattagagggccctcctggaaaatactaggtgctacagagaggcccagaggatgactggagacaggccactggatttggctactgagaagtcactgatgacctgttttgtttgagacaggatcgtcctctgttccccactccctgcaatccccctcccctgtttccccccaggctggagtgcagtggcatgatcttggctcactgcagccttgacctcctgggctcaagcaatcctcctgcctcagcctcccgagtagctgggactacaggtgtgcaccaccatgcctggctaattttttgtatttttcgtagagacagggttttaccgtgttgcccaggctgcactggtgaccttttgagagatcgtcggtagagcaaatttccaggggttaggagagagtactaagggaggaaatgggcaggcttggcatgaaataaatgacaaacaggacagtgtatgaggctggcagcaggttcaattaaaaatttgccatttcagggaagacagggtagcctgtgcccattgatggaccaagtaaaggcaacagcccaaaacagatggtgtgtgggggcaaagcagaagggcaggagggtcagtgggaagagaaggggcccagctcagaaggggaagggaagaggaccatgaaaacgcagcactgatgtggagaagtcctcttttcatctgaaataggggtgtcactttgctcctgaccttattatgctagagccactgatgtccgatggggaagagagcaggaataggaagagatggcccaggctaagccctccctgtgagcgcactgctgattgggctgcccctttggagcttgggcactggttcactctcctctttccattggcccttgatctggaagggatgggaagttgggtttattttgttagagcctggttgtctgtagcaagcctttactgtattatctccaagagacctttgtgttggggcatagcactctgatggaagatgtaatgctttcagggtaacttattttctccctcatccatgctctcagattgcattacaattatgtaaaatatggagttcacctttactgtcgatgtggagggtcccctgtgacttcatcataagatccttgcagacttcgggactggaaaggggaaaccatgttcaggctgactttcttttagaggaactctgaatcttgtagttgattatgtccctctttgtcttggtgtttaagaagcttggacttcagtttgcatccagcctatctttgggtggcatttgtgtaggatttggtggcatgcaggtgtttgagccttgcctctgacttcatctttttttcacacatcctcattaaaagcaaaatgaacctaatggctttttacttagggtctcagaaagtacaaaatacctttgtatggtatttcataaggcacagtatgaatatttttaaaaggaggaaatgggaccagcctaggcaacacagggagaccccatctctacaaaacatttttaaaaaggtagctgtagtggcaca

SEQ ID NO: 55198 - DNA, 2993 bp, Homo sapiens
ggataggggacatgacaccaagcagtactactgtgtttcatttctgtgtcaggaatgtgatctgccccagagtccttatccaggactccaccaccaggcagcgtgtgaggcatttccacagtgaaagcaccaggtctgtagatctgcaccattctgtccacattgcccttagggctgaggacttctctgtagagctagaggtcttgcttaccgggcttggttgtattctgctttttctaacaggttgattccttttaaataagatatatctttcctttcttggtttcagatagggcttgtattcctccacagctagctggttaacatattttccttcaagtgtttgaatttggcttgcttgaatctggaggctttgagtttatgtgttcttatgaagtctctacctagacctgtgtgaagcaagtccttgagtggagaagactaatgcttagttttcccccacaaggtagggagggaccaggaagcttcagggtgtgggcgtgactgttgagtgctgtgtctgcggtgggaaggccagggaattggaggcatgaatgcagagaaaagaggaggccttttgtgcttggaaggactcttctgggtcagttgtaacctaagcatttatggttatttcccctctgctggataattttccagggaactctagctgtggagtggccacactgggcgggctatggcttcattgcttcttcccgcctccactcccaaatgtttggacactgatctttctccattatctgcagcttctcacccttaatgttacccaggctctgtgaatggatagagtgtgcttcattagtgcacaatttcctggtctccttttgtttcttgtgggaggaaataggagagaaaacaatcaataccatgtgtagcaagtctctgtcctgctgttggttaattcaaacatgtgattccactttgaatgcaaaaatagcaacagcaatcatattctgcttctaattgagtgtagaaattatatgtacattaggcatcatcttgtgagcttgctgtggtctttgggccttagcagctgagctggaaccctagggctgctctttagagtccacctatggctagatgccttcccctgaatggttccattctctactctgaatactggggtggattttccttatctttcttcaaagaattggatgttgtattttttaaaaaccccatccctacctctccttgcttacatacagacgcattatttgccagccagattttcatttcaaggtttattcatctctgagcttcccccccttctttttcttctttagtgacaccctttcctgcagttggtcttacatcaccttcaaaaaacatgcatgtggcaggaggttggtcttcatatgggccagtgggagagttaaagtgtttttagtctgaaacagctctgccaaatatcttatgaactttttttttttttttttgagacagtcttgctctgtcacctgggctggagtacagtggcacgatcttggctcactgcaactctacctcctgggttcaagcaattctcacacctcagcctcctgagaagctgggattacagtcgcgcaccaccatgcccagctaatttttgtattttttgtagagatggggttttaccatgttggccaggatggttttgaactcctgaccttaagtgatccacccgtctcagcttcccaaagtgttgggattacaggtgtgagccaccgcacccagccttatgaacttttgaactgtgctggcaatgcgctttggaactaaggattcctatgggcttgtttaaatcaattcctcccaccccttgccgactttttttttttttattttattttttttgggagacagtctcactttgtcgcccaggctggaataccgtggtgtgatctcggctcgttgtaacctctgcctctcgggttcgagtgattctcctgcctcagcctcctgaatagctgggactacaggcctatgccaccatgtctggctaattttttgtatttttagtacagtcggggtttcactatgttggccaggctggtcttgaacttctgacctcaggtgatctgtctgcctcagcctcccaaaatgctgggattacaggcatgagccactgtgcccggcccaattagtcctttctacaactgggcaatatattcatgtgcattagtctgatacgatgatattggtggtgggtacatttggatatattgtcacatctccatgagttaaaaggactttatgttaagccagagtctaagcatcttcaggcagatagcatagttgcctgtgctaagactgtgtatagtacagagagttcctgtctctcagctttgttgtagagtagggataggggagcatccaatgatggaaaagacttagacttggagtcagatctgggtccgaatccctgctgagcccacaacctttggacaagtcatctctgcatgaagacagtacatctacctcagggtgccatcttccttgcttatgagaaccacttctctttatgccaacagttccaaaatagaaaagtaaataagtgaaagtatcctgtataccttactcctaccctaagtgcttgtactgctttgaatattgttcaaccattttgaaaactgaattatagtctgttgtatggatttccactgattattcactgcttccctgctggtggatatttcctttaaaagtacttgtgtagaaaagtgtgtaacttttgacataacatttaaatgtattttgatattgccaaattgctctccaaaaaaattagttcctaccaatggtaagaaagaggaggaggatcttttgatgttaaaaaaagaaaaaagtaacttgttttagtttctttattaccaagtcatgagtcattgacatctgtaatccctactccatccctcgtccccagcagactcaggtgggaattgacagtgggctgggatgagggcgttttttccacaaattatttgataatagtt

SEQ ID NO: 55199 - DNA, 1053 bp, Homo sapiens
aagtcataatgaatctgatctgcggcataaaaaaagtaagcacaattggatcgttttggtttttcacccatcattagcattgtattcaggagagtgaggaaatgcattttcttctctctcttttttatttttttgagatggagtctccctctgttgcccaggctggagtgaggtcgtacgatctcggctcactgcaacctccacctcccaggttcaagcaattctcctggcttagcctcccgagtagctggaattacaggcacctgccaccacatctgactaatttttgtattcttagtagagttggagtttcaccatgttggccaggctggtctcaaacgcctgacctcaagtgataacacctgccttggcctcccaaagagctgggattacaggtgtgagcaactgtgcccagccctgcattttctttctcagtgaaactaggtggtggttggagaaagcttgtccttagaatttgttggcaagttccatttaaatctaggcattaccctcctgtagcatataccatgtgcattggctctccttaactctgaacttattttatagcccaaatgggctcttaacttatttatgtgtacttgtaccctcagatttttgttaaggattcttggaactcataggtagatccaggttgtttgtggggacgaagtttatacaatttgggggtcctcattatgaaaaatatataaatatcttttaagttttacaaaaacctatggccatgtgaacccttttgaacttgaagacttctccatacctgtcatacaaggttcttgtcagggaaagtagagcttagtggttaagaacatggactgtgggaactgggttggattcctggttctgcatcttactgtgaactttggcaagtgacttaacctgcctgtcttgtatgtaaaatgaggatatcataacactcatctttatagggttgttgggagaaatcagatagataatccatgtaaagtgtttagaataatgcctggaatcaaaagcccacattatataaattttagccatggtttcattttgctg

SEQ ID NO: 55200 - DNA, 4974 bp, Homo sapiens
ggcttccgctcccctccgccggcccggtccggcccgccgcggaggatgcctggaggttgacgtgaatggcctgtggctgggaagcccccaggcgccctgcctagcccgggggcggggccgcctagccgccggccccggtggcgtgagggctggggcgggggccggggacctcgcggggagggagcgggagggaaagcggcccccgcggcccttcaattggccgcaccgcccctcggcgcagaggcgggaggaggcggccctccattggtcgggcccggcggccaatcctcgaaggcccaggcggaggcgggggcggcctgtggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaaggtacgcctggctcgggcgggcgcgggggcccccggggcacccttgggctggcctggcgctgggccgtgcttcgtttgctcttcgcgctgtggctcaccgttttcctggagaggggccgtcgaggcggcgcgagcgtctctgcctgtcccggtcgcgtccagtccccgggcttgcggggccggctcccgggcacccgcctggctttgttcccgcgccgtgggacaggactagtggctggcggtgggttcccgggcgcctggagtcccgcggcgccagcctttccggctgcgggggtctcgggggccgtttggtgactgcagaacgcgccctccgggaagggggcgctcctgcgtggccactcgcccttaggcggagcccgtctgcgcggccagggacccggcgagccgctgccgcagcccccgccatctgcccgggccccgggtgctggcggactccgcgcctccccacggggagagagaccgcctaatgtcccgccgaccccaggggccccgaggaacggaagccggtccgggacccatcacagtctccgatctcggtgcctgggaggcatttggaggcagattgctgctgctgcttctgctgttgcttttgcgggaaatggagacaaagcctgagcgcgccactgtgcgagtgatatctgcttaggcttgagactttttatgaaacactgagaagtttgaagtacattagactttcacgacataaaggattatttttgtgggttgcttttgtttggggcttgtttgctgaggcggcttatagtttggagcgattgggatttggtgacgctcagctttgccactgagcccaagaatgcgttaggtttatctttaggacttttggcctgggaaagagatgagaggcgtccccctccccaaatcctctccttccttcctccctccctgcattccaagcccatgacatcaggggtttctggggggagagaccagccaatcggcgcggaactgtgcacagaacgctcattgtctcctttctgctgttctggccaaagcgccacaaaggagggctgcctgtggtttaattcccattaacctcccgggagcccaagcatgtcaggattgccaccgcaccgtccgaccgctggtggaaggcactggcattgtcagagctggaacatcccggggctgcgggggtaggcggtgtgaagcgaattatgtaaagaggtaatgaagcgcaccgttgtcaaaccccaagggagagttgtggctcttgtctcccgctgttagtctgcacatcatactgtctttgaagcaaggagttgattttagtctatgtatctaaagttgaaatgtttaggtcctttaccttttcaaacgtgttgcccgtattagacaacagtttgctaacaatttttttagagagcagaaaggtgaatggtttgtgtatgattgagtgcaaacctcaccaactgaaaagtttgtaacaagttactgtttccttccttccaggatttacaaaccgaactttaggaaacttcagaggaatgggcatgtccaaaatgttggatgtgatgtgatactttggcctggttgtgcacattcattgtaattccccccagtgattcttggctggcagcagttgagtctctactaccttttgcattgtaaatgaggtactgataacgttggcagcccttcaagtgacttacttttcttggatgttaataatatccatgctaatttcttttttgctgactaatgtagcagcttttgcccttttcctgcttaatactgagcagatccaaggaaatgcatacacaggctagatcactgtaattattgtaaatatttaaaaacggtaaaacctcagtttttagaacctttggaaagttagttatgaaagctgtggatttatccctttaagcaccaaacccattttttaataacccgtttcatttttgtagtcctttcagacagtattctttcataggaagtcttttgatcttaacagcagagcagtcctgtaaggtgaggaggattgctgggattatccaacatcatttacagatcagtacactgaagctcagaaagatttgctcaaggtcacagaagttggactattctaagaattttaactctaaaagcgatgtcttagttgagtgaagtacttagggatgttctacacaaactctgctgtctgtcgccttccccccatttttttttctttcttttttgagacggagtcttgctctgtcgcccaggctggagtgcagtggcgcgatctcagctcactgcaaccttcgcctcccaggttcaagtgattctcctgcctcagcgccccgagtagctgggattacaggtgcctgccaccatgcccggctaatgtttgtattatttagtagagacagggttttgccatgttggccaggctggtctccaactcctgacctcaggtgattccccctgccttggccttccaaaatgctgggattacaggcgtgagccatggcgcccagcccttcctcccatttttgctacccacctgtcacttcttgacattgtgattatttatgtcatactgtttctgatctgttctgggcctgggaatcaaatagccatgtttgctaggcctttgtatgagatgctgcattttgactgaggcctcaggactcccgggtgaaaggtgggtatatacaaaagtgacattgcgtggtttgacaccttttgattccttcctgctttttctttattgcataattgatacattgcttgaatgctagattccccccatctacccccacatctcatttaacaaagaagtatagaaacatcctggggagacagtgtggagtggacctgggagtctagcatatgtgagttctagtccccgttctgccacttcctgccttctgtgatgctgggctagctacttgacatctctctcctagcttctgttctgtagaatgggggaaaacaatagttgccacccccagacaccatgttgtggagatgtgtctggcttatactcaactcagtgactgtattgtagctattagctcttagtaacagaaaattagtttttagtattatatttctaagatttgtatgtccctgcctctttaagtatttggtttgtattaataccttttggtcttgttatataatattctagctgtaaaagcatttcatcaatgaattgaggaagtctctgattttaaatactttaatcagtaaaatttcagagaaaaatctttaagacatttgattggtaagatgataatacatggcagaacacacaagcttactttttttaataggcaagaagatgtgtgaaaacagccttaaaaaaaaaaagcctaagaattccagtctttcagcctggaatatgaacaaagtttctttaataacaaagaaaaaaatgacaccaaatgatcaataacttagagtttacaaaaactatcagagagtaaaagggccagggaaaatgcagacactggtagggatggttcggtggaggatggaaacactcataaaataatgggccctacaggtattctacaggttgaaccaggcccttgaatgcatcttgggaaccaaaatgaaaagtgaaacaactctgtgcctcgtaaaccatgaaaaaacataacaggtactcaagggaagcacagtatttcctggcaaaatgttggagttgggggtagtttcccgtaaagttggatgggaagagaggacgcagtgaagcatgtcttcatcaggtttagagcaaatgccgcaggaacctttcttacaggtctcagggaaagtggaaaaaataaattgacaaatggggagctgaaataatcttacctcggtatgtttttttgggaggaagctaactggaatattaagaagcatggaattggaatgcacattcttccagtcttctgcccccttggaatgtctgatttgagcaaagcagcttcccacgggatcttcttgattacaaaatggtatttctcaacacctaaaaaccttcttgaaaggcttattaccaaaatctttggttgttgaagttaaacaatcatacagtaataattagataggaccagtgtccgcgaagtcctcctagcttgtttgccgggtgcgctttagacgcacagctgctctgagggtacttctgatcagagtaacccagggtgacccagctataaattacactcgagggtggtttgccttgtcttgctggtagagcaccagaatcttggtaaaaatgtgttggtgggcttagcttttttctttttaaacttggaagttcagaaattggtttttaattaaaatctttttttgtttgcttattatctgtctcttcccaccagagataaagctctc

SEQ ID NO: 55201 - DNA, 1145 bp, Homo sapiens
aattaaagatattttctcccaaatcaagaataagttggtacattaaagaaaacagtgaatctcagttgattttgttttctgtatttttatgtgacattcaaggtccacagagcagtcagagaagagcaacacatgcctgtccgatgagtgctgactgagcaccaggaactgtgctagaagttagaagttaagtgatttgccctgagtcacacagttggtaagcaagagagccaagacaacacagctctgcctggctccaaagtgcatgggcttaaacatgcgctgtttgctgcatcctggttcttgacagagaaggacttattagaatcataagcagatcccctctgaaatcaggctgttcttaatgcaaaatgcctcccttagattattattctgtattttcatttgaccttcaactttttctttcaggtgttgtgtaacggaccaggaacatgtgttcctatctgtgtatctgcccttctccttgggatactaggaataaagaaagtgatcattgtctacgttgaaagcatctgccgtgtagaaacgttatccatgtccggaaagattctgtttcatctctcagattacttcattgttcagtggccggctctgaaagaaaagtatcccaaatcggtgtaccttgggcgaattgtttgacaaatggcaactgacttctttagaattttgcagttaacagtagtatgtactcaaattggggggaaaaaaaccctacatgtttcttgtaaaggcgtctgacagtcctgagaattattgatggtaaggaataaaaaatgtacagatgactcagtgaagaaactgaggcttctcttatgaaacaaacattgataaacgtaactactaaatgtttatgcctctgtaaaccaaatttcttttctagataaaaatatgtattactacctgcaaattttcttctggctgttttagtagtattttttttacagaactaaatatagagtttgtatgattagtaatatttcctgtcctacagctttttttttttttttttttttttgtaaagtattctgcattgtaaaagaagagagaaaaaaagtatttctgagttttggttcagatacaaaaggctttatttcctgtatggaaacagtgatgtccccagtgaa

SEQ ID NO: 55202 - DNA, 1192 bp, Homo sapiens
tttgagttgtcaccaagcaaaatgcaagtaactaatatttgaggatgagccaataaattcagtatccttaaaacattagtgcattagcctaaatgaaaacaatttataacttgcttacctttttggtatggtttaaaagaagatgaaagctattctgggtaaagagaaatcggcaagtggctagatgactgtagtacgttcacgcagtggcacaattgtgcctatgtagaaacatggaatggatgtagttgtatacgtggaaaagtagaccccaaaatgctgtatacacaatgatgacatctctgaaaattctgttaccaatagaattgtaagagaccttgggttcatagatagtcagggattcgagggtttagaatttatttggtgatttaatgttgttcttgatattttgatgtttctgtttaactgttactcctcagatgattaaataaacataaaaaagaagaaatacaatgtaccatcatgtgagccaagcaaatacgtcatccccatctgctgcacatccttttccttcctgctgtccacctccactgatcgctgacattcagcaactgcctttcccaggcttcagcccggccttcctgtcccctgactgtaacctctgcatgttatataccacctgactctaactgcattttcttctttactcccttgattactctcagattcttctctttctagttgcctgaggcttttgtcccactgcttttgccctcctgtcttagataagtccttttgcttatcctttccgtaccctggagcactctcccagcctctttttgctgtgcagtcgccatccatgttttgccctgtctgactcctatgcccatggtccagtgcttttagccctgtctgaggaaatcctgtgactgctctgatgtgatctggccccctctgtctctacatttgctgctctcaaatctttgttcctcccatctagttagggttcttgatagcaaactatagaaatctactctggctgattgaaacagaaaaaggatttagtgaaggctattgagaactcttggaattaccagcaatgtcaattaagtaggcttagaaaatatagagggacaaagtgggaactgagcagccagaaccatgaatgaaattctatggccacagagctggtttcaggagatgctgctgctactgttgctggacagtgaac

SEQ ID NO: 55203 - DNA, 1028 bp, Homo sapiens
gggtgcagtgtgtcagagaattctttgtttgccactttagtaaggggaaaaaagactaagctgggccttgaaacagggtgaaaaacacttcgtggaaggcaaagatgaccctgtttttatatggagtttgtgaacacacaatcttgagttctaccggatactcttaaaaagcaattacagagtcctgctgagctcacatgtgcttgccagccaaacagtgggagtggggaaggagcagtagatactatcgttgctttaattcacttttgcctgcaggaggaatcttgtcatctactggctccccaaactattttcaaatgggatattttatttctgagtttctgaaggctactggcacacaggccagctctcacttttcatcattttgacatgaaatggaaaatccgtttgtggctgttttcgtagcatgtgatttactcctgttcttttatctgtctcccctttatattttttgtttggacatatttttctcttcaggcttttgctgtcctggcgtttttatgttcatcctccttcccctgccttctccccatccccaacccgctcagcctccttcccctggtcctcagtcccttgccccacccctcttgtgctcatccaacttaaggcgaggctgcctgtctttctcctccctgatctgttccatgctgctgctggggccgcttgcgctacttctccccaccttccaggttcccccccccaggtacttacagggctttatcaatattggcccatgagatagctgacaacaagcagtcattgctgaactcatccctcatcactgttgtagaaaaatagattatcagcaacattcttaggcatacctctgtctttaaggtactttgtgcctgcaacaaccagtgtttccagtttcctggcaaccatattgaagcatgaatttaagcctggaaatagaacatcatatgagaagcaccaaagtggaagtttagaaaatcatgcctttctgtcagacacagattcaggtctctactctatagtttattagc

SEQ ID NO: 55204 - DNA, 1054 bp, Homo sapiens
ccgaacaacatctgtgtcaaaattaggctgcatattagcagttagattgctttgagttgttttgattcgtctccattttgggggactctcagcagcttgaaaatgatttttctttctaagtcgatgctttttccacttggcaaacattacatttttcctgtctgcagaagccagcgtggctttgcctgtgatttttgctctcttgttttgctttgcctgcatcactcttgagttgtcactgttccagcccatcacaggctcattttggatctgaggctggtggggactcttcctttcaaggtgaaagccaatgtgttttcccaaggatagctgtgaggtcacagttaaaacaaaaatgaaagttgaatgaaaaggaattcagttgtgagaggataagaaaaaggaaaacatgaggtaaacaaaactgtttttgaagaagggactgatgtggtcacaggcagtgagctccagagacctggccttatagatgagggtaatgggagatgctggtgacgaggtgagaacagagggtggggtgaagagaagggaagcctttgaaatgaccttagatgcatgaataattcctagaaccagtcccagcttcacagactttcagtgcttattttaaaggatcatgtgaagcaggagctctatttgtatagcacttgaaaatcaagaaagtgatgtttctgtttagaatctttaaaatcgctctttgacctgaggaaaaaataaaagaagggggcacagacagcaccgataattgaatatgtaatggagagcctcagaagggtgctgctctccaagttaagtgggatcattaaagttttagagtttgtgtaactagagtcagtagggaagcgtcatgggaagttttaaaaatttgaatacagactgtgaactccttgaggaacggtgaggtgtattactcatcttggcagtgctagcacctattctagagcgtggggcatgtaggagttcaataaattttgaaagagtaaatctgggtaggagagagattaggaaaggagaagtcagagaagctattaaaacc

SEQ ID NO: 55205 - DNA, 1072 bp, Homo sapiens
actcttcagcatcctacttttcttgtctctcttgccaccatatatttgattatacatcagtcaagttcatatagggagcgttgggaggccttgtgggcatacagagtactatgggacatggccctgttctacaggaattaggaagctgagatggaaaggttgtttcactgtttcactaaaatatgttttcttctatacgatagagaataagaaagagtcttacttctttggccaatagtgtgaaagagactggattatattgaagacaggtaaattttgcaggatatacacattgaactacaaagaaagaaagaagagagaaagagacagagaagaaagagagaaaacaaaacaaaacaaaacaaaaacatcctttctaggaacatataacccagctgactgccaggtaggagcaatagcaggacagcagaacttgccataagggccttgaggcctaaagttcaacagaaaagtctcaaaatttctgaggtcctgttgtgttcttattttgatttttcccctaaaaggcttagggaatgtgtcggggtaggtggcgggcggtcactggtaacagtggtaggtgggtttggtaacccaagcctacagtgcaaaacagggcacagagggcaaagagagaggaggaggcagggagcttagttcctgtagaggcagggaaagagacaacaaactctatgggtttgagagtgggtgatttgaaaaatcaaggaagaaaaaggaaatggatcaggatgagtagttggctatacataagagtagcaggaggcagggagtaaacttcgtggttcagctccttatatgttggggaaagcagctcctcagcagtgagacacagagatccaagcaagatctagagaaggaggtgagtcagcagcatatttcagaacacatggaagacctgggttcaggtcctggtgctgtcactttagggaagtccagattcctcatctgcaaagtgagaaagttggaatagtatgtcccttaaaaccctgagatgtcatgaggttaagagccagcatcttccccatcaccatccagcatggactagacttct

SEQ ID NO: 55206 - DNA, 1055 bp, Homo sapiens
tttggggtttttgtttgtttgtttgtttgttgtttttgagatggagtctcactctgtcaccagactagagtgcagtgtcacgatcttggctcactgcaacttcctcctcctgggtttaagcaattctcctgcctcagcctcccaagtagctgggactacaggcacgtgctaccatacccagctaatttttgtatttttagtagagacaaggttttactatgttggccaggatggtctcaaaactcctgacctcaggtgatccaaacacctcggcctcccaaagtgctgggattacaggcattacaggcgtaagccaccgcgcgtggccaattttttgtatttttagtagagacagggtttcaccatgttggccaagcaggtttcaaactcttgaccttcaggcaatccacgtatcttggcctcccaaagtgctgggattacaggtgtgaaccaccgcacctggtccagtttattacttcttacttggtgctaacattatatttaataattgtctcatattatagttatccctttgactgcaattatcacttttcctgtgctgtcctgatagactgcagtgagttccttgtgaatgtcttattcacctctgtttccctagcccagttcctgtcacctggcaggtgcttgttgaaagtttaatgaagaaacaagtgaatgaatccatgcttagagagtacagctctgaaattcaatgtcgtaaacaattgtttcatacatgattttaatatatatattttattttaagaaaaggaatgcaattttcttaccattttaaggacaaaggaagggtgcttcaacttcaagtgacataaacctacgcttaaaattggcttgaacaataaagggaatttgtcaacttacaaaacaggaaaaattcagtcttatttctggcgaggcttggtccggttgcccaggcatatccctatagcaagagttgtctctctgctctgtcttctgcagtggcagctccaccgggcttcccacagtgctgcctccagcagctccaagctctctcattagggtaacaaaaacct

SEQ ID NO: 55207 - DNA, 1031 bp, Homo sapiens
gaatggttcttcactggtgtagagagccaggtttactgttggttgcaccatctgttatcaggcatgcagaaacatttttcttctggagaaacagaggggaaggtgttgttacagtgtacatgtttcctctgtgtcgtttttaagggaaataaacatgttccaaaagatgctgttaaaataaatatttgaacacgttttctgtttctaggttgctcttaattccaaacatttaaataaatgtgcatttgaatagctttaggtggtttagtctattagctgaaatggaaaagttcatgtattgacatcatcaataatacttcataaaggtttatgtatttttatgtgtttggattccataagaagttgaacttagataattttatcaagagtagcacagtgtttctcaggtgcgagccagcatacagcgagacccttcatgtgtctctggatgcacatatatcttcccaaccttaaacacagctcattgaaatacattaaagctactgaaagtgagttctgatgcaaaacacatgtgaggtgtgtaggaacaatgaaaagctagaggatctggagttagaggaggcattgagagtgcttttcccttaaacgccgtgatagtcctcccttgatctagaagtattctctttgaatccttccatctcttcctcctggtacaccagatgacttcatcagcatctccctcttttatgctaacacctttcgctgtcaacttttgagacctccccatgtatctataagcttcccagtctcttatggcaaatttaaaagtttacaaataggttctctcattgaaaaaaagcattgtagtaaagtttaaagtggagctcagacaaatcatgacttattaagagactacaggaagccattcagcatttaataataactgtttacaacatgaggcaaagctaataatgttatggttttattaagagatctgtcatctctgtttttcttaaactggtttaacagtcagagctttgtaatgtgtttcagctgaagatttattatag

SEQ ID NO: 55208 - DNA, 1026 bp, Homo sapiens
ttcctataactatctttacaatttttcctctgcagtttttcccaccaccctgactgaactcccacaccagatccctggagaattatctaccaacacagacatttatgtttatataaattatatgtacatgtatatgtacgcatatttatgaataaagaaatgtttaggtgtagaagagaagtcaaggaagatcacttgggatatatccctgctctcgtgttctgaaacactggattgagtcaatatgatgggatctgtgtcttacctgtcattttccctcagagactagtacagtgccttgagcttagtaggtgttcagtgaatgcttgttcaatgatgaatgattgaagatctttaaaagttctcctccttcttgaagagagaatgtcaactccctagatgattattagaaagtttattcagcctaaatggttgtgtgttgtctgcagttctatttgtaatgtctgttttacatattgaaatgtactattttaacataggcagcctactttaacaataaagtatttttttttaaaagggtaagtagttaggccgggtgcggtggctcatgcctgtaatcccagcactttgggaggccaaggcgggtggttcacccgaggtcaggagtttgagaccagcctggctaacatggagaaaccctgtctctactaaaaatacaaaaattagctgggcatggtggcatatgactgtaatcccagctactcgggaggctgaggcaggagaattgcttgaacctggcaggcggaggttgcagtgagccgagatcatgccactgcactccagcctgggcgacagagtgagattgtgtctcaaaaaaaaaaagaataagtaactagatagaagaagaagggttttgagaaacatgatgggttttggaggaatgtacaaagttagatttggaaaattcttcttatgaaatacacatataaattgtatcattttaatatggtcttcttaacggttaactgtctatgtttccagatgatgtcctaaaatagtcgttcc

SEQ ID NO: 55209 - DNA, 1026 bp, Homo sapiens; identical to SEQ ID NO: 55208

SEQ ID NO: 55210 - DNA, 1026 bp, Homo sapiens; identical to SEQ ID NO: 55208

SEQ ID NO: 55211 - DNA, 1013 bp, Homo sapiens
acatgagtgtttgtttctgtaattagctatgagcttgaattttataaatgtgcactaaaagtttgtgcatattaatatttcttcccatagttaggcacagcaaggtgtgtatttgtggatagtctgcaagatttgtaactttctggctgttaaaaatacattctgacactttaatttggtatctataatacctggaaagaggagcttgtctgttataaccgagatttcatgttagtagaagtagaatcattagggctgtcaacttgtcacctcctacctaacttttgctttccacctgacttgtctcagcagttgctttcaaaatcatcatcttcttcagatttttcaagttcttattctaaactcatctgacctgttttaggtgggacaagatgaggaaaactgttttttatattttaaatattagaagagctacaaatcaataggttttatactttcagataggttaggtcatgaataattacatttgaatttatttaagacaaatttagtgtgaacagtgaatttatttaagacaaatcttaaagatttgtagaataatgacttagttttttcatgatgggctcttaccacaaaactgctttggcatttggttaaccagactcatgctgggttaaagtatatagatataacagtaattcagatttaatgcatatcttggattgggactgactgaggaacctcttgttttaaagtgatttgtagtatatctataacgtttgatccttttgggtaaaatagtagctgacaaaaaataaatacaaattaattttcatgctcatctttacctgaaagactcagatttctctttaagccagctcaggaatattaggctaaacccagctgttttgcagatgttcttactcagattgaaacatcaattaattaacaggtatctattcatatttaactagaaccctgctaatgtagagaaagaatacttttttaggagatcttttttcagttctctctaaaatgtcattttatataaa

SEQ ID NO: 55212 - DNA, 1141 bp, Homo sapiens
atttaggagtacttgattcttcagaaaacctccaaagtagatgtggactcaagtggaaagaaatgcaaagagaaaatgattagtgtactgtttgaaacaaaagtacagacagaacacaaaaggtataatttagtactattgcagatggaaaagcaactgaatcgataattatactctgacaaatctaggcatattcatgagtttcttttgtataatgcaggtttctggcatttgaagtcaaagagtattcagcgttggatgaattacaaaaggaatttgaaactgcaggacttaagaagcttttctccgaatttgtacttgctctggtaaaatgaaatggaagacaggaatcttttagtaaaatagcagtgttttttgttgtttttgcattggatttggggagtggttaattgaaatagtcaattttaaagtttctctgaagcaaaatgataggcatcattctaacttcaggaacaaaagccagttctgttttatgaaatattaaacatgaagaaaacttgtatattctaatgtttgccaggaaaggctaggttcagtagatgagacattatttaaaagataaatttaaaaagatggtaaatgaacacttgtttttatagacaatatttgtttgaaactatgtaattttctggctaattttcttgtaattaaatgattttttaaaaaagatttgttttcatgtttgcttttcttatgtttatatttttagcatttgatcgccattttcccccatccaggttatgtctaatgttttaataaatgttaagaaaaatataacactgattttttttaatggaattgcataaattgtttaactgcaaagttctataaaacaagatttatagttgctttttgagggtgttctagaatagcatgatacttgctagccttaggactagagatttgattccaattaaaattcttatttgaaaaattgaacttcttgttttataagaagagaaatgttcatacagaatgaacctggcttgcaagatggaggaaattatataaaaatactattttttatttcttatgaaatcggtcaaaacatggtgaaacatacttatcatgacctaatgagagaagccgtaagataaaacttgtattaaaatctgtaata

SEQ ID NO: 55213 - DNA, 1055 bp, Homo sapiens
atcaaagctatgaggaacttataaaataagttggaaacggtacccttcttttaaaaatatttcttgaggaatttgtgtaaagttagtgttatttcttctttaactgtctagaaatatccccagtaaatctctcttggcttggagatttccctgcgggaagatttttccagtataaaataaatttcttaaatagaattagacaattcaggtgttctacttatttttgtatcatttttataaattatattttcaagtaacttgttcatttcttttttttttttctcattaaacttttttaatgggtctcaaaattctgtgacaaatttttggtcaagttgtttccatttaaaaagtactgattttaaaaactaataacttaaaactgctgcatgcgaaaaagaaaaccaaagtggtccacaaaacattctcctttccttctgaaggttttatgttgcattattatcattaaccagtcttttactactaaacttaaatggccaattgaaacaaacagttctgagaccgttcttccaccactgattaagagtggggtggcaggtattagggataatattcatttagccttctgagctttctgggcagacttggtgaccttgccagctccagcagccttcttgtccactgctttgatgacacccaccgcaagtgtctgtctcatatcatgaacagtaaagcgacccaaaggtggatagtctgagaagctctcaacacacatgggcttgccaggaaccatatcagcaatggcagcatcaccagacttcaagaatttagggccatcttccagctttttaccagaacggcgatcaatcttttccttcagctcagcaaacttgcatgcaatgtgagctgtgtggcaatccaatacaggtgcatagccagagcttatttggcccggatggttcaggataatcacctgagcagtgaagccagctgcttccattggtgggtcatttttgctgtcaccagcaacgttgccacgatgaacatccttgacagacacattcttgacattgaagcccatattgtccccagga

SEQ ID NO: 55214 - DNA, 1053 bp, Homo sapiens
tgatctttcaagtgttttttgagttaaacttttgtccttttttttttttttttttttttttttttcaatttgagagcaggtactgtttattaaccaaccagcttagaaaaataatcatggtagacaccttagttcattcttctaataagcctgttgatctggtcctccctgttgccagcatctccaccttctacaaaatgggtggtctttttcttcattccacctcgtggagaagacaatttgaagggccacaggaagttatttgcctctttgaagcgttttccaacagtatagatctcatgaatcaaatcctccatgcagatgatgccgtatttaccaagagatcgagcaatcaaagcgttatctgtcaaagcaattcgcttcttattgattttgccataaccacgcttgtagattagttcatttactgacttcagattggggtacctccatgcaatatatggctctacaatcctcagcatgttaatcgaagccttgttgagcttcacaaaggttccattgaagatttgacgaaggcgaagaagctgcaacacctttcgaacctttgggctcactccattgatacctctgattctgatgacaaacgccaatttgggttctgcaggtacatagaagttgccagcttttcttgccatcctcgccattcgaatttcagttctgtacatctgcctatattccttgtgatagtgctttgctttttcatagataagcttcctccttgcctttcgaagcatcttttgggcaaacttctttctcaggcgcttgatcttcagctctgcgaaattccttcgctttttcttaagggtttctggaacagcaggaacctccttcttcttctcttctacaccctccatggttccagccggaaaaagagctaaacttttgtctttaatggtctttctactagtcaaatctctcattccaataattgcaatatttaaatatttaatttaaaataagtacataatttgaatgccactaattcaggttagtccatatcttccaaaaccaggccaaattggtgatatttcc

SEQ ID NO: 55215 - DNA, 1016 bp, Homo sapiens
ttcagcttttcttgattttagacttttttttgttagctcagtgagactattaagaaagaatatttgtgagtttgtaataggagatttgttgcatttctttaaaatggctttttatattcttcgtaatttgtaatatcaggggtgtcatttctgtactcttaaccattttgccaatgtgaaatccttgcaaagtaatcggcctattacttgggaagacagaattgtatgaaatgactgtagaataattcaggatggtccccaatacggtaaaatgttaactttttagatgtagattttaagtatggtgaaatttgtagcagtgttctttagtaagttaactattaatatatcaagacctataactggacaactaataaataacctgtttcttaaaatgttagctttttctaaatattctgaaagtactggttgtaaattgctgaactcacaatttaaattatgatatgactattgaattcatcctcattggcttgcatagaaaattacaatcaaataatgctaaatgtaacttttttggtaatagttgtgtgtaactggttgttcattatagatgtgttattcaaaactttgggtttttaggttttgacttttcttaaaatacttttcttaaatgctacttaatgctttctctagggtatttttattagaatttcaattaacagatattttgatgtctgcgaaatgacagtactatgttagaaattgatgtattggctccttgagggcagtgaccctatttgttatgtttgttcctcaatcattaatagtacacatattaaatagtacatatacacttaatatttaataactcttagaagtgtcataggctttaatatgctcatactctaatgagccatttatcaataaaaagataaataacaagactatgtcttttaggactttagttagagaaataaggactcaaggttttaattaagtgctatatggctacagtaggaaagattggtttgggttggtaggctcagaatagtggt

SEQ ID NO: 55216 - DNA, 1069 bp, Homo sapiens
cttgaatgttaccaatactattgtatattccatatgcagcaatattgcttttttttttttagagtcttgctctgatacccacgctggagtgcagtggtgtcatctcggctcacagcaagcttcgcctccctggttcaccccattctcctgcctcagcctcccgagtagctgggacttcaggcacccgccaccacacccggctaattttttgaatttttagtagagacggggtttcaccctgttagccaggatggttttgatctcatgacctcgtgatccgtctgcctcggcctcccaaagtgctgggattataggtgtgagctactgcgcccagcccaatattgctttttaatcccccttcttaccctgccatgggtaggtggctgccacaacttttgccttattttttcaatatggatttttcatgtaaatgacaaaaatatatttagtttttttttagtttatggaaacggtatgcctatataatgttttccatgtcttgtgttttaattcaataatgattctaataaatagccgtattttttggatagttttataatactcattgctgtgatatactcttttgtgaaaatacccattttatcttttattggacatttgggttgatggacatttgaatatttaaagattttgacttaggccgggcgtggtggctcaagcttgtaatcccagcactttgggaggccagggcgggcagatcacaaggtcaggagtttgagaccagcctggccaacatagtgaaacccccatctctactaaaaataccataattagcggggtatggtggtgggtgcctgtagtcccagctactcaggaggctgagacaggagaatcgcttgaacccaggaggcggaggttgcagtgagctgagaccgcgccattacactccagcctgtgtgacagactgagactccatctcaaaaacaaacaaaaaaaaacaacaacaaaaaaagattttgactttaagaacaatactgctgtgaacttctttgtacttgtttcctggtgcatttatgcaagcgtttttgagagggtatatttaaaggta

SEQ ID NO: 55217 - DNA, 1059 bp, Homo sapiens
tttgtaaaatctcaaaattgcaaataatttgacgttattctcagtaatgaaggctgttaaatctcctctcttaacggcaggtatgaaatcatttgaggaagaaaaaagttcataaatacaaacttaaaaaaaaatggaaagacttttccatgcaaaaagatgcattgcaggaaggaggaagagtgtccttcatagcacaccacaagtcagtattagaggcttgcttttctacttgagtagacccaagattccccacctatcgtcttccaaagttacttgtgatccactgcaatcacaagttttacagtgtgtatactctaggtgtatggaaggatttgaattcacaaatagtcaaacatcagaagaataagctgataataatacatttgaaaagaggtcaagtatatttttgaaaactaggagagttaaagtgtttttgtgaactaaggaacaaataaggcattgacaatattttacttgattaggaattttgttcaggtgagtaaaactttaagcatcacttaagttttgtttttgtttcttacttttagaatatctgatctggacttctgtggatttatggaagagctggctttatttctctatcctgtgggaggggcaaactttgattttgtatgtggagtaacttgaccttcagtttttttggtctgagaacaaaggccaaaaaatatgtaacagttaataacgtaattcacttacttagtcaataaatatgtggggacattgtacttggttgacacttgggaatattgtagtgagcactactgatgtgagccaggcactttgcctggtaatcactgttcgtgtataatttaatcctaagggctgtgatgtagatgttatccctgttttacaaataaagaacttcaggcttagaatgattaagtactgttacctaactgataagtggaagctgagctccagagcaccctttcttaatacagtattttctacttgtcatgaaaacatgaagaaagctaggaaacattttctgtgttgataatgagccaataatgtgtatcagtggttcttaaactt

SEQ ID NO: 55218 - DNA, 1066 bp, Homo sapiens
cattatgagtttaaatacaaattagcgtaaagcttatggttaatttggattttttggactttctgaaatgctttgataattcattgcctcctttgcacatttttttcattttgatggttgcatttaacttctttgtactgattttttaaatcagccagtattaatttaacctattttcaatactaatatccatgtatgtaaatatccataactaaggcaaaacagttgattttagctagtttaaatattagtccattcatatttttgtaagtacataacattttcaaaatagctaaaatgtcactggctggtttgaacaactgtgcagttaccgaagagatgaatgtataaccttttctgtaaagaattttaagacatgaccttatttttttgcagaaagaaatctcttcattccaaagattttgcctttgctttcggtgttctagccactgaagtatatacctgtttaattttaataatgatgaagatattgatatctaactcaccagaatgaagttctaattttctaaagacctgaattatctggatgaataaaggaccattgggatggaggatttatagaacgtttctgagaaagtctagctgttgtggctttggtttgtttgtaaacaattgagatagctttccaaagcttttgcttatagaatctaatcactttttctatttattgtcttttgggcttagagtaaagaagggaagggaacactgttgcctttgtgagaatgggagagggatagatgggagagtagagggatgaagttaattttttattatagggattaacatttttaactattcccaatagtgtaacatttgacatttaagtgaaaggcttttagattaatatttttaaatttaaagatgtcttatgctaatttgtttttgttttcatagagaggatctgacgaactactctcaggcagtgttctcagtagtccgaactctaatatgagcagcatggtagttacaggtaagtgttactctcttagcagtctgtcatttgccattttagggggcagaatgttaaaactcaaatttaaccctg

SEQ ID NO: 55219 - DNA, 1132 bp, Homo sapiens
ccacaaaccctaaaacccaaattttaagtaaaaaccgaagaattcagctacatagttgtttaaaaccattgcaaccatagttgctatggttttaactaattttttgctgaaacagtattttaattctgagttgatccttttatgttgtctacctgcatatttaagatgatttgttttaatcttcaaagttagagttaaaaaaaattgtatatgtctgaaataatgttgtttgtagcatctgtcagtaaaacaatatagaccaaattttagaccttagttttatggctgatgggccaaatttttttttgtattttgtttagttttgcttgaattgacgtgttctcatctgaatgggccaaattttgaatttgattattattattatcaaatgaatttacctcacaactccacattttacattatttacctgaaaccaaagttcctttttctgtattttaactttgaattatttgcttgaagaacaaattatatttggcaataaaaggatcatgaaagactagaagacattttgatttcccttaggtagctgtgcttaatgtatacatacatcttgacacacacaaacacaaacacacatctctgacaattcagttaactaaaaattataaggacttaacagataatagtcatgatgtgaagataaatttgtcaacaggtcattatcattgattttgctatgtaatgattacaaagcaaaatcactgggccttgattttgatagtcaaagtaccatgtacacataattgaacaaataggcagaagtgtgtaactctggtttgtcggtttctctttttgtttttacaatgcatactgtgatcgataatgggaaattaatttggaattaatttccaaatatttagggctagtgacagagtaactagtagcagccttggcccctttttcagtctccccccaaaaccaaaaagtatgtaactgaataaaatacgtggaacaactgttgtttggaagtgatgagcagacggtataagatcatccttgagagaaggggtacacgtgaggtaagtatcatgaacactctggctttctgtcttggactattttactgctctaaaccacagagaagtggagagcccagagtatacaggtctca

SEQ ID NO: 55220 - DNA, 1097 bp, Homo sapiens
gtggcacgagaatcacttaaacctgggaagtggaggttgtagtcaaccaagatcatgccactgcactccagcctggcaatacagcaagactctgtcttagatagatagatagatagatagatagatagatagatagatactgtgaaacccagtgctagagtgtttatatttaataagtaaagataggtagagtatcggaacaaaaacagcatgggaaactaacaattttggggaatgaatgagtaatcaggattcaaagcaagtatcaaatgagtcgggaaattagaaaagtagaaattgaagtttttaggggtgctattagagaaattcagtgaggaagagagggttcacagttccttgttgactgatggatgtggtgatttaacaaattacccatgatccttgccgacacccatttatgtaaaaattgcaggtaaaagctagtggagaacaaaggtcagtcagcaggagaaaagtgatgtactgatcagaggtgaagatgctggctttagaattgaggtgaaaaactggttttgagtttggaagagaagtattcaagtagaaaccattttaaaattttatttgctttgaatccgtgattacatgaacatcttccctaagcaagaggctttgaaagagttgaataatgtatggaaaatggtgtgcttaaagattttttacattcatatacaatgaataaaatttatatgcataaataaaagcattacctcatgccttcttaactgaacataaacatttgaattattactggttttacacgcccaaacaaaagttctgggtttactggaggaatggaagggaaagatctctttcattcccccagtaaacctttcccattcaggatcatgggaagatgctgaagaattgtagaactgtaacacaggcagacctaatgcttcataagctaatgtttccatttttggaccctttttcggtgttgctggagtgtgtttatatttgaaaataggctttgttatattattaaaggagcccccattcccagtttcacattctcatagtatcatttatttaaaatgaagacttttataatatttggcactaagatatgaatactt

SEQ ID NO: 55221 - DNA, 1039 bp, Homo sapiens
ttataatcttcctaattttggtcaaaccagttttttcactttttaaaaatgttcatattagttcattataagatgattaaattacaagatacagtcataaatcttggggatagtgatgaggatactctcggagaaatgcattgttaggtaattttgtcactgcataaatgtcatagagtacatttgcacaaacctgctacacatgtaggctatatggtatatgtagccttttgctcctaggcaacaaatttgacagcatgttactgttctgaatactggaggcagttgcaacacagtaataagtattgatgtatctaaacagaaaaggtacaataaaaatatggtattataatcttatgggaccaccattgtatatgtggcctgtcaatgaccaaaatgtagttatgtggcacatgactgtgattgtattctttagtcattggacagtttctttatgagattacattttaatgttgttgcttattaataattactctttataatactgttaagaaacattaacagcaatcttaaatagttgataatttcatttaataataataggtggatatgattttattcctttgaaagcctggcatttgaattttcaagaattatttaagtattctcagctatgtttttaagttctttttggaaatttgtagtttttttacacaaataggaaaattcatacattcttttattgttgatatataaggactgttttttaatgtctttcagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggtacacttctttcagggtttatgaaatgttaaaccccaaactatccagcaggtgtgaattaattgtaaaagggagaaaatagtaggttatttttcttaaagaacagaagtcttattctcactttt

SEQ ID NO: 55222 - DNA, 1113 bp, Homo sapiens
ctgctgtgacacctcatcttcgtaaccaaccaatatatatccagtactcgaatcacaaagaactaaagacagataatacattaaaccaagtaagtatgtgtaggtacataaataaaatggcctagaacatattatgaatctcataaacattaataggaaggaaatgtttacctgttcagatgttccttataggcattttcttgttatttttaaggtattttcatgcagaatgtttctaagtattaaatactatgtcattttgaattcctttaatcccctggtcaaatgttctttttcttgttgcaagttaaaatttttgtgtagaaacttatcaggtaggatttattattagcataaactgtttatacaactctcctgcttagaatttaaggtaagaagttcagtgcctttggttatttgattttttttataggtcttaatttcttacggaaaatttttttttgaagatgtgttaatggttttcctggaaaagaaatcttaaggatgaagaatatgtgaatgtattgatgttttaaaaatgtaatatagaagatattgtttaaaattaatgtattcaaaaatagcattagaatgttttccgacctacattataagactgctgtaatgatctaaaactttagctgttttaatatagttttaaaactaatgatatctttctctgtcagtaaaatacaaactttttcttaataaaaatgtaatggaaaactgttcctcatagatttttgtcactttacaaagtgacaaaatcattttgttagtttatggaaaataagcttgtaaaactttttacctaaaagataggactgaaatttcagcttttttaatttgatgatgagtttttaatttcttttgaaaaagaatgtatgcttctaataatttatcaagaggaagaataccaaaagaaaatatctgctcttctttctttttacttagatttttttgcatttttaacttatttttaacaaataattgtttatacttatggtgtacaatgtgatgttttaatacatatatattatggaatgatcaaatctggctggttaacatattcatctcttcagtacttacaatttctttatggtaagaacattt

SEQ ID NO: 55223 - DNA, 1068 bp, Homo sapiens
atggtgcatcctgtaacctggcatgttttctcttgatgtcagtcgtttgctgccattatgtcactgctctcatgcatggaatattgtgggttggcctgccttttgcaccacccttcctccacctcacacttcacatggccagtgttaaatatcttgaggtctccctttagctatttcttctcctaaaagctatcccctgataagcaaagagtagattaggtttggattgagagtgttaactccgaatgagatactgctatgcacataaccagagtggctaaaattaaaaggataggtaataaaatactggtgacaaccatttttgaaaactcgaaatatctactaaagttgagcatatagctattctttgatgtagtaaactcgctcctagttaacatacctgagaacatgtacataggtatgttaaaagatatgtacaagaaagttcatggaacactgtatgtaatagcccaaaaaactataaatcatccaaatgttcaacagcagcagaatatgttgtgttgtattcatttagtggaatattgtatagtaataaaaatgaacaagctactgctgcctgcaaaacatgggtagtgtacatcataattattggaagaagccaaaccaaagtagaatacatctgatatgattccatttatgtaacttggaggaagcgtgagtatggcttctagagtgttgataatatactgttttttatctgggtaattatttcacagagatgtccaatttgtggtattttatggagctttatacttaggttttgtgtccttttgtgtgtgtgtgtaatattttgataagaagttttattaaaatctaggtttgcaagccaacactgctccatgaattataagaaaaaatatatgaagtcattaaaaatgaaatcataaagaaatgtatgaagtaatttgttactgatgtgagagaacatgattgttaagccataaaaggaagatagagaacaatgaatagtattaaataaaagtatgaatagtattgaataaaaatatgaatagtattgaaaaaaatacagactaagtataatattta

SEQ ID NO: 55224 - DNA, 1766 bp, Homo sapiens
ttgcatgttcaacattgatcccaaagcctggataatttttttgaatgaaatactagtagaatatttgatttattaaacaggtagtacctggctcatggcaggtgcttaaaaatatctgttgaggggccatttaattttgtttaatctgtgtaagttctaggaacaaagtgaactagtagtgtaacaggttgcaaagtatgtgacaataatgggtatgtttctaaactacataatcttaatttccagcgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaagtaagtttaatctgcataattacctataaattagagaaataataatatagtaaataagtaatgttttgattttaatgttttaacagatattttctaagtttggtgctgtattgaagataatcacatttacaaaaaataaccagtttcaagctttgctccagtatggtgatccagtaaatgctcaacaagcaaaactagtaagtctttcttttgagatggtgatttttttttattgaaatgtatatgtagaaaaatatatatatatgtatgtatacttaatgatatcttgtagcattacagatagtagaaattgatggcattaatattaagaaaccttaatatttgtcataaaagaaatatttatttttaggaaaatcatagttgtagttaaccatgatgtgggtttctattattttactttttttttttttttttaatttaaggacaaaagtttgtactcttaagaaaaaagcaggactatattgtgaatgtgcaccagcataagatttgaagtggcttttgctgggaatttcaaagtaattagttttcaaaagagtttggctgaaatatacagatgtggctcaaatgctatgataggctctcagtttatttaaaactatatattctctttaatgtcttttttttaaaggttttatgaataggtttctagtcactttttattcatatcatttatcttttttgtcattgttacatatggaggatgtaaggtcattgagagatgtaaaatttcccatcaaggctgccactgaaaactgcgcaccacatctttgcttccaagtaccttaatcttctgtttgtatatcttaaatctacttttgctctgtctctttaactttttgtgccatagtatctcattattattactattccattattaagccattaaaaattcattattaagccattattatgaaaccatttaataagcttacatttatcttaactggttttcttcctttcattcattcttttactttcagattaattattgtctctaatacttaaatgcttcctccagatcaagattacttctgtggagcccagaccattttttacaattgtttcattgcatttccatccacacaacctcattttgggagcaaaattagttgtaggtagcagaaaggctatacaagtaataatagcataattgtaatagtttaccaagtgccgtagtctcattttttctgaccactactctatattgtcaacaaaacagggttttcccctgcgttacaagaggatgctaagatttaaagaggtgaattacttacagtgaacaccacctataaggtagacattttttcagtcttagcctttctctccagtatgct

SEQ ID NO: 55225 - DNA, 2978 bp, Homo sapiens
tggaatattttccttgctcttctgaccccaaagaaaagtatttgttagaggaccaattaaatgaaatttgagtggggattatactgtgtttgagctataattcttaaggggaaaattgtttatatgtgtatcttgtctgaagtaatacatagttacattaaatctcataaaagtacctcaattgtgtcaactgtttgacatttttgtttaatcttctgtgaacagatactaagcatccaactatgatattgatgtttgtgcacaggtatgcactcaggtcttcttgacaaagatctaaagttataattctaagagagtagataattgttttactaagtacttattctggtatcagaactcacacttcacttattacagaaggaaaaagaaatttgtttcctaaacttgctttgccccattaccttgtaatctagaccctttggtaaaatttgcatttttgataactacagtaatgttcattttacttgcctgcatctgggctctacttagagaatatcacataatattacataatctgacaattggtaccagtttaaatccatcaacgtcaactacaagtaagccctctactctactttaaaaatctcttcccatttcttcagtcaacagtttttctgtttttcacaatgcctatgtcagatagaaattttcccttctaccatatctctcctcactctcacttgcttgaagaggaaaatcacatggaagcttcatcagcttttcttgcaaaatctgctaatactcacacttgtctttctcttttaataaaaggcatagatgtttagttatctaagaccaataaacaccaaagcctatcgtcttctgcctgtcaagagactgcactatctgtcatcccctttctcatttatttctctctatattggccacttttcaccagtttcaagcattctcagcttctttcattttaaatgaatttaccttcaactttcaatccatccatctataactctacgtactttctatcaccctgcctcccctctcccttttcactcataaccagacttcttaaatagtctatctttgttgtttattatctcatttctctacttactattatttggttttagcactgttgacccaaattgctcttcctcagcgtcaccagcgattagtagagtagctaaatgctagtgatatgatttagtccttgtcttacttaatacctagataatatttggcactgtgcaccattgtcttaaaattctctttcttcctggtctctgatacttctcacctggatttatcctacctctctatttcttccttgtcttgtaactccccttctacctgggaggcctcacctgctgtcacagctccattaaacctcttatgattcagacagagttcacatcacattttctagctcagacctctcctaagagacccacactaagaacctggcggactaatgaatatcttcaaacagtgtgttcaatctagctcctgtttttggtgtccgctgtgttaggaaagtgcaagataccaacttcagtctcattaacaagccagtaaacatggtatttttccctttccttccaacctgtcatcagatattattgattatacctcctaaatttttgttgaatctggccttttttctccaactcttgctaccattgcagtctaagccagtgttattcaagatgctggtctctcaaggtagtagtgtgtgtcaaactgaaatcagcatacttctagcaacagtatgcttaatgtcaatattggcataaattttgacacagacttcttatattcatgcagagtagcctgggcttctggaccgtcaatcataatttaagtagcattgatgtagtaataattctctttcatatctccacttccttggccttctgactgaactcaccattttgacatcttcccctacctccattatttttccacagagtactaggaatcatctcaacgtcaagtcatattgcttctaatcacaataccctttagtgacttttttgtccttgcaataaagtccacagtccttatcatggcttataagactctaaatcagtcctcagcttgcctctccattctcctctcatgcctttttagctatattggacttctttaaatagcttgcatatactgtattttctctgatgtctcgatcttacagattgctgttccatttgctaatactattttttctcttcatctctttatgcccaacttctgcttctctttgtctttcaagtatcagtttagaagcctcttcctgagataagtcttctgtaacatttcaactagattagatcccttcctttcttagttctcagtatcacacataaaatttataatttgttaaatgtgtatattttctgtcggactgtaagttctgagtaccatgtctgctttgctttctgctgtatttattaaacattgacattcagggtgaaaatcagaagtcatagtaacaatcttaattatcaataaaaagtattttatgcgatcctcatatttattaaagaaaacaccttaatacctttcagaaaatcttgtttatttattggaaagtagtgtattaggcaaagatgcgtcttctcttggctttctaattcagcttttataatgttgaggaatataattacttgatgcataaaaatatcaatctttttaatagtataataagacatataatgtaatctccttttcacctgggatttaaaaattgtttttacatagtccttacattataacacacataagtaggaaatggttctttttggtttttgttattagaaacagcttttcagaaacatgtctttattaggaatatctttagttgacactggacagtatattgtgtcttctggaagtcctgtttatatgatcattttattttaacatataagtgggttgtttcttattctttatttcttccaggagattccatttcatcactaactgataataaaaataaa

SEQ ID NO: 55226 - DNA, 2708 bp, Homo sapiens
attatcttgagcttttaatgtcagaaatctttgctccaacaagatcaccacattcctgattgctgaaccacaggactggtttgtgtgctactgctatttcttgggattttgcaaatacatgagcttgaagtgagcttgcatatattttttaaatttgattttactccctttcttatttgtggtcacctcctttaaccaactatttaaaatacctggatttttgctctcatacaccctcagctcctatttctttcctcttttgccaacagatgattaatttacatcttgtttgcttatttctctagctcttgtaccttaggtatacttctgcatcttccacctacataaagtttttgtttttgtttttaatgttcagagggaaaatttcaaagggtcctggagggctttctaacaattggcatattcattgttagataatttggcagtcggacctcagtattgctgggaaagaattcaactcctaaaaaacttagtgtgtgtttagtaattttgtatcagcacttttagcattaacctagatactgtgactcaaacccagctcttttctcataaggtatcattttctctttgataacattgaagtagtcacctaagagtgaattttgctacttatcttttgatatttatctattgtgtagaaacatcagttctattacttatctcacattttccctataggaatgctacattagtaaatgaatacctatcttcagtgctttcttcacctttacaccagggtattcaattaatagttatgttattctggctgataaagttgattgatacatggcttccacttttatgtgatgataggtaccttgcctaacccaaatgtaattcaaatcctgatgtgtatgaactctctttcagtttttaccagtgctgtattgaagtggatgaatctgtgttgaattattttctaggttagtttttaggtaggtagattagtccataaaaaaattcgtatattaagagaaaaggttttatattcccagaggtgagaatatttgaattaaaagctttatatacttaagcaactgtagaggtttactttttccataacacgacatgtttattcttctaatgaaaagttaacagtatgttcacctgttctctagtttgtttccagcttatatccagctgaactagaaatggtgattatataggagcagaaaaagtacaagataatcatagcggtaacatagtcctttataattcatgatgtattttcacatatgttgtctttaatttactcctcttaataacccttgaagaagcatgacagccattgtcatcattcctgttttcccgattaagaaattgagattcagagaggtcaaataacttgcttaagatgaccgaaaagagtctaggcttttaattaatcctagacctggcactcgtcagtttcagaacttttcgggaatgacattggatttgctaatttcatcaagataatctgattgggggtgaacatttcaggttaaggaaaatactagtttttttcttttttgcctcattttatgggaattgctattatgtgttaggataatttggtttgaagcaactttgtacaatgtggcatcaaatagcagttaccttctaaaactgtactgaatcatataagtactgccatccagcaataaatatatgtataataaaattaaccttattgagcagagtagtgtggtactactttggtaggacttcctgtttgtgatccttattagtttttttaaaactaacctatttgcaatttttaaaaattaaaagtattagcatggatgcttagctggttgtattttaggttgaagtagcattttctatttaaggaagataatatttgggggaaagtaatacatggacagctggaacagcaaaatttgatatatgaaatttgaatccttttcctggtagcttttaagttcgagtttttgttgttgagttttattactaaaattatactttcactaatttttattttttgtttaagattgctgatatgctttattcacttttacaggccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttaggtatgatttttattgtcttaaccacttttctcccattttgccaaatggaaaagtaccagtaagtataatgaatccccccattttggaccttaccaaattgtgttaggtttcgtgagttttctttttctcaagtgagaaggcatatgaatactgttaagaaaaacccaaagtattctttataagtctaattaaaattatatgttagttttgttccttttaataccttcagcttctcttccatgccactctcccagaacaaaagaagaaaagctctaatgaagaaatactgttgaattcttaatgccatatttacactttaaacttgatgtcactatgcctgagtctaggcctaaagttcttgtgtgtgtttttcagtgctgatctgattgttttaatttagcattgcatggaaacagtgaaatgttaagagacaaaacatacataatgggtggaggcatatgggatttt

SEQ ID NO: 55227 - DNA, 1063 bp, Homo sapiens
tttttatattagatctagctacttgactgaatttaattactttagaatcagtactataaattttaattgatttattttacacagtaattttttaagactaacatttatgtctggcttttctgtttcctttaatgctaggtatcacagtgtctcagaaaatgtaatttgttcaaagaaaggagactgagtgctttgtaatgagtttaaaatctgacatctaaaatacataatcacaaatgtggccgactattagtcattcacatattctgtttcaaagaacacagtgatcaaaaatccttcagattataaattgagacatcattataatggatcattttatcatgttaagaggtgtagttaatttattaaggggtagatcacttttagaaaaattgctggaagtaatttttcatgatcatgttatctacattctaaaaattaggagagagactgtgtacaaagagtgtttattttagagctttccttgtatttcaaattgaataacaggcattctcatcataaagtttttaaaagaaaggcaaagcagactttctgtaggaaatcattgacgttaaaatagttataattgtgaacagatacaacatttattcatgaaggtaaacatgtaggtcttatagaatattgtttctcaaaattttgctgcacgttgaagtcaccagattctaccccaggctgagaatagttaaagagtgggtcacaggcattcctatgtttttaggatctcaagatggttttactatgtagcaagagttgagaattactgctacagaaaagagcttgtaacttaatgtcatttaaatctattttggtacagttctcctggcacaattttaattagctgttaaactgaatttataattttctatatgtttgtgatacataaaattaactggaaaactttgattttctttctttgttacatttgtatgggttattcatttggtaatatttattaatttattattagagatttcagctatttgctaatataatgaatcccatacacctgtcatcttggttcaatagcgctgacacttagttt

SEQ ID NO: 55228 - DNA, 1485 bp, Homo sapiens
cattataaataatatttgaatgaatgtgttttacatctggaatgatttttatcatctgagtaaaggaaatatgtttgatggtagttgggaactttgaaggtattacgggctacagatgagaaaaaaatgttactacgtcatttcatgtttacatactgaccagcattttcaatgaaataagcttattactataggactataaaatgtttttcaaaggtttaactgtccagggcagatacttaagactatctgatcatccattaaaaacttttcacatagtcttgcttaaatggatccattatgtttacccattatattgttctcagctgtagttttaagaaatttatttcatttgttaatacttactttccattaccttccccttttctgtgacaatccgttgatacttgaagacctctcttgtattcatcttagggttaatatttttaaggccaaacagcctaaattctatggtaatcaactccagccttgtgtaatgaaatcttctgcataaagataggtttaaatcaaatcagattgcagattttattgaagaaattgtgtttttaagagttgacaaatatatgttgtatggctaaaacaaagaaaatacttctgttgcttctgcatttagtagaagaaaaactatatatgtttgtgaccaaagtataaaatatgattctttccagggaggtaaaggttatgcagaagattttcactagcagctctaaaaggctaccctcaattaattgccatgaacatttcatagccctagaaggatgttggctcatttcagtgtcatcctggtttattctttattgtattattcagcagtcattttaacactatgctagacactttagagattcagaagagtaacagggtttctgttctcatgaagcttatcagagacagaaaacatatgagttagatctaattggaggcaaactgaaatatatagtggagttagtgtggttatcagcacataaatgagtgatccatcaacaaaaggagaaattgggagggttttatgggccaaaaacagcatgattaaatgtgatagagtatatgtcatgttttaggtgtgatgaacattcagttatgtgtgacgaataggataattgaaaaaatatgaaaggctatgatgccagaaagtattatgggacaagatcttaaaaccagtgttacccagggagtatgaatttaatatgggaattcttaaactcctttatgactggaagatgagcatcagagtgtctgcgaccatttgatgatattatgtaccaagttttagatgtttggcttttttcaggttatgaaagcgggggatgagttaagaaccactgctgtgaaggattcatcaactatttttaggcagttgggtaaaaatgaccaatttagttttaagaaactgactgtggctccagagtatgttggagaagtgaaaatggagactaggaataacaggtgggagactattagtct

SEQ ID NO: 55229 - DNA, 1050 bp, Homo sapiens
ttgaaaacaattatgtcttaaatatttaaaattcttttaaacatgtttttaaccatctttaaatttttttggtaagtaattttcattagattgttaaaatgtatagtggcacggtagggttgtatctcaagatatgaagcagtttttcataaaaataaagtattaaccttaggctggtatgtttagatcaatactgtatttaaatagattgataattttttatatattttatgaatttatactttttcctgagatttcaggagggaaaaatgagtaggagatgactgagagcttaaagtttgggagtgtcaattaactcagcattcttttaaaaaacatgtgtcatatattacagcattttcttttatttgaagtgagtaaatgtatctttttaaattccttagtaatttttgagcactccatatgtataaagcatgtgaatatttggtagcattttacaaatgtccagagatttgtgagagttcctgagatcttcatagggggcccacaaagtttagtattacttttcacggtaatactaaagtgtattttgcctctttttactttttctcttaatagcatacagtggtaactgaaggctaatagtatgtgtgtttatgtgctttaaaaagttcgtggttttggccaggcgcagtggctcagacctgtaatcccagcactttgggaggctgaggcaggtggatcacctgaggtcaggagttcaagaccaaaaccagcctggccaacatggtgaaaccccatctctactaaaaatacaaaaattagccaggcatggtagtgggtgcctgtagtctcagctactcgagatgctgaggcaggagaatcacttgaagctgggaggtggaggttgcagtgagccaaaatctcgccattacactccagcctgggggacaagagcaagactccatctcaaaaaaaaaaaaaaaaaagttattggttttaattttggaaatgacaaccattaatagaacccacattaggccgggcgcggtggctcatgcctgtaatcctagcactttgggaggccga

SEQ ID NO: 55230 - DNA, 1046 bp, Homo sapiens
caaaaaattagccgggcgtgttggcgggcgcctgtagtcccagctacttgggaggctgaggcaggagaatggcatgaacctgggaggcggagcttgcagtgagccgagatcacgccactgcactccaacctgagagacacagcgagactccgtctcgaaaaaaaaaaaaaaaaaaaaaagaacccacattaacaaaaactccttgtgattctccatagttttaagactataaaggggagctgagaccaaaaagtttgagaactttttcactgtgggatacaaagttgaagacaattatagttaaataagcaggagatacagagtattttaatgaacagtagatggttataagagtcaagagatgtacagagaaaatgctagtgattagagtttttagattattttaattttggtaactaattataattcctcagttaagattttttggcttagtgggcccttagaattacttcttcctgttagaattaaaagtgaaaccagaaattaaagtgatttaatttttttattgtggcaaagatctagtccaaatatctttgatggactttttgaaaacagactttattgttaaaaagggaatttgaggcttggtactgaacttcttctgcatgccatattgaagttggtggttttttgtttgtttgccatcagtgggatctcatacagactatggaatttaatagaatttttaagatactgtttttcctaaaaggtagctaactaaaggcaggaaaatagaatgatgtaacaatataatgactacatctggagtttctgctactaataaataattgtattgtcaactttagtcaaatattctgtgcattcagtcagagctatctgaaaatactgacgaatagtattacaatatggggaggtcacttctcaagactgcaagaaaaaaaattgttgtgtgtaggaatgtttgcctaggaattaggaatgtatacttgacaacaagtgaacgtatccattgaatgttaaatgagaacaacttatggggaggatagtgagaggtatagtattta

SEQ ID NO: 55231 - DNA, 1534 bp, Homo sapiens
tggccatgagttgatcattgttaaagttgggtgatggctacttagagttgcattattttagtcacttttacttttgtatatgttggaaatcttccaaaacaaaatgtatagccataaaaaaaagggagcaaagtaagaaaaaaaggagagcctaaaaaaaaaggtacaggcaaaaaggtgtgaaaagaaactcatcaagagcaagagtattaaatgagaaacatatgccactgacagagttctcagaagagataaaggctgaattaaaaagagatggaggggaaagttttataagtcaaaaacttaggttaaggtttgtgaatattaaagagcgcttcagattgccaatgaaaggtcatagtagtttctataaagtcaaaagatcaaaaacttgacttaaaagagtaagatctctaaaaccaaaggtaacagcagattcttatgaaatgcaccagaaagctggaaagaaagaagaaataaaatgtgaacttatggaacaagagtgctaagggcctgttctacccaggtatgttatgaaatcaaattcatttagtttgggtgtttgttcctttatgttgggaagataaaaaagaacatataattcgtttcttgagtgaaccagtatttatgagaaataagctgggtgtgtaagaatttaagggatgaaaatattccaagttgattggtaattgaaaagtagatgaacggtgctaacacaaaagggaattctgtctagaataaatgaaaatatggtgacttaaagatagtaggacagcaataagactggaaattagaacaataaaataagaaggaaatgataacatagattgggaaaggataggaaaatactgaaacaaaatctgtgttgtatagtgatggtttcttgttctttcaaccgggagagtgttgtgttgaaggaacttgtattcattttaattacttgagtgtataattaagaaggcaagcacattttgctaagattttctttatttgcatgaattaaataatgatgttcagagtgatttgtctctaggagctgaaagactactacctttgtttcataagctgtaattatttgatttcaagtgtgagtttatgaagaagatagcacttgcggaaaaaagtgaattaccattatgtcgaaagtgatacttttttacatttggccttttactgtaaatcgtggaagtgaattttccaagcctgtgacttggaattatatttttcatgctttgtttgcttttccagaggaaatagagtattatatatttgatattttaacataatacaggtatgtactttagttcaaataattaatggttttgttgaaatcaattatttttctttactacacatcagcaaacaatttttctaaacactataaaaattaactttcaggaaccatttggaatggtcagccgtaagccatgcagccatcgtgcttaaattggtttttgtaaacgacttgtgtgtgtttcgtaaaatatgctttattttaaaattagggcttcctgttgcagctgttccaggagct

SEQ ID NO: 55232 - DNA, 1848 bp, Homo sapiens
atattttattttgaatgctatgaaagctggtatgaaatgtgggaagctcagtgtatcagtttatgatgtctaatttgaatatttgtttcatttttaattggcctctgttaatatgaacattagcttattttatccatttaatactattatcattcacagttctgcatgctaaaatgtttgaatcagagtgcctttgtttttattttaagacttttgcctgcatttcataaccagccatgcttatgcagttaaagttcaaagtttaaaattcctatgcatgctttccttccctatgttgagatgaaatgctgtaatttactctttgatatagatgtactttacccatatttgtcttggatgactacattttactcagtttttcttgtacagtacataaaccaaccattttctgaccaaattcctgcatttcctatgtactgacctatattttattttgtttttgttccccaattccttatttttttcttctgcattgctgtttcccttccccatttcatccttttccctgtgtgttcaccttccctttccttgtcttttcccaaatgcccattcccttccctgtcttatcctttattttccttgtccttgtcttcattccctgtctccattccctatgttcatgcttctgtgcttgaacaaatgttcctcggaccaacttgccccaattaaccgccttgaaccatgatccatgaccacctcaccattctgcgggaaccacccttcgttatggatgatctgttcatctccgctcttcctcgactcttctctcttcttgtcttacgctgcttgctcttctctccttctaaagatggttacgccccaaagtctgtttaccctcttcggtatgttattgttagcactatacttttattattgatttgatttttgtttcaccttaattcttatttgtagctagcactttggcttaaagttgaatagtaaatcttttgctatttttctttgctatttaaaactctccatagacacaaaatttgttttaatgcatgctaatttattttgcatggtctttaatttaatatcattcacatagctttgagggtttatcaaaaattattcttttcaaaattcactgttcaaaatcttgatcttctttattcatttgtgagaatgatgagattgagtgatcatgttgatgtctgaatgtttcattgatatgtcagaaagataatctttaggtgacttccacataaaattaattccatttttggattacctctctgtggctccaaaaaaggtgtttatggagatgtgcagcgtgtgaagattttatacaataagaaagacagcgctctaatacagatggctgatggaaaccaatcacaacttggtaagattaaactatgttttatctatacatcttcacttctgctttcaaatgcataatgtgaatgtgcgaataaaaataaactcctttacatcagtaagaaattattttaatggccagggctcaaaatgtcattttaatgtgaatagttgtatgtgacgaacatatttgtatttttctgctatcctcctactgtttttcaaatgcactcataataggaagagattttagcttcaaaattgtaataatagtttcacatgagaattatatcatttatattgaagattcatagtgatttttattctaggtactccttgttaatagaggctaactgttcatacagtccatagaatccttcttaatgccatgttattttaattcttctaaagtcttgcgataccaggttcttagaaaatgaaaagcttgtgctaaaaacactgttgttaatccctttgggaatcttaaaaggcactttagtcagg

SEQ ID NO: 55233 - DNA, 2556 bp, Homo sapiens
atgagactgagttatccagataaaaaataatgtcagcgagaagtagagaaacagatcatgaatttgagggacaattaggaggaaggctatcacaatatttagcaattaggatgtgtaacagaagggagaaaaagagctagggatgcttattaagtttctttcttgtgtagctcactatacgatttgttagcaggattgttgaggaagatagatattcataatctggattttcattctatgaaagtagctggcttttttgccagaatgccttgtctagttcaaatgaaaatgtacttaagtcttatcaccagtggctatggtaaattggtgatttattttaaaatcataagaaaattcaaatttttaaactgttacgttaaaagaattatgtttgttttgagctttgatattgtttgttaatagacatgctttctttttatagccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatcccgtaagtatataagctagagtgtattgagatacattctattttgataaaatatgaaatttattcttaatcttcactttttcttcccattcaattttcctagtccatcagtagcagaagaggatctacgaacactgttcgctaacactgggggcactgtgaaagcatttaagttttttcagtaagcaagcttccttatctttaaattagtgacctgataaaatttttaagtagtttttgttcttttcgtttatagaaatttttgattccggaatggccaaaattcaagtatttaataagccctttctaatttgtatgaagtgtctaattttataattttgtttcagaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaagttgggaggtttgatggttgtttaatttcatt

SEQ ID NO: 55234 - DNA, 1057 bp, Homo sapiens
tctcttggctagtacatagaagtataatttctcagtcataaggtggatgcataagttttacaagaaacttccaaacagagttccaaagtggctttactctttcacagtcctaccagctgtgggtgggtgtttggttcttctatgttccagccaccttttgatattctcagtctttttagtttcagctattctagtacatatgtgttgatatctcattgtgattttaattttcttctccctaataagaagatgttaactcttctttatgttcttattggccttccatgtatcttactctgtgaactgtctattcaaatattttgtccattttttaattttttaattgatttcttggagttcttaatcattctagttataagtccttagatcagcaaaagcatttgacaaaatccaacatccaatcataataatggccttcagcaattcattaatagaaggaaacgtctacaaaaatcctatacctagtatcatacttaatgttgaaaggataaattattttctcttaagatcaagagctgggcaagaatgtccattctttctacttctattcaatattgtactggaagtcctaaccagcgcaataaggtcataaaaataaataaatgatatttacattggaaaaaaatgggcttgcactgtctttatttgcagatggtaagattgtgtgcatagaaaatcctaaagaacctataaatacactattaaaataataagtgaatttaacaaagtttcataatacaaaaacaatgtacaataatagttctgtttctacatgaacaattggaacaatgaactggaaattaaaattttaaaatgtcatttacaatggcatgtaaaaactataaaatacttaggaacaaattaaaatatatgtagtatctgcactgaaagaattgctttcacagcgacgtggatacatgcagccaacaagcgtatgaaaaaaagctcagtgtcactgatcattagagaaatgcaaataaaagcacactaaaataccatctctcaccaatcagaatggttattaataaaaactcaa

SEQ ID NO: 55235 - DNA, 1040 bp, Homo sapiens
tctttaaagtgtaagttaattataaatagaactagtttacttcttttcacataaaatatgggaactgaaaattggacaattaactttgtgtaaagtgataaagttaaaagtttatttttttgcttagaactgaaagacaaatgctaaaaagtattcattattattaacttgaacatgtagtgcagatgtaatgtcacctttgtactaaaccagaatagatagttaaaatctaaatacagatctccttttaagtgttttggaattatacaagaatttctgagtagggaatgggaaaatattaaaaatctctgtgttgggaagacagtcattttaccttatactatattttaatttcctagtgctagaattttatggatctaactatgcatttataatttgtttccttctttattctccaattttctcttttcttgtttttctctctttactttatgtaatcttccctccttttttcactttttgttttatatttaccccttcatcggttttatttcctattcagtttgctttgacccttgtttcctctttatcaactttgtctttcctcccgtctcatgccatccttctcaccacaaaaggttctgtcagcagtgttattattttttgaatacagtgatgacatcctacttttatgttcattctgaattaataaaatatgtagtaactgttagtgcaaacaattgtgacctgactggaagaaaacgaaaatccttgaggatgttttcacacacaataaatgcatactaattaagctagtatgaagctttacattcagagaaaaataagattcataataaatgtttggatgaatattgagaattttgatgccttttttattttaaaatattcttttcaaataccctaacataaatcaaaaataatcaaattaataaatcacaataatttaaaagatgcattacctttttatatggtgcattttacccctatgcaagaactattttaatcaataggcaagattattcaggtgagttcaacaaatttgaattcctactgtgtat

SEQ ID NO: 55236 - DNA, 1007 bp, Homo sapiens
tcccctttccctaaggcctacatcctgatcttgtcttagtgggccttaccattttgatgattaggaaaaaaaaaacaaaaaaaacaaaacaaacaaacaaaaaaaacaataaaacaaaatagggctgatccaggactacttatatttctcttgcaaaaaatttcactctgtgccattatagctctcttataggttaagtattcttttatatttctccttggggaggaagtctaggtaggtgaaatagaaagaaggtgaaaagctctaagtttctctttttgaggtagcatatatgatcaacaataaaaccaaaacaaggaaacttcagaataagtttggggagaccttgtataggaccattttatgtgcaaacattcctagtggttttcagtgactgaaaaaccagtatacacaaatgacatgatattgaatttaaacaccatattttcaaggtcatatagggtattaattttaatgtaaatttgaactctccatgccacttcagaagatccattccactctcagcattttaaaaggagaattaacagttgatgtcaaaaaatggcagaggaataaggcctcatcttcagatgccagtgccttgttatggattctttggaatactgtgttaagatggagctgaaatctggtctgagcttagaaagagggcttagatccattaacactgtcttcctttggcacaggaagtagcaacagttttgacacacgtatttgctatccatgaaagagagtccactaagggatttcactgatgatatgttctgttaaccatggcctgtgaagaaagtctggtgaagaacaaaaagtgatttagcttggaagagatgggttaattcttttaataactccttatgaacacttactatgatctaggtggattaaatgtttacagttttgaagggcaaaactaggaccactgggtcaaaaaatagaagtttcaggttaattcagaaaatagatttctaattaaagtttccaaaatgaaa

SEQ ID NO: 55237 - DNA, 1037 bp, Homo sapiens
ccttcgatgtttcactgttgatgattctctttcctctctctatccatttccttggctacatcctttggtttcacttcattattggggtcacccccttgtgtcaatcttcaagaagatcagatttgtatgttctgttccattaattagtgttttctcctatattatatcaagatggaaattatgtaattgaagtattacattattaagggtatggaaaaataagaattattttataggtcctcgtttgattgaattaatttttagatgcctagggtataataagtagtacttatattgcatttcttgttctgtttgatattggaacattctcttcaatttcagctaaagtaatgaaaaataatccttccataaaaatgattaatttcatgtaattttcaccagttgtcctctgaagcaaccttttactcaaaatgtatttgtgcatatgaaaaccagtgcttcatcttttttgaaacaaaccttaaataaataggactgaattagagagtgagtcattttggtcaaagaaaggaagggctttcttgacattaatggtatttaaacattgaggtaaatataaaggaatttgagatatcagttgaattttctatggacttctttgcaactaggaaaaatgttagcttcctttgattttttttttttttaagagacatggtctcactctgttgcacaggctggagtgtagaggcataatcatagctcactacagcctcgaactcctgggctcaagtggtcctcccacctctttcttccaaagtgctgagatgtgatataggtgtgaactactgtgcctggcctgctttgaatgtcttaagagtcattccaccaggtgcaaaactgtactaagtgattcttaatccttaatgctttttggttatcatttaaatagtgtagagccatcttgtttgacctccatgtaactgatttgtgtctagtttctttccttcttctttaaaacaccagaaggcccttctcttttatgtcctgtacttctctagctggttgaattgtttgct

SEQ ID NO: 55238 - DNA, 1050 bp, Homo sapiens
tgggctcagtcgcagcctcccaagccccatcaataaagcccctattaatgcaccaccagtatatgaaggtaggtcaggtggcagccactcctcccacaaataagaattcacatggagattttttgactgcttcctggcatcttcccacagtttaaaatcctgtgcctgatatttgcaaaatatgcaggagcacacagcttcttagggctctccagagccctttttggggaatccggcaggtcagcccgaaggaccaaagttgtcaagcccgatggcacaaggacaactgagccacaaaatgaggccatgagcccaataatcttgagccaagatactttgaagactagcttggcttgcaggtaaacccaggcattcctgctagctggtgtcacttcagattccagagctaaaagggattttacagctctcctcctgatatgaatctgctccacaaaattcttgccagatggtcatctggtgtctgctcttttgctgtaatgggtgctcccctcccctcaaaggagccagtatgtaaattcttcctaatgctaagtcaatctctatgctccatacagctcctcctgctgttcttcgtttgttcccctgcaggaacacttggacatccctgtggagatgtgaaggcagcagctgtcatgggttaaattgtgtccctcccaaaattcatatgttgcagtcctaacccccagtacctcagaatgtgaccttatttgaaaacttggtggttgcagatgtaactagttaaaatgaggtcatactacagtggagtgagtccctaatccaatatgactcatggccttatgaaaaggagatatttggaaacacatacacagggagaatgccatgtgaagatgaaggcagagatgggtgacgcttctacaagctgaagaatgccaaaggttaccagcaaaccaccagaagctagattcttcctcagccctcagaaggaatcaacttgccaacaccctgaccttacatttctagccccctaaagcatgagacaataaatttctgttgtttaagccacccagt

SEQ ID NO: 55239 - DNA, 1056 bp, Homo sapiens
acatattagtgacccaaatacactcacaagcagcaccataccatgatagaagatgaaattcaagttattaaagttcctcaatacaatatcaaataaggcaatgatttatttttactttctttatcttttgaagtgacttaatcactttactgtggtgataataatctctatcagcattaataaaaaaatctcagtgcgtattagtttatgaggtggtcagagaagcctgaaagcaagactgcattagcacaagagaagctggtcacatgactgaacagcagtggcatgccttgtcatttttattacctgttaaggatggatcctcagtcccatctccagttgtctgagcatcaaatggggaatggtggacagggctgcctaagctttcttcttgctctttcagagatatggaatttttgtggggggatttatgatttgtgttttcatgaggactagcttctgatctttttctaggaagtggtgttggtttggctggctggtacacctgactatggggagctatggggtggtaggacggtttctctgcttctccttcatcctcctcctcctcatcatcaatcacaaccagctcagcatggatgatcccatcatatcctgtcagaaacttcttatcttcttcactgtcttctgcctgctgataccccatgaaaatcattgtcaccggttctgtatcatttatgtctggaggcagggaatgaacgatattatatctgacatcttcctcgtcctcctgacaagtgggtgaagaattctggtgttcagatttcccaaatattgtctctctggggctcagccttggctttggagagggtgcatctttgtcctgcatgacattcgattcttcccaaggagtcattagccttttttgcggggtgtgaagcttctcttctgcttgttgaatcactgatcggggatgaggcactggcggaatgggactgatgtgattgaagttgtttcccctttcctctgaaagaccattgcccatattgtgtatggattcatttacaccaatacccagtccattagttttaatct

SEQ ID NO: 55240 - DNA, 1074 bp, Homo sapiens
attaatatgatttcacttatatgaggtacctaaactagtcagatttacagagacagaaagtacaatggcgagtaccaggagctggtgggagaaaggaaatgggaagttagcgtttttttttttttttttttttccttttttgagatggagtctcgctctgtcgcccaggctggagtgcagtggcatgactggattctaggctaagtggagctgcagacaactttgacccgtttgacaaacttactgtgggctcagctcactgcaacttctgcctcccgggttcgagtgatcctcctgcctcttcctcctgagtagctgggattacaggcatgtgccaccactcctggctaaattttgtatttttagtgaagacgggctttcaccatgttggccaggctggcctcgaactcctgacctcaagcaatccgcctgcctcagcctcccaaagtgctggattacaggcgtgaaccaccacacctggccaaggttagggtttaatgggcacaaagtttgttaaggaagataaaaagtttcagagatggatagtagtgatggttgtacaacactgtggatatgcgtaatgtactgaactgtactttaatagcatttatcattattatgtattttttgccacaataaaaaaagtggaaaaaagctaatgttcatagcagtgctattcacagtaaccaaatgatggaaacagcccacatatccatcaactgatgaacagataaattgtggtatataaatacaatggaatattattcagctataaaaaggaatagagtgctgatacatgctataatgtggatgaacctccaaacattgtgttaagtaaaagaagtcagacacaaaatttacattttatgattacatttatataaaatatccagaataggtaagtcaatagagagaagagagattgatggttaccaggcactgggtgtggggcaagaagggaatagaaagtaattgcttaattagtataaggttttattttggggtgaaatgtcttgggactaaatagaggtggtagttgacaaattgtgaatataagaaatgtcactgagcgtc

SEQ ID NO: 55241 - DNA, 1005 bp, Homo sapiens
ttatgggtggttggtatccacaaattgcaaatgcctagtcttcactcctctcagtttttctttttgtttctgtaataaacactctgggaagtttttcaaaagttatttcttttgatagtaattattgttaaattaaatgcttttatatctttagcaatgttgccaaaaacaatgagcaaaatcatgttttcttctaaagaagtgatgcaatatgaaataaagatgtgtgtgcttttcagaaagaaatgaaagaaattctagaaaattgtggttgggctggcattaatagctgaggcaataaaaaaattctctggtctgcagaaatcaatcttaagggcaaaggtagtctatagtatgggttatcaagtaaatgaatcaaattcactttagtactttatttttgtcaaggattttgtctctaatgtgtgttaagcaatacctcatcccttccacatcctgcaccagtccaggctgcagtgggaaaagacaaatgcagcagatgccaactaggaagctctcagggcacatgtagtgtttggctgaaattctatttatctgtatattctcatgaggcagggaaaaaaagaacaaaggtccttgtttaagataatccattataggttggaatgaaaggaaagattcttctaagagtcctttttaaatcagattaggatattcacagttcctatccacatcctgcttctttcttccttgtgcagcccctaccaagctcatctctgcacccaggtcacagatggttaccagcctggaatgcccttctcagtgaaacgggaaatgttcccttgtcccccttgcagggtgtggaatggggatgtggctggcttcttcagtgccccactgctcaaatctaggggagcatacagatgggcaggctgtggggctccgaccccacagcaatgtctaggggtgaatgtttgcagctgaagccccagtgggcatgtgttaccacgtgctcttttagtttagctgtccatagttagcttg

SEQ ID NO: 55242 - DNA, 2534 bp, Homo sapiens
ttaattgttcaggaagtctgcaataattagtagtttggagtgggagaatttctaccctggaaattggggtgaacagtacaaatcaggtttttttaaaaaatttaatttacctgcataacgctgcccttaaaaacttatgttattattcttgacagttgaaatattggatgatgacagaattcagatccttcagtcatttactgcagtggaaacagaggtaagtccttttcttgttcattgacacaaaccttaatggtaatacttttttttttcatatctcaatttttctttcagggtcatgcttttaaaaaggcagtgttggcaatttatgtctgtgggaatgttacttttctcatcatatttttatctgcaatcaaccatctatgagcaagcaaagaccttggcttttgcaggccaagtgataattatcatcaaaccaaagaaacttgaagcctgtcctgactgcctggagcatatttgtgaattctcacttggaagactggggtcatgtctgtagaggaattctgaagtccagcctttagagaacaacattcaagagggtcatatagactataaattaatgtcatgccctatatgtaattctgggtcttaaaggaaagattgtacttcaggagaagtaactctcaaatatttcatgccaagattttaagaatgttggtatttaagaaaataaatagtgatttggaaaatcacaacagatgtcactaggataataaagagatatattacgatatatatatatatatatatatatatatatatatatatttttttttttttttttttttttttttttgagacagagtcttgctctgtcgcccaggctggagtgcagtggtgcaatctcggctcactgcaagctctgcctcctgggttcacaccattctcctgcctcagcctcctgagtagctgggactacaggtgcccgccaccatgccgggctaattttttttatatttttagtagagacagggtttcaccattcacaggatggtctcgatctcctgaccttgtgatctgcctgcctcagcttcccaaagtgctgggattacaggcgtgagccaccacgcccagcctatggtaaatatattttgaactacaaaggtgctgtggtactttaaagaaaaactatttttactagtttatctgaatggtctgtggactttatttagaaactgtttttcagtttagttttttggacatatcctttgctcagtgtattttgttacttctctagtaaaggtagaagtgaagcagatgccattgtaggttttaccagcatttaaatatattatgaattgcttagcaatgaaatgcaagtatgcatcttttacttaaagatactatttatgtattcagctacagagatgaaatagcattttatgtgttaattgttttggctataaaatttaagtccttacagcatttggggattatacacttggatttcaaaattgataaaacccttgtgaacatatctaatagatattctgtttacttgtagaaataatataatgtgtctggttctgttttgttagacattttttatgttctactgaatcagaatagtcagtgttatattccttatttcaagaattcatctattttatggctacatctcatatgtgctatgaggacttctagccagtgggtggcgctgtaataccgaagtactgcactgctttgttcctgtttccttgtgctgattcctttctagtatttaggtaacattaccggatggcatttcccttaaattccaccaactcttaatctttattttaaaaatggctactttttttgggtggttggggtaagggttaaaaccttaaattagtaaccgctgtttattttccagtttatttgttttctgtgattatttataataattgatatttgtttttacaagtcccctgaccctgtaataatgaatgcagctatcttaggcaaagcaaataaataaactgggcatttttaaaataaaaaatttaggaagtcatactttatttctttaggtattctttctgattatgttatagtttctgcttggcccgagaacctaatttctatatggtgtgaataatagcctcagctatgtagcctacatctttattttattaatatttttcaaaaattttctcattatttcttttttatatttttattttttgaatttacttaaccaactttctactaatagcctacatcttttactgggtaaaataatgtggaagtttagtttttgttccttttataggtgtttatcataagtggcttagggcttagatatgaactttctgtgttcatattctatatgtgccatgctacttataatctaaattttccttttgaaggtctttattaaaaaaatttagtatagcaaattaagtgtgtactaaagttattttcctccagttttctatactaaggagcttaaatgttaataaatttctcttaagttatattctacatctgacaaagaaaaattctctcttttttttttttgtgacaaagtc

SEQ ID NO: 55243 - DNA, 1049 bp, Homo sapiens
atgttctcacttataaatgtgagctaaacaatgagtacacacggacataaagatagaaacaatagaccctggggactccaaaagaggagagggcggaatgggggaaagagttgaaacactaccctttgggtactatgttcaccacttgggtgatgggttcactagaaggccaaactccagcattattacgcaatatgccctaaaccgccccccacaattggtaattcataatcagttgcccatcttgccctatctagccttataattttaaaagtctgaattaactatttggtcttagatattaatcttcttttatctcaaactcttttagtatgttttacttgataatacacatacacaaacacacaattgtctctcttggtgggactacatttgaatgtaacttttttcttttgtatgtagtggcagcgatgttcctgggaatggatttaccaggactgaatcttcctgattcatggaaaacctatgcaatgaccggattcgtagcctggcatgttgggactgaggttgttctggaggtacatgcttatcggctctctcgcaaaggtaacctggtaaaaaagccatgttatgtagaagcacttctatacaaaccattggaaaagaatgcgcttcccgatagtaatggctgactgctacattgttagctcactaaaaacttgtgatcactcagccagtgctagaaattgtgattttctgcctttgtttttttacatttgttactattagaagttgtgaataagatataaaggaaaggttttaggttttaggcagggagtcttccttgtaagtactttcactttgctggtctgacttagagccagtatggactgggaactctgaatgcctagagctgaggaaaccctgagatggaggaagaagagactcaaagtcaacactggatggaggtgcagacaactttgacctatttgacaaatttactgggtgctatcatttaggttgtcatgtgcataattatgtagctaggagcaagccagataggaaggactgattttgcttttgctctt

SEQ ID NO: 55244 - DNA, 1054 bp, Homo sapiens
aaaaatccaacttattccagtcactttatagccaagattcatgctatagtatacggatacatttccttttactggttacgtaaaacctgtaagcaagagggaaagactgttactgcattcagtatggtaatgagtagcccacaggtaggtcagttattctgttctaaattgtaggcattgatggcacaaaagcatttctctctaattcaagatatatttatcttacttagaaatcttatctgtttccagtatagtactcctcaaaaatgtttacaaaaaaggcttaattacgcaggtgcagttgatttacagagaaatcctgtttaatgattaaaataatctgtacacctgtttgactaacttgggggaaatgaatcatcctcaaaatatatttttaagtggttatttctatttttggttattacttttaaaactttcaggtatttttgtgacctgctatttctttggagtgtataatgtaaatttaaatactgaaggtatctgatgtcacgaatactcattcgataacctaaattatacccctttttcaatttggcttgtaaattaatgttagcaattattttggtatgttagacctcatcactaaaatcaaaatgtgtaatttaccctatttctgataataatgacttgctaatgtgtgaattttaactgaatttccaagtacaataagtcctcacttcatgtcgtcaataggttcttggagcctctgactttaagtgaggctacatacagcagttccttgaataatatcatttccttcaatatcgttttgttatgacattgatgaggaaagaatattggccatgttgtatgttgttttgcttaaagtcacaattttcaagaacttacctatgagtttaagtgaagatgtactgtacatacctctttcctatttgagatattttgttaaataatgtaaagtctatcaagtatgcgcattagcttccttccttctccttccactgcgctgtatcatcttattccatacatgatctctccatgccccaattccaggatgtccccaatcctgaac

SEQ ID NO: 55245 - DNA, 1033 bp, Homo sapiens
atgttttttcctctaatgaggtcaagtaaacattttttttttaaacttttattttgggttcaggggtacatgtgtaggtttgtttataggtaaattccatgtcacgagggtttggtgtacagattatttcatcactcaggtgataagcatagtacccaattggtatcatctagcattttccaaactaacttagccttatggactgcccctggaccatcacctatttttcttttctctttgcggaatggctattaatatctcacagattgaatatcttatggaacactggaaaaaattttatggaaaaagtttagagcttctttgcctataagatgactgttttctctccaggagtacttttgcatatgtagacctcattgtaattgtaatgtacaacctctaaacatttttttttgatattactaagctttttaaccaacccttttgtctttttctcagttactttgtcagggcatccatttaaaggctttctcctagaagcgcgtaatgctgaggatctgaatggccctcctattggctccttcacattgattgacagtgaagtgtcacaacttttgacctgtgaagatatacaggtttgtgtttagagttgatccttgaacaatgtggaggttacaggtgcagaccccacccctggggaaattggaaatctgtgtataacttttgactccccccagacttaactacaaatagcctattggtgaccagaagccttactgataacaaatagttgattaacacatattttgtatttatatgtgttatatactgtattcttacaataaagtaagctagacaagagaaaaatcttattaagaaaataagagaaaatatatttactattcattaaatagaagtggattatcataaaggtctttattctcattgccttcatgttgaatgggctgaagaggagaaggaagaggagtggctggtcttgctgtcttggggtgggtggaggaggtggaaggggaggcaggagaggcaccacactggtgtaactttatagaaa

SEQ ID NO: 55246 - DNA, 1006 bp, Homo sapiens
tggtggcgcatgcctgtattctcagctactggggaagctgaggcaagagaatcacttgaacccgggaggcggaggttgcagtgagccgagattgtgccactgcactccagctcgggcaacagagcgagatctatgtctcgagaaaaaaaaaacagcattgaaaagagatctttgtttccttatttttcaggtaaggaagtggaggattaaatgatttgcccaaagtctcacagtaatttgtagagctgagattgaaattcgggtgaaacttcacatatcacattctttttatcaggtatgttgagaatatggtttgctgaacacagaaagcaagtagttatctagaattatggtccagttgtgtaaaagcttttatattttaattatatatgacaataatgggcttttacccttctttttgagatggcagtttctggatttactcttggtacctgcatacttctgttgcacattagttatgtggctaattatcccaatggaaaagtaacacagtcatgccatggaatgattcctgaacatggtcatagtccacagtctgttcctgttcatgacatttacgtgagtcagatgacattcaggccaggagatcagattgaaggtaccgtgctgggattaactgtttacattttggatttcactcttttactgtttattgaatctttattattacttgatttagaagatttcacttaaatctgttttcttttgtaagatactatcatacttcttatttttggttccagatgactgtattacttaagtagtctgtgtattccccatccagaacaggctttaaaataagtttttatcgttatttactatttttattaattgtgctatcacttcaagagaagagaaaaatgaagtttattttatcttgtttaaaatataataaacccttgtccttcttgatatcatataattttaagaacaattctctaatttctctggtaaaatgtaggctgattattaaagataaatctat

SEQ ID NO: 55247 - DNA, 1072 bp, Homo sapiens
aattagcacatattgaggagatggaaagttaatagtgatattataaatagtggcaattaccacttactgacaacttgctgttttcaggcatctatggatttttacattcattctttctggagttttagttctatgaaataaatctctacattgctattcagtctcttataaagcagatttaacattctgaattaggtaggcgaacttagatttcaacctttgtcccaatagctccccactcactttgtttgtccctgtgaaatgttgatccttgctggacctgtttacttttcaccttctctctaaacagggaacagtgatgaacagtgaaaagaacatggctattgcagttagattttggttcaaatcctaaaagtatgtgtgatttagggtatattccttaacctcagtttcctcatctctaataagaagataaatctgctgcttataaggattccatcagacgtggtttctaactgccgggtcatcactgagtgttcatttcttttcgtctttctctatgtctcctttcctttgactctacagtaaaactacaatccttttctttccctttgtccacaaaattttattgctgtctttatatatcttgtgcttagtcttaacttgctgactctgtcaatctccttatccttctgtggttttacctatttttctaaaagtcttcctacctaactctgctactcagcaggtgaacacctatttccacctctatccccagtctaggtttttggtgacaatgctaagcccaccaggtttgccccaaatcctagatgaaatgctgagctaagaaatgtacactgtccccagattactggaggaacccgcccccaatatttcaacataggttctttctattttcagtaagtgtcagctggctgagaaataaagagagacagtttaaagacaggaattttacagctgggctgctgggggtgacatcacatatctgtaggaccctgatgccccctgagcctcaaaaccagcaagtttttattaagggtttcaaaaggggagggggtgtaagaacagggagtaggcacaaagatcacac

SEQ ID NO: 55248 - DNA, 1134 bp, Homo sapiens
cactccatgtattcccaccctggaccttggcttcaacctgatattatgcaatagaatagtattaggatagctcaacttggatatgcttaaatctagcatgtccaaaaatatcccctgcccattctcgatcctttatttctcagcttccctgtttatttcgtggcatctccatttttatagttcccagggtagaaaccttatattctttgatgatttcttctcttttcctgcagtctctttttaagcttgcagtttctttccaaatatctctgattgcctgtctattctgtatggctgaatatagatgccagaataatcttatgcagtctcttccctttgttattaagtggtatgtataaaatcaaatttaaatacctctgtctgacttctaagacattctgtaatgagactacaccttccttagccaagattgtatctcattctccatcattaatgtcatagatctttacagttgcccaagtcattcctgttaattcccttctcagcaggttttctcatgcctgtccttatacccgtactcccatcagattcctttatatctgttaaatctcatttactgtcagtctatgtgttgcctaagtttcaactttcagctagaatatcacctcctttgtgaagtctttccctaatttttcactgtctgcttcctttgatttccaattacacaatgagcacagaactattaagtgctgaataatgaagcagtgtctaaaggcttgttagtcttacagtgtcagactagggtttaaaatctgtgagaattgatgagggcaggtgactcacacttgtaatctcagtgctttgggaggctgaggctggaggaccacttgaggccaggagttcatggtcagcctggacaacatagtaagactttatctccacaaaaaagaaacaaaattagctgggcatgatggtgcttgcctgtggtccccagctacctaggaggttgaggctggaggatctcttgagcccaggagttaaaggctgtagtgagctatgatcccaccattgcactccagcctgggtgacagagtgagaccctgtctttaaaaaacaaaaataaagggccgggcgcagtggctcacacctataatcccagcactttgggaggcc

SEQ ID NO: 55249 - DNA, 1071 bp, Homo sapiens
ggcaacattgagcactgagtgaatgagactccgtctgcaatcccggcacctcaggaggccgaggctggtggatcactcgcggttaggagctggagaccagcccggccaacacagcgaaaccccgtctccaccaaaaaaatacgaaaaccagtcaggcgtggcggcgcgcgcctgcaatcgcaggcactcggcaggctgaggcaggagaatcaggcagggaggttgcagtgagccgagatggcggcagtacagtccagccttggctcggcatcagagggagaccgtggggagggggaggggggagagggagaccgtggggagggggagggggaggggggaagagggagagggctcttttcttttctctctacctgttttagttttttaagtctgttatatgttagcaacattgaattacgttaatatatgaattatgctctcagtttgtatgtcagataagttacaaacaaaaaaggcatactcagaagaaaacgtagaggttgtaggtctggaaggggttgacaatcacaccctcatttgtttgcagtatgttgccatgcattgcacttttacttaagctaggttaagtagctttacgggttatattatcttaaataacagtctctatattactttgtaaggagaggtagagtaaccaagaatagttcttttacctcacaggagtgatcgaacttaaaagatgagttagaaagtgtttgagattcgtccttttcagaaataacaagtagcattagatagtatgatacttagaaaatattttcagaaaaaataaaaacttaagtctttgatgtaaacatgagtgagaaagttaagtgcttttttgaaggaaattgatgcttggagcagagtttggcacatattttcctgcaaaagttcagatcgcaaatctttgcagcttttcaggcaatgcactccctattggagcgactcaactcccattgtagcaggaaagcagccataggcaaacatacatgaatggatgtggctgtgttccagtaaaacttcatttacagaaatggggattaggctggatatactttgccaaccctt

SEQ ID NO: 55250 - DNA, 1035 bp, Homo sapiens
cctcagatgcctgccattgggtacttaattcaggggtgaggatgggggatcatggtaaatggggttgtataagaatttgcacatcccaagttgctatgtgaataggaatgcgtttccaggggaaggagaaagagacattacagagcagacagctctatgatgtttactatacttgctaaaatgtgaaattcagctaaattggaatacaaagtagtgccaaaacagcattaggtttgcggagttattttaaacataattgaaaaatcaaggttttttaatactttaaataaaacatctgtttttcaatgtggtaatttaagtcctacgatgagtttattaacatgtgctttttatttagggtatgagctacagttccgattaggcccaactttacagggaaaagcagttaccgtgtatacaaattacccatttcctggagaaacatttaatagagaaaaattccgttctctggattgggaaaatccaacagaaagagaagatgattctgataaatactgtaaacttaatctgcaacaatctggttcatttcagtattatttccttcaagggtaagtcaggtgttttgtttgtgagaaaaaaagttaatttgttctgtaatttgaagtcacctaacttgtaaatgttactgtatgaaccatggcagtgcaatttttatagtgcttccttgagatgcaaatagaatattctttgatttctaggaggtaattttatggtccattgcagagctaaagtatcaagtaaatgtattttaagtaacatcttaaaatgtagtaatttcatgcaacctgattataggttgctgtttatttgcgtgcccttgttattactgataggttttagtatacttatatttcattaaaccaacattcttggatattttgtgtattatacatgtaattatgtagattgtgaaagggtaaaagtagcttttccattaagttttgttgcaacttttaaaatgattttatgtgcttagaaataaatacattttatttgggacaattaaccttttag

SEQ ID NO: 55251 - DNA, 1022 bp, Homo sapiens
aaaaaaaaggtacatgtatacatgtataacaaacctgcaagttgtgcacatgtaccctagaacttaaagtataataaaatatatatataaaaaaataaaaaaagaatagaataagtgaatgctgatgtaggcagaaaagtgggggctgagattgaattgataggaatccttgtgtctttcttttatgttatttttgtctctgtttctttctcccccacacccctcgtgtgtgtttgcgcgtgcacgcacgtgcacacacgtgcacacagcaggatgagaaggggaggaggtaggaggatacctgtgaaataaatatttgttttattttcagtgaaaaaattataggccaaaaattagaaaatagtgacagttataatctctttgtagatatttgcatttaaggtatcgtcttttctttcttttagaaaataggcgagtaaccaagtctgatccaaaccaacaccttacgattattcaagatcctgaatacagacggtttggctgtactgtagatatgaacattgcactaacgactttcataccacatgagtatgtaatgtgtttttttctgtgaaataataatattacttacaaacctttatggctagtatgattttcatactacttattaaaaacgcttaatagaaaatgaaataaagtaattcactgtaattctactatttcagcacatgacattttcccactttttctgtgtgtgggccatgtttctatatgtgtatataaacatttttacaattggaaaacatcatcagccataattgaaatcccgatgaatatatttaaggtttctgtgacctttgttagaaagtttttaaatgtagaatctgtaaagccattaaatattatatctgcatttctccatctgctctagcaaggggccagcagcaattgaagaatgctgtaattggtttcataaaagaatggaggaattaaattcagagaagcatcgactcattaactatcatcaggaacaggttttacttatttttgaactgctgctt

SEQ ID NO: 55252 - DNA, 1006 bp, Homo sapiens
gttgtcttctagcatagatcagcgtatgatgctcttccaagtactacaattgtttctatggcatgttgtgctagtggaagtacaagaggctatgatgaattagtgcctcatcaggtttgtttatatgttgtttcttaaaacctacatggccaacaactttgggcatttttattaaaaaaaattcattgtaattaagatgtatccatgctaaattttacctttgtccagatttcagtggtttctgaagaacggttttacactaagtggaatcctgaagcattgccttcaaacacaggtgaagttaatttccaaagcggcattattgcagccaggtgtgctatcagtaaacttcatcaggagcttggagccaagggttttattcaggcaagaaataattaaatttgtttcttcaggttcaatttcagagtaagtctttccagtttgagagctaatctagttgttctttctgcttctcaggtgtatgtggatcaagttgatgaagacatagtggcagtaacaagacactcacctagcatccatcagtctgttgtggctgtatctagaactgctttcaggaatcccaagacttcattttacagcaaggaagtgcctcaaatgtgcatccctggtaatgcaatctaaaaattgttactgtatttgtattatattattatattaaattatactgtaatgttatggttatatatcatgtatatatcatatatattataacacagtgctactgtggacgtacttgagaaaaagaatttaaactttttggtaacttggccaggtatgatggctcacaccagtaatcccaacacctcaggaggctgaggcaggcagatcacttgagctcaggagttcaagaccagtctcagcattatggtaacaccctgtctctatcaaaaaaaaagtacaaaaaattagatgggcatggtggcacatgcctgtagtcttggctactcctgaagctgaggtgggaggatcgcttgagcccagcagg

SEQ ID NO: 55253 - DNA, 1045 bp, Homo sapiens
ggggatggtggtagtaagtgtgcattaatgaaacatatgcattatataatgtatattttttaaatatttagacctgtaaagtaactcgtagttggctgataaaactttgtaaagcaaggatctttgggagctgctttaataaaaatgaaggtaactagtatatcacatatatttaactatagattttagtgtgtttgaaaatctttttctcttaagaatattaaataattactgaaaatatctttgaacatgaaataagctaatattttttgtataaaatgcaaaagtaaattctaaccaagccatcatccaaactcattaaatccaaatgaatggagtttagatgaatgaaattttcttgtatattttcccccaagaggtgagaagagatttaaaaataataaaactgaactttataaatatcaaacatccaaaaatttagaggagaattagtgattagaaagcaagttcaagatcgattagggtgacaaacaaaaccctgaaatattttttgtgcacaggactgtaaaggatttatagaagtactagcaatgtgattgctgtatcaaatcagtgtgattgtaatgtctacattcatacccaaagattataattatggatcattataataattatacaatagttgattattatattttactatatagatatactcaacgtttacaatttacaaatttatgtggaacttttagaaaaagttgaaattagattaatagaattgtgtgtgtgtgggtgtgtgtgtgtgtttcagaactggaggggagtggaatgaagagaagttgggtaatggctacaaaaatacggttgggggccaggcgcggtggctcatgcctgtaatcccagcactttgggaggcccaggcgggcggatcacaaggtgaggagatgatatcaacctgaccaacatggtgaaaccccgtctctactaaaaatacaaaaaattagccgggcgtggtggcgggcgcctgtaatcccagctactcaggaggccgaggcaggagaatctcttgaaaccgggaggcaga

SEQ ID NO: 55254 - DNA, 1446 bp, Homo sapiens
gttgcagtgagctgagatcataccactgcactccagcctggtgacagcgagactccgtctcaaaaaataaataaataaataaaaatacatagatctcattattccagtccagaactatttgttgaaaagactgtccccttttttctgtacctttgtcaaatattgtttgacaatatttatatatggtttaatagactgaatatttgtgctcttctcctctctgtcccctgcctccccaaattcacatgttgaaatcctaactctcaatatgatggtattaagaagtagggcctttgggaggtaattaggtcatgaaagtgcagccctcatgaatgagattagtgcctttataaaaagagaccccagagaactctctgttttctgccatgtgaggatacaatgagaagacagacatctgtgaactcagaagaagggcctcactagaacccaacgatgccagcactctcatcttggacttccagcctgcagaactgtgagaaataaattgctgtgtttataagccacccagtctatgatactttgttacagcagcctaagctcataagacatatggatctaaatctggactatattctgttccattgatctatgcttctgtcctcatgccaataccaggttttgtttttttgttttgagatgatgtctcgctctgtcgtccaggctggagtgcagtggcgcaatctcagctcactgcaaccttcgcctctgggttcaatcaattctcctgcctcagcttcctgagtagctgggattacaggtgcccgccaccatgcccggctaattttttgtatttttagtagagacgggctttcactatgttggccaggctggtcttgaactcctgacctcgtgatctgcctgccttggcctcccaaagtgctgggattacaggcgtgagccaccgcgcccagccaccagttttgattactgtagttttatagtaagtctggaagtttggtagcttaagcctttcaattttgtttttctttttcaaaatcgttttgatggtctaggtcctttgtatttccatatgattttaaaataagcttgcttggtttttgtttgtttgtttaccaaaaaagcctacagcgattttgttcagaattgaattgcatcttcagttaaatctatgacaaaggatgtgatcatcactaggaaagcagtcaggtattagacactgcattaagtccttccttgaatccttgaattcaagtaagatctgatagatctttttttggagacgtagtcttgctctgccgccaggctagagtgcagtggcatgatctcggctcactgcaaccttcacctcccgagttcaagctattctcctgcctcagcctcacgagcagatgggactacaggtgcgtgccaccacacccagctaatttttgtatttttagtagagacgaggtttcaccatgttgg

SEQ ID NO: 55255 - DNA, 1812 bp, Homo sapiens
tgttctatgcctttgagcagtttcaggttttgggctgctgtagcacccaaagtagattacatctgtagcaaaaaaaatctctagggaactcactgctgagtcatccgtcaagatctgatgtctctatccaatttaccttattttcttcacctttcagagtcttctggtagttgctttttgtttccaattcaaggtttttggttgtaattagcagaaagaataaggtggagtgtgcttatttcatcttgagtctcttggtttctgtttttttttcttttttctttttggtggcaggtggaggagagacctgcaggccctctcccttctccctctcggtgtttttaaatatactagttttcatatgttgtaatcttatttatttgccctgtttattttgtttttcaggcaaatgaagataaaacaatgttcgccaacctaaaatacgtttccctgggaattttggtctttcagactaccagtttggttctaacaatgcgttattccagaactttaaaagaagaaggacctcgttatctatcttctacagcagtggttgttgctgaacttttgaagataatggcctgcattttattggtctacaaagacagcagtaggtatctaggttttttgtttttaatcaatgcaatttatttagtttgcatatatatattggtaactacacatttgcactcttgcattgtcgaatggcctagtatgaagaatatttcaatattttaaaaattttcttaagacattttaagtctagtaataaagccattttaatctgtatcatgattcatatcttctggttaattctgtaaatataaaatagtttcttgcatttataataatttgagagtaagagtaaattttataaatctgttactgttagaactctagaagaatcataataatttttttactaatgtaaacaccttctgttttatttgctttattgattagtccagcagtgactaattttatatagttttaaaaaatagttctattgagataattcatgagccatacaatttatgtgtttaaagtatattatttaatggtttttggtatatttcaattataatgttttaaacctgtggtaaagtatatacacataacataaaatttgccatcttaactatttgtagtgtacacttcattgtcattattttacagtgttgtacaacagtgtaaatttttaaatcacttttatctaaaattttttatctaaattttatctaaaatttttaatctaaattttatctaaaattttgtatcactttaaacaacaactttgtaactgttaagtaataacccccattctcccttacccacagcccctagtaacctctaattcactttctggctctatgaatttgcctattctaaatatttcatataagtagaatcatgtatttgtccttttaggtctggcacttagcaaaatgttttcaagatttgttcacgttgtaacatgcatcagaactttattcctttttatggctgaataacattctattgtatggacgtaacacattttgtttattcatccatgtgttgatggacacttgggttgtttccaccttttggctattgtgaataatgctggaaagaacaatgagtaatgcttcagtagatgtacaagtatctgttcgagtccctgttttcattccttttgggtatatatttaggagtagaattgctaggtcatatggtaattctatgtttaactttttaaggaaccatcaaactgtttttcacagcaactggatcattttatatctccatcaacaaagtatgaaggttcctgtt

SEQ ID NO: 55256 - DNA, 1027 bp, Homo sapiens
cttcacaattactaattggcatgaatggctgatgataaacaaaatgcacaaaatacaagtttttataacattgctataataaactaagaatacttggttaacaaattaaaactttgagattttggctgtcataaatatgtgtttgtatgtgtttgtatatatacatatatgtagatatacataagatacatttgattatatatcagaataaaagaatatgatttcttaatacattataatatttaacattttaaaaatcagcatcataaagatatattttagtcctaaaagtatcttgacatgtagctcaattttgtttttctataggttagaaaattgagatcttgagagcagatatgtaacttattcagagttacttaattactgatttttctcatattattttctagaatgtagtctaagagcactgaatcgagtactacatgatgaaattcttaataaacctatggaaacacttaaacttgctattccatcagggatctatactcttcagaataatttactgtatgtggcactatcaaatctagatgcagctacttatcaggtacttaaaatacatttctttcttttttaaaaaaacttttttcttatacataataattgtatatatttatggggtacatgtggtattttgatacatgcatccaatgtgtaatgatcaaatcagggtatttaggatattcatctccacaaacatttatcatttctttgtgttggggacatttcagatcttctcttctagttattttgaaattttgagtaaattattgttaaccatagtcaccttactatgctaacactagaacttattccttctctctaactcaatttttgtacccattaaccaatctttctttattcctccccctgcccttgtatctttcccatcctctggtagctatcattctgctctctacctccatgagatccccccgctccctttttttttttagcttccacatgtgagtgaaaatacgatatttgtctttctgtgtgtgcctgggtt

SEQ ID NO: 55257 - DNA, 1664 bp, Homo sapiens
tcacacctgtaatcccaggactttgtgaggccaaggcaggtggatcatgaggtcaggagatcgagactagcctggctaacacagtgaaaccccgtctctactaaaaatacaaaaaattagctgggcgtggtggcacgcgcctgtagtcccagctactcgggaggctgaggcaggagaattgcttgaacctgggaggtggaggttgcagtaagccaagattgtgccactgcactgcagcctgggcaacagagcaagactccgtctcaaaaaaaaaaaaaaaaaaaagaaagtaatctaattttatcaaaaagaaaaagttaagtgtaaaattatttggaatgtcagtggaaaaaatatatctcttcagacaaactaaacgatatatcatgtagactttacttttttttaggtttctttggaagtatatttggattaatgggtgtatacatttatgatggagaactggtatcaaagaatggattttttcagggatataaccgactgacctggatagtagttgttcttcaggtaaagcatttaaagtcttagatttaatgctaataaactgtattttaatataaagaatcaaagtagctcctgatatactgatgtgagggggaaaaggtccctcctgttagtgctctcgtatctagtttattcaaggaagtgaaaatagaagtgatcttaatgctgtaatgaaatcttattttgtacaggggtctttaatgaactttgtggttttaaatgtaacataatgaaaatacaagtttaagaataaaagagttgaagctaaaggcaaatataacttttgatttttacaagtcttatcattgtacaggaagtctgggtcagccattaagacccaggaagcagatctagatatttaattctgtgacagttcatagcctcatattgtagttacatattggaaaacatctgtcaaattcagtttatatatagcttggaattgttcaagggttgagtaattaattacatctttaaaaaatacatatggagaattctagaggatataaaaatgaagatacaagtcactatccttagagcctcctattcttctagagatatttgaagcctaggaagcaaggctccagaaaggaaggtgaagatggcaaaggatagttgtgttttaaaagcaggtaggatacttctattttttttttttttttttttgagacggagtctagctctgtcaccaggctggagtgcagtggtacgatctcgtctcactgtaatctccacctcccaggttcaagcaattctcctgcctcagcctcctgagtagctgggattacaggcatgtgccaccacgcccagctaatttttgtatttttagtagagacgggggtttcaccatgttagccaggatgatctcgatctcctgacctcgttatccacccaccttgacctcccaaagtgctgggattacaggtgtgagccaccgcgcccggcccggatacttctattttttttttttttttgagacggagtctcgctctgttgcccaggctggagtgcagtggcgagatcttggctcactgcaagctccgcctcctgggttcacgccattctcctgcctcagcctcccaagtagctgggactacaggcgcccgccaccaagcccagctaattttttgtatttttag

SEQ ID NO: 55258 - DNA, 1360 bp, Homo sapiens
catcttaaaattgctggcttgagaaacaggtgtttcctgacatgattaggtattcaagtagatcctgctaaagatattatagaaaggattcctgcagtggatacaaaggtagaccacagaatctttcagttgagcatgaactttcagtccatgccattccaaagttccagaaagctaagaatagttcataatgactaaggaagacagtgtctagtaattaataattaccaatattaatgtagcaatttcttcaagatacattacaggatgttttatgttatcctaataaccttatatgtataactgcattcgagtcttttgaagagttaaccatttgtatcaagtcaaatctagttattaatcataacagataattactgagctccctatatatgctaggcactgtggctaccacagtgaatgaagagcatatggttgagcaggggagtggacttgtaaataatgcatcatttaatgacagtgtggtaagtgttatgctggggtagttctgcctaggggagtgagtcttggagacattagacctgaattattatgaataagcattttctaagaagcaaggaaactgtggacagagggaatagtatctctaaagacactgtcaagaaagtgtatgttgtgttcactgattggagtggctgaattatagattgggtggcatgaagtgggaaggatgagtttggagggaccatattatgaagggccttttaataatgattagtaattatttttcgtttataggcaattaaaaacaaaaaaacaggagcatggctttggactattagtagaaactttaaatccaaaactagcttatgtctctataatagcattttaaaaaatgtacacattaaaagttaagattgcactttgggaggcggaggtgggcagatcacttgaggttaggagtttgagaccagcctggccaacatggtgaaaccccatctctactaaaaattcaaaaaattagcggggtgtggtggtgcacactggtaatcccagctagtcgggaggctgaggcaggagaattgcttgaacctgggaggcggaggttgcagtgagccgagatcacaccactgcactccagcctgggcgacagagtgagactccatctcaaaaaaataaataaataaaagttaagattcaggctggtcacagtggctcatgcctgtaatcacagcacattgggagtctgaggcagatcacttgagcccaggagttcaagatcagcttgggcaacaaagtgagacctcagctctacaaaaaatagaaaaattagccaggtgtggtggtttgcacctgtggtctcagctacttaggagactgagctgggattgcttgaacc

SEQ ID NO: 55259 - DNA, 3017 bp, Homo sapiens
ccagcatggtgaaatcccatctctactaataatacaaaaattagctgggcatggtggtgcgcgcctgtagtcccagctactcaggaggctgaggcaggagaatttcttgaacacaccaggtggaagttgcagtgagccaagatcgtgccactgcaccccagcctgggtgacagagcgagactccgtctcaaaaaaaaaaaaaagaaaacacacacacacacacacacacccacagtatgaatgaaaaaaataaaatacttctttttttttttttttgagacagagtctcactttgtcgccaggctggagtgctgtggcgcgatctcggcttactgcaacctcccactccctggttcaagggattctcctgcctcagcctctgagtagctgggattgcaggcgtgagccactgcgcccggcctatactgtatatatttttaaagactgttctaatagatataaaaactgtaaaaaataagtatttttatatagctctcatggattttattaaacagaattggctcaaaaatactatgttacagactgttgggtacccttgcctaacgtgaactggcagtgttaccttgcttttgcagtaatagtctacagattgcaggtctcatcaattccatccaaagtttaaaagcatttaaaattaccaaatctttaaaatcactttggtggtgattccaaattggtaccaagcaaactttctggatgcccaacatgattttcagtaaccaccctttagagtatttgtttactaagttcaccacattttgaacatggtagttttagactgcaataatatttagacttacattattacttactgctaagtaaaatctaaatcctgcaaatgcacagaattcaagctgaaatataatgatttatgtttagctcacattgaagtattggttggttacttatgtattaatgcagtgtgcattcacatttaatcaggtttagtctgtttctattttaataattttaaaaaattatacaagcaaattagatattagacatgttagttacaatggtaacacatttttaggtgtcgaaacacaattttcaaaattcctaatgaaagttataaaaatgtaaacaagaattgtaaaaatggacaaagtagtcaaatatattttcaaagcacaattttattagacaggcataatttacattttgcttttctagtgggtttgaaaatgtttattggagattgggctatgtagtttataatttttaattcataaaaaagtaatcatacatgagaaggtagacctgtgccctaggatcatgtcacatatacagataatgccatttccttgtgtgtgtgatgtgtgttttgatgacctccacaggccttactgtatcaagcttttataatgatgactccttcattatttaaattcctatactttttatttgttatcacgcaactactttgttcaatgtgaaaatgtgctaactcatgggagaagagtgccaattgatagttcttttagcaattaagaatatggtatttgggaagaaaagtttgaaatgcaacaaatggatatttcaacacagtagtattatattatcagttctttagtaagtgattttagagatgttgtaggctacttttacggtggaatatatagtatagagatgcaaaacttaaatgtttacatcaatttatattgaatgtcacataatttcatggaaggaaaggtagcttgatatttagattctaagatataatctgaaaggaaactaattatgttctctacacttactgtaatactgattattcttacatatcaaattattgaactttaaaaatttcattgtatagtcattaaactgagttgggttttttcttaaagggtttagcatcactcatttgatttacacattcacattataatatttaattatcatgggtgtatgctttacataaaaaaggtttataaaagttatttatgctatattgaaagtcatcttaagaatctccaggttatttaaagtagttataggagcagagaacaagcacctttatcaaaatctggtcctatgtgccttgctttaccaaatacctgatttttctggagggtgttcctgtaattcacaactgtagacacatgggcaaaattaggatttttaagaataaatacatttctatttttttggttgtttcaacattagctcttcaaattcattaacaaaattaaaataggtatattacaaaagcataaacatttgtgaacagtacttaaataaattgtgatactattgctccatcattgaactttttgaaactttaacaattgtataaaactgtcagtttgttgtttcatttgtaattacaaaataatttaaaaactttttaaaataatttggatcctgactttgtctatatctgtatttcatttgtttagaaagattcttttgggtttgataatgtaatttgtatatttaaattttttatggacataattcaaaggaatgtataaattggtcttttgttaaatggctttttaattgataaacttctcttgtcattttttggtatccagctattacctatttaatagatttattgaaatagattattttcataaagaactctatacaaatctttttctatatttccttattttcctatttacctgtgtctatgacctaacctatgaattagtcttctctctttatatatcaaaaatgaattactgatctttttctctggctctgtagtatctctatcactgtcacatgtgatctttcttccttttctctagcccatattctagcatgaaatactgggttggccaggtgcagtggctcattcctgtaatcccaacactttaggaagccaaggcagaagaatcgcttgagcccatgaatttgaggccagcctgggcaacatagccttgtttctacaaaaaatcttaaaaataaaattagccaatatgtgggcatgcacctgtggggccagctactcaggaggctgaggcagaaggattgcttgagcccag

SEQ ID NO: 55260 - DNA, 1142 bp, Homo sapiens
accaaaaggacaagactgtttctgaaacactacattatctcttaagttacccattacttacggaaaatgattttttactgttcccttcggttcctgtcttggttagaacacagctggagattgtgttaatagcttaggacgtctgtttccgtgagcaggtaacaactttttgaaacaaattccctcatctgctgaagaagggggacaaaaacggcccctatcgcccagaaccgttgcgaggatttagctagctggtgacgccggagcacgaagttgtacaggtagccagcagcacccacgcgagcccgcggttaccctggccgcgcggctactgtagagtgggctggcggcgagcgggcggggcggtatcacgcgggaggggcggggcccgctcgtcggctgatcgcacgattgtgacgcgccgccggaggcaggccgggccctcaagatggcggcgggcgcccagagcggctcggcccggcagtagtggtgggacggcactagctgctggggcctgccgccccgggagtggctgcagcagcgccaggaatcgaggatggtaaaatgacccaggggaagaagaagaaacgggccgcgaaccgcagtatcatgctggccaagaagatcatcattaaggacggaggcacggtgagctgagttccgcgccggcgagcgtccctcggggcccccatccggtctctccttcagacccccacactgccgtctctaggcgtcccggtgcctccctcccttcccccaccctgtccgagctgccggtgcctcggggtcgcggacccgcatgccgccgctccgggaatcgtcctccgctgctcgggcttgcggcctccggggcccgtcctctttctttcccgcacctgccgccctctgctctggccgcctctgcaggccctgcggcctcgaaccccacgtgcgcctccgccgcggggaggaatgtgcggggctcccccggcggcccgcccgccgcgcccctcgtcgccgcagcctcgcctcgccttcgccgccaggccccgcggagccgtcgccgcgcttgtcaaggggctgggaaccatccctgctctcccatatgttgctaacggggtggcgtctggcgcggggatcccgctgcggccccgtagtacgtt

SEQ ID NO: 55261 - DNA, 1197 bp, Homo sapiens
ataaatatcaggggaatattttgcattatttgtattttaatccatcccagctttaaatttaaaaagtataactattgcagtcatagaaatgattgtaaaatggtagttgcttatctacctctctacttacaatagttcagactactattatgaactttttttgtttgtttgtttgagatggagtctcactctgttgcccaggctggaggagtgcagtggcaggatctcggctcactgtaaccaccgcctcctgggttcaagtgattctcctgcctcagcctcccgagtagctgggactacaggcacgtgccaccatgcctggctaattttttatattttcagtagagacaaagtttcaccatattggtcaggctggtcttgaactcctgacctcatgattcacccaccttggcctcccaaagtgcagggattacaggtgtgagccaccgtgcccagactgaacattttttaagaaaggggaaaaaattgccatttgatactctgttgttgtgtgttttttaattcatcgtatcatagaatatttcagtgctattgctgttgacctcagagtttcagagtttttataaagttccgccaatgggtagattcattcagtgagatgtctgaggctctatggtcggtacatgacagtcgtgaacagtatttcacatacctggtcaatggtactgatttgatcccccttctgatttcttcttttcaacaatgttaataaaattctttcccgttgtcctgctaatgacatatatgtaagcctatttggccagtttaaatatttataaacaaaactagtaagagttgttaatgatttttctgaaaattagagcagattagagcagatttgtagttttcaacggctgaagaaataaatccttctaaatgagccagattaatcgtaagttactgatttttttattgaaattgtatttcattgaattgtatttcattcagctgaatgaaaaacaggccaggataaagctaacaagtaggctacctatgtgagtagacacaattaagataaattacattaaggtgtgtgattttatattaggtgtttttaacctgggtctgttcaccctgaagttgtttgcaaaattttcttttggctatacatgtttcttggaagagtcccaaaaggtccatacttcccaaaagtttaagagcaattgttctgtttga

SEQ ID NO: 55262 - DNA, 1016 bp, Homo sapiens
caagatgtttaacctctgcatatcagttttctgatagggctgttatgagggattaaatgagataatatatgtaaagtgcccaatgtagtgccctgtgacatattaagtaccatataaatatttggttattaatggtcatatgcatgtcatacaaatctgaatatgtaaaataaatcagattgtagtatgaatggatgttcaaaaaggtaaatgtagaaattttattaagactgaaatatagcatgtgatttttattttggtttttattctttaggtattacatgaaacctttcctaaacatacatttctgatgaacggcttaattcaaggagtaaaggtaggatcagtcatacatatatatgtgtatatatacatacatacacatacacgcacacggatgaacatacataaatacatatatataactatgcgaatatatgtttgtttactgattaataacttaatttttataattagatggagtatattttgagagataacttaatactttctagacttgagttttaaatatgatctaactacaatatagccaatcatgcataataataaaccacatcataacagattccctgtttttatgttggcattttaattccagagatctcaatgattttgtaagactacagattgaagaggaaaaaactatactaaaaaacccccatcaatataaaactgtatcagtagggtaaagagttggttattatatgaattctttgctctttctttttcgtgtttttttttttttttttttttttttttgagacagagtcttgcactgtcacccaggctggagtgcaagtggcatgatctcagctcactgctgagaacctctgcctcccaggttcaagcgattcttctgcctcagcctcctaagtagctgggaccacagacatgtgccaccacacccggctaattttttgtatttttagtagagacagggttttgccatgttggccaggctggtctcgaactcctgacctaagtgatctgccctc

SEQ ID NO: 55263 - DNA, 1612 bp, Homo sapiens
gaaaaacagtaatggatggattataatagactttagtttgttgctgtttttggcagaaaaagcaaaatcacttaacagttcaacagttggtcaaaagatttgcctgaatacatgatctaattttaagtattcctgtatagtagctgagctgctattgaagggctccttctagccctatgttttcataatatctgtggcttatatttatggaatagttaatccatgaactatcctagtaagctgttgactgaaatgagctgctcttacgcttaattaacttataaaaatgaaagaagattaaaacaatggtaattgctctaaccatttcttgttatctttcattcctaggtggtactttgctgttatctctgtttctggggtttttgcagtgactttttctgtggtatttgcatacgtagcagatataacccaagagcatgaaagaagtatggcttatggactggtatgtatgtttattctataccttttgtatctgctgagaaatgccttgtttttaagataaatattattataaggagtgcaaacctttgcattacaagatttttgcgtaaaatatattttgtaataaaatcattcattagactacatttaaaatttttttgcggtatgaggctatgtaagttttgattcttttcatttagtagatattcataagtcacatgtcagaattgaaattatagtatattttaccttgtagagttctttttaacagaatcctaaaaataagaattatttagtatgtcaagagttaaaaaaaatcactactcatttaatgtctaatctaaaatacaacaggctaacatctagctcagggatcagcaaaccttttttgtggctttgtgggccacgtacagtctctgtctcattcttttgtttttgcatgtgtatttatgtttataaactctttaaaaatgtaagaaacagccagatttgagccatagtggtaggtcgccaactcctggacactgttttggtaaactaaattatggcagtataatgtgtcatctatcaaatctaggaattaaaggaaaaaagcctagtaatagaatgactactataggcacaataatagatcactactgaatagccagaaataggacagtgatgcatttcggtaaatgtgagacaaataccttgtgataaataaggactgaatattgtgttgggctgaattagttttaaaagggactgatttctgattcaaaggacgttatagtgaagaatcataagatttttggggaggaaacacctatagagagaaagttagaaaaagaactaataatttctggcctgttcagtggctcacacctgtaatctcagcactttgggaggttgaggcaggcggatcacttgagatcaggagttcacgaccagcctggccaacatggtgaaaccttgtctctatttaaaaaaaaaaaaaaaaaaaaagtgaaaagaaaaagaactaatgatttcagttgtaaacttggaacattaaatgatacaaggctgatgatagccaggatatttaaaaaatagtctaattaagctatagtttacataccataaaatttatcctttttatgagtatagttcagtgaattttagtaaa

SEQ ID NO: 55264 - DNA, 1516 bp, Homo sapiens
gggccaggcttggtgtctcatacctgtactcccagcccttcgggaggctgaggtgggaggatcgcttgagctcaggagttcgagactagcctaggcaacatagcgtgacttccacctctataaaaaataaacaaaattagctgggcgtggtggtgtgtgcctgtagccccatcaggagatcttcaggcaggaagatctcttgagcctgagaggtcaagactacagtgagccgtgatggcaccactgcactccagcctgggcgacagagcaagacccagttcccccactctcgcccccacaagaaaaaaagataaatggcacaggtaggaagagaaaagggagggtgtgcaacagaaggcctgacataaatcaagattatgaaaggagttatgtggtgttgaggaaaaaagtagcctgactaatctctgtctatccttaatttattgcaggtttcagcaacatttgctgcaagtttagtcaccagtcctgcaattggagcttatcttggacgagtatatggggacagcttggtggtggtcttagctacagcaatagctttgctagatatttgttttatccttgttgctgtgccagagtcgttgcctgagaaaatgcggccagcatcctggggagcacccatttcctgggaacaagctgacccttttgcggtaagtttatactttttccttctccttgataaaaaagtgcatgattcagtgcagcattaatattttgttgtggatatttctttagggaaaacatcttgggtttttcttttaacattttgaaatacttttcagaatagtttggggaatatgaaataaataaaaaggacaactagttgtccatgagtacactgccaaaaggaatctctgcgtattcttaagaatagttcagtggttttgatagaaaaccttatatcaatcagtctttttcttgttctagtccttaaaaaaagtcggccaagattccatagtgctgctgatctgcattacagtgtttctctcctacctaccggaggcaggccaatattccagcttttttttatacctcagacaggtaaaatcctcttccactaaggtggacttttctttcattgtctagtgctttaataaaaatatttaatcttgagagaactgtaatagaagtggcctttaaaaatgaatatcattggacttggtatagtggctcacgcctgtaatctcagcactttggtaggccaaggtgggtggatcagctgaggtcaggagatcaagaccagcctggccaacatggcaaaatcctatgcttactaaaaatacaacaactagccaggcgtagtggcgggcacctgtaatcccagctacttgggaggctgaggcaggagaatcacttgaacccaggaggcggaggctgcagtgagccaagattgcgccattcactccagcctgggtaacaagagcgaaactccgtctcaaaattaaataaataaataaataaataaaaagaatattatttggtctactagactttacct

SEQ ID NO: 55265 - DNA, 1055 bp, Homo sapiens
atttgtaaaatgattctgagttcttgataagtatctccaatttagtatatccacattgagggacccaccatggataagtaggcatttttagtatgttaagatatgttgtatttcctctgaggaattctttgtttataaatgaattacatttatttttttctggcccattaaatgttaatatacaagtagctgcagtggttttctatctggtatacatttgtattcattaatgttaccttttctggaaacccttctagataatgaaattttcaccagaaagtgttgcagcgtttatagcagtccttggcattctttccattattgcacaggtgagtttctttttttagttagagtgatgtcagtgaccctggctggccatccaaactggggcctcatctagtgatggtatcttggtggaatcaacaaagtcaggagtctgaggttgataggttcagaaattcaatttgtttgtgtagctagtgttgatcagatttttgggactgacacatttaatataggatatataaacgtaaaagctagtttattgatgtatactaggatatatgtctggatgaagttagaagtttcatgtcttgtagtccttgtcctatttattcactcattcaacaaatatttattgaatacctaccgtgtgtcaggcactggggatacagcagtgaacttaactaaattcttgcttttgtagagtttacattctggtgggataagacagaaaataaaaacaccaatgtaaacatatcagatgtattgagaactacagagaaaaagctaagggtcatatggagagtgacttgggagaatggtcttaagggcacagggggcatggttgagaagaccttgctaatgcaaggtgacatttcagcagagacgcaaaggtatgaggaacaagctgtaggattatctggaagaagagaattttaaacagtacaaacaaaattctcaggagagactgtagctggcttgtgtaagaaacaacagggggccagtgcggctccagttgagtgaacagttgagagcatcttagaaactgaagt

SEQ ID NO: 55266 - DNA, 1468 bp, Homo sapiens
aagtatgtaatcccatagcaacaaggccctgaaagttatttacattttttgtttttctggtcaggaaaaagaaagttgtataaccagtgatcattactgatagcaaaccagaagtgaaaacaatccagttattttggtgccagcttcatgctgtgtctcagcttttctgaccagtcgggtttcctgcaggggacttgagtagtgacgcttgttgtcaggctgcccacgtagatagtattattgtgctcaggcattatggcactgaactccatggtttgcactaatatttcaaacaactgactgcctcgtctctgtttggacttggatataagcaagcatcaagagggtgatgatttgttctccaaactagcctttgcaaagaggtgctcacaattgaaattacctaaaacatttcttttaaacatcaagccaggaacatccaagttacttgttctttacaatttaaggattagatcaaatcagcgatatcttcacaaatccatccataagaactttgccaaagacttgttggcttcatgtgtttggaaatatttgatgatgtttcgtcatctatattatacattatcctcaatataacctctcaattgcctgtagaaataatacccagcacattttacagtttggaacatgatatccctattttacattacaccctcacagcactcttgtgaattaagttgctgtctttgtatacagggtcagattgttaagcgacttgcccatagtcacctagtaagcaagttcagttctccttttctctacagccatttcacagtaagaattacttaattatgtagtttgactttcaggtacagtggagaagaatttactgtttttgttttgctgctctccttataggatgatgtgggctgctggggcagtagcagccatgtctagcatcacctttcctgctgtcagtgcacttgtttcacgaactgctgatgctgatcaacagggtgagttgataggaactagcgataattatttaaaagtacagaatgttctaatcctgtgttctgtctcctatgtactgaaacataagtatatcttcagggtagagacttttaaaattgcttttgatataaacaggaaaagcagattctagggtatttatccttaggtagatacatattcccttttctctcacttagaatatgtggcttatctgttctgttcatagaaaatttactgatgaggctgggcatggtggctcacacctgtaatcccaacactttgagaggccgaggcaggcagattgcttgagttcaggagttggagaccagcctgggcaacatggggaaaccccatcactaaaatgcaaaaattagctgggcagggtggcgcatgcttgtagtcccagttacttgggaggctgaggttggaggatcacttgagtctcagaggcggaggttgcactgagccaaaatcaggccagtgaactccaacc

SEQ ID NO: 55267 - DNA, 1482 bp, Homo sapiens
cacacctgtaatcccagctactcgggaggctgaggcaggagaatcacttgaaccctggaagcggagtttgcagtgagccgagatcgtgccactgcactccagcctgggcaacaagagtgaaactccgtctcaaaaaaaaaagtgtgattttggctgggcacagtggctcaatgcctgtaatcacagcactttggtaggctgaggcaggaggatcacttgagttgagttcaacaccaccctaggcaacaaagtgagaccccatctctacaaaaagtacaaaaattagccaggtatttgagcccaggaagttgaggctgcagtgagccaagtttgcgccactgcactcccgccagttgacccccccactttatttttgactaaaaggggtcttaagtacttgcttggggacagataaattttaacatttgtagttgtgaaattgtgactgatttttaaccagccatgttttgaaggctgtaatctagggaaataaagtagttttgcccacttgtttctatgtgagacctatatatgggtacatcagagctcatgtttgcataggacagcttactacactttgtagagctgatagcttctaaatattaatagtttttaatgacattgctataaattgctagtgtctgataagaagcttgattttagattaagtgatttcatatttgtactggttctaaggtagggaaaaaaaaccaggtagtttactaagtgataatttgtttaaacaatgtaggtgtcgttcaaggaatgataacaggaattcgaggattatgcaatggtctgggaccggccctctatggattcattttctacatattccatgtggaacttaaagaactgccaataacaggaacagacttgggaacaaacacaagccctcagcaccactttgaacaggtaattctcattcaacatgatcaaattgtatggttcatttggctagattaaaggctactggtttttggtcatgaaagcttttatgtgagattctatttgagattggataaaatgcttaaaaaccagagtttaagggactgtgttcttctacataccaccttgtgaaaattggctgtgcatattttttttccacttgagaatgaaaaattttaagtacctagtttgtcaatggcatatgtaacaaaccatttctctttactactagtctcttttgaaacttttctaatatcacagttgtgtatgttaactaacttttcatacaaaaggcaggcttatggtaaataacctttgttcactgtttgctatatttccctcttttcaactgaaaattaatgccaaacaatgctgatcattttggccaatattagcagctcatcagtttcctggcttatttagcagagttctgtacttatcttccaacccactaagactacttttaaataaaagaatgtttgtgggctatacacaaaactggcagtgcaagcttctgctaagaatgaatgtaat

SEQ ID NO: 55268 - DNA, 1753 bp, Homo sapiens
tttgtgctgaaagtaatgatgtaatattttcgcataggctgttttgccagttgttattcccagaattttatagagaatgtgatagtatctcttttctcctaaaaagggaatgccttttataattatggctttaataaagagaagagcaattagcttgtaattcataagttaatactaaaaggtatgtagtttctccttatgagtaaaagtatttgtgtaaaaatcctaattactttattcttcctcagaattccatcatccctggccctcccttcctatttggagcctgttcagtactgctggctctgcttgttgccttgtttattccggaacataccaatttaagcttaaggtccagcagttggagaaagcactgtggcagtcacagccatcctcataatacacaagcgccaggagaggccaaagaacctttactccaggacacaaatgtgtgacgactgaaatcaggaagatttttctatcagcacccaggtcttagttttcacctctagttctggatgtacattccatttccatccacagtgtactttaagattgtcttaagaaatgtatctgcatgaactccgtgggaactaaaggaagtgggaacttagaaccagacagttttccaaagatgttacaatttcttttgaaaaaccttttgtttattagcaccaatttcttgccactaagctatttgttttattatacatcctttaattaaaaactatatatgtaacttcttagatattagcaaatgtctctgctaccatttccttaaggtgttgagctttaactctatgctgactcagtgagacacagtaggtagtatggttgtggacctatttgttttaacattgtaaaattttgagtcagattttaatattgtaaaatcttgggtcaaataattcaaagccttaatgcagatgcactaaaacaaagaaatggtaaatgaattgtttgcatttaaaaaaaaaaactcttaagaaaactgtactaaatctgaatcatgttttgagcttgtttgcagtacttttaaacattattcactactgtttttgaagtgagaaagtatcagccatttagcatttaagttggggtatttagagcctgtaatctaaatgctggctcaaatttattccccagctacttcttataccactattcttttaatgtttgcataatcataagcacctcaacacttgaatacataatctaaaaattatatagtaaagctggtagccttgaaaatgtcagtgtgatatctattatgtagataaatatatatagtggcctttcaggactgtcacagtaacactttatttacagagctaatgtttgtcctaaattttcaggaccctagaggagagctttatacaattaccgatgtgaatttctctaaagtgtatatttttgtgtccagttatattatttaaaaaagtgttactttgtaaaaattgtatataaagaactgtatagtttacactgttttcatcttgtgtgtggttattgcttaatgctttttaaacttggaacactcactatggttaaataaggtcttaaaagaaatgtaaatattctgttaataaagttaaatattttaatgattttttttttaaaaaagtcttgatctgtgagttcctacagggtctgttttggctttgttaccatatttttacagtaacaaatcaaagcattattcattctttctttgcatccatttcttttccctcactaaaaaatgctcttcaag

SEQ ID NO: 55269 - DNA, 1060 bp, Homo sapiens
tttacagaaataacattaaatgcaacactttttgattattaacacatgtacaattttacactgcaaaacaattgcaactaaaagtttaggaggtaaagaattagcacacttggaagtctgtatacatttaatacaaatttgcaagatatcagaatgatctctcctgaaaattcaactttccttgtgtatatatatgcaaagagatacctatattttaaaaaagagagctacctgtatgtcatgcatcccatccaaaacatgtcacaatattttatatatattacatagtatttacaacaaagccccttccatagtatttacaataaagctccttccaaaatcaccaagaggcttctttccagaatagcaagtgctttcaagttactgtaccaagtattctcactaatacagtagtgtatctaaatgggggaggtgggggagtatcaactgcctaatattagttactgaattttcagattagatccctagtttaaagacacttgcaattgccaatagtttcaagatactggcttcgtaaaaaaaaaaaaaaaattagcaaagattctttcttaccatgggactcagtaatgttattacatcaatatcttgaaatgtttcttcatctgtgtaataaagtagttgaaaataattttaaattatcacatgagcattagtactttataaaaattgatctagaagactctttagagaatgctaccaggtattgtttgtcaataagaaaacaaaatgaggccctatgattctaggtgaattttaaaaaaatttttccccaaggaacaattcttaaaactttcagttacagggaagagaagaaaattgtaccttctaacagttatttgttttgcctagtttattaacattgaaatcaacccaagttctgatactataaaaataaatgaatattcatgatatagtagatttagtagtagtaccaagttttaaaagtccactgatacagatttaactgcataataaaactacaaattgagaaaaactagatgagtataaacatttaggaagcactgaagttttaaaaact

SEQ ID NO: 55270 - DNA, 1104 bp, Homo sapiens
gacagtttttatgtgaccagattaagtgcttttgtcatttgagctgacaagtttttaaaacttcagtgcttcctaaatgtttatactcatctagtttttctcaatttgtagttttattatgcagttaaatctgtatcagtggacttttaaaacttggtactactactaaatctactatatcatgaatattcatttatttttatagtatcagaacttgggttgatttcaatgttaataaactaggcaaaacaaataactgttagaaggtacaattttcttctcttccctgtaactgaaagttttaagaattgttccttggggaaaaatttttttaaaattcacctagaatcatagggcctcattttgttttcttattgacaaacaatacctggtagcattctctaaagagtcttctagatcaatttttataaagtactaatgctcatgtgataatttaaaattattttcaactactttattacacagatgaagaaacatttcaagatattgatgtaataacattactgagtcccatggtaagaaagaatctttgctaattttttttttttttttacgaagccagtatcttgaaactattggcaattgcaagtgtctttaaactagggatctaatctgaaaattcagtaactaatattaggcagttgatactcccccacctcccccatttagatacactactgtattagtgagaatacttggtacagtaacttgaaagcacttgctattctggaaagaagcctcttggtgattttggaaggagctttattgtaaatactatggaaggggctttgttgtaaatactatgtaatatatataaaatattgtgacatgttttggatgggatgcatgacatacaggtagctctcttttttaaaatataggtatctctttgcatatatatacacaaggaaagttgaattttcaggagagatcattctgatatcttgcaaatttgtattaaatgtatacagacttccaagtgtgctaattctttacctcctaaacttttagttgcaattgttttgcagtgtaaaattgtacatgtgttaataatcaaaaagtgttgcatttaatgttatttct

SEQ ID NO: 55271 - DNA, 1045 bp, Homo sapiens
attattctataaaacgccatgttcacaaaccaaaaaatgtcatttactcacaatctttaccaatccccaagtacaaatttgttcctatattataaactgccataaaagcagtacttaaagtatccagtctttaacagctcaagtaaaatttgaaacttgctatttgaggatctggtttgtgttgacatattttttaagcacctgagtttctaaaataccaataaaaagtaaaacatgacactagaattaactgtttggtaactgcccagggaaataggctgaagacgcagaggggagcgctgtgggtttggaagatgtatgtaatgctcctaaagtgccatctctctgatggtctgcaaatgaggacaaaaaaaggttactggtattcattaagtcttcatacattaaatttaattcaactataaagtacaaaaatccagaaatccctgcttacctgaattactaaataggttctggctgagtccgcgtaaaggaatgctatcttcccttttcttcaggtatttggattccaaccctacattttcaccacttaaaaagaaaatggtaataacttatttaacaaagtctttattaactttgaaggtttatctcatatgtatacatatatataagataatgtaactaagttctatttatagcttagctttgttcagaacacattcttcactggtttcttaagcaaatggtaattttatacataaaccaaagtatcctcagtaaagagtagattataataaaattttaagagctgggataaggatggtgggaaaaatgaaaattctacaagtgctataaaaatttaaatactagcacataagtgatacatgacagaaaaatacgtgccttgagagtaacactattaatttctaactcatatttaaaataagatttctttttcctttgaccaaaagctcttcgaaattttctagtgcttcaaagtagtcatgatcaagtattaacacacattacacaataaattctgatcaaattaatacaaatgagaaaatctgggggagaaagaagg

SEQ ID NO: 55272 - DNA, 1042 bp, Homo sapiens
taatactagggaaaccgttaacactggatgtatttagaaaggatggcagtggtagaaaggggaaacacagaaatgcccttctttctcccccagattttctcatttgtattaatttgatcagaatttattgtgtaatgtgtgttaatacttgatcatgactactttgaagcactagaaaatttcgaagagcttttggtcaaaggaaaaagaaatcttattttaaatatgagttagaaattaatagtgttactctcaaggcacgtatttttctgtcatgtatcacttatgtgctagtatttaaatttttatagcacttgtagaattttcatttttcccaccatccttatcccagctcttaaaattttattataatctactctttactgaggatactttggtttatgtataaaattaccatttgcttaagaaaccagtgaagaatgtgttctgaacaaagctaagctataaatagaacttagttacattatcttatatatatgtatacatatgagataaaccttcaaagttaataaagactttgttaaataagttattaccattttctttttaagtggtgaaaatgtagggttggaatccaaatacctgaagaaaagggaagatagcattcctttacgcggactcagccagaacctatttagtaattcaggtaagcagggatttctggatttttgtactttatagttgaattaaatttaatgtatgaagacttaatgaataccagtaacctttttttgtcctcatttgcagaccatcagagagatggcactttaggagcattacatacatcttccaaacccacagcgctcccctctgcgtcttcagcctatttccctgggcagttaccaaacagttaattctagtgtcatgttttactttttattggtattttagaaactcaggtgcttaaaaaatatgtcaacacaaaccagatcctcaaatagcaagtttcaaattttacttgagctgttaaagactggatactttaagtactgcttttatggcagtttataatataggaaca

SEQ ID NO: 55273 - DNA, 1050 bp, Homo sapiens
ttccagatatatgctactataccattagaaagacatttatgcttttaaaaaaaaatctgtactaaaactttaaaattattaaagacttttttttaatatgttagacatcttaattataaataaccagatgaggcagcttccttttttcataatgcttaatttctttcttttcccattctaggagctacagcggactaagcaagaagtcctctctttgcgaagagagaattctacactagatgttgaatgccacgagaaagaaaagcacgttaatcagctacaaacaaaagtggcagttttagaacaggaaatcaaggataaggaccagcttgttttaagaacaaaagaggcatttgatacaatccaggaacaaaaggtctacttttaaatttttctcagaaattgataatcatatttataagtaaacacaaatgccctaattattcatgtttttaaaaaatatatcaggtggttttagaagaaaatggtgagaaaaatcaagtacaactaggaaagcttgaagctacaataaaatcattatctgcagaacttctgaaggtttgttttaaaaattttatagactagtatttcattaaattacatagaaatatacatatgaagctcttttataggcaaatgaaattatcaagaagttacaaggggatctgaaaactttaatgggtaagttgaaattgaagaatacagttactattcagcaagaaaaactcttggctgagaaggaggaaaaattacaaaaggaacaaaaggaattacaagatgttggacagtctcttcgaattaaagagcaagaggtagttaatattttaaatttttatgttgtaactaaattttttcctcgttttaaaaatttatgctttgttacattaacaaatggctttggtcttgtttttttttttaacaaaagaacatgactagattgagtagatggtaataacctgtttcagtttggaaagttagttatcatgattcagataccttgattgctcatgtatgtctatgtttgtatacacatgtaaatattttattaca

SEQ ID NO: 55274 - DNA, 1054 bp, Homo sapiens
ttattgttacaacagttatttaaggtaggaactattattagccctattttacagatgatgaaactaaggcacagaaaggttaaataagttgcctaaggtcacatagtcaaggagtggaagaacaaggattagaactcatctattatttgactatctttaatactaccttgttctttcaggcaacagagaaatttttattttttattttatttattttatttaagttccaggatacatgtacagaatgtgcaggtttgttgcataggtaaacatgtgccatggtggtttgctgcacctatcaactcatcacctgggtattaagccccacagaaatttttaaaatcttgctatagtgccacatttgttgttgctttggcattgattacaggcttctttgtagcattatatattattgtcatatgaattattagaaaatatatgtagattttgtctatatttaaataccaaagttaccagtgttattctagctcacaagacttcaaactctattttaccagtctcatgcttagaagctctaaagcctgaccaattttgtgttcagatcctcatattgttttgccccaataatagatgtcttctgtttttcctgcatacactcttcatactggttgtaaagcatttgaaccttcatggtacattggtagtctaaatgcttcagtataatgctctgatttcattattctcagccctggaactggtcattatataaacaacctcattgcattgatttttatatgatctaatgaaaatatttcctccaagattttcataagacttgcaaattgttagttcttggagcttttttttttaactgctgagtattcagttacctattttaagtaacaatttttaggcattagtgtcctaaaaataacaattgctaccatttattgagttttactgtgtgccagccaaaatgctaggcaatttacgtaaggatttttatgaaggttaaatgaaataatttattaagtatttgttatttctgttttacaaatgagggaactgagatttaatttagggagtttcagta

SEQ ID NO: 55275 - DNA, 1058 bp, Homo sapiens
taagataggtttgtgatacgattcagacaggcactaaatattgcacagttataaccatgttcaaattttattgttggtaaaaatgactataagattggactaatgaaccaaccttgctcgttttacaattttaggtgtttttccattataaagcatatatacgagtatttattattaaaaactgaaacactgtgatggtgtttaaagcaaaaatctgctttttttttaatacacaagtaggttcatcctgtatacagtatttgcagtttgcttttttaacttatatagcatcttcccttaacttgaagactgttgcacctaaacatatatggatttagaagaagcaaaaattatgaacaagatcatggtggtaaatttgcttttgttgaccttgctttctccgtcatgaaattcataattgaaaatagacccttttcagaatggggatctaaagaaagatgacaaaattaagacaaaaaagaaaaagaaaaaataagaaattacaatttttttttgttcaaatctttctgtatttgtatttctgatttttttctttgaattttggtactgtatttttattgtatcataggcacaggttcaatatcaacagcagcatgaacaacagaaaaaagatttagaaatcctccatcaacaaaacatccaccagctacaaaacagactgtctgagttagaagcggctaataaagacttaaccgaaagaaaatataaaggagactccactattagagaacttaaagcaaaactttctggtgttgaagaggtattgaatgttgttttttttcctcccccaatttaagagaacgttttgatttggttattttaatgtggttacttgtgtgggtggtgttcctctggatgctcttgtggtgttagggtatccattcagacaatgcaaagaaaattgagaatttgaaatttgataaaaagcataattcataacagaactgaggtaagcttgaatatttttagttagggtcttgagagcagattactggcacagctgtcagatttatcaatatgtttttaatagtaacaca

SEQ ID NO: 55276 - DNA, 1175 bp, Homo sapiens
tgaagctgggtaatttataaagaaaagagatttaattggttcattgttctgtaggctgtacaagcatggcaccaacatctgcttggcttctagtggggacctgaggaagtttacagtcatggctgaaggcaaaggggagcaggagtgtcacatggtgagggtgggaggaaggaggtaccacatgcttttaaacatccagatctcatatgaactaactgaatgagaacttgcttaacaccaagggaatggcactaaaccattcccatgatccaatcacctaccacaggccctgcctcctctgttggggattacatttgaacatgagacttggaggggacagacatcctaactatatcggtatctgataatctgcatggcctcatgcagaaaatacccctgcacaatgtggcccacagggccatgttactgggttttatatgtaagtgaactattccttataatcgacttgcttccccttacccctctttattgggtggtaaagagccagatttaattaaaagctttaattaaaagatagttaatcttgacctgtgggccgttttgggtctaagattgttcttattctaatgttgatttcctaaaattaaaaaattttgtgtaggaaaaggctttgaacatgtcctgaaaagctataattttgttttctttaatatccttgtaaatattgctatattctaatcaaaattattacatattaaggagcctatcttaatattttgtgttaaactctaatgtagacattagcagaaaaaaaacaagaattagataagttacggaatgaatgggcgtcacatacagcagccttgacaaacaagcattctcaggaactgacaaatgaaaaggaaaaagccttgcaggtaagaacattaaaggaaactgaaaaaatatcttttattgctgttagtcattttgttaattttaaaagtaatatatgcttgctttaaattttccaaacgttacagaagtatataaaataaaaataaaaatcctctctttcaaagtcttactacctagagataatctataaacattttgatgtatttttttcagacttttctctacgtatatgtaaataatatgtaatttataaatatttgtttataaacttataactctgtaaattatgtcatttatatatgtacccatataatggg

SEQ ID NO: 55277 - DNA, 1035 bp, Homo sapiens
ttgattaaaatcagaaatatttcttaattttcatgtcttgacaaaggcactaaagtcatccgaaatatttagcagcatcaaatatttggttttataatgatattggaaaaagggaagactaagattgtatgtgtgtatggtgctaacgcctgattcttttactgtaaagttcaccatcaaccttttatttattggttttatcagttgacgattgttgttgaatcagttatttcattaggaagaacaaaatgatgcttctgtataattttttctatattaagtataattcttctataaagaagaacttttcctcagcaattagggctatttgattactcagaaaattcataaaggataaatgcttaattcttgcatttaaattgtcaatttttagagtaaagagctggtagtctacttttgtggcactcagtgaatttttgtttctagtttttgctttttctctcatttgtttctcatgaactcatggacttttatgtagtcactgtgtttcagtcaatcttttcttttttttgcccaatttatcttttaccattgggagtcctcaatgtgctccctttcctgagctttcttaagtagagaagcttctgattcagtgagagattttcactatctcttaagtgtgttataatgtaacattttcttttcaaaggtttttgctacagttagtttctccagcagctattttggataactcacctgcatttttaaatgtggtagagacaaatccttttaagcatcttacacacctctcactaaaacttttacctggaaatgatgtggagataaagaaatttctcgcaggctgtttgaaatgtagcaaggtaagatttaaatttaagttattcttttaacaaaataagtatcaatggtctttgataaattattgaagagatacattgccataagtttttgttttctaaataaagttttatgaaatataacgaatttattttactgtttcttatttagtcaaggtatagtcgggatggatctggaccaggaattgagaagctt

SEQ ID NO: 55278 - DNA, 1056 bp, Homo sapiens
aatagtcatacatataatagttgatgctatcttagatttcagacaccatatgtaggccttctctataccctgtttgaagctatagacccttgtttgtccaaagcagtatttgttcatatgtatttaagccagtacactggagagtttttgttaaacccttgggacctgattttgccaacttttcattatgtccttgtaaggtttccttaccttgttttgagattacagagacactgaagttatatctggtatctgtaagcaataaacttgatattttatttaaataaatgtatctcttaatttattaggaagaagatgctcggaaaagaatcctgtgtcctttagatccaaaacagtaagtgtggatcagatacgggtttttttttgtgctggaaacagtaattggcacaagtctcatttgaaataattttctctttaaatttagcacagtatatgaagatcaactagcaaagcatttgaaaaaatgtaactcaagagagaaaccaaaacctgtaagtgtttgatcagtaaaattgaatggtgaaatgtggtatgtaatgccttggtagatgctgcacatggaatgtacttgtttcatagctgaggaacccaagctcaggaaatataatttttttttaaagagatagggtctcactctgtcactcaggctggagtgcagtggcgtgatcgtagctcactgcagccttgaactcctggactcaagcaatcctctcacctcagcctcatgactagctgggactgtaggcaaacgacaccacacctggcttatttttttatttttttatagagacggggttctcgctgtgttgcccaggctggtctcgaactgctggtgtcaagcagtactcctgcctcagcctcccaaagtgctaggattataggcgtgagccaccaaatccagccaggaaatacaaatatttttaaattgggtagtaggcaaacctgcctgacttttgttccataagtagacatttatttattacactgtacaataagggctgccatgcgatccaggaggtgacaccatttctgtct

SEQ ID NO: 55279 - DNA, 1019 bp, Homo sapiens
cttaggtgactaagtggtgttctttcctgagataaggaatgaaggaggcacaagaggaaggatggttttggagacagaaataatgagttcagttctgaatgtgtccagtttgctggtgaagtagagctttctagttcacaattgagtatgtgtctgatgcccattggagaggcctgagccacaaatgtagatcagccggtcgtgggcacataggtatagattagaatggttgtgatctttcaggagagcaagaagaggagcgaaccaaaaatagtacaccaggagtgacaaagataaaggagctagtagacaatcttagataaatcacttaagatctgtgaacttcagttcctttgtcagtgaattgggaatttttagggttaaaggaaataatgtctatgtaataattgataaacattttcaaatcttttttaaaaagtgtgatattttgaagttctcatcaaagaatgtacaatcttaatttttaaatatgttctgttgctctgaattttgaaaaccaataaaaatctttttattttcataaagcttttttaaatgtaagaagtgattattacaataatgttctgtttgtgcaggtggatggaaaacacagaaagaaaaattcagtgtttgaaagacttcaaattgatattcaacacttgtgtttgagtaagttgtgtaactttccattggtctacaaataaatcataactgttttaaactctgaggttgcttagaaatccaatcatgcagaactgtgcttcagggaaaacagtcaaatcaattcattgttaatatagaatgttttatataatgtttttaaatagatgtaaattgaattaaggttgagaattttaaaaattttcagtatcaagtggaaatgaagtgttatattagggaagagtttaaaagttttataatatgtacttctgttgtttctttgtcctgtttaaattaattttgagtctgttcaaactataaactagccttctgcctgcagttaacgtgactttacctaa

SEQ ID NO: 55280 - DNA, 1745 bp, Homo sapiens
atttggtcaacaatggactcatatatgacagtggtcctataaaattataccatatttttactgtaccttttttgtatttagatacacaaataccattgtgttacagttgcctacagtattcagtaacatgctgtacaggtttgtagcttaggagcaataggctgtgccatacaccctaggtgtgtagtaggctacactacaccatctaggtttgtgtagtacactctgatgttcctacaatgatgaaatcgcctaatgcatttcccaaaacatacaccaatagttaagcaatgcatgactgtacttttgcataccttatctcatttaagcctcataaaagtcttctaaagtaaaccagttccatcccgggggtaggagggagtacactcttttgacctacagtggccatttctcatgttccacataattttttcccttgattcactgtatctgaatcctccttttgtctctgctgcagttgcttaccctttttgaaattccattttcttctcttttgcgatactcttatttcctggttcttcccctacatctatgccattcttctgtttatttcacagtctccttccacttctgtccttaaaatactaatattcaggccaggcacagtggcttatgcctggaaacccaacactggaggctgaggtgagatgattgcttgaggctaggagttcaggattagcttgggcacataggaagaccccatctctacagaaatttgttgggcacgatagcttgtgcatgtagtcccagctattcaggaggctgaggtgggaggatcacttgagcctaagagtctgagtctgcagtcaactgggatagcaccactgcactgcagcctgggtgacagagcaagaccctatctcaatcggtcaatcaatctcagacccatctgctacacaactaatgtgtctttccctttaaactcttcggtacttcctgatatagtccaaactctttgacataacgttttagtctcaatctggcttcagccttcctctctttacattccctgtctcctactttgctgttcagcaacatcaaaccctgtgtgcttttccatagactgtactatttctactatatctggaatttcacccccattcacctactcacccaaacaaaacaactggtcaatttttactcatccttcacctcagttgtcaccactctcagggagctcccttaaataagatatgcctccttggtgttatcataataccctctgcatatttttaccttgtggtattttaattatctgtttatatatctaattcttccaccatgctctgaattttttgagtatatggtatatacttagtacgatgcttgctatataacaggaacacagtgaatatttgaatgaatgaataatcttggctaccaatttgctgtgtttccttgtccctttctgcatatgtggctttgtcttttaagttctttataaaagatgaattgagataaattgctaaagctccttctaattctgaaataacttaattcttttttttttttcttcgagacggagtctcgctctgtcgcccagactggagtgcagtggcgcaatctcggctcactgcaacctccgcctcccggcttcaagcgattctcctgcctcagcctcccgaattgctgggactacagactcgtgccaccacgcccggctaatttttgtatttttagtagagacgggatttcaccgtgttagccaggaaggtctccatctc

SEQ ID NO: 55281 - DNA, 1661 bp, Homo sapiens
agaataaatcattaaagaaattgagaagatagaagagcaaatttgaatgaagttgataattcatgatagtattattacaaatataaagctgagtaggtttttgctgtttttattgttgagtttttaaaaacagtactgcttaataaatgtaaaaagtatttatttttaaagatgatgtggtttgggggggccacataattgtgtttgcagatcttgcattacgatgtttggttgaaacctatgctgccagttttgaggaaaggaatgaagaacctttagccaaacgcataaagaatgataaaacagaaaaagaaatttacactttggccaaggaaggaaatgaaaaaaatgtcccagagaagtggaaccctgtggctggcattgttattgcactctgttgtcaccacaggtgtgattggagacattatgtgggcaaagaatatttcagggctctaggccttggagcagtggaattccattatttccagcgaatgagtagttgggcaacttgtgggatgcggaaaacatctttggaaacctcaaatagtaccacaaagaggcaagataatcagaatgatgatagtgaagagcatgatgatggaggatacagaatcacagatgatggcgctgattgtttgcctgggtaagagactacttttgtaatgcatgatactaaaggagaaatattatattgtactgtactttagatgactattatcaacaattcatgaaaatgtattttataatctaattttagaataagctaaaatatacacatcttttattgtggtcataaatataatgtgtcttggaagcatgggacaaagtacttagtacattatgggttagttaacagtctctcaataaatagtgacaaaaataattttttataaacttttgcaaaattttaacaatgttttgtgtgtgtttattcaatttaggcttcttagtgttgaagaaaagaagaaaatagggcatctttgtaaattgctgattgaccaaggtcgaatccagtatttgcagcagaagggattcagtcctgctttgcagtactatacagaccctctggtgtctttggaaaatgttttgttaactgctttaccaaatcattcttcatcaccagaaacaactgcttaatggaaaagaaatttgagcatcatctgtcttccaccaaaaaaaattttttaattatatttttatatcaaaaaaatatatactttaaatagcaaataatatgaactttaaaaaatgctgtggcctcattaaactttggtaatagcttttctttttacttcagaaatccaaacattagagaattcaccaaagtaatcctctttagaagggcatcttgaattatattatccatccgtatttatggagattggtaaagtagttgaaccgttgacttggtgatctgaaacatacataacatgtcaacacataattagcgtatttctgtttgtattaattttggaaatttatcttcctttgattttatttaatattttttatttcttaagttcaagaggtagtgattgattgtaacaagggccaatctgagaatttgacttatatgtggacatttttccctacagatctggaaagcacaattgtgattttctcaaatgcagacaattcagagatattcacaattaataaac

SEQ ID NO: 55282 - DNA, 1028 bp, Homo sapiens
aggagttcgagaccaccctggccaacatggtgaaaccccatctctacagttttgtaaaaatacaaaaaattacctgggcctggtggcacacgcctgtagtcccagctacttgggaggctgaggcaggagaattgcttgagcccaagaggtggaggttacagtgagcagagatcacaccactgcactccagcctgggtggcagagcaacactttgtctcagaaaaaaaaaaaaaaaccaaaaagccaagtgtggtggtgtgcacctatagtcccagctactcaggaagctgagacaagaggatcaattgagcccaggagttcaaagctgtagtgagctgtcattgtgccactatcctccagtatgggtgacagagtgagacctggtctctaaaaaataaaataaaataaaaaaaacaggtcaaataaatgctgttgttgtaaaatttcagataatacaaagagttaaccaataaaagaaaaagtcattcataatcttaccactattaacattttgatgtatctatctgtatgtatggctattcttttttgttaaaacatgatcatagcatatctactattttattatttgatttttaaaatttaacattatattatgggtaaccttacatgtcaataaacaattccacattgtcatgctttaaatggctgcataggctgggtgtggtggctcacgcctgtaatcctaccactttgggaggccaaggcaggtagatcacaaggtcaggagttcgagaccagcctggccaatatggtgaaacctcatctctattgaaaatacaaaaatcagccaggcacggtggcaggcgcctgtagtccacctactcgggaggctgaggcaggagaactgcttgaacccagcggcagaggttgcagtgagccaagattgagccactgcactccagcctggtgatagagcgagactctgtctctaaataaataaataaataaataaatgtctgcatagtattccattgtatgcatttattatacattcaaacattaaacat

SEQ ID NO: 55283 - DNA, 1160 bp, Homo sapiens
gctcacgcctgtaatcccagcactttgggaggcccaggtgggcggatcacctgaggttagaagtttgagaccagcctggccaacatggtgaaacctggcctctactaaaaatacaaaaattagccgggtgtggtggtgggtacctataatcccagctacttgggaggctgaggcaggagaatcgcttgaacctgggaggtggaggttgcagtgagctgagatcgtgctattgcactccagcctgggcgacagagcaagacgccatctcaaaaacaaaaaaacaaaattcatgttactaaaagacaggtagccatatacagacagtatatgccctattttttttaactgactcttaatgaaactttaattttacttaattaagaaatggaatttatatacaaaaatattttccatttccgttattatgctaattgttgtatgaaataagtgcaattatacttctcttttgagatatccaagagtatattcttgctctgtatagagaatatcatctgatagtgtcttatttatattaattaatgtctttgaaaagggaaaagtataaactggccttaaaattgtccaattatagttttataaccagtctattaaaggtgtttgtttaaaatggatatagttttagatttgtggtaatgctttggtattttcttggggaagaccttcacctttgcaaacttccctcatgtaaggaaggtactttaaatgtagcagccactgacatttctttttttaaaaaaaatttgagaagtctacttccttttaacttttttggtcttcagctaaaaaataggataagaaattaaggtctattccattctccatatcctgggtaagaatgtaaataagaggagaaggaagagtctaatagtaattatggatataaaaaataagaaattttgtatagaaatgaaggtttcataatgatcattttgttaaaggtctactttaatcagaaatagcaacgagatgaatgtatccaacatttcaatttgcattcggaaatccatgttgtttctaatattgtccagttgaaaactgtatgccaaaattagttgtttaagtgaagttttgtgacagaaaaaaggttgttttaatatctacttggtttttctcaaaatggaaataattttaaaatcagg

SEQ ID NO: 55284 - DNA, 1004 bp, Homo sapiens
gaccgaaaactctttttgagatgcctttcctgaagtttacttatcattagaagtgcacaaccagaggctgggcacggtggctcacgcctataatcccagcactttgggaggctgaggcgggtggatcatgtgaggtcaggagtttgagaccagcctggccaacatggtgaaaccctgtctctactaaaaatacaaaaattagccagccgtggtggccagcgcctatagtcccaactactcaggaggctgaggtgggagaattgcttgaacccaggaggcggaggttgcagtgagccaagattgtgccactgcactccagcgtgggcgacaagagcaaaactccatttcaaaaagagaattaaaaaaagaaaaaaaagaaaagacatgtacaaccagaaagtgagcttagatattctgggaggtcagctcccatacggttaatacagtcagctgtattaattttaattttaatatctcctgattaagtatatacttattaaaaaaatttcaggcaagaaaatgatgttggccgggtgtggtggctcctgcctgtaatcccagcactttgggggacagaggtaggaggatggcttgagcctaggaattcaagaccagcatgggcaacaaagttaggaggccccatctctacagaaaaaaaaaattagccaggcatggtggtgcatgcctatagttttagctgcttgggaggctgaggcaggagaatcatatgatacctgggagatggaggttgcagtgagttgtgatcatgccactgcactccagcctaggtgacaaagtgaaaccctgcctttgtcaaaaaaaaaaaaagaaaagaaaagaaaagaaaaaagaaaacaaagatgtttaccctcaattccatgaccctaagatagctcactgtttatgttgagatatacatctttctaggatttcatttttacatactttttacaagatatagaattatttatattttctttaacttgcttttttctttttctttt

SEQ ID NO: 55285 - DNA, 1033 bp, Homo sapiens
tggtcaagactatgtctgcagccctgaagatacctcattttggttattgtgatgagattgaccttactgaactggttaagctccgagaagaattaaaacccattgcatttgctcgtggaattaaactctcctttatgcctttcttcttaaaggtgagattcattcatttcaaacaaggcttgagtaggacatttatttgtttgtttgtctttttgagacagagttttgctcttgtcacccaggctggagtgcaatggcacaatctcggctcactgcaacctccaccttccgggtttaaacaattctcttgccttagcctcctgagtagctgggaatacaggcacctgccaccacgcctggctaattttgtatttttagtagacacgtggtttcgccatgttggtcaggctggtcttgaactcctgacctcaggtgatccacccccgccccagcctcccaaagtgctggaattccaggcgtgagccaccatacctggccccaagtaggacatttaaattttgctttgccaacatgcaatatgttgactgtggccttgaataaaaatattacttttcgcaacatcagatagttagaaaatgtgccatttctttgttcaataggaaattataaaattgagatttctgtactatatttttagctgcttatctttgagctaggtagagacaattctgccagttaagtaaagcctctgatcctaaaaggatcactccaaccaagtcttggtttgaactaaaatgagacttgatattaattttgcaatatcactgacatatatttaatatttattttcatttactcaaccaacttatattgaggatcctgggaatcatttctagtgctaagccttgggaccagtataaaatggagtaagaccatcagctaaccttgagcagcatacagtctagctcacattagtgactgtgcagcagctaccatgtgccagcctccatagtaagcatgctgtatacattatctctctcttttttttttttttttttggtatgaatctcat

SEQ ID NO: 55286 - DNA, 1050 bp, Homo sapiens
tggacaaacaagtttccatcaagtttgctagatatagaactgcctgatttttagccattaagaatgagaaagaatagttatataaattcaaaagaaatctgttcatgttattatagtttcataacttaaaacaaggatatctagctgggtctctctttgtatatctttgttctattttctattcattacattgtttcaaaatttaattaatttgttagtagggccttttatagccttataacagaccattttggaagttagaaaatgtaagttctgtggcagtgccagtaagtctgtgttgtaaaataatttatttaaatctctaatggttatgaataatggttatgctcttaaaaattataaaatgctgtttttctgtctgtaagatggaagaatttctgcctctgcctgagaacattctctaattttagatgtgaaagtatatattagtaatatgttatatacttaatgagatcatttctcatttgtctttgaagctctccgtggacaggttgttcagttcaagctctcagacattggagaagggattagagaagtaactgttaaagaatggtaagtgaatctgaaaaaagctcttaagtaaatttaaaaataatttgagtaaaaataactatttttatttttatttatttaatggatagtgggaatccatttaaattgagaaacgtctttataaacacataatgcatttttaaaagcaataaggtagaattaccttgtgttgatgatatagtggtgaaggactttgtcatacatcaaggtactttatttagtgtgatttaaaactgtcaggtagtctaagctctcttcactgttacgaaaatgactttagtaagaatgtaagtatgtttgacttaccattacctgatacagtttacttgtatgtttagaagagatgaaaatattttaccaaaagtcatgaatcaaaaaataaattttgaaacattaaaaaattgtccaaaaaagggcctgaaacagacaaaagcctttcatcctctaccccatttttttctttcaccttctggaaaa

SEQ ID NO: 55287 - DNA, 1010 bp, Homo sapiens
cacacacacacacacaatacctttcagacacttaggttttgatatatagagttgaatacatttgggcctacttatttctataagagattttaaaataatattatactaaggtactatgtaaaatagttaattctaaagagtcatctataagttactataagtaaactttggggtatcatactatacaagtttttcattgtttttagatgctaactattactttagaattctttagtagttttagttcaggaagtccaatgacttaagcatacctataagctgatgtatttatacagaatacactgttaaaatgtctttactttcagaaggaattttgggtaaggatcataaatgtaacaaatctaaatctaaggatataatatttctattgtgacaatggttctacttttagaatggaattgaaattcaatttatacttagagataagccggtatggttgtttataaatgcttttactttttgttttctcatctgtagatttgtgttcgctattttcaaacatgtggtaatgttcatgttttgaagccaaattatgtgtgtttctttggttatccttcattcaagtatagtcatccacatcacttcctgaaaacaactgctggtaagtatgatttcaaaataacgtgtataaaataatgttttgtacctcattcagtaatattttttagtagttgattgagactttttaaacaaaaaaaagttgactctgtatttctagccgggcccttcccatctccccacatttttccagttctcactttcttttttctcatccctctcttttacatactttccttaacactggcacccctttttaaaaaaaatttttttttagagacaggatctcactcagttgcccagattggagtgcagtggtgtaatcacagctcactataacctgaactcctgggctcaagtgatccttctgcctcagcttctcaaagagctgggattacaggcattaacttatctcgcccagcacttgtgtc

SEQ ID NO: 55288 - DNA, 1051 bp, Homo sapiens
aaagtgctgggattacaggcgtaagccactgcccctggcccagtttctcttgatttgagcctgtaattctctctgaagaaatctagtcatgatttttccaccctgccctcaactggaggtgtcttggcccttcttaactggattatatgcctccagtggtcttgtagtttttccaacccattctccatagtgtagccagagtgatcttataaagtaagagacatttgataatatcattttcttgtttaaaactgccttcagcaaaatgtccaaaattcaaatgactatgaggcaatttatgatctggacctttccagtctcttagatctcattccttaccaaaacctacccatcccaaccccaactctgacacttccccacccttattccacactaaactacactagaagtctgttgaacaacttgagttatttgcacacacactgtgctttctgtctcaactccagacctttgcacatgtatttcctctgctttaaagactcttgccttactccactgtggccttatctgcaacatacctcatccccggggttacacctactcatccgtcaggtcttacttcaacataactttctccagctaggttcccttaacacactctatttccttcattatagcacgtgttataatcaccggtttacttgtctttacctttcactgtactgtgcattctataagggaagaaattgcatctgttttgttctctgtataatcccaagtgcctggcacattgtaggtgtgcataaatattttttaaatgactcagtaaaaaaaaaagtcaggtttgtaaactcttctaaaaagttgtaagcaaaaacagttcttacccccgtagtaaattattaaaatagccttataatgttgtgttttacatttccctaggacataatgcatttgactcttgattaatcatgccatttggaatttttctgttgtgtctgtcttcctgtagtaaagtgtaagcaatttgaattcaggaactatatattgcatcttatttagctttgcatttccaagtccagtacaatgt

SEQ ID NO: 55289 - DNA, 2064 bp, Homo sapiens
tgtccagagccttgctacaacgtatagaaatattctattttctgtatttggggcggctacactacaagatgaagacggggaaatgttttccaactcatcgctcaggtcctactgcaacataactttcttgaggtaagtacctttctttgtgtttccttaacactctctattttccccatcacatacactaaaaagattatctttggtgcatctgtatttacacagcagtgttaaatttgggctgccctctgccccgcctccgtcccccaggctcttttcactccccgctgggtcccagatcctagggtttagctcaggctccgccctactccttggttggctgttgggtgggaggctcgtttcttccctccctattggtcgcccagggggaggcgcgtttcccatctcctgataggccgcgccgaggagagtctctccagtttgcggcactgttgtcatttccggggtaagatggctgcagtccgtatgctgagaacctggagcaggaatgcggggaagctggtaagcacgtttgggcagatctgaggccgggaaggagtgatttgtccggagtcatccaggagtggtgttttactttctcctccggtgccaggcgtccagggcacgcgtgatggagaggtgaagggatgcatgcaaaataaagggcagagaacggagcgagtcgaccagtctggagtggaaacccactccctccccttacctggaagcgcttctgcagcgactcagccgtcctgctccatctgtaccccgaggcccagctagcgttttattgagcgccttccaggtgcccaggcattgtgataggcgctgtggatccagagatatattcgtttagcatttattgcgtacccacagtatgccaaacactggtaacacgacccctaccctcaaggaatctacagtgtgtagaggaagaggccgttcaagttatagaatatcagcaggggtccctgcttccgaagaactgagcagctcggcgtcactcttttgccttgtacttctatgtccgcaccacatatcattcctacccttttgtcaccaaggctgtgacccatcaccatctcccctgcacttccttctctttctcccagtcttagcaccaagcactgacacataccggtaatgatacttgttacccctatttgcttagtgtttcttcttcctgcctcttctccctttccctagatgctcctgccttggtgaccccgatcttacaaaaactttcaagagcctgctatgtaccagtgctgtgttaggcactggagatacaaatatgaaatagacatcatatcttccttctcaagagattacaaccttgtggtggaggacaaaggagagggagacagatagaaattacaacccagcatgagaggtactgtgatgggacaagtgcctagaactacaggaacacacaggagtggacacctatggtggacttgggggtcagaggagttcccagaggatactgtatgacttgagatgtaagaaggataagtaagagataaccaggagaagagagctcttctcagcaacacttaacacatattggtctctcttctttctagagctttccattcttgttttctgtgacaccagtttcccaatattattctttcttcatctttggccacttcatcccaatatcctgtttcccttcccgccttttaaatattgctttttctaaagggctctgactttggccctctgcacttttcccactttctgggttatcccatccactctttggctttagttaccatctatgctgatgagtcctaaagttccccagtcttccaaccaggtctactccaaacccatatatcctactgtcctggaaatctccagtttcatatgtacgtgatgttttccagctgcaattaaaaacccaaccaataaataggaaattaagtatccatgcatacagagcatccccaattagatgtcagctcacattaagtggcttatgattatcaatgtcgtcatttccctagtagttcatttgtccttttcctactgtatacaagagggctgctacgacttctt

SEQ ID NO: 55290 - DNA, 1029 bp, Homo sapiens
taggcacaggaaaatagcaggaacaatataggtaagtctagccctcaaggcgcttatattctacaatagccctgtcaaatagaactttctgcattggggtatatgttccatatctatgctgtccaatatggtagtcactagccaaatgtgactattgagcacttaaaatgtggctagtgcagctggggagctgatttttaaattttatttaattttaatagtttcacatatctcaaggctaccacattgtatagtacagacaaaattttgttttttaatgtataaaattttacaaaatacagacctaaaatatttagacctttccatggattacatgtttggatatcattgacatgtcattttattgtaatatagagctttgtttttgtcatgcaatcagtttatgtgggcatttgttatacttttcataggggatattacccaaaagggggtggtgaagtgattgttcgaatgtcaccagttaaacaattgaaccctataaatttaactgagcgtggctgtgtgactaagatatatggaagagctttcgttgctggtgttttgccatttaaagtaagttgtttagatgttcttagaaataaaatatatgtgtgtcttgataaatattatgtcaactaaattttgaaattattgagagaacttaacatttttttaaggaaagaaataatgtcctttgtggcaatatggctgcagctggaggccattatcctaagcaaattaatgtgggaacagaaaaccaaataccacatgttctcataagtggaagctacgcattgaatacacatggacataaagatgggaacactggggactgctaatgggaggagggtggaagggggctgagggttgaaacactatcaggtactgtgttcactacctaggtgatgggatcattcatataccagatctcagcgacatgtaatttacccatgtaacaaacctgcacatgtacctcctgaacctaaaataaaagatgaaatatatgtattaatggatacattaattaac

SEQ ID NO: 55291 - DNA, 1452 bp, Homo sapiens
tgggaggcggatgttgcagtgagctgagatcacaccactgcactccagcctggcgacaaagcgagactccatctcaaaaaaaaccagactagaactattatgttaattcagttaggagttatagatttaagtattagtacaaattctttaactgatgtttttgaagtataaaagtaccatttttggatatttaagttccaaatcctctcattcagaatttccattaaaaggtttaaagtaaacgcttgctctacttatgataacactatctaaaaaccgtagaacaataccaaagtctctgcataacgacctttttatttaagataattctgaaacactttatagtactgtgtgcctgtgaaatggtaccacttagtgctaatgacatgttaacttgttggggggcatggtagacatttcttaacctgtgaattagaatctggtgtgacttctcctggtcaagtggtaaaggatactactggtctgattaagatagacaatgttaatcataccactctatatgaagaatttttacttttgcaatttgttgcccagatttagttctgcctatttaatagtcattgttctcttttgttgtatttgcataaatttggaacatttatagcaaaggtagtaataactttttttcttgcatagaattattgctgagacctccactggctgtttgtttgctggatcatcgcttggtaaacgaggtaagataaatgaagggggtccatagttcccaatgctactgcagaattctttaatccatcaggattggaatgttatagaatgatggatgaaagtttaaaaggatgtagttaattgattctcttttagagtcaattacactttcagactttcagtctttctcccacctttatactttggaaaatttcaaacctatggaaaagttgaatgactagttcaactagtcatccatacaaccttctcttagattcactagttatgaacatttagtttgttgtgtatatttctgagccatttcaatataagttgcaggtgccatgtctcacccctgaatactgcagcatatatgtccaaagagcaataactacataattataataccatttttacacctgaagaatttgttttattctgacacaccagatagcttcatacataatgaattgtttccaaaatattatttagagcgatgtggaatttttttttttgggggggggcacatagcatttgtttctcaagtctctttagtccctcttttaatacacaatcctcccattaccttttttgttgttgttcatttcatgatactgacatttttaagagtccaggccattttctcacagagtttcccacaatttaaatttgtctgattgtctcatgatatattcagattaaacatttttattaagaatactacataggtgattttgtgtacattccactgtatcacggcagggg

SEQ ID NO: 55292 - DNA, 1027 bp, Homo sapiens
tttattcattatattctttacttttcacagtactttacatatagtagatgcttacttgttatttgaaatgtatacataacggaaagtgctatgaacctgtgtatagcttgtatcttggtcagctttgttgtgtataactgggtgacttggggcaagtttcttatctttctttgtctcaatgcaaatagttatctgtaaaatcagacttaagctagataggcctgctatgctcctttcaggtctacatatttgtagttttaagtaggtttatgtataggctagaaatgattttcatagctgctacgtgtgtttcatatttacataatgcttgtaatttgaaaaatatataaacgcatgcatatattactaattaattaatatggttacctagctcagaattcagcatttattcattcaacagtaatttcaagtgtccactctgtgtcagtacattaccatgtaatgctgaaagtgaaagaatttttaaacattactattcattcagtaaggcccccaagtgatggttttcaaattgtgcttccaagaatcctaagattttaggcatatttgaaatccttttgccacaaacttaacctatttaattgttttgatttttttttttaagacgttgatgggagttgtgaggagtcttcctgtgttgcccaggccagcctcctgaactgaactcaaatgatccttccacctcagaatagctgggattataggtgtgcaccactgcacctggctagttgttttgattctaaatttagttttgttaaaatgaatcacatttgctttaaaaataatgatgttttcaaaatacagtgatataggccaggcacaatgactcatgcctgtaatcccagcgctttaggaagctgacgcaggaggatcacttcagcctaggagtttgagcctgggcaacaaagtgagaccctgcctatacaacagaattaaaaattagccaggcatggtggcatgtgcctgtggtcccagctacactggaggctgaggcaggaggatccct

SEQ ID NO: 55293 - DNA, 1628 bp, Homo sapiens
aagactggtgaagtatctccacagaacactcactaggaagaacccttctgcagtcctgctttgtcatatttcagttggagaatctgaacccagagaggtcgagtaccttgtccaagatcaaacccagctaatggagaaggactagaaccccgatccctaagtttctagctgggagctttatccagtcatatagcatgtcaccgagcactgctggtcttggtatattatactacatctaaaccataatagtctgcaaaaagattagaaacagcatgcagtgtggaagagtagaattttctatttagaaagcagtgttgtagtgtttcaaatacactagtcatacagtttcttttccaggtagcttctgagctttgattctggctaatggggctaacactgccaaaactttcgtgtaccaaccagggacaatggtggttgttctcatgtttactttggtgatgtccatggatgtgttggggtaggtctaagtgcaaggagtgatagggggataagagaagcaaggaatgatataaagtaggttgggctggtatcttaggacagagttttccaagctttattcactgtaattcaccataagaaacacattttacattgcagcctagtacacacacatacacacacgccattcacatgtataattgaaacaagaggttcatgaaacaattcttacaaggtgtaaagcatactgatattttatattctgttctattttatttaaaatatgtctttacccatcaaattgacttcactgctcactaatgggttgtaacctgcagactgcaaaacatagccattggagaatctacttactgtgcttagatccagaaggttcttgaatgttcttagggcattgatttttggcattgaatgagcaggtgattgtttgattgctctgcatctaggctagtttgcaattaacatgaatggcttaaggaaaactgaaagtattctgaagactgctctctctaaacatcaagatgcatacctgtctctggatggtttttattcagttggtacttgactttttgggaaaatctgagtttgttttaagccttcaaataatatgatttatcttttcttatctcactttcatttgaatcactgtgttacccttaaagccctctcatactcctcccttcttcctggcaaccaaaatgtgcattgattcagtttgggagaaccttgattgagaagcctgtagctaggtcaacgttgtgggccctgaggagccagcgctgagcctgccttactgggtctgtcattttagtatctcattgggcttagtttctaagtgtgggctgaaaagttatataatgtcccattcacctcaagacatcgaatcttaaaccttaggtttataagggttttcttgattgaataattttaatttatgtaaatttttatttcaagaaatgttttctatttgatagagtgagtaaaattgtggcctttcccctattttggaaagtgaataaattcattaaacccctcttcatgagcactttctgaaattttaaataaaagaagagctaaccgcttgcagtgagctgagatagcgccactgcactccagcctgggcaatagagctagactccgtctcaaaaaaa

SEQ ID NO: 55294 - DNA, 1041 bp, Homo sapiens
cagtgagccaagatcataccactgcactccagcctgggtgacagagtgagaccctgtttcaaagaaaaaaaaatctccttttagtggggttcggtagatgcatgggttcaatcttccatctttatcttctctctttctcccccagagaatacataacatgttcttgtgtcccttcactgttatagtattttcctgtgactacgtatgagccacatgccacgattaagccatttctttcttgtccagtctttgggacagattttgagaacctgttggcactatgtggctgtcatgaggattaaatgcgctatgcatataaattacctgacacagtaggtgctcaaaaaaggcatgccgtttccttctctcaatctggaggatatgactaaattctattgcattccttattagatttcaatttgtaaacttctctgtgccttttcagcctgtggtgactgacttgcctagttctgtcggatggcatgttaactttccctcccaactttggaggcctgcagatttgaccaccgggtcaccagagctctccttttagtcactggtaacaattgtggctgtgatggggtaggaggtatcatggaagcctcaccatactttgcagacattcagaaagaataggcctggaactttttctggtagcttacattagtgacattgtttagctgagtctaggggtgggaagacatacttgaaagaataagggatacctctacatcttgtaattttttttttttactttttttaaatataaagaaatttttacccccttttaaaaaacgtaaagcagtagtttttaatctagggtctgtggaagagaattcagagagtcagtgaacttagatgagaaaaaaattatatctttatttttactgaccttaccttatcaattataaagttacatccaattataaatgttgtaaataaactgtagtagcattagcaatataagtgacaatttaatatcacttacagttattatttcttaaaatatttatgctcattccttcctcaaaattgtagtgg

SEQ ID NO: 55295 - DNA, 1031 bp, Homo sapiens
aaaacaaagatccctccttttgaaatgagacataaatatttggaataattgaagtttcaggacttaagcattctgttaagttgctttgctaacttcctagttttatgttaggctttcgggatgctgaaactcagggatgatgaagttacatttcacttcatggcttagcagccataggttcaagtgaccttgaatggttgtaaaagttggttttatgttaattataccttaaagcccttaaaggtctattctccccttggaacgtcttctggccccttcctgatggctgccatatgtgcctttcactttgtctagataggtgtctgcctgctctgtttcttgggtcagcagtggaggctgggcagagagcctggagccttgaggtcaagtttcctacctcggacaccttggaacactgtagtgttaaagctctggtgccagttcttgcttaactgacctgaacttgatactttagttttatgttgcctaaagcaggtctgctaaattgctctaaaaacttaaataaagtatgaagcactcaattttcaccacggtaggttcccactccttttgaaggagtacttcatggtgcattagaagctctcgtggctcccagtggctcagaggagattgtttggaagcctgactacattttcctgttttctttcttttcttttcttttttgtaggggaaggatggcatttaatccatgaaaacacctgctaggttctgttggcctacatacattgtctctcctatcttttaagcttgtttttatcatattcctgacaggaggttattcctctgccagaatacctcttgcaatgatgaatgttttacttaatcaaacagttcaattcactgttaataataagaatagtcataatatttatgaagtgcttcctatgtaccagccactatatgaaggactttacatattttaaaaaacataatctgacaacagtcctatgagtgatagctgctatcattaacttcatttcacagatgaggagaccaagattcagcataga

SEQ ID NO: 55296 - DNA, 1048 bp, Homo sapiens
tgaatttgtaccttttatttatttatttttgaggcggtgtctagctcttttgtccaggctgaaatgcagtggcacaatctcggatcactgcaacctctgcctccccaggctcaagctatcctcccacctcagcctcccaagcagctggaattacaggtgcatgccaccatgtctggctaatttttttttttttttaaagacaggatttcaccatgttgcccaggctggtcttgaactcctgagctcaagtgatcctcttgcctcggcctcccaaagtgctgggattacaggcatgagccaccatgccaagcccccttataatatttttggttgtataaattttattttgaaatatggctgaatttacttagttctaaaagttcactgaatttttttttccccatggcatcattacaagacttttgattaatgtcttgactgctcaaaatgcaggcaaaggctatctccaagctggtttgcgctgtaaggagatgttgaagcagagtaggataaggaggagtctagaagtcattaactttttctgaaagatgagaagcctgtacaatgtgagtaggttcaacattctcggaaggtgaactcatccgttgggtttccccagaggagtaatacaatttatctctatccttagtaagataaggacagccctcacatttggggccctagtctagaatagggctgtttggatattctgtttccatgttaaatgcaacatatctgaaaagaaactgatcatcttttacccaaacatggtcctctgctttgtgtgtgttaccacattgccatcctactgagcacccagcctcaaggctagaaacattgctgttttcctccctaacctagtgagtattcggatcacttctactggtgccacaggatgtattaattatatctgtctttcctctctgttctcacttccttccctctgactcaggtctcacgtcttttcctgtggacctttcattttaatagttctctaactgagcacggcccttctcctcccaggctgccttacacacacctgagtgat

SEQ ID NO: 55297 - DNA, 1053 bp, Homo sapiens
aatgatcagagagatgaagagtatgaagtcaatgatgacgcaaaagcatgaataagtaacgtgttcattaagcaagaaataagagggtaaaaacgttttctgttaggttttcacctgtcaaaaatgactgaacaagttaaagtgattgtattcttttaaaggtgaaaagtcaatcagtgctttttagagaatgttaattccaaatctctgactttagaaaggctggtttgtcatatcctcctagtccttgaggaccaaaatatgtccaggtgcttgattgccatgtcttaaacaagcagccctcttattcactggcagtaagagagatgtttattagcatccttttgagttgttgatgaatttacttattggctgacctctcctttgttacagtctgaaattttatatttaaacttttaaaggatataaagctctctatttgcaaaacaaccatcaggtgtttttcttctatttaaagctgaagttcttaaaccaaaaataccattctgaatcccaaatgtgtcttctatcaaacatcctcaaggttcttaaaatgatgtaaaaatacatctttttgtttttgagccaactctggactcaatgtcctccgagacaacctttagaagtataaaggtggagtcaggctgcttttacaacttggttgattctatttattgaacatttgctgtgtgaatgttcccctgaccttgggtatcattatctatctgtgatagataacctatatcacagatagatagatctatctgtgacagataacctatatcacagatagatctatctgtgacctcggggatcatcatctgttaaagctttcattcattataaagggatcattgagggactagtgtggggctcccacggggattttcagctcacggagatcctttatttatggggctcaatatggcattgtttttgttttacatttccttctgagacagagagaactcacataaagcctaaatctggctcttgcaggaagttttggctctgtaaagcagagcttccattttgaatgaggttatctttatg

SEQ ID NO: 55298 - DNA, 1038 bp, Homo sapiens
gagtagattgttttaaagataactttttcttgtcgttttgttttgttttgttttttatacagaaaacaagcatcgttgtgggtccaaggagacattttccgatccaaactgaaaaatcgaccatccagtgaaggaagtattaataaaattctttctggcctagatgatatgtctattggtggaaatctttcaaaaacacaaaacatggaacgatttggagaggtaagttttccctaggagattctatcttcttaaaactgatgttctgcatttgtttctcagttggacctatataacatagcagtgtcttttctctggatgccacgagtaccaagtttttagaagtagagccatccgtctatatagcaagaagcagaggaaagaaaccaattgcccttaaaaaaaaaaaagctataatttaaggagtaaattataaaggaggctactctggtaaggggtaatatttatagaaaggaaacagaaaagcaaactttctatttgaaaattaaaataaatatcaagaagaaaaattttaatgtgacaattgaggaaataatacataccacaagtggtgctttgaaagcctcaaattcatgctgatttctaaagtaagtgccaacttgaaaacatgattagggcacttttttaaaaaaaaattaaggctctactgtaaacaaaccacggtaaatagttgatatatattgtctgattaatattcataactacctggtgagttaggtaatactatctctattttataggaaggaaattgcatatcagagatgttctaacctcagtgtcaaacatggttcaatccatgtctgtctgagtccaagcttgtgtttttttatatcacaccctgttacctctgaataaaaatagaagtgatttactaagaattaggattatgagcatttttggaactagaaacaacgttgaaacaccatttgtttggttccactattgtagagacaagaaactggggtcccagaaaatttgtgatttgtgtaaagttccagggttgtttagtagtggggc

SEQ ID NO: 55299 - DNA, 1047 bp, Homo sapiens
tggtcctctttctattttttcccaatcagcatgcatttgttcccctcctttattttctagtcttattttcttctctaccttccttttcaagaggaaacactagttttgttctgtggaaaaatgtcccctgaaacctccgggagtggtaccacgatctggtgtggcactcagtgagagcagcagagatgtttggccaagagtgttgatgaaataggggaaagaagctcttcacctgctggttcttattcattcttaggtttaggactgtttagtgagggcagttcaaagagggcttaagcatctggagcttctggagaagcttgaattgcttctttgtagaactttttccatttttattttggaggcaaaacatgagcttaagctgctgtttggtgggtggataatgaaggaaagagtctacaagtaaataagcttttctctagcagagaggaaaacagagttcagctatattaaatgatttatctaggatcaaacagatttggtattaagattatgactgggccctggctctccagatttgagtcagtttttcctttttgtccacttggcaaatatttattgagcacctgctcagaatccagcattgtgctagccactgggaattgaaatgagagagaagtctttgccctcaaggagcttacatcaggtaacggagatagacaaatatcagatgacgcaatatggtataagagctatgatttactatgagaatatatgatgaaacatatattgcttgggaactcagagaaggcttgcttgatgaggtaacagctgattggaccattaaaggctaagtgtgatagaagtgggtcaaatggacatggaagataagaggtagaggatgggaaggagatgagaaaatgccatggcagggaaatagtctgtgcaaactggacaaacgtgtggacgctacccattcagggaactcaaggcattcttatgtagctggaatagagatgtccaatgggaaagtgtggaaagaaggacctgtccagattttggaggggctgcatatgccaagccaaa

SEQ ID NO: 55300 - DNA, 1084 bp, Homo sapiens
ttaaaagctacaattagcatctcttttgaaagctgcaattgctcactcactttttgcagcagttcagcccccagaaaaatgtaaaaatgatttccttattctgtcattaaatcgtttaacacagaaaacaagaacaaatgttaaggattccttatggttgtgacagaatgctgaggaacagtcagattttatttttattaatttgtcctcttttgctagtcttgcagtttctactgccctgtgcaatgcacacacacaaggttacatttttgttgacccacttactgtaaaaaatgagtttcactccctgacactcagaggagttttcaaatgcttaagaaatgagggacatgtgattatggtgtaggtggggtggaagtattttattaaattgaaattacttgtggtatctgtcttgaatatttgctatgctttatttttatgacacttaatcactggattactagtcatctacattgaccttacctgacccccaactctgagttagttcatgttgcttctcccataagcctctctacatcccaccttggtctaaatcagaatactctttttcactcagaatttgcataatccactagactatatgctttgtgagggcagggatggtgcctctggtttttatagttatgtgccctgtgcatggcatatattaggcactcattaagtatttgttgattggataaaatgatggatggttaaatgaatgaatgctctgtagctttaataataaaactatacaaataagtgaaacttattatagcctgtaataagctttgttatgcactcttctatcttaatcttcaaacatttgcagggatattctcatagtgaaggttgtaggtaatgtcagtggtgccattgtctcttggaatttttcctttcttctccattcagttgcttcctcatccctgttgtgtttgagtctttgatgatcttcctaacttgtctctttccacctttaattcttactttaaagtagggttggcaaactttttctgtaaagggccagatagtaaagatttttagctttgtgtcccaactattcaactcaatacataaacga

SEQ ID NO: 55301 - DNA, 1107 bp, Homo sapiens
ctgctggccttcttgttggctctgcccgatcatctaggcctttcagtctagaaacagaccttaatgacccaggcttccatctcttggtgagctcctcccaggctttcttctcaggcagggatgtggctccatctcagccctggcccgagggcaatggtcccaatttctctcagcctccttccccatgtgggagagcctgactccacccctgatttcaggccaggggctttcgacctatgtacccacatgaatggaacacccagccacttctgcaggcttccagctgtgtagccagagtcccaccactgtcttgattgtttctgggtcacaaagatgttgatcttgcttttaatttctgctgtgccctttctttcttcttcatctttaaaaaatatttaatgcatgcatccagagggtagtttggagtgtaccatctcgacatgaagtaggtccagtctctgcagcttgctgtttagtgcctttttcagctttccccaaccagctttccaaactcatatccctccactcctgagcatgaaccttctgcttctgccaggcagtttcttatgtccttgaacgtgcatggctcctcctacctctgtgcttttcttacatgctatgtccccaacttggtctcccttcctccctccctttgcttctcacctcctttccatcaggagttgggctaagtctaacctcctcctctgtgaagccttccttaatctcaccagaccatagcaatcatgatgttttttgaagtcattctgtttgtattggttattggccttcctcatccctcttttgtgttgagagtcacctatcttgtggatgtgggccttgaatccccactgaattccttgattgaggttagaaaatgtcttttatttttgttatctccaaagcatctggcattgagctatgcttacctgtttgattgtgggtatactcagtccatacttgcatcttttctaatactgtgtaggtcatttgtttcttccaaaaatttgaattttactgtgtgtgcacatgtgtgtcagatctttaacttagaaaggcatatttttattgcaccttcctcttacacacacatacacatacatgtggatg

SEQ ID NO: 55302 - DNA, 1035 bp, Homo sapiens
aaccgagaaaaagcaggtagaaaaatgtttatgctctaattgcgagtgtggtagctggcgtccctcaagtggaatgtatatgggcttcaaggcttttgaccaacttcactggactttcttagggtcttacctcttttattcgcactgtgggttcaggtatatttatagtatagtgctctgattcttgatcatctcacacctattttgaagtattagcatgaaccacatacaagaaagtcaatagccaaaccttttccattcttcctacagctcttgaaactggcagccttgagaaccacccatttcccttactacctctcacctaagcctttcctggtgcacgatgttaactttacactatgtatattactatttaatgtcgacaccgctgtcttttcatttcacatctgttatgacattgtggctttcgccctttgcggtcagggaccataactctttgacatactgtgttaacagggacttactcaggaacagccatttggctgttcatggggtgtaaaattcactgcagttttgaagctgagaaaagatagcttgaatccttttgtaagttctttggaaaatggacagattcttttttactgataacctatatcatcaccaaaatggacctgtcttataattgactagacctgttaatgaaatgttacagactaatttgagaaataattattgggtgggagaaaagggcatttactagaaaatcaagtaaactttgttatcctcaggtatttaattggaagaattgagcaaaaaatttgttaatgtttagattgatttatgttcctttttctaatcactgtttcctgctaaaaaaaataactgtttggcaaactttctgtaactctctatcttttcctggtttatgtctgttgtcccaggcattctgattacatatcccaatcacaatccttttatatgttagtatctaatgtgatgtggaagaatttgtatggtttacttgaaaattgcctattgtttattaaattccgacagcaagactcttctgcataa

SEQ ID NO: 55303 - DNA, 1055 bp, Homo sapiens
ttgtgatgccatttgacctgtaaacatatcagaacacagatttatgaagttacctggagctagataaaactgaaatgtagaaaccaggaataaggaagagttgacaaatcagtttcattctctctgtaataaatcattgcctttttcactatgtcttctctaaaaatatgtgacattttattgttctttttccctcttttcagcaatttcctgatcaaattgtaggatttgttcctagaaagcacgtctctacttcatcaggtatctacagttatggaagttttgaaatgcaagcaccagggtctggaaatggtgaccagtactctatggtgctgattggagcctcattcttcaatagcaaatatcttgaattatttcagaggcaacctgcagctgtccatgctttgatagatgatactcaaaactgtgatgatattgccatgaattttatcattgccaagcatattggcaagacttcagggatatttgtgaagcctgtaaacatggacaatttggaaaaagaaaccaacagtggctattctggaatgtggcatcgagctgagcacgctctgcagaggtcttattgtataaataagcttgttaatatctatgatagcatgcccttaagatactccaacattatgatttcccagtttggttttccatatgccaactacaaaagaaaaatataaaagtaaaacaaacaaaaacaaacctgaaaactgcttggcatttgagtagcttctccatgctatgtatttttttaagcaacatcatgaattttatctactccagaagtctctacaatagaaaaaaaagtgcagtgcttctaggatataaaattcacattacttttgaaagccaagaagttggtcttatccagttaggtcttcttatgaagagttttcatccagggatataactccttggtcagtgattttattgtttacatcctgagactgttctacagtttctttgactcctggcatttgccttaaggacctatagcaagctgtttctaggatcagaaactcaagagaggcatttctctgctt

SEQ ID NO: 55304 - DNA, 1031 bp, Homo sapiens
cttttgtctgcaactgcgtaacaagcagggcaagaaggaagggaatattaaactggttttttaaaatctcttaggccaaattaccttattgaggaggaagggagaactgaatttgaatcaactaaaataagattgatatctttcctcattggaaaaaaacatgaaaacacagggactcgtaagaatgctaacatttgtatgttgtttccatttctactccaggtgttgccacatctgcaaacttcctgggagagtaatggggattcgagtgcttcgattatctttggtggtcatcctcgtattattactggtagctggtgctttgactgccttacttcccagtgttaaagaagacaagatgctcatgttgcgtagggaaataaaatcccagggcaagtccaccatggactcctttactctcataatgcagacgtacaacagaacagatctcttattgaaacttttaaatcattatcaggctgtaccaaatctgcacaaagtgattgtggtatggaacaatattggagagaaggcaccagatgaattatggaattctctagggccccaccctatccctgtgatcttcaaacaacagacagcaaacaggatgagaaatcgactccaggtctttcctgaactggaaaccaatggtgagttgcagtgtagttctcagcctggaaaggctgccgctgtccagagctgggacagacatgtgaatttctggccttctgcttaaccgtctggagaaaaatgaaggaagttagtcctaagaaagcactttggaaagcttgagggacaatttccaagatgtcaagaagtggtttcctggcgaagaggttaatattgtaataaaggatatgctataattacatatgattgcattacagttgatagtaagatgccatttagcttatgcttaatatatttttttgccactcctcttttcctcccattcctgacagtttcatgaggttgcaatttgcttaaaagaatcttggctttattcatttataggcccaatagtttctagg

SEQ ID NO: 55305 - DNA, 1023 bp, Homo sapiens
cttccctcaagatacgttaagactgaaaaaaacagcaaaagaacagtcgatagttgaaatacctgaaaacaaggactagaaacacagtaatcagagttcactggaatactcagggtggagagtggtgagggaaacatttataggagatgtgatatttgaaagagatttgaggggcagggagtaagagtttgtcagatagaagggttttggaagtagagaaaatagcatgtaccaatacatggagtcgtggatcggctcactgtatgtaggtaccattgaggggaaatgtctttttggaatttggcaccacatgcgcctttgccttagtttaaacagtgttggttatctgcatgccataaacctggtcagaaactggtcattggttgtagagccgtctcttccaattttctttttgcatcttcttacgtgcatcagctcaggttctgcattggcctctgtattcaaccttggaatgattttatctcttggcagctgaggccccttttctgagcatctacattctatattcatcagtttataggcaagtaaatattctagaagatgagccagaggagaaacaatctggacagtatgaggcaaatctcgtagtgaaatggcagaatagttatcgttctgctgccatctgtggcagcaaaataaaaatgacagcttctcattgtacaacaccacgttgctcattgcttttctaccttatgagtcagagaacataatctttgttcatgctgtgcactggcatgtttgttttcagcttctctctggataattattgctttccagtctgaaggaactagccttgaggaaagaatccttcaacggtgtttcttctagggaactttgatagattatgtagtaagtaactctatagcagatctttggaaattcaaattgcctggtccatttaaagacatccatgacagaatttgtactgttatttaatatactatatattatttactttcttattctatgtccacatttaagaaaattacttgtaatttcaaa

SEQ ID NO: 55306 - DNA, 1008 bp, Homo sapiens
ctaagccattccttttgccctttcaatatgtcgtattggaaaatcaaaaatgattcttcaactctgttcaaatggtatcttgcaagtcaccaatcagaattcttaattcctttgtatgttacaagattaaatcggtttataagatcataaaatacatatactattgaacatttttaaactaaaaaatggatttctaccctgaacttttaaatatgtttttatatctctcctaccaactaattgcattaggttagctatgcagactctatgggtggaaaaaccccagctgctcagacgtgtgactgaggattctgagaaatgaaagcagagagaattaaggggcagaagctcatttcagtcatggtttcagctccttttgggcaatggtcagcaaggaataggaaagatgctatctgtcattcctcagtaatcaaccctggcatttatctgcaaccctgtttgacccttttagatgcttcaaattgagcgccctgggaactgctggttaaaaaaggagttgtaaaggtacataagaatacaaattcatataaatctagaaactggatacaagtgcaaattgctgacatgttcaaatgttttgctccatggcatacatcctctggtttcaaatgtgtaacattagatagttgggatcgtgtgcatttattttgcttctggatccttatattagggttctctggagggacagaactaggatagttctggtaggatagatgcgtatatgaaaatgagtttattaaaaagaactgactcaaacaatcacaatgtgaagtcctacaataggccatctgcaagttgaggagcaacaaagccagtagtggctcaatcagagtcccaaaacctcaaaggtagggaagccgacactgccgccttcagtctgtggccaaagacctgagagcccctgacaaaccactggtgtaagtctaagagtctaacagtcaaagaacttggagcctgatgttcgagggcaagaagcatccagtacag

SEQ ID NO: 55307 - DNA, 1061 bp, Homo sapiens
gcctccctcctttcctgtcccaggacgcgttgcgcggcccgggccggaagtaagcgaattcccgggtgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgggctggtttaggtgcggggtgctgtgtttgcggggagggggtgtccggcagaaagggagaaggcccagacctcaggatggcccgaggtccagtgagggagagtcaaaaactccccgtcaacccctagctgtgaagaaaggagcatgtgaactgggagggtcttgaagagggtacccagcctcggggtcccggcacctccttaactctcccggctcttttccacgtgtatcattcccaggtctatactgtccgacaagacttcccggaacctgtttttcttcctgtgcctgaacctctctttcgcttttgtggaactactctacggcatctggagcaactggtaaccaaaggggaaaatggtttgggcggaagctgggtgtgagggagacgaagcactgtttgcttaatgccacgtagctcctcactaggaggttcaggtcctacctttgttacctacctctgctgctgagttgctttctcatacccacaccaatctggtagggctacagttcttgagtaagatctgggcctatcctgtgcaacctctcttgtcacgctcccctccagttccatcagacaagactgacaagcccctccttattttagcagatgggcagaatctttcatttctaattgtaggccttaggtttacccactttgttggaattgggagaaacttgtttgctgcctctctcgggggggagtggcatttggatttcacccttaagattctgagagagtatatctgagatgttctacttagtttgttattgg

SEQ ID NO: 55308 - DNA, 1036 bp, Homo sapiens
gcctggtatcaaaagggtggagcaggatactcaacaaaagcagacctttgctttgtaagatcctgggtgcaagcaggtatcagcctcgtcccagtagtagatggctttttttttcctacctctctttcagtggcagctgacctttgcaagtgaccaaggagtggtcacattcctacccctcacccagcagcagatggtttttgtttctacctctctcgcagcagctgggcttttccttgtgcaggaggtacgagggtttactttttagatatttaaaacttatcctcaaagctatctatatagcatatttaaattgttgttttagatggttaattcctgatgaacaaaggctgaatcttagactttcagagaaagatgcctactgtttggtttttattataatttgtcaatgtgtttgttcttttccagcttaggcttgatttccgactcttttcacatgtttttcgatagcactgccattttggctggactggcagcttctgttatttcaaaatggagagataatgatgctttctcctatgggtaagactttaagaaaaaaaatctttttattgaagtataagatatacacaaaaaaacactaatcttaagctcagtgacttgttaccaattgaacacaggtgtaacttttgaatctttgaagcccccactcaggcctcttcgagttcctacctccccaagggtaaccactttcatgacttcatggatgagtttttgaatagtatataattggaatctacagtaatttgttgagattgttaccatatagaggaatttctcaacttttttttgaagaagaaagttttagtatatgaaaataggatttttttttgcttttgcttttttctttttgaatggatactttgctgttgatttatttaaaatcattttctaatatggttttatattatgttctttagctctgcttttatgtaacagttcttatatgcttgccgagttggacaattaatcaaatatttgtagagcatctgtatgctgaagggactacattgga

SEQ ID NO: 55309 - DNA, 1523 bp, Homo sapiens
gcctacagttgggcaaaatcatctaacacaaagcctattttataataaagtgttgaatatctcatgtaatttatttaatacagtccactgtagagtacagtatcagttgtttacccttgtgattgcttggctgactgggagctgccgcctgctgttgctgcccagcatcatgagagatgatcatagcacattattgccagcccaggaaaagatcaaaattcaaaatttgaagtatagtttctactgaatgcatactgctttcacaccatcatgaagccaaagtcataagttgatcattttaagtcgaggactgtctgtaggagtatgtttgcttttacaggattattatgtagtttttccaagaataatatttaatatgtttttatgttgtgggaaaatttagagctaaagatttaatgcaaagtgagaactccataatatttgtaggccatcaatagctaatacatgtgtaaaattgtatattacaaagttttacatgccagagaaaatcctgtctatgaattatagtaatttttttttgttttgttttgtttttgtgggtggggcggtaggttattaatcaatctctggctctgagtttccatttagactttattgtcagggtttcctaattcccagctatctacttgcctttattaacttttgacttcagtctgactttctgaatggcttctgatccaatctcaactgcacctatttgtcttcactatttctttatataactctcgttttttattttttcactgtgaatatattccttcatactgagaaatttattttcagaaggcttaaatgtgtcttccaatcacaggttttccatttacaaaagatatggaattgttttagaataacatttgctgaaataacatataatcatgcatatatgatgcatctatatcaagtactataaattagccttgataataagaatttaattttgaaagtcatcacaagttggaggaaaggaagttagatttgcctttctaattctcttttatataagttattgtgaaaataaatttatattttctgaatatttatcaatttatggtggctgaagagcccagtaaatagctgaagaacagagaaaactacctggcattaaaaacttcttgtaaaatgaccaggtagatagatactcatacatgaaaaacttgaattaattatgtttttcaattatatgctacatcttgactcctggcttactaaggttttggggggttaggttatcagtatcctaccacatcttctaaggcttttaactttgtataagttaaacatcctagtttatgtttctttcttagtgatttttttcttaaacagtttatgtagtaagaaggctttaggtagttttaatgacacttactaataaaaccagttttcaggttagcaaataaatggtagccagggactttccagtctaaggaaaatcaagaacaaatcattattttcttacaaatcattattttctttttcttttcatgtttagagttattttcatt

SEQ ID NO: 55310 - DNA, 1005 bp, Homo sapiens
atttaaaaatttacatatacactgtatatgtcttgactggactgtttttattttttcattgtgattttactgtcaggaacttttttgtaatgataactaagatctgctagaggccagactcaagatttttatagcttgtagtttgttagaatagatttttttttttttttttttttttttttttttgagacggagtctcgctgtcgcccaggctggagtgcagtggcgcaatctcggctcactgcaggctccgccccctggggttcacgccattctcctgcctcagcctcccgagtagctgggactacaggcgcccgccacctcgcccggctaattttttgtatttttagtagagacggggtttcaccgtgttagccaggatggtctcgatctcctgacctcgtgatccgcccgcctcggcctcccaaagtgctgggattacaggcgtgagccaccgcgcccagcctagaatagatttaataaagtatgatgaaatcataatgtaagatgagtcataaatggagatttttttttaaagtttctgcctaaaaaaataggatatacattttaaacatacagattattttttaattttttcaaattatttgaacagggaaataactctgctatataaaagtctgttataagctcagcacagtgctttacaactataattccagcattttgggaggctgagacaggaggattgtttgaggccaggagtataagaccagcctgggcaacatggtgaaaccatgtttctacaaaaaatttaaaaattagctgggcatggtggttgtgtacctatagttgcagctacttgggatgctgaggccggaggatctcttgaacccaggagtttgaggctgcagatagctatgatggtgccactgcattccagcctgggtgacagagtgagatcctgtctctatataaaaaggaaaataaaaggatttcgtaaagtttgaaatgccttttcttcttctttggaaatcttactgtacc

SEQ ID NO: 55311 - DNA, 1072 bp, Homo sapiens
gatcttattgtcgtaagaaaagcttgtcagaggaagaacattctagtctaggtatcagttggtagaaaagccttgtggtaaaagcagctttgatactgaaaggaggccagcatggctgaagcatagggagtaagaggagagtggtttgagataaagttggagaaataggctggggaagactacctagggttaggagtttggattttattccaagtgcaatgggacacaataaggatatttgttttaaaaaatgattttggctgctgtgtggataatagattataagggggcacaagtgagaacaggcagaccagctagaaggctattatttaaagtggaccaggtgagaggccatggtggcttggtcttaggtactaaccttagaaatggagagacacagaaaagttagaaaatgctttggggtacagctaacaagatttgcttgagaatataaatgtgtgggtcagggttgagtgaaagaggggaattaaggatagtttctagagtttttaatctgggcaactgagtgaatgaggtgtcattactaaaagagaggggactgggagaaaggtaatgtttttatttttaaagaggactgtagataaaaaattctgttttggatataagtttgagatctctcagacattgatatggagagttcaaatagacaaagagtgtacaaataggcattcttgggagcaatcaactgaacagaaagggttgaaaatagtccacacctggatttaaagtcatggagtggttggtattcatctggcattggaattcatctagcatgaatgccacaattcccaccccttctgttttcctggaagatatccctcagtatggtactcctgcctgctaaaactgatttagcgtcaggggccctttcaatatagtgcttcaagcaaccacaaccagtcaactacagtaggcttccaaggtaaaacttatttgtcatccttgtctaggtcctactgacctacttataaacttctctgtaacttacatagatacatagtttcaggtcatatgattggatttctttttgttattgttaagctttgatatt

SEQ ID NO: 55312 - DNA, 1635 bp, Homo sapiens
ttagactttaaaaaagcataagttttttaatgaaagtcagttaaaaagtagctccaaagtacaaaataaagaaattctagttcagcatttttttcatttaaaaaagaaaacaaactgaatttatttaaatgtacacctgataaagaactatttgcaaggagatcactctgagatgtttttcaaattggtaaaaatttgcctgattttaggaaatagtgaaaactcttaaaaaatcaactaaatagagtataaagaagtatttttccctaccattaatttttatatattcagtatttgcagttcatcaatagcaagagaaatagtggcacttcttttaaattctctgggtctactgctgctcagttgaaaacgtgccatggaaatatatgtctatcccttctagcttgcccagcgttccattttcacttccacagtgaaagttatttcttagaaaaagacaggtttttttttttcaacattttctacacagacaaagggtgataataaattttggggtaaaactgagttgtattgtgatgaattttgttttgcaatgaaaaacaggagaatgaatataatgtaagagtgtgattttttattttctgaaaatatgattcctataagagctttcagagtagttctgctccttttttccctaaggtgagttgggatagaagatgaattcataacttagaatgcagaaatctgaacaattagttgtagctttgaatctcactgcagtttagagacgaggcaatttacatagatctgtagcttgatttttttttattcacttaaatgaaagggttacctatgcatgatggataattataaaactaagcaggatatagaaatatactttgttactggtgtgatatttctgaagccttgctagatttttttaaaaaaatcaattttctgcaactcaccagttaccatcttgtggtgctttgtacttttatatacatatatatatacataccacaaaatcatttgtaagtacaaagaaaagctttttaaccaaaaacaagtctttttgttaggtctaaaattttaaaatagcagcttaattttagaggaaacaaatttttagaggcaaactgaggtacagactttagaaatgataaataatggtctgtataaaatagaatgtatactaatggaaacaaaattataaacttgaaattctaaattataagaaatcatcattgttcatgaatataggatttagaccctgtactgattttgataaatcttgttgatttcatatttaaatagaaagagttgaatagaataaatttgtggcctgtattaagcaaaaagtaagcatttttttttttaatatgtagaaagttaccatatgacaaattctggagattttacttttttcaaaattgtttttgggtgttccctaacaatttcctttgtggtttgcctttcaagtggttataatttgtgaactattacttttggggactaagataaacagtttaccaagattttaacttgctgcttgtatatgtgcccatattgtaaaattgaacatatgggaacattattgcatagttattgtattctttaatcatgcataaaaccatcatagtaagaacatttataaaaactgattagtctaac

SEQ ID NO: 55313 - DNA, 1058 bp, Homo sapiens
acatgcatataatctaaatgttttcatataattttgaaaagaaacactggaagaataaatcaaaagcaaatatagttaccttttcggcagaggaaagggattagaagtgagactttgaattttcattttattttatttatatattttttcgagacagggtctggctctgtcacccaggctagagtgagggcagtggcacagtctctgcagcatctgcctcctggcctcaagccatcctcctacttcagcctcccaagtagctaggactacaggtgcacaccaccacgcctggctaatttttgtagagatggggttttgccatgttgtccaggctggtctcaaactcctggactcaagaaatccaccctcctcagtctcccaaagtgctgggattataggtgtgagacaccatacccagacagaatatgtttttaaaatatttttgactttggaatcatccacatatttagcccttcaaagaaaagtaagtcaaaaacgtgaaaagcatattgagattttttaacttactagctgcaaaaagaaaaaaaaattggctccttttggttctttagtttttttatttatttattttttattttgttatactttaagttctagggtacatgtgcacaatttgcaggtttgttaaataggtatgcatgtgccatgttggtttgctgcacccatcaactcctcatttacattaggtatttctcctaatgctatccctccccccaccccctactccccggtgtatatgtgccacaatttcttaatacagtctatcattgatggacatttgggttggttccaagtctgctattgtgaatagtgccacaataaacatacgtgtgcatgtgtctttatagtagcatgatttataatcctttgtgggatcactgggtcaagtggtatttctagttctagatccttgaggaatcgccacagtcttccacaatggttgaactaatttacactcccaccaacagtgtaaaagcgttcctatttctccacaacctctccaacatctgttgtttcctgactttttaatgatcgcc

SEQ ID NO: 55314 - DNA, 1049 bp, Homo sapiens
ggagtctgtagagacagtaggccttactgagctgcggtgggcccctcccagtttgagcttcctggctgttttgtttacctactcaagcctcagcaatacagatgcccctcccccagccaggctgcagcattgcaggtcgatctcagactgctgcactagcagtgagcaaggctctgtgggtatgggacccactaagccaggcatgagagagaatctcctggtctgccggttgctcagaccatgggaaaagtgcagtatgtaggtgggagtgtccccttttcccaggtacagtctgtcatggcttcccttggctaggaaagggaaatcccccaaccccttgcacttcctgggtgaggtgatgccccaccctgcttcagctcgctctctgcagggtgcacccactgtccaaccaggccctgtgagatgaaccaggtacttcagttggaaatgcaggaatcacccgtcttctgcgtcgatcacgctgggagctgcagtggttctttagttttaatggtcactcttaatctgtatgttaatttcaaactctccaccactgggtatagcctgcccttaaattaatctgttgttttgcttaattaatcctttggaaacatgaattccagtcatacctcagcaactaaatattttaatatggttagcatccagtgtaagtagcaattaacttactttgagatattcaataaaaaatatattctcacagtgttatttaaaattttgtattttaggtaatcagttaaataagagttctttttctttgtttttatttcacaatttaggtttacttaaacatgtaactttggaagtcagcatggagtttgggcccagaatggaaattgggtgtcagagatttgtttttggtcatgtcatttgactgtaccagtcagctctatgatggcagaaaactttcacattgttttctatcactgcctcttgccaaggtccactggggttatttttactgttgatgttttcctgagcttttgcatttttttctgtgggctggtccttttatacactttaaaaatcag

SEQ ID NO: 55315 - DNA, 1039 bp, Homo sapiens
ttcattgaggcatttactgttgctggaaatgtttcccctttttccagatgttttacttactgtgactttactttctttactttactttcttttcttaactgctaatgattccatatattatttaagatttagtattgatccctagccttagatatacttttaaaatttatgaattaattatgtttaacagattcagctacaaattctgttccataaacatttatttgccaaacaccatctgagatgctgggtttacaaacataaataagataattcctaccttaaagcagctttctggttagagggagggggaaacacaatctggtaattatcacgcaatgtagtaatagtataggtagcacagatttttttcataggaacacagagaagacacttcatacagtgtagaagacagtttgggatcaggaaatataccctaaaagaggtgacacttgaaattttaaagaaggagtgtaagactatagggcagcttagggacattctaagcagaagttatagtttgagcaaaaccatgaaagtaataaacagcataaggtaaagtacaagtatgttatatttggagagtttaaaatatgaagcaaggattaataggaggtgaaggtagaggggccagatccaaaaatatactgtgttaaagagccagcacttaattccctaggcagtggggagcttttgacacatttcttagtggtaaagggatagggtcacatacctattttatgtagattagtctaacgtctctataaaatatggttgtattagttatctgtggatacataatgaagtacccaaaaacctagtagctaaaataatacacattattatcttatacgttctgtggtttaggaacctgggcatagctaactatgttgcctggctcaggatctctcacaaggcagtaatcaaggtagcagccggggctgcagttattccaaggttcatttgggggagaatctacttctgagctcactcaagtggttactgacaggattatgttccttttgggctgttgaactga

SEQ ID NO: 55316 - DNA, 1001 bp, Homo sapiens
caagatcacttagggttttgggtcatagatttagatttaattctaactcagtgggaagcattggaaagcttttaggcaatagaagtgtcataaatcctatgtttttaagagattattgtgttttctatgaagagaacatattctagcgaggatgaaagcaaagaaaaccagttatgaagttattgtcctctaaatgaaaaacaatggtggtttagattacagttgtaacggtgaagataaatattcttcttcacatttgggatatgtttttgggagtggattatattagcagaggggagagaaagtgttggcttattacttggtagatggtaatgccacttactgagactgaggccttgttggtacaggtttgaggatggaaaatctccccaaatgaagagttctattctggatatgttaaaatggaaatggctactatacttctaggagaaatgttacttaagtagttggatatgaaaatcttgagttttgggtacagattaggaccagaaagagttataagtcatcaatatatgaataacatctaaaacatcaagattgtatttattacctccggagaagttctagttctactcttttagctctgctttcaactctaaatttggagcataggtgagaaagccaggaaaggtagtggttagtggtgtgctggaaaaccagaagagtgtaggatcacagagttgaagaaggaggaagtaattaactgtgttgaatatttctgtggggtcaaggagggtaaaaacaagaagtgatcattgactggcattctggatgccattactgaccttgttaagagcaatttcattggagtgttggagaggggagcatgatttgagtggattaaggagaaaatgaatggagaagtgacaactcctttaagaagtgttgttaaagggggcagagaaatgagttgatagcggatatggatgtactatcaggaaagagggtattttttgtttttaaagtaggatgtttagaac

SEQ ID NO: 55317 - DNA, 1088 bp, Homo sapiens
gctcctccagatcaatatggggatgcagaacaatagcagtgatttgggtatctgtctttttcctgatcttcagggaatacatctaatgtttcatccgtattttctgtacatttttggtagttagcctatattaagttaaggaagtgtccttctaatagtttttttccaagtcataaataagtgttggactttataaagtgattgttactgtaaatttccctgtggggcacactctcaggtgtgtcctacaaattttgatacatgtttgtttatatttcccaaatacttgtcatggcacctggcacataattagtactcaagagtatttatttatttatttattcaaacatcctcctttcctttttttaaaatggacgatagaatccatgtttactgatatgttgcataataacttaagtaaaagggagtgcttaacttgattatgatgttaatatctctcctttatatttcaggtacagcagttgcaaggagtttacagtttacaggaacagcacttctggactttatgttctgacgtttatgttgggaccttgaaattaatagtagcacctgatgctgatgctaggtggattttaagccaaacacataatatttttactcaggtatgtcttttttactaacttcttttaagggccttaacattttttataactagtagttttaaaaatatttacaaggccaatgtgagaggatggcttgaggctaggatttctagatcagtgtgggcaacatagtgagaccccgtctctacaaaacataaaatcagctgggcatggtgacatgcgcctatagtcccagctgcttgggaggctgaggcaggagggttgctggagcccaagagtttgaggctgcagtgggttatgatccagttgcactccagcctgggccacagagcaagaccctgtctcaaaaaaaaaaaattgccatttaacataataaatatatatactactgaactataaggtaagcataaaaccacatttttggctgggtgcggtggctcacacctgtaatcccagtgctttgggaggctgagtcaggtggatcacgaggtcaggagatcaaga

SEQ ID NO: 55318 - DNA, 1043 bp, Homo sapiens
tatcagttccacaaaacacaaaagatggtctctcctaatacatatttactccttgatagaacttctacctttatttcttccatcttttctactcttttgcctttctcacttgtgcctgataagtcctaagcccccaacttcctgcttcagctttttgtgctctattctctgtcctcaaaatagaagttaacactgatactcaggaagaaaccaaaaagcctcctcacaagcccaagtaagagtgctccaagtttcagatactttctgcctccgtaaactctcctaggatcataatcccttcctgtggctttatctaactttgctctgtcttcttgagggagggggtacagagtaggagaaagtggattactatttttccacctttcctttttttttctctaagcttttggtcaagggctttaatgtttcctaagtattgattttggttgcctgctctgcagtttttccttatccatcttcccattatctttcttcatcatttgtatttgaagtccgccagaatctgacctcctttggaggttggagagaacaaccacaggttgtgaggccaacagatccctaggtttattgtttttaagtaatccatatgatttaagtgttcactggttgatgaatagtggtggaaataataacagcaccagcagctagtatttattgagagctcatcatgtgccaagtactgtgatcagtacctaacatattaaatgagcctcaaaagacaatttacagacaaaaaaacccacactcaagttactgttattgacttgtaatttagtcacagttactcattattttgctaactctgaaatgatttaggtttcacaaggaagagtaaggcagtttttcaagacttcattttaaagggataaggatgaatatatgtacagtcgaaataattttctatagtcatattcccgtttatttccctaaattttttacttccgatttgttatcctttctacaacaataaatatgtattgaagatattctaagcctatagcaccaggttaacatttattttc

SEQ ID NO: 55319 - DNA, 1629 bp, Homo sapiens
tttttttttaacaatggatattctgtaaaatatcctgtacaaaacaagactattgccagtaatgtatacaaattgtctttttgtgtacttccagcataggtttggatatatgaacatttttcttttattgttttatcttcacagaaaataaaaggtgttaatttgctttttaaaacaaatttaattatcacattttaaattactttgtggactgtgttttcaaaactttgcaaattcatctgttacacagaaaattttgacttaaaacatctgctgaattccaaatttctgtaatagctactgtatctgtgataaactttcctatatctttccttgccatttctatggattttataatgaaagaaaaaggcattggagactgaaggcagaaatggttgtgacagtgctgtttggctttttcattcttcaaatgccaagtcatccactttgttttcctgtttaggctttgcacaaatacaattgctttcaggaatcctaaagcagcattttattgagtttgaattattaaaggtacagaggaaatgtggtgatgtagaacttttcctaacacaggtatctaggaagtaagtgctgagttgattttctaggttcttacgtatttgaaaaataaaattgcaattcgagataagtgcttgagcactctacttaagtattctctgtgttttatgaagagaaaatgatctgattttcccttatacttcattttacaatacatattcccttttaacttaaaaaaattgtaaatgtgggagaaaaaaccctgcaggatggaaacaattattaagaatgtagatcaataagtactttttagtgatgtggcagaaatccctgttgattctaagttttagagtgtcttttcccctatttctgacctacaactataaactactctctattaggagaactagaccactttcttcattcttttctaaactgctgcagattgccgtgaactctatcaatagtctcttttccgcaggcaaagtggcattttctaaacatgtttgcttactgccaggtggtttgaaatctatgatttactgcagtagtatgtgcttaaaacaactgttgaggtcttttaagcaggaaagttcaaaaggaagtgtcctgataatggtactggtttttctacaaatataagtagtcattagaagtttgcaaccaccaccaagtctgagagaactctgggatattctgtgggttttggcatattagatagagaaaatgacagatctagatgaagggagcttttggatgtgtgcctttaaaaactgattatgtataaatactgatatttcacatacggagatatttgaagacccaagtctgcctttcacagagccctccattccaagtttagtttttgtcaaaatatgaatcattttatttgactgtactatcagtacacaaatgcatgagtatgtttatacagtgttagactgatgtgaatttgcatttgttacattacattgccagcgcatatcatttagcaagttggcattaacatttatgctttaattaaatgccagtatacctatgtgtgcagcagtaaaaaattagtgagaaaaagcaactttttgtcactcttaggaaatattttgtcttatt

SEQ ID NO: 55320 - DNA, 1527 bp, Homo sapiens
tatctgtaggtcagtgttccttgtgctgtcatttcccttatatctggaatttgtcagcattcctgaaaacctacacgtgtatatcagtaaccaaaatgctatgccttttttgcacctttgtacagcagccaaatcatgaactcaaaatgtatttgatcacagttctataatgtttttacctacctattatggaataatcagtttttacagagattattaatatggtagaaccctgttatgtaattccaaaacttaagaaccatatttacattgcttaacacagaattttacatctaagcaaggactggctttagaagcagtgtagttctacctctcattttacagatgagaaaaccgaagcccagaaaaactctcatttgctcaaagtcacagagaaaattagtggcaaagccaaaaagattcagatcttctgactcgaagttgagagttctttatactctattatgctgcctctccagtgtaatatttgcctttctgtaaatgggattaaatatgatttgtaaataaaggacatctgacctccttttttggtacattaaggcactttataaatggacttttattgtctcatttttcgtatataattatttccatcatattctttatggaagatgcaattaattttaacttttttactcttataaaaccagttcctgacattttaaaaaacaatatctgtaaaatggatccttttatgagtgaatttttctgctaattgcccaaggctaaatccaatttaaggattgcttagtttctttattttgtttatggtctctgaactggtatttttttataaaccaggctaattcacaggtcataccatttcattcttgtcgtgttggcttccagtcactggaaaagcttttgcattttaaagatttttagagccatgcaaaactgggcattaaatgttgcataaagcaaatcttttaagtaaggtaaaatgttgaagtcttaaccagaattcctacaactaattactaaaactgctatttctaactcttcatgaaagcattacctttggaaagttaaactttttttttcctttcatcaccgtctttgaaacaaattattttccaattcataagaactttggtaaaaaaaaaaataaaaggaaattatatgtttttctttggacattcattggaaggcttgttgaagacatgatcccccagaagccttagtgacccagatctcaaccagagactcaagatagcctcaaatacagtgaaagattatgtatccaaaaaaaaaaaaaaaaaaaaaagaaaaggagcagggaaggacagttctagttaaagccaaatggatgtgagtctgacaagggtgtctttgatttatatttcctaactgcaaattacacagaaagtgagaatggggaataacttttattaagtatttatgtgccaggcggttagtgtggccttcatgttattacatttaatcctcaaatttctacaaaggaataattttgcatgattttatgattgacggagcattttcaaa

SEQ ID NO: 55321 - DNA, 1032 bp, Homo sapiens
accaacctgttagcttcaggatgcaattatcagattgctctttatgggccacagttccagtgtaagttcggttttcaaagactgcagttctctttggatctatttcaagtttgtggcacacaatttgggacttacgaagtcgtctgttggatagtttagttctcaagattctcaaggctaaatagaatcagatccaagcattagtgatttgaggatgatccttggggttcataaacaactttatgagattgctttcgtggtttcctcccactccataatctctccacttcctggttccctgggctccccttcttggttgagcctctggccagaaaattgggcatctagttactctactctgatactatttcatactttcatggctgggcctgcattctgctccatgtggtgggggtacagagagaaaaaagcaacagggttgctgtacccttttaaaaccataactctaccaaacagaaatattcccctcccccaaagttttagttcctatgggcttacatagctgttggccaccaccataggattgcctggccaaagcttttggaagccagtgggaagtcttccctccaactaatgtaactacaaatgtagtaactttgccttcttctgaggtctgtagaaaccaatatgacctgtgtacaaattattgctcacggggaaagtagtatgatgcacatacaggacaataaaccctgtaaatctgaacattatgatctaacttattgtctagggtggaagacagcgacggctaatcagatggaccttattttatttgtaattttacaagtcacaatgacatactcaaaagtccaagccaaatggccaagccaagccttaattgctatctaagtgctcctgcttatatgtgaatctgaatatcttgtttacttaaaaaataccacatttaaacaatgccatttggtggctacattcaggaaataatttttataaggtctttgtattattttgctttattctttagttttagcagttgctctttcacaaaaagag

SEQ ID NO: 55322 - DNA, 1034 bp, Homo sapiens
tctgatggttttataagtgcctggcatttcccctactggctctcattctcactcttgccgccctgtgaagaggtgccttccaccgtgattgttaagtttcctgaggccttcccagccatgtggaactgtgagtcgaaaattaaacctcttttataattacccagtctcgggtatttcttcatagcagtgtgagaatggattaatacctggatgcatgcatgtttgtgtaacaaacaggtcttttggcttatctagtaagtataaaacaagtgaccaaaaagaagttgactcaacaatgcttggtttcttgtggcagtgagttttttccctatgatatcatcagttgttgctgctattttggcaaattttcaggatgtacacataaagcagaccaggctggaaagcttgtggatagacatccactgacagaatcatttaagagcagtttttatttatgaaaccaatttatacaaggtggttgttaacagaatataacttagaggtaactggaatttgaatcacttgaatctgttttaaagggtaaaaaatgttatgagtgccaagaaaagcaaataaaagattagtaaatgttcacaaaatatgtttataattttcttctttttaaaaaagttagctgtccctactgcatgaggagttgtcctgacagcagctggtattagtgtatataaacaaaggtagaaagattacatttccatccagcagtctgacttaaagctcagctgagcacatgccacaaaatgacattcttctgaattcactgtcttggttagctgacatcctaattacgtggctcatactctgctgtattttggaggttataagattgtttaattataaatgttcagccagccttgtacagttgctgtttggttttaaatagcatctttcacatccaagcagacaaatggaaaacttgctgactacaaaataaaatttttaaaaatgtaagttttaaggcaacaatggattagtcaagatatgccatataacttaattcagttaatatgccattg

SEQ ID NO: 55323 - DNA, 1097 bp, Homo sapiens
gacatctatctttatgtgttcctgccatcatttcagtgagatcagaggaaagttaaattagaacaatgaaaaagcttaagaaatgaacaatcatcatgcttttgtgtatgcttaaagtgagtacatgtaaaaaaacatcaaacagaatgtagactgtggtacttgagtatacctgggagagctaattgcattaataacatattatgtagtttcatggctaagaacagtggcatctagttttctgcctataggggaaggaagatctatgaacctccacggtatatgagtgtaaaccaagcagcccagcagcttctggagattgttcaaaatcaaagaatacgaggagaagaaccaggtactcaagacactagaagggctctcatattattcctctgttactacatttagatgtgtatatgacttaatatctcataccactatggaagcaagagtcagtatttttgtattgtactatttcttgtcatttttgtccaactttaacttaaatcccataggcttcaagttgtagtgaaagaaaaaaaaattggcattcttttatagtataattaacaccattccagaaagtgaggatttttcacaaattaaacataagtcacatttgatataaatatattactgtataaatatttttgtaaaatatatctattatgttatccctaatcaatggtgagatctatcctgcaaaaatatacttatcgttcttttattctccctcctttcattcttaatattgagactaggaatagttttcttcagggtaaatataagagaaaatttgttcttatattcctaatatgtagacacagtgtgtggtatataatagaaatgtttattgtcaataaatctttatgggaggttcttttttttttttttgagagagggtctcactttgtcacgcaggctggagtgcagaggcactatctcagctcattgcagcctccacctcctgggctcaagtgatcctcccaccttagctgaactacaagtgcatgccaccatgcccagctaatttctttgtgtgtttttggtagagacagggtttcaccatgttgcccaggcttttctcgaattccttg

SEQ ID NO: 55324 - DNA, 1058 bp, Homo sapiens
gaagatcagtgtacaggtatttattgagtgcttaccctatgccccatgtagagttagtttcttttggaatactaaggaagtgtagacgtgggtcctgctctcaaagctttgaaatctagtttggaactaatgtgttgtgcacgtgaaagtttaaagaacaaaaattctattgtatggagaggcaggaaggacaaactagaaatgtggctcttgagttgtccttctaagagctgccccttttcttagctttcctgggaaaagacaaacaaggttaaacaatgtatcttccttgctccattaacaaaagcaggaaggaacagagtgtgaagtataggatgtcatgatttcaaatcctcaaaccatagttctcatcgttttatcatctggcattctcattatttaaattagtatgtatttattcaatgcctgctgtgggttaagttccatagggattagtgaggataaaccatggcaggaaaacacagagaatttaaaatttacttagaaagacaagaccaatatatatgatataattagaggttaataaaagatagcattaattgtgtagatctttccaagaacaaaaagcatttgaggagaagtcaacaaagactttatgaaggagttaggacttacgttgcccagagagtggatagtttaatatgggctggtgactgagtggtaggagagtcacttgagtaaatttattcagtagacatttatggagtgtcttctgggtacttcacattatgctaggtcctggtactaagatgaatcagagaaccttacattctagcaagtagaaatagagaggaataattatggactgtgtgaagacaagggaaaagtaatgcggggtctggcttgagacgaagtcacgaatgcactccttgattaaaaaggatttgcgtctaaaaattctcctcaaccctcttccttttaaaaatcagattctatagagcatatttgaaaagtaaagacaactgaaaatatgaaaaatctcatcacaacatttcagaagctcagagtgaatgaattaataaacgggttaaaatttt

SEQ ID NO: 55325 - DNA, 1004 bp, Homo sapiens
aaacaggaggtgccttttaaggttctgtcttatatagtgatcacatttctatgaagatatacttcttataccactgaaattattcatatcagaagaggtaattgttgattcatttttgtacagttttttaacataaaaagcattaaaaatcatatgcatgacacacttaaattttaaaataaatgtatagatatcctgcataatgcaagtactttgacaaagtcttcttccttataatagctggcctttttctctttactttttggactagcgcttatggaagaaaaaataacctaaatctgtggttctcagacttagtatttattagaatcacctagagggcttgtaagacaggttgctgggcttcatattcagactttctgatatagtagatctgggatggggtctgagaatttgtatttgtaacaaagtctcaggtgatactgaagctattgctacaggtaccatactttgagaattaccaacctagacaaattaaaaacttagaaagtgaaagaactgtgttgtcttttttttggcatggcaggattggaagagtaggtttttaattcccagtatacacttgttaaatgtaggatgttgagaggttatcttgccatgctctcttgctcaattttttaaaagggagataagaaccactgtgaaaaggcattctgtcatctccatgaaagagctttccatgagttcaaaaacagccatcaagttattgaacagagtagattaaagagtagcagtatgaaatttctaacctagaaatagacagacttttcagctatcaatttatcaaccccctttgaactattctgttgtttttgttattttctaaagaaacaacatgcagagttcagaatcaaccactgagtattgttcattacctttgtagtttattagccaacagaaaatttttgtttatcactatgatggtaaaaattgttgtataactatctaacactccttcatacacacagacattcacacacaca

SEQ ID NO: 55326 - DNA, 1005 bp, Homo sapiens
ctttgttcttttacccaggttattgaaaggaatatggaaatagatcacacaaagaaagtaaatgagtctaaaaatatatactaaatcaatagaacttaatcactgtgagagttgacagtctcaaacattctatccctaaatctctgcataagaagtctttattaaacacactgtttctaatgatggttctgttttattattccattctgtatttcaatatgctctgtaactatattattataatgaatacaaaatttttatccctatgttgtatgccttttccttagtggcatccatatacagataatatgtcctgatgtaggctgactgcttccattccatgtaatgaatgtgaacagtgcttgatacctaataactataaaatcaatggcagcattattattagtctatttttcttcaatataaataaagctgtcacatgtaaatttatgtatatgataccttcctgcctcccacttctttatccccatgttttaggttgtttccttatggtagatcctccaaaataggtttttaggaataaaatatcaaaaggtgtggacatggacattttgtagaataaagcatattgtcaattatttttcaaaaggatagtgccaagtgttagtgcttccatagttcatgaaaacgtcatttgcgctatatcattgcaaacattactaaatttctggcccaccagccacacttatgtcaaaaacggagacactataaaatttaaaacaaacataccagccggcgcagtggctcatgcttgtaatcccagcaactttgggaggctgaggcgggtggattgcccgagcccaggagtttgaaaccagcctgggcaatgtggcgaaaccccatctctactaaaaatacaaaaaagtagccagacgtggtggcaggcacctgtaatcccagctactcaggaggctgaggcaggagaattgattgaacccgggaggcggaggttgcatgagccaagatcgtgccactgcactccag

SEQ ID NO: 55327 - DNA, 1037 bp, Homo sapiens
taattccttctataagattttaaagtaatctgaggcctaaaaattttaagtctattttttgtttggaagacatgacaataaatctgctccctcctcccataacatatgtattaatcctttgatttacattctacttagagtttgacaatgaacctgaagttgacccttcccccaaatttactgggcccttatgagggccaactataaatgtataatatactaacaaatactttggttacttagtgtatactcatgtaagtgtatactcatacatttttatatattaagtccaggctcactcaatatatacaagtgtatcagtataagccttattgggagatagtctatttaagataagatctctctggataggatacaaaaaggcaatcgccattccctatggacacacttcaaagggggaagctttcagcttggtttttgaatatatataaccaactcattaaggctgtgtcagctcctcattagcactcaactcagaaagggtttcttgactacctcatgaaataaggggttttgataactatcccccaggagtataaaatagctttcctatttactggagaaagccacaaaattagacttgtaaaataggacaaagcaccctttcattttccaagtcacttggttggtgtaaaatttccattcttctgctcctcagatcattaatgaacaagggatgcgtttcaaagggtttaaacaagcagacctgaaaattctgttcagcttagtgtatgaaaatcagatgttagatagctttcttcccaggaggctggggaacgctcagcacctaccaaggcttccttccctacagttaggactgaggtgtaggcttccagatacactcgactgcagcgtctaacaacttccaggcccttgactgtgatgtccttggcatctcccaggcccaacccgatgagataaagcatttcaaacttgaggagaagagagactgcaagacgaagtggacagaaaaaccgtcagtaacaccgaggacatctaaaatctagtgatgaaca

SEQ ID NO: 55328 - DNA, 1031 bp, Homo sapiens
agtctacagcacctagaacagtgtttgcggagagtgaatactcattcagcgaaaggattccattgcttgtaaagttatgattatgaccttggtttcctcagctattaaaggagccaagcttgaccctcctttagcatgacccagagtggttcaagccaggagctgctctgacactgactcagtccctgggtggtgatgactcactgctggggctttaccttccagagcctcttctgatagatgggattttctgaaacttctttcctcccattggatccatgattccagcactgtcctccacagctcagggagagggtgctttgttctgtggactgtgcaaagaccttcttgctgtagaatgtgtgactatgactgagctattctcagaggctcatcagaagtgctagaagaaataccttgattgtcagagacgtttagttacctataaatatctctttcctcttttacttagcagcagtaatttattcaaagtagcaatgaatccagcctaaagactgtgttttccatacaccttgcagctaggtatggccatataattagattccagccagtgagttttacacggaagtgttggctggtacttctggcaaacctttgtagaaagggaagagtgtgcctttttccctctttcctgctgtttggaatgtggttgtgactgctgtggaaataacagccactgtggaccctgaggctgaggccctcagcctaaaagtggaaaggaaagctgaaaggagcctgggtccccaactatggcaaaactcccatagcagcccaggtctgccaatttctggcttttgtcagggctctttttaacttattttaatattttatttcttaccaaacacctagaattcaagaagatagggctctttttgactctctgtctcatgcggctaagccaaatccgactgatctggtgtgcaatttgttctcgtcccagcaggagcatgcgaaaagcttctgaatgaatttggaccatggctcagaatcgagcctcaaaccaacccact

SEQ ID NO: 55329 - DNA, 1025 bp, Homo sapiens
tagaatctcatccactcatttccatctcagcacaatttcattaaataaatgaatgaagaatgagtctgaatagagtgaggagaaggaataaggaagcaagtaaggtttgaatgcaagtccaaaaggactaatttcagcgaaggaactggtggaaaagagtgcaattttgttaatttcatgtagttaatttggggttgtataaccaatgtattggtcagagttcagttaggagatagaaatcataccagatatttttgcaaagaattgaatattaaaaaattgttgactagatattggaaaactgaaaagaccaaaagtgtcttgctaaagcaacatggcaggaagcaagtgcagaagatagctatctctcagaccatgttcattgttttaaaagagagaattttatataaagagtagttaattaggttttgaagaatcaaaaagtcaaacatggaacactaaagtaccacagagatagtagatacaggtaacagttagaagagcagaggaagcagttggaattatgaaaacttagatggttggaagagaggcctcctggagctgaaactcagtcctttgatgagggcctgcctgtgatgatggatatgtgagtgctgaaagaactcccaaatagaattgactgctgaagctggaatgcgctgtagtgcactgctgctgctgggtaaaaacggaggctgaacaagaactggagggaaaaacaggaagcatgaagcaagcaggaaggagcaaatcctttcctatctttccaaccttgcagcctccatctactgggagtatctaacaggtagtcagctggcaaagcagaaattatttgcagaatcacaaaccagcattccaaagttcagaatcaaaattcaggatcttttatacaatattatttgggtatttgtgatggaattctatttttccatgtgtcatcaattagagaagtcatctctccttcattttccatcttagagttcacttggagtttatcttagcacccacttcctggagtggacctg

SEQ ID NO: 55330 - DNA, 1039 bp, Homo sapiens
taccaccttatgctctctgtacgttgtggtctgaattcctctggccactgcccagctaggcataatctgggtctcaatgaatgcctctagaaggaaacatagcaaattcatggtgaggaataattatatctaagccctgtagtctgttgctagatgccagatctagagcctccctaggaaccagcccatggatttacaggagattaactcagtgaaagaaaggataatactaaacaacaatgggagcaggggaaagccagaagagaggcaccttagctaacttcaacttcacacaggggaacttccaatggcatcatttcctgggccatctttcaaccagtccttgctaattgtttacgtgtagattcaaaatataataaaacaggcagttttcctgacataagtctttagtttgaagcacaatcggtgatattttcctattttgtcacatttacaaataatgatgtttaaagttattttttcagctttgtagaattagttattattggcaagattttcaaaaacaggatttgaaaagtagagaaaaaatagtaatttttctgtagcagcattttaaattaaccattcgtccatattggcttgtcagagaaactgagataataattcgacaatggattgggaggtcaaagtaaggaaacttaaagttctaaacaatcttcagagcccacagaactttatgaaacattgtaaaaagctcataaaccatccttcacatcttcacaaatctctaggaatcaggggagctggactcagaaccagtgtttgaaacattaagacctctacaaccaaagggagactgaagacaccttgacaatagctggatgcccctaatacaaatagtattaaaatattgacagaactctataacaatccttaaattactacagctagaattaggggaaagaagaagtatattaggtaacacgattttataaacagtgcatcatcttttaagtcacttggcatgtattccccttttctcatactgatgtttcatccccctatttttgatatagat

SEQ ID NO: 55331 - DNA, 1001 bp, Homo sapiens
agaccaattttgatcagtttaaatgtcacttatgcctgcaaattaaaaaaaaaaaattatatatggctcaatttaagtacatcaggtcatcgtgtatcagattagacaaaattagaatgtgcgatataattattaaagtaacttttaataagcattgaccagagctcttccttagcatagtgattcttttactgttgatttgtgtttcttttctgatggtttttaaaatccgtataatttatgtttaaaaatagacttctcccattgaacattattacaaagataaagcacaaaggaaatatgcaccttgaagaacgatttctctgttggtgaatgtttttaaactacgcattgttatgtatagaggaaagtttaaaatctttagatctgtcataaatgaaggaaataaatttttagttggttaaaagtgaccctctgtgtagaacaggtctttaaacttttggtcttttgaactatttgcatgtgtaaaacgtgtgtctttatatgatagaggttgcatagctttcatctcaagtctgactcaaaaagtattgaaaaccactggactgaaattagtaatcagttaaatggtcttgagttttcatcctttcccgtgattttattaacatgtcacattactccactggtaaaaagtcagatttctttgtgagaaactgaaattatattggaagtaatttgtaccttaactctgtttcagaaacatacagcttttgccacattccctaatgaaaaagcagctataaaggtatgactttttcttgacgattaaagttgtcaacaggatcctcttatacaatcttggttcagataatgtttaactgtggtttttaagaagcaaaagcgtttgtattccaacagtttccccaacagactacatttgatttgtcagttggcagatcttgcccagtcctttagtagattatctataaagaaaaactaactgcgtatgtaattaaaataacaatttctaaatgatttag

SEQ ID NO: 55332 - DNA, 1044 bp, Homo sapiens
ccaacaatgcaaaatttgttgtctatgataagcagtctcagtaaacttattaaagcattaacctgattgaaataggtttgaaactgaataggcagagaggagttgtagatagagggtttagatagcttgtacagagttttactgcaaaactaataatacaaatttaggatgggagaaataggagcatgttttcatactgatacggataatccaatagaggacagtaaattaacagtataaataagatcaccctccacacccctcaccacacacaattccagagcatagctaagtaaagacccttgaggagatgagaggatggaatttagtatataagttaagcagctggatttagataggcatgtggatagttaatagatgataacagatagcatgcatatgctggtagatggggggttatagtgggagtctgatattctcatgtcatcaattctgttgtctcaaagtagaaaacaaggtgctaagctaacggaatacaagaaaaatattgtgaggttaaggaacaaggagaaagtacaaaatactctctgagatataggtggaaaaaatagactaagattgtaataagtaattttgtggcataattaaaaatcaccctgagatttgtggtagtttttataaattgaaagtgaggccagggaaatttgttagtttgttttctagccattttcagctgcctgggtataagcagagctggcataaagtgggatttagctagatttttattttcctaagttataggaagtagtcctttaataagtaataaaggcttgatagcctgagattaaaaataaattaggaaatagtcaaggaactgtttacagcattagcaaaaaaaaaaaaaagtataaaaattggtctctaacgaatcatttttggtacaattgtgaaatgtttactcttgttcttttaactgaaggcattgacaagactccatcaactgaaacttttaggtcatactttagtcgttgaatttgcaaaagagcaagatcgagttcactccccatgtcccacttcaggctc

SEQ ID NO: 55333 - DNA, 1036 bp, Homo sapiens
aattgcaccaaaccatgggttagcatttttgtttgcttttcttttgcttttgttctgtgttatatacagatgtacagatatcttactgctttttgcttattatatattgtaatatacagatatcttattgcttattgtatattgtgttatatacagatatcttattgcaaataagataattttaaaaacaaagatatttaatgtcatgcatatttttaatatgttgaataaacattttgagttgagtttgtcactgaattcagtgcagataaagcatctattaagatgttcagagctacaagataaacctctgccaagaaatgcagtagcttatttttctttttaaatgtactttggatcttttaggaacaaggtaaatctaatagtactgtatcatttgagcagtgtgtttgttatcaggttacctaaaatgagttactgatatgaaattatgaaaacataagcatcttaaatgttttttgttttataggctgacttttcctttaaattcatgcctcaagtatatgtacccaccaccttccagcacaatcctagcaaacattgtaaatgccttggcaagcgtgcctaagttctatgtacaggtaagtagaataaaacttttcctaaaaggacttgttgtatagcttgatactttatttttcatgctgattctcataaaagtaatcagactaattctagacagccagtgatacagtattttaaatgtaattaaatattttctacttccaagtagagacttttataaggtatcgtataagtggatactaataaacagaagctagtttgggaaatgtaatttgtgataattctctattactttagaatacatcattaacatagagattcttaaaagaaaagttatagtagacccctgagcaaatgcttaaaaatattggcagtaataacatatttttttgaagtacaaagtatagatgatgtttattttttaatgtatttctctattttataattttacaataattgggttaaagatataaaatcatttcagtggttt

SEQ ID NO: 55334 - DNA, 1012 bp, Homo sapiens
ggaaagcatccatagatagtatacctaatgagttggtgtggccttattccaactagactttaattacaaaaacaggcagctagctggatttggtcattgagctgtagtttgtcaacccctgtctgcaggactctaatgggaaaatgatcaaaatcttaggtgactgtgcacggaagaagtggtatataggaggtgtgagtggttggcatgaggcagaacccaagcagactctgagcaacatatacaaataatcgcaatttgactgagtcagtgtccacccaagtagtggtacaatgtgcagtatattatctttctaagggaagagttaaaatcaaagcataggtggggctgaaactataaaatgggagtgaatacactatctgtcttaaaaagagacatttagggaaacaggcagtgcctgatagatggttactttaacttgttgagtgttaactgcggactaattacttaacctctgtgaacttcactttctttataaaaataatgatagtaattagaaatgctacagtaacctggccaaacccttttttgtttgtttacttaggtttccattaaaggatgtagtgaggaattctgccagtaattcatcttgagtcctgagagagaacatagcctttgagtgtaccaagctctagtttcatgcttctcttttatcttcaggaaatgtaacaagacctaaacaaaagaaaaatggtacaggttgagtatctctaaactaaatctgaaatccaaaatgcttcagactctgtaattttttgagtaccagtatgataccacatatggctggcttagtgacacctttgcttgttttctttctttcttttttctttttaagacagggtcttactctttcgccctaactggagtgcagtggtacagtcatggcttactgcatattcaacctcccgggctcaagcaatctgcccgcatcagtcccagtagctgggactaaaggcatgtgctaccacacctggttaatataatatttttc

SEQ ID NO: 55335 - DNA, 1032 bp, Homo sapiens
ttgcatttaaatatggaggtggctgatggtttgggaaattcactttaagcaaaataagtacccaaatcaattaacatatatactttgctcttttttataacatgactcatcttaacggacctttaatagtagatattttattggacaaattgtagttactctagaagtctgaaatttttaaaacaaaagttatatatatataaagttttttatataatcaattcagattttcagtgagtatatttaaacccatttgtaatattgttactaattttgttactaattttatgtaatattgttactaattagttcatatgaaaatgaactaattttcattttatgttaaagtgaaaattttaacattttcataaagcttattttgtctatttaacaattaggtttcaaaattgtaattatctttaaaaacttgcttaaaatattttaattttatatctttgttttttgttttttaataagaaatggaaacactttcagttttcagaagttatgaaccgggtgaaccaaactgtagaatttatgtaaagaatttagctaaacatgttcaagaaaaggtaggtataaattgattttttttcatgtaaatgaaaataatttgaaggttttatagttgatgtgttaaagtctgtttgaaactacctttaagaatgtggttttcttactgtgcttcagggcatgacaaattattgtttagtattttcaggttaattttttattaaaataatactctcatagcttgggttctctggcagtaaatactgagacagagtttgtggtatgtattaatttcctagggctaagtggctgaaacaacagagatgtgttgtctcacagttctggaggcaaactgaagtcaaaagtgtggcaggattggttcattctgagggctttgagtgaaggatctgttctgtgcctctcccatagcttctgctggtatgcagaagctggcgaactttcaccttccttggcttgtggaagcatcaccacaatttctgcctttgtacatagcatact

SEQ ID NO: 55336 - DNA, 1022 bp, Homo sapiens
gacatcacctgtaaaattatggttttaattagataatcattgaggttcctttctactccgaagttctgtaattgcttataataatataatgaactctaggccaggtgtggtggttcatgcctgtaatcctagcacattgggaggccgaagcgggggggatcacttgaggtcaggagttcaagaccagcctggcctatatagtgaaaccccatctctactaaaaatacaaaaattagccaagcatggcggtagacggctgtaatcccagctacccggggggctgaggcaggagaatcgcttaaacccaggaggtggaggttgcactgagccaagatcacgccactgcactccagcctgggcaaccaagcaggactctgtctcaaaaataataataatcataataataataatataatgaattctataattgcttataactggctgttaatcctttctatttttccattcttggttatgtagtagtagttgtttttttaatcacttgagcagatagtgccagattgtaaggaacttaaaaaattgagataaatagtaatttaagaagtttgcagccagtgcggtggtccacgcctgtaatcccagcactttgggaggccgaggcgggcagatcacgaggtcacgaggtcaggagatcgagaccatcctgactaacacggtgaaaccccatctctactaaaaatacaaaaaattagccaggcgtggtggcggacacctggagccccagctacttgggaagctgaggtaggagaatggcgtgaacctgggagatggagcttgcagtgagcggagatcatgccactgcactccagcctgggtgacagagtgagactctgtctcaaaaaaaaaaaaaaaaaaaagaagtttggttttctagttgctaatagtataatttttaaatcacatacttttatgatagttgagaatagttaaaagtatatcttaaacaaatactacctacttgtagaatcaattttagtgcagaacatgaaatatatttttag

SEQ ID NO: 55337 - DNA, 1027 bp, Homo sapiens
tcaagtcatgaagagaggcaggaggcactcaaggtaaattaaaaaaccatactcccaccatacactagaaagtttttgagaattatttagaaaagattacttgcatattcatgaaggaaaccttaattttaaattattagcagtttgctcgatctgctagaccaaaacaagatcctaaggaaggaaaaagaaagtgttaaaaattaataaaggtaagtgtgaataaaacataataaaaagacaagactaattcttgagataaaattaagaataaaagtttgacaaggtagtaattcaggtatctctttttttttttttttgaggaaatacctatctgtgcagttaagtcccattaaacgtcaaaactataactacagattaaaacccatttatatgtgaaaattaagtttggagaatgaatcttataaggggagtgtgcctgttactctttttttaactttttctgcctatagtaaagcaatggttcttaaaccctaatatgtatcatatcacttggagagcctaataaaacacagattcgtaggttccttccttccctgaaagagttgatttggtaggtctgatgtggggacctagggaaactgtttataccagttttccttttaatgaggggatttccaggatgctggacatttagtgctgaaatggggaatgtgtctggtaagccaagacaggtcggtcacccttgttggcacctgaaaatttgcgagattaatgaggtttcaggtaatgatgaggcatcttatccagagaccacagcttgaaaactcctggaataaacacttacagatacattttctaactcttaaaattaacctaaagtaaatgttaaaataaaagttaaaaaaaaaagtcaaactgtcattaaaaataattctggctgagcacggtggctcacccctgtaatctcagcaatttgggaagtggaggtgggcggatcacaaggtccagagatcaagaccatcctggccaacatggtgaaaccgactctctactaaaaatacaa

SEQ ID NO: 55338 - DNA, 1312 bp, Homo sapiens
aggaggattacttgagccccagaggttgaggttgcagtgaaccatgatcacaccactgcattctagcctgggtgacagagtgagaccctctccctcctaaaaaaatccttaagaaatatattgatgcttggttcctttggtcagaattttgatttaaggtgttgggagtgtagcacagatgttggaataaacctctcaaactgattttaatatacaaacaaggtcgagaaccaccaaggaagagtttttatgcataaagattcctgtactctaccctagaactaatacatctgaatctctgggaatggagtataacaatcagatttgaaaaggtttctttagtaattttaaggactgaccagtttagacactgctttgttagagtaaaatgattaggtacctagtatcaacctagccatccaaccttatattaataactaggaaaataaagggttggagcctctgtgtttctttgttgaaaaatctgctactattattagatctgtgaaaacaattgaaaattcggttattatcaccttaaaagtacaaaacctatagattttgaaaatgtaattatttttctgtaggcatagttaaaaagattttgtaaatgttataaatcagtttctttataagcggtttatttagataaattttgttatactgacatgattcactaattttctaaatataaatggttcagctcttagttatttttaaactaatgacctgtgttatacttcctatttttaatgggcttttatgatgttttaggtttttttgaatcccgtgtccttcaagtgctttctaactttgagaggaagaaattgaccacctggactatggaactgtgcgtaacagctttgaaagtgtatttaaaaattaaatctatatgcctttaaatcagtgaattggaaacatattacatgtattttaatgattttcctcaaatataataaattgtttcctttccaataaaatagtgtttgtattttttctttatctggtttaacacatctaggaaaacataatattataaaaaatatatataatttgtaatataatttttttatgattacaaatactgccttttaaaaattcttacctggataccaaagcactttcacattttttttattgtaatcttgttttttgtaattattttatatttgtctggctttgagttttactgggcttttggttttttggaaatgggggtttatcccaatttagaaatttgtatccttgctgtaatacagtcttccatttttgttcccccaaatctttcatctgtcagaacgtcactcaaagg

SEQ ID NO: 55339 - DNA, 2034 bp, Homo sapiens
gaacatcactcaaaggtgaaaatatttcccacataaaattattcttttcctttagtgaaattagttccagctgtatatacgtaggaaaacattcttctttttattcgattcattcctataggtacgttcctgggtctgtgattacacctttaccttagaggcactgcccaaaaagactcaagtcttgtgtaaaaatgctgttgtggatcatagcttcctaccttttacagcatcgtgaggcagggagagtaagaacattagagacaggaattagaggcatggagaaatgaaccctggagcatcccaatggtgagatataaaatagttcaagaactattaaagaagactaaggaggaatagctagaagctaaatgaagaaagtatctcaaataggaaggagtgatcaaatattttagctgtgttgatgagttaggaaagatgagtttttggattaagcactgggtagagcaacctttgggacattgacgttgaccaacttggtggatatcaggagtaagaggaggtactcaagagaatgttggagaggaatttaatatagtgagtattgaagacaacacttaaggagtcttgctttcaaggggatgtgagaaatgggttgttaatggagggtaatatagcatcaaaaagctgtttattttaagatcgatgatatagcaggtttctatgctaatgggactgattcagtagacagaaaaagcataatgcaggaaacagagggatattgatgaagacatagacctggtaaaaaaatagaaggcttggttttaaagataggcacacaaacagctaattactaacagtaggatgtacgtcagattatggaggtccagatgtttgtagttcagtagataggaggagcatgtcaaatttttgtgatattttctcagtgaaataggaagcaagctcataaaaagggaagaaatcacgaaggattaaggaaggaaaaagagatgtaaaatgaatagctaggaatgtacaaaagtaaacaaactcttggcaatctgtggtttatttaagtggtattagtcaatgtggtttcgtgttcttttccagttcagttcagcagaggcgctatcactgaataagtacagaattcagtttaactaaaggtgagatttctctaggtgaataaaacagtcagtgatgagatgttcatacatttaggagaatgattataaaagagggatatggaaagtaatctgggttaaggagtgaagtgagaaaataaagaaggttgagacagtggaaaatggtatcatcaattgtagattgcagtgtggttgacgatgcaatggagttctcgaggtaggaactagaaatttgggagatttagataagagtgggttgattgaaattggaagtattagaggataatagtatataatagtactaagtatagtatactaagtatagtagcatagtgctaagtatatactatcttgtgagtataagttttaggatgtgaagatgggggtagcatagaggcaaagtgatggaaggagatgagttaaaggaattgagaacctaggagactgaaaggattatctaaatgaattttgaaatctcaacaagagctgtgctgagtgcttgtagtcattattttatgtttactactctgtgagaagacagcacttccttttgtgagtaatggaaagttctttcatgtgtcaattgtaagatactttattaggttcaattatctttagtaatgcatactaaaaaatagtgagctcagtgggattattcagtagatatgtgagctaaccccctctgtcagacacctaagaggtagaactgatggtcttcaagaggaatagagacttctcatcctaagtgtgtaagctgtgaaatatcccaccctatgttttctgaaaacaaacgttatatagagtgtccacataaaagctaacaggaaatctcacacacacacagacacacacacacacacacacacacacacaaaacattgaaaaacttcaggaaagatataccctgtacccaacatgaacgagg

SEQ ID NO: 55340 - DNA, 1049 bp, Homo sapiens
gaccccgcaggaagtaggaaggacgagcgcgcactacaagtcccagaagcccccgtttcctggagcccgcgccgtgccgcgctacgcccgccgggagccgggcagagcggccaagatgtcgcagcccaagaaaagaaagcttgagtcggggggcggcggcgaaggaggggagggaactgaagaggaagatggcgcggagcgggaggcggccctggagcgaccccggaggactaagcgggaacgggaccagctgtactacgagtgctactcggacgtttcggtccacgaggagatgatcgcggaccgcgtccgcaccgatgcctaccgcctgggtatccttcggaactgggcagcactgcgaggcaagacggtactggacgtgggcgcgggcaccggcattctgagcatcttctgtgcccaggccggggcccggcgcgtgtacgcggtagaggccagcgccatctggcaacaggcccgggaggtggtgcggttcaacgggctggaggaccgggtgcacgtcctgccgggaccagtggagactgtagagttgccggaacaggtggatgccatcgtgagcgagtggatgggctacggactcctgcacgagtccatgctgagctccgtcctccacgcgcgaaccaagtggctgaaggagggcggtcttctcctgccggcctccgccgagctcttcatagcccccatcagcgaccagatgctggaatggcgcctgggcttctggagccaggtgaagcagcactatggtgtggacatgagctgcctggagggcttcgccacgcgctgtctcatgggccactcggagatcgttgtgcagggattgtccggcgaggacgtgctggcccggccgcagcgctttgctcagctagagctctcccgcgccggcttggagcaggagctggaggccggagtgggcgggcgcttccgctgcagctgctatggctcggcgcccatgcatggctttgccatctggttccaggtgaccttccctggaggggagtcggagaaacccctggtgctgtccacctcgcctt

SEQ ID NO: 55341 - DNA, 1021 bp, Homo sapiens
tgagaaagagtttcattttcaagtaagtttgggaaatattaggttaaaattagataggttttcttgttgtgtgacttctcatctttaatacagaatcctgttgtgaatctttatgagggagagcgtctatatggctaatactcctccaagatctctgggaaatcctgctgtgttcaagttttctgaaaatcatctttgcttgctgtttgccagctctttccatagggtctccacttaatcccaggaagatcctggtaaacatttccaacctctttatattacaaacctttcatctcactaaactttcccttatttcctaggaccaacgtccacccctttgtactcagaacctaagatctttttggataagccctactcaggtcttagcttttgcccttctcttgtccatgtacgtggagtaccatggcctttcacaaaacttgctagcatagcttcactacagtttctaggatgaatcctggctttgggtcaaagagaattaagataggtctgccccataatttgggactcatcacaaattcactcttcctgcttgatcttgatcatgtacaggaacacttattctgataaccttctagttcataggacccagtccccactttgttctccattgataaccaggttaccgctcacctgcttggcacctgtccatttcaagaaaaatattattattattataaatactatcattgttttagacaaaagcaaaacttgggcctgttttacaattcaataaaatcaaacatttgtgtttgatttgagggtcaaagatgtacattttttttcagctttagtatttttttaaagtattgctcagtagtgagtcttaatatatgtcagaatagtacagttgaaaaataatattgacccactttagtattatgaatgtgaatcctcataattatcttcttttgtttttgttttctaccttttttatgacatcaacataccagaatgaacagaggcagtctttcttggagaaatatttctttttagaggc

SEQ ID NO: 55342 - DNA, 1124 bp, Homo sapiens
acagatactgagaatgccgagaatgaaagagatatggtaggccagaaactaaaattctcaaggaataattcataaattgcatacatagattattgatctcagggatctagaatctccacaaaacatttgggagatattactgtgtaagtcttcatatacatctccaaaatgttgccattttttggcaactcagacaataatgttcttttcttccttccttttggaagcatttattgtctaaaccattttattttatactttaaatgtattaatattagctcgtatttatgtttttatatatctattcaagtgtaaagtctttaagttagagaaaatagtttctacaattttggtgtttataatgctgatcaacaattgactttcaaaacgtatttgttgtttgttgatgaaaaactattatatagattaggacaagttatacttaattactattttcttcttctttcctggtagtatttcatggcaccactaaaaagatttctgacagcagcagaatttgattcagtattcatcaacattcctgtgagtaaaaatatgctagctaaaattgtggtgtacttcaataaaatcttcatttccttagggggttccagatccctattttaatactcttttgtattatttaagaatattggccttatttatttattttttgcttttccagtttttatatccttattttcttgaaataactgatgtatcatatcttcaaccaaaagtcagtcaacatgtacgaagaacacaaatggaaaaataactttcatgtgttattcttaactctttgtcatgaagaggtagtctcaaataatctggggatccacttccatccccacacttccctgcggagctctgttgctcttccagaccctcagaccttgtcttgtaggtgatgtcctcaccatatcagtttcccctactttcctccattcctccacatctttgacttctactatttggtgctttctacttccagttgtatcatatgtaactcccatttatgaaataccctacttccttatgatttaccagactattttaattgtaaaatttgaggagatatttttcgtttacatttatgtaagcatttcaagtttcagggcacc

SEQ ID NO: 55343 - DNA, 1015 bp, Homo sapiens
ttgcacagccatcgtttctctttccttctgtggccttggatctcctttgagaaaccacactttcctctttcttaattacagagtttggatggtttcatcaattatatcccatgcctttgaccacatagtgatggttcaggaatggggttagtcactcagttgggaccaataagacatttgcaagggtagttttatttttctctcttcctgatacagaagagtgtagatgtgagtctacacaaggagctataaccatctgggtaccacatggagtttcaaaatggacccagttcagagggaatagagttgaagatgaacctagtgacaccctgtgaagtgggaatcagtgctgtgcccaaagctaaatgtatatctataggtttttccatgaaccaatacattcctccttttctcttttttgagccagttttcactagttctttcaaccaagagtaagagaaatctaagtgattcactgtgtttcaccagttaaatgatttcaggtttgtagatgtgttaatctttattaccgaagttccaagcaatttggagaccatttgttaagcctctacatctcctatcgtatatgcaagaggagatataaagacaaagtcccagaacctattttgcagcatgtaaataataaaatagaagtacagtcccagcttcatagtcaatgctttcttttccttgccagtgattccagaaatatcatcgatcttgaggtttagaaggtcaccacaggcatcccgacaacctacttgagagcctgcaatggtttactactacctgtctatctttgtgaaattctgcctggctttccctgtcacaagaaaaccctcccaagcaaaggcttctgagcctttcttggctataggtggccccagggacctcaccttggcatggcttgaaagagccttattatctagtgcatacacgttaatcaacacctgaaaacattttttcatatatacatatgtaaacaggaagaattattttagggtgtaaatctttt

SEQ ID NO: 55344 - DNA, 1007 bp, Homo sapiens
caattaggtagaaatatagacagaaaatagaatgtaatttagtacagagaaacagtgactgatatatatgagaataattttgtttcaaagtgagtcagggtaggcccggcccagtggctcatatctgtaatcccagcactttgggaggccgaggcggggggatcacttgaggtcagaagttcgagaccagcctggccaacatactgaaaccctgtctctactaaaaatacaaaaattagccaggcgtgttggcgggcacctgtcatcccagctacttgggagtctgaggcaggagaatcgcatgaacctgggaggtggaggttgcagtgagcctagattgcaccattgtactccagcctgcgcagcaagagagaaagtccatctccaacaacacaaacaaacaaaaagtgtctcagggtagagaagaagcctgctgaaaggcattgagaaagaaagtggtgttctcctttgtagttggggaaaggaagaggggagagtaggttgcctagtctagcgctacgtgttttgctgatctgagctacagtttaaacactgggtttgttggttattgctacatagaaattatataggccaactttttctgaagttgaagtcacttgtggggaatgttgcactttgtttttagttgcactacagattacctctttcaataaagaagatatcacagtgtggggttaataacagtgttctctgatgtattttattatgccagtaagaataataatacaagattataaagtaaccattaatcctttctttttactttatgtagaagaattaacacactattcttaagtctgatcttaaagatactttacaaaataaccccccccccaaatttttggatagaaccaaaacagcctggttggaggccagaaaaattgttattttgtaaaattaataattatttcaagtttaatgatgcatatttcctacttaattgtcacaaaaatgacaaagcagaaaatgaactggaaaaattaaag

SEQ ID NO: 55345 - DNA, 1120 bp, Homo sapiens
ctctactacgcagagaccacattcagtttagtcctttagtactagaaacatgggactcagaagaagtagaagataggaaatttagaatgtgcgggctgggaaagaaaggttctacaaatagggcctggagggactacggttgccaccactgcaaatttctgaactttgaaagaagtgagtgatgctccaaatgccaggctttgagggagaagacactttgcaaagtcagattttttcctgccagtatgcatggggccaaaattaacctcctgcttgaagatttcttctagttgagggtttttttttttcaattgtgctaaaatatacatagtataaaacttaccattttaaccatgttgaagtatattgttctgtggcattaagtacattcacactgttgtgcaatcatcaccaccatccatctccagaaccttttcatcttccccaactgaaactctatacattaaacaacaactccccctgaagcccctggcaaccccctttctactttgtctctctgaatttgactactctagatactgcatataaatggaatcatacagtttttggccctttgtgactagcttattttatttagtttaatgtcctgaaggtttatccatgttgtagcctgtgccagaatttctttcctttctaaggctaaataatattccgttgtacagacaccactttttgtttgctttttcattcattgatggatacttgtctcccaatcgagttttaagctttagaaaattggcatagtttcgcaggcatcctggcaaggctgaaaccaggaggactttgtttttatttgtagaaccttctctatctttcaaatgtcctggagtttctgctgttgtctttggaagcaattacatggctctgggttatgccaaattctggattctgggaacactggcttgcttgttgtggtagctacttcatggcctgaggattagctttccttttaaatattgtgggtgtggggcagatgatagtcttgcctgaccttataattctttggtctctttaaaagtggaggatgtcaaagatttgagataacgttgactcaacatctgaggctctgaaggaactatactttcttcattacagcttg

SEQ ID NO: 55346 - DNA, 1047 bp, Homo sapiens
tctacaccactcacagctgaggcgccctttgttctagcctgcatggtcccttggttccagcagttgtgccatgcttgggatgggaggagttgggaagacatggagtgtctgtgtctggggtccggcctttccattctgaaatggtgatgagtagaatgtggatctcccttagccttgggacccactaacctttgtcttcttccaaacctccgacccacctctttttctctttgctcttaaaattatccctctcctcttccctctgaggcccctgtcatcctctctgcaggtagcttcagtgtttgcaaaagacagaaaagactttgattgaaagtgacttctgatttctactttaaaaaatcaccaagggaaggaaatgctaaaggcctgactcctgctctgaaatgagaaaaaagggaaaatatagggacataaatacaagttagtattttactcagttatcttgctatagcctctcaaattgcctcctgtctcctggtactctgtctcaggagtaagccttgtgccttacagcagtaggctctgcacataaaaggagatggctgttttgtttgttttaacataaacagattgttatacctattgaatctccaagttcccacaactatattgatatgtggcaatgcagtttcacaaccagacagttcaataaacggtgtccaggttgaagggtcaactatgtacttaaaattcaacccttttcaatggcctggggaggagatgggaaggatgggagagggtacaattacttggaatgctgaaaagaatgataaggtgagactccctctctgcaaggagtctagagctgtttctaaatctgttttggttttggatgtgttggtgaatatgagtgcaagctctcagaagacatggctgataaagttgcaagtgtagaattagaggtgaaattgatgagttgggtgcttgagtttctaagtagaagaatctggtggaattctaccagaagatgaggaacatggtttaaagctcatcctttagtgatctttgtttttgtcctgattttat

SEQ ID NO: 55347 - DNA, 1021 bp, Homo sapiens
gcttgagcaagtcatcaataggagttgataatagatcagcctgattgcagagcgttcatgttgaatggaagcagaagataagattagagaaagactttgaatactgttgtaaagagtttctttctactctctttctataaatgagagttgctttctactgctcatagggtaaaattaaacctaagattcttgaactgagttgttgtgtggttaaagtggcgtatcacctggctgacaggctgatgctatctgtattcaaggttgggtgggggggaaattagagatggggagacaaattaggaggctattaaaataacccaggcaggagctaatgagaacctgaactccgaggtgtctcatgtaagtgactgataaatgataatcttatgacagatgccttgacgccaccacagaagtaaagaagtcaggaaaattatttgttttgtttaaggggaatattgcatatggtggtggaagatatagtgggttaagttgtatgcttagcatgctacatttgaggtgacagcctgatgagtagtgggaggcatttatgcggtatgtggatttcttagatgttgtctattggagccatataggcctgcttactaaacttatttagaatttccttacattgtttttacccttttaaagattattagtgaaaaaaggccaggcatagtggctcatgcctgtaaatcccagcactttgggaggccgagacacgcggattggttgagctcaggagtttgagaccagcctgggcaacatggcaaaaccccatttctacaaaaaacataccaaaaaattagctagatgtggtggtgggcacctgtaatgccagctactcaggaggctgaggtaggaggatcgcttgaacccgggaggcagaggttgcagtgagctgagatcaccaccactgcactccagcctgggcaacagagtaagactctgtctcaaaaataaataaataaaaataaagattattagtgaaaattaattttagaagccagtttttcttggt

SEQ ID NO: 55348 - DNA, 1043 bp, Homo sapiens
tttccttgttttgcagcatttgttggtccaactgcatgcagtatcatttatagaatagctgctataatagctatgttactcaattgctttccttctgcttctaagttaaaaacagttcttgtttccaaatatgattgtgccctagggaaaatggtcacagttctgcattctctggaagaagcctggttctgaaaatatgtaattggcacctggaacatacacatgatcagaaactattagaaatggctttgacactgccttttgtacatttactttgaatatgaatactataatcactttcttaagaacttttactctcagtgctacgtcccatgctgtgttgatttaagccacagacattgcccaaattatagcctagcactaacaacactaacattaaagtaatagagtactctttagcttgctgttgtgatggatttttaaggaagcagtatttccttagaaaccacattaaaacctaccaattttgtgaacatttataagaatacatctgagtcatttttgttagagaaatactgaacactaaaactgtagcagttttaagatagagtgctgttaaatgttttgaacaacaggagtttattgcatagactgaactaataaaggactgaaataattttttaatgttatgaaaaatataattcttcagcgaactaaggtatttaaatactttgtatatcttgcaatacagttacttccattgcactgacttaaaaggatgtccctcattttgtaacttattgttttgataatgaacttggcagagtttataaagtctgcagagtagaatacaaattgaccattaactttttggcaataagaatgacatcatgttatgacatattacagatctttcagcaaagagtgcctctgttccagacgaacttggtgcctgtggacattctagaacatcaagctatgcaagtcagcagtcaaaagtatcaggtagaggctaacagtgaagttgaattccttattgttccaaagggacttgaaactgctgtggtgtgggggaacgatgt

SEQ ID NO: 55349 - DNA, 1025 bp, Homo sapiens
cggagaaaacagcattatatacatcggagtatcattttaggattcaagtgtaaaaatctgtgatcaagaggctcaatagatttgggctctatggtttggtttttttagtttgagagacagtacatgaatataacttaaaccctatagattttgtcaagatagttgtaattcctgttctggaaatcttccctattacactacctacagcattgtataaagtgtgggtgttcatgctttgggaaaatgttagactacaatttaaacatgtgatgtgcttattcataattctcagtgtatcagtcataaatgaaataacaagtgcatttaagtcagagatacgtgaatggatgtaatgccgttatgcagtatatattgttaattgtcattaatattagatgagctgcagaaccacccccaagcactacataaaagactcaaaataagtttaacacttactgtgttgggcaccctaacagaagagctatcttaactcattgaatattaagatctgctggtttcaggagtcaaaatgtagaaaaagaggagaattgtaatatggtcagaaacagagaagccttttctatgtaaattcagacttatctgaggctaacagttttccgaagtggtggtgggtagcagcatgacagctgcttgccatgactgatgcagactactaggtttccattttagctctctgtaggtactgttttcttccccactgtgtcgaaagtgatttgttttgaagcaagagtagaatataacatctatcaaatatagcttttaaaataagaatacctggtctggatccagttgagcagcacagcagataaaccttagagtttttctgttcttacatgacggtttccatgtggaaagatctaaactttcttggaatcactattagtgaagaaaaatgtagaatctgtataaccagtaattccccaattcttactttcaaagtcatatccaagaaagacaatatgtcagaatagaatgactttggtctaggtgttttcacgttggca

SEQ ID NO: 55350 - DNA, 1200 bp, Homo sapiens
tattaataaatttatttttaaatattaaagtcaaatttcaaatcacccagtgttgaagaatttgcagatgtatacaatactttttctaattatgtcttttctatctccatgcctggctttttctaattatatcctagagaaaaagactaatggtatttcaaagctgtgtatttgtgacgagataaagaagagtcttaaacatcttgtttgggagaatgcacaggccagtcaggagacccacctcctcctgtgccctgagctgctgagacccgacagatcatgaaggctagtaaagggcagagaaggccctgagccatcagtttacactcgaattgttgactcccctttgtggtgtttttgaaggctgcttataccaacagctaatgtggattagtgcttatgatcttgaaaaagtcttgaccaagaatcctaaactccaccactcctcccattccagcttaacactatcagaataatatccaaattccagatttttttcttttttacttttttttcttccttttttaagagagacagtgtcttgctcggtcacctaggctggagtgtagtggcgcaatcgttgctcactacagcctcccaactcccaggctcaaatgagcctcccaccttggcctcccaaagtgctaggaccacaggcatgagccactgtgcccagcctagtttcttttctgtatgctttttttacaaaactgtgagccacagaggttgaccacttagccaatttgttgctagaagggagaaaaaaatctccaactagcctccagacaaaacatactcaaattcaaacagcagttagttttaattaacatacagaagtaattttagactttcagatttctatgctgactagaacactttgcaggctgaagctgacattattaccaaatacttcatttaagtacatactctgaagtgtcaggcttccagtatatatagcaacgctctgagagacaaactgggctcatatgacggggttgcattttattttcttaacaggtctttaaattgggcagttctgaaattctgtttggtcagttctagatggtacgtcatgtgaatgcaaccaagcactgtagttgaaattgtgttatgccactactcatgttgtcttaggtactacgcataatgttaatagctgagatgttaaagaatttgaagtctaaaatataaaagatgaat

SEQ ID NO: 55351 - DNA, 1233 bp, Homo sapiens
gtcccagaccgttgtcccgaagagcgagatcgagcttggccccctcccccccctccttccctccctccttccttccgccgcaacatggctaacaacagccccgcgctgacaggcaactcgcagccgcagcaccaggcggctgcagctgcggctcagcaacagcagcagtgcggcggcggcggcgctaccaagccggcggtctccggcaagcagggcaatgtgctcccgctctggggcaacgagaagaccatgaacctcaaccccatgatcctgaccaacatcctgtcgtcgccttacttcaaagtacagctctacgagctcaagacctaccacgaggtggtggacgagatctactttaaggtacgaagtgtgtaggccttggctttgggggtaagttcggaagagggggtatggaggaaacgggcgaaggcggcccccgaaatctgaagatttgtgggtgggggaaggtggttcggcggaggggtggctgcggcctgtagtgtgtctgggaggggtcggactggggccgccctctcgtttccattttagatttttagggccgggagagcccgccactattgatctctctcctcccccaacctcctgcccacccctggggggagttgggcaagagggatgggggagaggaggaaagagtaacagaagcctttccagtttacagctttaaaattattccttttgacgtggatctgctgagcgccaacttgttggtgcttctcccgctcacccctggccagggcgtgtaatgacttcagtattggcctcgtgttgttggtactcactatccgatccaggcagggaaatggtcagtgcgtgtgtgtcgggtggggtggggggatgagggtggagaggtgccatttcaagaggtgtacagaaggcctggaaattttcccagcaggaagtcaggagtaagaggtctcagccacctgtgcattgggctaatttagaattatctgggccctgggcttctgcggcagggtcggtgctggcttggctgtgctggggagctcacctggcgcctcctcactgcactcttgtctcagttcttgtttcgttagcaggattgactcagtcttgcagcgaggctcggagcagcccagggtcgcaggtagaggtatgcactattaatcatgctcaatcgccataaatgcatttccctggttaaatgaacgactaattagatttttgtgggtttttttggccattgctttt

SEQ ID NO: 55352 - DNA, 1011 bp, Homo sapiens
tcttaaaaacttgacagaccgcacaaagtgttttctatcatttgaacgtatgtgtagagatggtaacaaaaggacattctcttttgtcttgcccaccttttcccccagttgagtaattaggttattgaaggattttgagagattagttgctttttatagaaaacatctcttgaatacagttcaactttgggttgataaagtacacaaataaatttggaatcctcttacgagagtaggtctgattgtaattctatgaattagtttttttagcttttaaaaggtaagacctttttagcatggatacagtatggtgaataacatttaatccttagctttatttatgcagtaaactttaaacagttgaaaattgggttcctgctctttctgcggcaggttctgttttctaacataggcaaaatgttaatgtaatagaggaaagtctcgtttttaagtttcaaatgtgttttgaaacaagattctaccaggaattgtttttaaattccgttaaaaaactaaagacccagtttttttactaatattaagaagacttaagactttcagatcaaatactcactgaaatttataagtttccaactttgtaattttattttgtatgcatccagccctgcctttggctagcttttaaggaattgaaacatcttttacatggcaatctgtggggaagaaaggaaacgttaaagcactgcaaaatagtgtagtgcttaaacttacatgcacgcttttctatctaaagccattgttcaggactacaaaatttaccatgtgggtggaaatagaattttagaaatatgcagtgaaaaaacaggatttttttttatgtttttaaaaaaaaacaaagatgggtcttcccaaaagacctttttggattctattttagagttaatattcttttgttgttgttgctgttgttgttgctatttttagataaggactagtttttgtaagatgttcctcttagcaaatatgatactgtatcatctttgatgatac

SEQ ID NO: 55353 - DNA, 5719 bp, Homo sapiens
tttaaattaatgcttaacgttaatactttttgctttaaattggagacttaaatccatttttaaaggaaaatgttaagcaacccataagttaaattgtcaaatattatcaaagttaaaatattaccaaatagtttttgcaaccaagtgagactatagaaattttctgactcccagatgtagatatcagctctttataaagctagttgagtgggatttctcctctgcaaagctattaaggttttgttaaaccctagtagctttatgggtgctgtctaaatgtctaagcagtttttccaaaaatgatttacacacttaatatcagtaaacatatacttaatgccaaaataattttggaagagctgctctattatggacttgggtttacttttatcaggcttttaaacaaattcaaagtatgaatgtttgttgtgttcctcttttctattttcaggtcacgcacgttgaaccatgggagaaaggaagcaggaaaacagcgggccagacagggatgtgcggaggggtaagtagaagtacgtgcatttttcagtttttctgtgtctaataactaagtttatatttagagaactagaggcctgtcaattatacacttgagtgacaatttttttaatccaaattcaagtgttcagtgaaatagggttagaaaagtgttactttttaatgctccttagttctggattatggattgttattgatacctaacaggattaatcaattggtgttaagagtccgttaattattttactactttttcttaactcgtttcccctaaaggttcgaggtgttggaacaggaggaattgtttctacagcattttgcctgttatacaaattatttaccctgaagttaactcgaaagcaagtgatgggtcttataacacacacagactctccatatattagagcgcttggatttatgtatataaggtgagcgtacatttatgtacatttccagtaaatatctcattttaattcacatgtgtttaataatagtcttttgtaattctagatatacacagccccctacagatctgtgggactggtttgaatccttccttgatgatgaagaggtatgtcaacaagggtaataatttgttttcttctgattactctcatatttttattatcttttatttattggtggtttaatgtcttcaagaacttcctgtagttaaatttatttcagtgagatacttttggaattaatgtccttttactgagacctgatggcttttatgtattttagggtaaatttctgaagttttattttcttgttttaaaattgtttaaatgtgtttggtaactattggaaaattttctcttcttaattatgttctgtgtattgtattgatcctgaattgtatagttaatagtgacttttcaagatggggcatgctcaagatcgaacagataataaaagatatgcacatagaatactaattgtagcttttttttcttctggaacatttcagttcttcaccctctagcttcttccaaatatcagtattcccacttgcatagaagtgcagaattgaagagttgggtgttacataaataggctaagtgtttggatgacttgttcaaggtgacaaaattttaattccagttttctgactcctagtacaccacacacacctttaaaaaagaaattttttaaattgtaattcgagtctccctaatttgaaatctgaaatactaagttagatttaaatcgtgtatgcattggctgggcgtggtggctcacattgtaatcccaacacttcgagagttcaagaccagcctgagcaatatagtgagacctcatctctacaaaaaaaagtttaaaaattagctgagcatagaggtatgcatcttagtcccacctacttgggaggctggggtgggaggatcacttgagcccaggagacagaatttgctgtgagccaagatcattgccactgcattccagcctgggtaacacagtaagaccctttctcaaaacaaaacaaaatatcatatatgcattaatttacttgcatggtgaagtccaacatgtcaaaaatgaaatgatgagctgtattgtccctatgtctacccagtctactactttgtgttttaaggttcataagactttttgagtgctatgtgtcagtagtctatttacagagttcatccaaagaatttattgaattaaaggatggttctaatggaaatctattgtgttttgttattacatgcacacctaaaaaaaaaaaaaatctcatttagacatggagaatttttatttttctctttttttttttttttttttttgcctgttaactgagttacttcactcagaagaagcaaaacgtgttttaaatcacaatctttaaggtctttttatctttagatcagtttttcagactgaagtgcttctcccttctgtctttaaaaaagcatgttcctcttcataattggtgttgtattggttttgtttctggatgcctctattttatgttttttattgtgtttacaaatctgaggtcctctatttaagctaacttattgttttcttccttagatatctgcagcgattatatttggaaatactgtatatctgaacacttaaatgtgtgtgagtgcaagcagttttacctttagctcttgttttcctgtttagataacaaatctcactttccttgtgtgcttgcactataggtttgggactgacaatagctgactaacatgtcctgagctgtgagagggcatagcaagaaggccttcatgcggtaatgacccttttcagagacaatggtcatcatggattatgcgtttccaattatttgttcatttatttattttctacataactaaattagaaacctcactgcttcatggcagttggtttgctattgcttccagttttattagggcttcattttatattagagctgttaaaagataacctttagacaggaattatctaaagtagatcatatgtagctaggttatggtgcaaggtatatgatgtgtgcaaatatgtccacagaaataaatacatagtaggtatgtggaatgtaaatttaagtcaatcgttccgcatagtttagaaatgtaaggggctttttcatattgttaactgagtgagatcagttccctttatgcctgtgaggctgcagggtttgttctcacttgcatgcacacactaagcccaaatatttctgttcattcattgtcagatcaggatatgaaaataaaatttttctgttagttttttttgtattgagattccaaagatggtaatatttttataatattcatgtatatatggaaatactttttttgacggctagggtatcttttgtgtttctgtaggacctagatgtgaaggctggtggaggctgtgtaatgaccattggagaaatgctacgatcttttctcacaaaactggagtggttttctaccttgtttccaagaattccagttccagttcaaaagaatattgatcaacagattaaaacccgacctagaaaaatcaagaaagatgggaaggaaggtgctgaggaaatagacagacatgttgaacgcagacgttcaaggtaatgtcactcttgaattatgcttatttttcatatatgctttatacaaaattaatggttctgagaaatagcaagttcttaggaatttgtttttactgttcattttattagtttgtcacttttaccccccaaagattattttcttcctttcagggctttttctataaaattatgcatctgtaaatgagaacaataaaattttttgctttaatgattcttgacatggccttaagcttgaggacatgaataaataatgctgttgaaagttttactgtgaaaagaattgcatatgttttattcattgaaattttctttctccctccgccttccttaggtctccaaggagatctctgagtccacggaggtccccaagaaggtcaagaagtagaagtcatcatcgggagggccatgggtcttctagttttgacagagaattagaaagagagaaagaacgccagcgactagagcgtgaagccaaagaaagggagaaagaacggcgaagatcccgaagtattgaccgggggttagaacgcaggcgcagcagaagtagggaaaggcatagaagtcgcagtcgaagtcgtgataggaaaggggatagaagggacagggatcgagaaagagagaaagaaaatgagagaggtagaagacgagatcgtgactatgataaggaaagaggaaatgaacgagaaaaagagagagagcgatcaagagaaaggtccaaggaacagagaagtaggggagaggtagaagagaagaaacataaagaagacaaagatgataggcggcacagagatgacaaaagagattccaagaaagagaaaaaacacagtagaagcagaagcagagaaaggaaacacagaagtaggagtcgaagtagaaatgcagggaaacgaagtagaagtagaagcaaagagaaatcaagtaaacataaaaatgaaagtaaagaaaaatcaaataaacgaagtcgaagtggcagtcaaggaagaactgacagtgttgaaaaatcaaaaaaacgggaacatagtcccagcaaagaaaaatctagaaagcgtagtagaagcaaagaacgttcccacaaacgagatcacagtgatagtaaggaccagtcagacaaacatgatcgtcgaaggagccaaagtatagaacaagagagccaagaaaaacagcataaaaacaaagatgagactgtgtgaaaatattttgtaaaagtggatcacattgaatcctataaatgattaaatctgcttttttcccccacgttgagattgtgcagtagttcgcactcctcaagctctccctgtaggctgcattttcatttcctctttcgtgtagggaagtgcctttgtaattccatttattgcattggtgttttcacccaattgttaagtttgatacatgatgcacagattgttcttgcatttttattgtttgtttttgaaatgtacagtctgtacatatgtcctgaaaatgttttaattcctttggcatggttgccatgttggttaaatttgtataaggcaataaactgccactaatctatttttgttttgtaggtgtgggattatggtttgtgtactgaagttagcatggctgtgcttttcgtaatagaatgctaaagactttgagaatggatcttggatgtctattataggagaagtatgtgctgccaatgtacaagaaggcagcattgtaggattaacattcttgtctactgtatattatcttggaaggctcttgttaatatgttacacttaatattctccacagttacctttagagagaatttatgagaagttagtttctgatgcagaggtttttaggctgtgatttcatcaaaagtccttttagcattctacctcaaagggacacttagtatgcctaaaatttattcacttagttttccttttttatttgaaaaaatacatgacatgtaatctttttttcttgaattctttctcagattttaaagtactatattaaagaaaaaaattaatgtctaaagcctagcattcttgcagaaccctatactaacatgtaatggggagagggtggggcagatgagtagagaaacagattcaagcctcaagcttccaaagcatttttataaatggaaaatccttaaattatgaaacagcttgatat

SEQ ID NO: 55354 - DNA, 1347 bp, Homo sapiens
tttttaaacagagataaaagcaacagtgtttgatgactgcaagaaagaaggcgaatggaaggtagagtttgcataccttgctcttataaaaaataatacaaactttaaaaacaatacagtataaaaactacatagtatttacatggtattaggtattctagtataagtaatctaaagataatttgacgtatgtgggaggatgtgtgtaggttacatgcaaacactacactattttatataagagatttgagcatccatggatttttggtatacacaggggtcctcgaacccccatggataccgagggatgactatatagggtctggaatcacactgcttggctccaaatactaacttcaccacttaatagctgtggctccttgcacaagttacttgacctctctctgccccatttccttgtttataaaaatggtgatggtaatacctcatatggtaattgtaaatatgaggtgaattaatccatggaaattacttaaaacagtgctttgtgcaataattgttctacaagtggcaattgtaattttaagaaaatttgatgttaaacagtgtcattcaaaatgaataagctctatgtttcaaattagaaatatttctgtttgtttacttatgtacgatactatatgcatgtatattgagaaaatctctagctcatgcaagataaaagatgagatcattttgcctactgttctgatattttgtgttataaaaggcttataaagtttaatggataaaattctttttttcattcttggtaataggatgcttacagtatttttaaatttgtgtttgttttaagataatgcttttagatgaatttaccactaagcttttggcatcgtgttgcaaaatgacagatcttctagaagaaggtattactggtaagtgttattcttggcatgaacactttttaattgtaattgggggagatctgaggtattaaattttagttagtagttgtgtttctaaggagcttatttttttaaattactgtagccataactattagatttaacattcttttctctgaatcttctgtcagtttttttccctcagccgagacatataattaagacctctaaccaagcctaacttaattgctttgttgaggttgttctttaaatgttttactcatatatacatatatatatataaaacaattttgtatattgatacacaagctttacttcagtattttgatttagtttatggtttcatatatcgctttaaaatggatatcaagatttatgtcataaaatcagctgttgtacatgtttacaaatgcataatgctgacttcgtaaatttatctttattaccagaaatgaga

SEQ ID NO: 55355 - DNA, 1070 bp, Homo sapiens
aatatttcaccattgttatggtttactaacagaaaattcaaagtaataaagtacactttagtagaaaaatattgccataaactagtttgcttaggaaagtttttttctgtgttagaagattatttgcattcttccgaatgagaatgtataagtaaaaggattccttttttccccatatatgaaagcagaattaaattgtataaaataacatttctttgcatgttttgtttttcatgcagttcctattgaactataccttttggggggatggtaatgtaggtaaaagaaataatctatagtcttggattacttctttatctcagtgactttcctgtagcatatttgtatgtatatatgaagatgggtatatatgtgtgtatgtatatattttatgtgaaaggaaattctttagtttataatctgactctatgacctaactcatacttgatgccaacctttcagagccaaattatcagatttctttattctgtacaatatctgagaatgcatttttgaaaacctgatctctcacttattcccatgtagaacgttaatttggcaatctctgtttcatttcacttctaaaaaactttagcagacatttttaaaaaaacaaaaagatacacactttttagtctctacatgttggctgctagtgggttttaatgacattttatatcttatctgtaatataattccataagagaaaaattcatgattggaaaaaaaaatgcaacttaaaagtaccatttttcacctagcaaattggcagagggatttaaaatatatatatatgggtatgtatgtgtgtgtgcattctggctattctggttatcagtggataatggagcagaaactgccatatactgctagtgggagtatagattgatacagcctttttggaaaatagtttgtaatttgttatcaagaaccttaaaaaatgttttatattttagagtttattgttaggaaataaataaatggtttagctaagtttctagtagtaaataaatctaattaaattttagcattaataaataatagaccatatgatgatatctgaatgaaat

SEQ ID NO: 55356 - DNA, 1063 bp, Homo sapiens
ctatatgctttgtttttttttcccctcagtttgccctgataatctctttaacaaaattaaggcttcttgctccaagtcaataagaagatgtaaagaaataaatatttccttcattccacatgaatctcaggtactttctatttttattttttagttcatgagaggtttcaaatttggttttatggcttattgttaataaagtatattctgaagatattttttatatgtatttggtgaattttgaacctaatccacaaatagacatttcccatgatgaagtcagacgcgtgagcaataaattggaattaaaaatgaatagcagggcttaaatttcatatctgccaccaagtcctttgtcaaattacagaactaccaggttatgaaatcaagagagttttgagcacagtctttgttagatgactccaaaaaaagtgtttcatttagcttgtgtaaccttttgtgatattaaaacaaatgctctttaataaactttttatataatattatgtaaattattttaatttataaagtgaggggatttttgacttgttttgcctttggaacattgagccttcaattaataatagcaatgattataatgatataagcaaacactcatataatactccctatgtgtcatatactttcctgagtgttttacataaatttattcatttaatcctcacaatagccatagtaatagattgtacttctccattttgaagatcaagaaatcaaagaggttaagtaccttgcctcaaatcacacagctaatgaattgttaaggtttgttttgctctgttctctgtgtttggattctagcattttatagaattgaaatagttgactgttgtttggaactatgatcaatattttaagggatagacaagtcctagacaagggatttctactatattacttttaagatactgctgggttttttgtttttgtttttttctttttttgagactgagtttcgcttttgtcacccaggctggagtgcaatggcgcaatcttggctcactgcaacctccatctcccaagttcaagcgattctcctgcc

SEQ ID NO: 55357 - DNA, 1011 bp, Homo sapiens
actaggaatggccgctgtttctgaaaagttactgaacatgctcagtggtgaagaaggattgaaatattgcagcataggcagatttcaggaagatgtcttacagaaattttgttacattaccccaggctactgcactttacatatttgaaggacaacacattatattaagcgaaggaaaattgatttaactgctggcctctgaaaaattctcttttctcctaccaggttctacacatgttttaacacccaaaaagctgttggatgatataaagatgctgaataaacccaaggataaagtctccttaattaaagatgaatagcatttctttttggagggtttagagattcttactaatatgttgaactaaaatagaaagaaaatgttgctgtcatgtaatttaaacaatgtaaatattttatggaataatggcttttcaaatacatttcttaaggaactgtttatgattattactggatttgtcatttttgataatttaaatattgctgctgctttgtagatgatgagaagaaatgttaaagtgctttctaaaaggaaattttttcacctttggaggagaatatattagagttgtgggtaatttttcacagccacctatgtacatactaattacccattggatacttatatctaaaagtctcatgctgaagtatagtttttgggaaagaatgattttaaataaagagattgtaaaagtaaaaaactgtaaatgtatatgtatgatagaattgtttcctctaagtgtagtttttctttcaactaaaattcagtttatgtgtaaaataattcagtcattaatagaaatggagtgatttcacagtgtgtactgttttgccacatacttctaaagaacacaattttatataattttgaaatcatgtatgtttaaattagaaaaccaaaaatcatgaacattctaagagaaaataaatatagaatttaaaaaattattctggtttgtgttttctgtaggggagaggggaaagttacaa

SEQ ID NO: 55358 - DNA, 1038 bp, Homo sapiens
ttcattagtctggtttatgatatagctgaaatacttaaaaggatgttatatagaagaggaattaggctttattgtatatggcagcagaaggaagaagtagaacaaatgggtagaaatggaagaattgctcaaagtatggaacgattttcttacaggaatattcaaaattaagattagctgctttatgacctatgtaggaatgctatagtaagatagtggactaactgacctctaggattgtttataacactgagattccaggactttatgattgtatatctaccaatttatctcatatatgtatatgtatatccttctttgtctttctcaactgttatctcagaggttatagtttatgtctgatatgctgtagctctctctaatgtatcggtatggattcatttttatttaaatattctcagtctttatcactgaagattttacctttattcctctctttttctttctcaccctcctattagatatattatagagctgctcattttgtcctccttttctctgaacttctctttattatttttcatctgcttattctttctttagctgcttaactagtacattgagggtttgttgttgttgttgttgttgttttggtgggggcagacagagttgcactgtgtcgcctgggctggagcgcagtggcataatcttggctcactgcaacctccgcctcccgggttcaggctcactgcaacctccacctcccgggttcaagtgattctcatgcctcagcctcctgagtagctgggattacaggcttgcatcaccacacctggctaacttttgtatttttagtagagacagggtttcaccgtgttggctaggctggtcttgaactcctggcctcaagtgatcacctgtgtctgcctcccaaagtgctgggattacaggcatgagccattgcacctggccctaactagtacattgagttattaatatcagtgttcatggtagttttttgtttcattttgttttggggcagggtcttgctctgtcaaccaggctggagtgcagtgg

SEQ ID NO: 55359 - DNA, 1116 bp, Homo sapiens
ttaatactaaccagtattactaatattaatactaagatttaatataaatcttgctaaatactgacagtgcatatatatatataaatataaatatataatatataaatatatattatatataataaatatataaatatagacagatatataaatataaatatatatagatagatatataaatatacatatatgtataatttttttttttttttgagacggaatcttgctctgtcgcccaggctggagtacagtggtgcgatctcggctcactgcaagctccgcctcccaggttcaccccgttctcctgcctcagcctcccgagtagctgggactacaggcgcccgccaccacgcccggctaattttttgtattttttttagtagagacagggtttcactgtgttagccaggatggtctcgatctcctgacctcgtgatccgcccgcctaggcctcccaaagtgctgggattacaggcgtgagccaccgcgcctggcccgacagtgctaatatattaatactaaccaggatggctaatgccataattatcagcactggaagatgaagcagcgctggaatttccttcatgagtgctttaataaattccccagttccttttccaatatgcttcaatggctccgttacaaatgtggtgaatgtaactgcaagtgcctaaaacgagagaaaagcaacttaattttctcctcacaggactaaggtacagaatgcatcaaaattcattgagtactgatgctgaaagtatgttacataaattaaaatgctgttgtgccatttttaatgtgaaaatcactgtgcaaaagtattttttcttggacaaacgcttattagcaaaatgactcaaacactaaagttctttaaaatacaagggatttctgactgactttaagtaatttttacaaaatatatgctatacctttgttggtgggaccaaccaaatagggttgactagtaagagctcatagtatttttggcatgggtcatccttataggtccatgaacttctaaaccattctgtttagagaaacagacaaaacactgatcatttcttttaatgttgcatttcattcccaaacaagacattactttggttttgaccc

SEQ ID NO: 55360 - DNA, 1044 bp, Homo sapiens
ctgccttcctgagcattccatacagcatgggatgattaattgctgattaaaacattaataaaaggccaaaagtcatatgcacattgaagaaatactctgttgtgtccttcatttcatcgtctggcttcatcttgtttctgtttctctgtccctttgtttctctctgtgtatttattctactcttccctcctgcccttccttccttctttctcttgttaaattgttgctttggaattagaaagaggcagattggtccagatgctctgcttgtggatctctgcctcctttagctttaaagttgctgaaagtcagcagaaaaactgccaggttagggctaagtattggatctgtgctccttatttgttgcctacttgccctttgcaaagagaacatggggaagcaggccagctctgcactgtaatgtattatagctgataaatgcaaacttgatcaaaacaactagctccttaccttgattccgatgacagcactaggctagaaacttaacccttatattatactttgactctaactaatgttgaattgattttatggttacagattgatgagtgtgaaaagaaaaagagggaagactatgaaagtcaaagcaatcctgtttttaggagatacttaaataagattttaattgaagctggaaagcttggacttgtgagtatttgatggtgtgatactaatccgtatagtgtatatttttatttattaatttcaaataatatgaagaagtgaaagcatcatgatgctttttaacagagaccacctgactgactctttaaccagaagctattcattcaggattaaaggcactactatactgctttgcagtggtctggtggaagatgagcagtgcagaccgctctttctcctctagtttgtatggatttacttactcagctctgtgcactgctccaccagttaatggaggtgaggaggtggggtgataattctgttctgatcctactccttgttttctctcagtatatgctgagaaaaagaaaaatgtgttttctgtagtttttctccttg

SEQ ID NO: 55361 - DNA, 1068 bp, Homo sapiens
ctggtagctggttatgctcatgatgatgactggattgaccccacagacatgcttaactatgatgctgcttcaggaacaatgagaaaatctcaggtattaaaaaaaattcgtgcatgtgtgtgagaccttatcagtcccatgatggaaacagtctagctctgttgttttgcacagagctatgagggtcatggatccatgattagcaattatgcagaatattttcttgacactgttaatctaaaattatttcaaacctacctggtattgaatttgaatgtaaagcccttgaagtagcaaaataatatgattttagttcttagtgtgtacatttgaaactttttttttgtggttcagtacaatttaagaatataacatgcagagtcatgaaatgatgaagtcagaatcttagtcttcattaaccaaaggctatttttgtaactaaactataaagaaataaaatgtttctatactctgttttaggcaaaatatggtatttcaggggaaaaggatgtcagtcctgacttgtcatgtgctgatgaaatatcagaatgttatcacaaacttgattctttaacttataaggttagtttttttattgataaattttatatttttatattatgttaaatcgctctatattcttgtctctgctgataaatttgtatttctagtgtttccgtgtaccgtatgatttttatatgtcaaatttttctttggatactctaaccttggtttcttattagttattctagccttggtttttctagtagtaccttgtattttcctgtaataacattgacatctctgtgttgtaagtatttctttaccagactgcagacttcttggtgcaaggaatacgttttattgatcttaattctctgtcacctatcacagggctgaggcatagtaaactctcaacaaatgtagcaaatgaagaaatgtgtctattaccagcttatacgaataagagttactcttaagaaggattattataatttagtgtgtaatagctattcattccttcatttatccaatcctcttaaaaaaatgtagctgaagagtttacac

SEQ ID NO: 55362 - DNA, 1105 bp, Homo sapiens
tgtggtcccagctactttagaggctggggatcacttgagcccaagagttcaaggctgtagtgcactatatttgtgtgtatgaataacccctgcactccagcgtgggcagcagagtgagatcctgtcttatgcctgaattataatagaacagtgtttttatagataaaagtttaatgtactaataaaccaagtttattatttttattttagttgtgaaaacattatgttcctatcttgaaagctgttgcatatcctacaaattatatgagtattctgtggcaatataatttattctttgtactcttgtcgttttcatatttcatagcatgttttttatagtgattatttgatcatttatatttttcttacagctggaatttaccatgcaagaagctgtgcaatgtttacatgctctagaagaatactgtccttctaaagatgactatagtaagctctgtttgcttttgactttgcctcgtctgaccaatcatgccgagtttaaggactggaatcccagcaccgcacgagttcactgttttgaagaggcttgtgtcatggttgcagaattcatccctgctgataggaagctaagtgaagctggttttaaggctagtaacaatcgtttatttcagcttgtaatgaaaggcctgctttatgaatgctgtgtagaattttgtcagagtaaagcaactggagaagaaattacagaaagcgaagtgcttcttggcatcgacctcttatgtggtaatggttgtgatgatttggatctgagtttactgtcatggcttcagaatcttccatcttctgtcttctcttgtgcttttgaacagaaaatgcttaatattcatgttgacaaacttctgaaacctacaaaagctgcatatgctgatcttttgactcctcttatcagcaaactctctccctatccatcatccccaatgagaagacctcaatcagctgatgcctatatgacccgctctctgaatcctgctttagatggcctcacctgtggactaaccagtcatgataagagaatttcagaccttggaaacaaaacttctccaatgtcacactcctttgctaacttccattatccaggggtaca

SEQ ID NO: 55363 - DNA, 1026 bp, Homo sapiens
cagtggcatgatctcggctcactgcaacctccgtctcccaggttgaagcgattctcctgcctcagcctaccaagtagctgtgattacaggaggcttgccagcacacccggctaatttttgtatttttagtagagacggggtttcaccatgttggccaggctggtctcaaactcctgacctcaggtgatccgcccgcctcggcctcctaaagtgctggaattgcaggcgtgagccaccgcgcctggccgagaatgatgttcttacaggtttgtgtaattgtattcttccttatggttatacttcctggatgcttaattaagctcggttgaacatcacgtatatttgtggaataaggggcttacaaccaacaggagtagacaaaacctgaacatattaaatgttaagtaactgaaaaatgctttcaaggcagatcagctttgcaaaatgagaaaccaggaaggggacaaacaaactactggagttttctgggacgaagtgggacctaggaaagcagcgaaagaagggtagaaggcaacattaatttcattaacctttattaattatcggggaggagtatgaagagtcaatcctaatgcgcagtcttctccatttgcaggcgacaatcctgttcgtgctattttgggacatggggtcaccggccagctaagggtctacgtccctgccaccagtctcacgctattgccgcacccgttctgctactcccccgggcccctagccggtccctccaagcccgacccccgcccgccccgcccaggctttggtccgccccgcccaggctttggtccgccccgcccctccccgccccagctttgggcccgcccctccacgcccctccccgccccgccccgccccgccgactcgcccttcggctcaggcacctgcctggccgccccgcgcggcggggtcctgaggcgcctcggggaagcgcggcgattggctgccgctcgcgggtagagctcggctccccggcacttgacaaccgcagtctgcaagaggctgagctga

SEQ ID NO: 55364 - DNA, 1305 bp, Homo sapiens
acagctatagtaggccaggcgcggtggctcacacctgtaatcccagcactttgggaggccgaggcaggtggatcacgaggtcaagagatcaaaaccatcctggctaccatggtgaaaccccgtcactattaaaaatacaaaaagttagccaggcgtggtggcaggcgcctgtacttcccagctactcgagaggctgaggaaggagaatcacttgaacccgggaggtggagcctgcagtgagccaagatcacgccactgcactccagcctgccaacatagtgagactccatctcaaaaaaaaaaaaaaaaaaaaaaaaagctacagtatagcttacaagggcataaacatacctaacacattaaatactactttatcctttaaatagtcaaaagtcagaacaacggcatggtttgcaaggtactttgacttatgtgtggtcattaaaacccagtaagtaattcaagtatggtaatataaaggcaggcaattacatgcaccaatatcaccctaaaatcaaaggcataaaaataaaggctgaaaactttgtgtttctccatctttcatttacatggctagatatcagaatcttactttagaaaatatacaattattatatatggtttccccagatggtaattttcggaaactacaaaaagtgtcaagatccataatttgcttcatcaaatgcttttctagctcgtttcaattcttcattcatagtaagcaagtctttaaccctggcaaacttccttgggtcctttcgaatcaagaagacgatatcttcaacttgtactcgaccttgtcttccaattgacattgccttgtgagtctattacaaagaaacatattacatttaacttttttaaatctaatattttactgttttaatttgcatttattaattgcaagtgaggtagaagattttctcttattattattattatggctattcatttgtgaattatctttctactcatgtcctttgtctattttctactggattattagcaatgttctcctttatgcttcacaggcactttaaaaaaaatcttaaggacatgaaagctgtcaactttattgttccttttttgttttttgatatatgtagattttgtcttcatttatataaaataattttataattttgtgtacccacccatttcatttatgctttgtgtcctcctctatcttaatacccaataaatattggtgggttttctaaaaatcaaataactctatctcatcctgtcattatatactcacctgtgcaaaatcaaagacctatcacagcattatttctaatg

SEQ ID NO: 55365 - DNA, 1043 bp, Homo sapiens
gctggcggatcacctgaggttgggagtttgagaccagcctgaccaacatggagaaaccctgtctctactaaaaatacaaaattagctgggtgtggtgatgcatgcctgtaatcccagctcctcggaggctgaggcaggagaatcccttgaatccgggagacggaggttgcagtgagccaagatcgtgccattgcactccagtctgggcaacaagaacgaaactccatctcaaaaaaaaaaaaaaacaaaaggaagaaggggggatagaatatacatgtataacctccatcctcaatgataaatagtaaccaataacttctgcaaacaagcactcaaatggatagcttatttcaaagggatgccataagttctagtcttacctaaagtttaatatttcaaatctattcttcaattaactaagaccagttaggaaagaatcttaccatttcagtgataaactctatgacaagatcttcaagaatatccactgactcagtataaggattctggtcatccccaaagccatacatcatacatcgcactgtaaaagaacaatcacttacttttgtttacttttacagatttaacaatttgatactttaaaaaaataaagtagaaatgaaccaagttatagataatattggtatgaaaacatatttacatcgtatttgttatctccaagtatggattcttgtgtaaaaggtttaagaacagtctgatgaccaactgttcccacgtagcctccagcaaaactcttccttcctcccacctactgaaccctaaggtaaacagtcttttcctaatctctagcatctacttaccagtccctgcccccagcagaacacctttaagtaggaaactctggcaaaggacaggacagacagcaacagcttagccttttttggaggtggtttttgtgtgtgggcatggcagtggggcgttggaaaaacggcagactctttactgatattaccataggggaaaagacatgagagacagttctccaaatactttttttgtttgtttgtttgtttgtttttctt

SEQ ID NO: 55366 - DNA, 1415 bp, Homo sapiens
ccattgcactgcagcctgggcgacagagcgagtctccatttcaaaaagaaagaaagaaattgaagacaaattaaagtcacgatcacagaaaaactaaagatatgtatataactatgtagttatacaaaggtcaaaaggctaagtgccgtggccatcgcctgtggtcccagctactcaggaggctgaggtgggaggatcacttgatctaggagcaatgagccgtgttcgcgctactgcactccagcctgggcgacacagcaagaacgggtctccaaaaaaaaaaaaccacgattctgtaaggtggaaattagtactgccttttcctgggacctatgttcccctccgagccacgcgagggcagcaacgcgcgcactctgaggaacacccccttcctcaggactcgtccgcctgtgctcggtggtttctcccagaatcctccaaggcgcgggagggggcggagagcttaaaagtcgcggggggagcggacttccgctgttttagggagggagagcggcctgggtcctgggtgttgtgtgcggagctgtggcgtcgcgtgtgaggcgcgtgcagggtgagtgtgagtggacgcgtgagtgtgtgagtgtgcgcgcttggagcgtgttaggcgagtgcgtgcgcccacccctgcgcccctcctcccgcttacactttgatcttatttgatcggatcgtgaccccagccccgccgggccgacccgaaatgaaaagctctcctcctgcgaagccccctcggggcgctgtgcagcgaggccccttaggcggcggccacgctgtggtccccgaggtcccggagctggccctgcggggcccggcgctcagaagtgatgaattgatcagatagacgaggccgggcttgtccccggccactgattatcgaggcgattctgatctgggcacggccaccgggctgcgggctgccggtggcgtaggggcgagcacgtgaacggcggcggcgggcggggatgctgagcgcggtggccaagggtaaatgagccgctgcccctccccctggagctggaaggtcgcggaggcctttttggccgctgatatactttcctcccactttcccatttctccttgtttttcttttttcttttgttcctttttttttttttttgagacagggtcttgctctgtcgcccagactggagtgcagaaccgcaatatcggctcactgcaacttcgacctccttggctcaagcgatcctcacatctctgtctcccgaataggtggaactacaggcgcgcgtcaccacgctcggctaatttttgtatcttttggtagagacggggtttcaccatgttttgccaggctggtctcgaactccagcctcaagtgatccgcccgcctcggcttcccaaagtgctgggattacaggcatgagccaccgcgc

SEQ ID NO: 55367 - DNA, 1006 bp, Homo sapiens
ctctaggcagttatctagagcaaatgattttacaaaccttctcattctctaactaaaacaaggactgaatataaacatgaatgaggtaaagttcattaagcccacatcaggaacaatattcctgagtctccagtgagagctcaccactccctagacctaacccaaagataattccatatcaacaagagttatcatatacaacaatttagtgtgtacggagttggtggatttcaggcccaagagagccttcactatacttttggggaagagtagagcacaatagaacctgactagagcagggacacaggtggctgagctaaccttgggggggactgacttctgtagataccaaaggatgacctggacttccgcttagcagccttgtacaaccaccacactgggacattcaagaacaaaagtgagatactgttaaaccagaaaaccacgcaggatacctataggtaagtggtagaggcagagcctctccagcctaaacatgctgccatccagtcatataaggtaaaatgtcacctggaaaatgataatcactaggtactcatttgtatacaaatttctgtatttttacatctgtgtctataatatagtttctgtattttcactgtctaagatgaacagaaatctcccaagattgtgctcatctgtataaacaaaatctttggttaatcccacagaggtaaaaagagtctttggctgctttattcttgagatcacattcaactaccttgccttcctcacctttctctgattgatttcactctccacttttcttccctatgccttcttctagaaccaagatccaattccctggagaatttttaacccctcccactccacccatcactttcctggctaacatcagacactggatcaaccctaaaaaggagtccatccacagcatccaaggatccataggtaagggttagaggactgggtaagcagatggggcagtgggggagtctttctaaatggacccatgaatcaggga

SEQ ID NO: 55368 - DNA, 1137 bp, Homo sapiens
tgacaatttggtttatccaataatcagattaataaaggtataccatttctaaggcacgagagcaggaatcttaagctgaggtagccctgggactaaatatgccatcctcttgtatcaagatggagaagacggccgaggttcagggaaagagcccagtggaagaacccaacctagtgagaggaaaacgggcacctggtgaaggccccggcctctaagctagggatgaggggacaggcctctgcctagcctgagacaggagtaggaaactgaggcattcacacttttatgtggcgatcacagttcctgcagactgtagcagagctggggagcaggaaccagaggtatagtcccacgcccacccactctcccctcccctccctccgcggccccgcctccaaccagccgcttccggtcgcggggagggtcgcctgcgggctccagctgcgcctgcgcaggaagggcgggtcagcgcgccggcgcagtgcggcggtcacaggctgagtgctgcggcgcgatccttgcttccctgagcgttggcccgggaggaaagaagatggtgctggatctggatttgtttcgggtggataaaggaggggacccagccctcatccgagagacgcaggagaagcgcttcaaggacccgggactagtggaccagctggtgaaggcagacagcgagtggcgacgatgtaagtaccgggacgggcgggttacctccttgatgctaaacccaattttctctctcaaatccagccaccgctcctgaggccacagcttccacccttcgtcagaccccctcccagggtgcggtggctccgaggttctccccatccccgaaaacacagcctggtcgccggggtcatcccactttctcctccacccgggcggagcgaggtcccttccacgcgtgctcagtgccgttcgctgccagtgtgcgtacgcacgcgcatcgggagctgtcaagccttcctgccccaggggttgccagaacatgccggggcgggaggttgtggggtctacgcggctttcctaacacgaatctttggtcccccccagtctttttctcatcttcagcaaggccagagtggttttcctttgttttgataggatcaaaggcttctcctgagactgcgtcac

SEQ ID NO: 55369 - DNA, 1010 bp, Homo sapiens
aggccgggcacagtggctcacgcctgtaatcccagcactttgggagggcgaggtcaggagttcaagaccagcctggccaacatggtgaaaccccgtctcttccaaaaacacaaaaattagccgagtgtggtggcgggcacctataatcccagctactcgggaggttgtggcaggagaaccgcttgaacctgggaggcagaagttgcagtgagccgagattgcaccattacactccagcctaggcaacaagagcaagatgctgtctcaaaaaataaaaataaaaagctgtaagattttataacttcatgaggcagatccttcagctctgccggcatttgggccttaacctgaaatcagtactaagaagtcaagatcaggagaaaggagtatcttaattatgggcatttctttggtatagtcttggattctttattcctaggtagatttcgggcagacaacttgaacaagctgaagaacctatgcagcaagacaatcggagagaaaatgaaggtaagagaactgaataacaaacagccatgagaacttgagcggagatatttgatcttgctcttagctaatgttcacagaagttctaactcagtgtttaagtctacaagatgttcaatttcttaccaaaggggaaaatattattttaaaaagatagggaggcagggaacttggaggcattttcatatactttaccacaagtccatcttctgtgttcaggtaagattctttgttgtctagctgtttgttgtctattctgttcttatattagaaatataaattccaccagtcatcttttttatggcagatttcagatttgtcgtctcagcgtagttatgctccataatgaaaactacagattcagagttcaaatcttgctacgttatgtgtcttttaggcaagttaatgcctcagcctcagttttctcatttataaaatgacaatactaacactcacctacagaatggaattgttagaactttttttttttaatttaaacgcca

SEQ ID NO: 55370 - DNA, 2301 bp, Homo sapiens
agccagacgtggtggtgcactcctgtaatcccagctgcttgggaggctgaggcaggagaatcacttgaaaccggaaggcggagcttgcagtgagcccagatcacgcaaactgtactctagcctgggcgacagagtgagactccgtcaaaaaaaaaaaaaaaaaagaatccacactcaggtgtgtctgctccagggcttgctcctgagcactgcactacctctccagcgcttatagctcatgagcatttcgaataaattctcttctgattcctatgatgatctatgtacagggaatgacattcttctcatattcttcaggatgttaattctctgacccagacagattaattgattttaggatcaaaaagctattaagtggcagcatagggaggggcttgacactttgacttctggcttccagtgtactaatttttttcctacatgttgtatcttttagaaaaatttatgtaagaagttctgtgattcatttatataatacgttaatttggtgtacactttataaaacaatgccagagattttcttttatttatttgtgttgggtttttttccttcctgcagaaaaaagagccagtgggagatgatgagtctgtcccagagaatgtgctgagtttcgatgaccttactgcagacgctttagctgtaagttatagttcttttctaagttaggatctctgctattttgtcttaattttattcctagacagcaagtgctctcactctgctccacacagcattgtgacatcctttcatttctgctgctgggaaatgtccccacccattcttgttatattctatatttgagtatttattagacagcagagatggagacagatggagtgggagagtcggagagtcaaggacaggaagaatagaaaaaggaaaggaattgtgtttggtttatataactccatattctaccgtttgttacacaaaggcaagaaacttcagtttactgtaacacagtaaatattcagtacgctggcaagagcagtaatttttgagttttttagtcactgaaccctttcttgaaacccttaacatatagcaagaacataaaccaaaaaagcaaagttgctgtgcttgaaggtctcggattgggggcctgaacctgcctggccctactgctaaagcgcttgcctcaaagaaataagagcacagtttgaaacacctgcaatacagaatacaaaatatgcttcagacaaatctcttactcctaataaatttataatcttcctagagaacagttgaatgcagcacatcaatggagtgctaaattggttcagtcaagaaaatcagaaagtgcaaattaagggaaagttctcataagagagcggcagtacttaaatttctgcaatgtatgggaacaatagatagtggccagaactatctatctctgcctcaagcacccccaaagaaaaatgccgatggatttgtagggcaagactgtgtatatctgtgtgtgaaggaaatctcagttcttaaaagtcttcgtttccagtttttaaaatgctaccacaagggctatctttagagcacaacagggttagggcaaccgaatcatattcctgtgctgtccttgcctcactgtcctgcttatgggcctggcctgttcatctgcagaacctgaaagtctcacaaatcaaaaaagtccgactcctcattgatgaagccatcctgaagtgtgacgcggagcggataaagttggaagcagagcggtttgagaacctccgagagattgggaaccttctgcacccttctgtacccatcagtaacgatgaggtaggtggctgtgccgcagcaggaggctgccttaggtcgctgctgtctctgcaggggcggggacgggaggagatctgtggaacactggcattgtctgtcagaagcaggttctttgtatattccctctgcccaccaattgagaattgcaggagtcagatccttgtctgattgggaagtagcagagacagcaggtaggaggagactcctggcacagaaatctcttctaaatagggctgctgtcctccgctgcatgttgcccgtggtagcaggcatctcgtgggagggatctgctaaatcaacctaaccccttcacccacaccctgctgagaagctgcaggttgaagggaaatctgcatgataaaagtttcctgctgagcgggagcttcccctgcacaaagctgctctgagcccagcctttgttccccgacaccccagccgtagcagggcccatctgtgcctctttcattcattccctggtgaacattaaactcactgcaggc

SEQ ID NO: 55371 - DNA, 1828 bp, Homo sapiens
tactacttctccattgagtagcaagttgccttctctagttatgagacacagtagtgtttgagttaagcgatgacttcacaaagttaagttgttcgtggaataaagtttggaaagatggaggttgtagaattaagaaatcatatatcaagcttggcgcggtggctcacgtctataatcccagcactttgggaagcctaggcaggcggatcactcgagcccaggagttcgagaccagcctaggtaaaatggcaaaaccctgtctctacaaaaaatacaaaaattagccgagcatagtgttgcacacctgtctgtagtcccagctgaggctgaggtgggaggatcactggagcctggaaggttgaggctgcagtgagccaagattgtgccattgcactccagcctggatgacggcgtaagaccctgtctccaaaaaaaaaaaataatttaaaaataataaaatcatatgtcttgtatgtctctttcttgctctgtttccttaggatgtggacaacaaagtagagaggatttggggtgattgtacagtcaggaagaagtactctcatgtggacctggtggtgatggtagatggctttgaaggcgaaaagggggccgtggtggctgggagtcgagggtacttcttgaaggtaagagctgggaaccagtgaggataggattatgaaaaagaaacaaaatatatatatatatatttttttttttttttgtagagaaacataatctgtttaaagaggcccacagatctaccagttgtacttgcctttctgcaaatgtattggcaattagatgcaattctctttctaaagcaagagagggcttatcaggattccgtagaacaaaagccactaagtggtcctccataatgaatgtctgttttgctgactgaatcagaacagtctctgcctttaagtagctcagtataattggacagtcagacaagtaacaaagaatcaaaatccactgtcataagctctgtggtttgtgtaggcccaaagtgctttgagaacatcaggataattctcttaacggtgtgcctggatgatttgctgggcttcagtgttcagaacgaatctcaaggttcagaatgtcagttgctgggatctgtggtcttttcttggcctcctgcttgcccctcggtagtcctgttctcttggcccaggtgcctttaggtgtcagttctagctgaacatgatggtgacaagacccaatcacatagtactgtgtctctgctcctctagggggtcctggtgttcctggaacaggctctcatccagtatgcccttcgcaccttgggaagtcggggctacattcccatttataccccctttttcatgaggaaggaggtcatgcaggaggtggcacagctcagccagtttgatgaagaactttataaggtgagtagcctgggtcaggtgacagaatgacttcttaagttatgtagcttaacttcagtgatgcagagtggtgctgtccaataggactttctgcgatgatggaaacgttctctctctgtgactcttgagcacttaaaatgtgggtggtgcaatggaggaagcacattttttattttaattaattttaacttaaacatgtagctaatgactgccatattagacagtgcagctgcagagcctcttttacctttccctgggtaatctgtatgatgtatctaaatcaagcatacttgaacaccatgagcttagaaaagaagcccattccttgggtgcttggacaaaaggaaattacagtggtggcactgatctcctagcctgcttcccatgtcctcccactcctaaccccagactggaagctt

SEQ ID NO: 55372 - DNA, 3381 bp, Homo sapiens
ggctgaggtgggagagtcgcttgaacctgggaggtggaggttgcagtgagccgagattgtgccactgcactccagtctgggcagcagagtgaggctctgtctcaaaagcaaaaaaaagataagtggaaaatattctttcctcttaatttacatttctttgatctctgtcagggaccccattttggactgacccattcctttatctttttagtattctctccccactcccaggcagggattaaaggaaatttttcctgcactattattgatctctttcttgtggtttcttattctagccaaggtcctccccacttcctcttaactggtatagctccttccttccacaggtgattggcaaaggcagtgaaaagtctgatgacaactcctatgatgagaagtacctgattgccacctcagagcagcccattgctgccctgcaccgggatgagtggctccggccggaggacctgcccatcaagtatgctggcctgtctacctgcttccgtcaggaggtgggctcccatggccgtgacacccgtggcatcttccgagtccatcagtttgagaaggtgagtagatgggtcagggtaaggagtggaactttctctgtctccagaatggttagatgagagataggatctgtgttgctgaggcccatcctggctccagcttttcctctcattgcttacctctgtgtttctggggaagtgcatggtggagtggcgtggattatggaccctgaaaccaggctgcggctttaccactcaccagctgtgtaacattgggcataatgcataagcccccagtgctccatttctgcctttgtatgaggaggataacagtaacagtgcctgcctcaccaggcctattgtggcctattgtgaggattatcccagtcactatatgtaaagcactcagaacaggggctggcatgcatacgggaagctcgcaccataagcatttgctcttgtggtccagtcccagttgctgggggcccagacttgcctgcctcccagtggtgtggaaacaggtcttcatggcaaggatgtctcccacttcagtcctttattcaccctataccgctgtcaccgtttccttgggtccctctctgcagattgaacagtttgtgtactcatcaccccatgacaacaagtcatgggagatgtttgaagagatgattaccaccgcagaggagttctaccagtccctggggattccttaccacattgtgaatattgtctcaggtatgggacccagcctcttctcagcctccctttcctgtaatcccagacgccacccttaccagctgagctgccacacagagaaacagctcacaattcaactcattgcccacattaattaaaatattacactcttctcacttgggagtatttggtgttaagaatatctgggtgtgatttcacctctggagacaggacatgaattaaagaattcttcaggcttgctaaaggttagccttctgaaataccatccctccttcatgaattctaggggtttttccttacaggttctttgaatcatgctgccagtaagaagcttgacctggaggcctggtttccgggctcaggagccttccgtgagttggtctcctgttctaattgcacggattaccaggctcgccggcttcgaatccgatatgggcaaaccaagaagatgatggacaaggtagatggcccccagggaggtgggaagcagagtcttcagtacacggcccgtccgaattatttctcagcctttggggtgcactggtccccagcatcatgggaaaatctgagcttctcaatctagaccaaaaagggaatctgaaaatgccttctactgagtcaggactgagttcttttagctagaaacctgaatctagctctcttctataaggtaattctagcttttctctttctggctttgtttttcttaactccagagaaagaataatctccatttatctacacagaacaagttggaggcttccctcttctcacccaagaaggtctgggttgtaagctgctctcttcaaacccaattttcaggccctactcttttccaagtcaggtgcttgaaaggggtgaaaaggaaaggccacaatagtagtttcttccttccctcaaagggcccaactctcagaataccagaagctaccacttgtcactcatcgaaacatgagggatctttctgcagttatctaataggcaataaataccaaataattcaaatttagaaaaaagttgctaaggggtagaacccatcattttgatttggacagttgtggttggggaagtctggttgaatggatggttcctggccgtcagtaagacccgatgagagttgagcccgacttcccctctgggaccctgtcttcccaggtggagtttgtccatatgctcaatgctaccatgtgcgccactacccgtaccatctgcgccatcctggagaactaccagacagagaagggcatcactgtgcctgagaaattgaaggagttcatgccgccaggtaaaactcccagctcatctcatcgttctcctcttttctgtcttcacactcttctaaatagcagtcccctttcaggatataccaggtttttttgttcagacacagcccctgaaactctgtctgccctctcgggctgggcagggcagggggcctggttgagaaagtagccagtgcaggtatgatgttgaaatgctgctaaaattcagactagggaagaaaagaataaaggaaaccagtgcctatcaaagggacccctctgttcaaagggatcattgtcttgttgaattctccccagaggtcttagggctttgactcactgagaaacaacaggtcatttggttggctcttccctcccaggactgcaagaactgatcccctttgtgaagcctgcgcccattgagcaggagccatcaaagaagcagaagaagcaacatgagggcagcaaaaagaaagcagcagcaagagacgtcaccctagaaaacaggctgcagaacatggaggtcaccgatgcttgaacattcctgcctccctatttgccaggctttcatttctgtctgctgagatctcagagcctgcccaacagcagggaagccaagcacccattcatccccctgcccccatctgactgcgtagctgagaggggaacagtgccatgtaccacacagatgttcctgtctcctcgcatgggcatagggacccatcattgatgactgatgaaaccatgtaataaagcatctctggggagggcttaggactcttcctcagtcttcttccccgggcttgaaccccgcctctgaggttctccctgatatacacttctgcttttccttccaaattaggctgctccctccagttagcaagtcacagagc

SEQ ID NO: 55373 - DNA, 1042 bp, Homo sapiens
ccgcttctccatcaccagccaaagtggtggtgggctggtatcccttgccctgccactggactacaaacttgagcggcagtatgtgttggctgttaccgcctccgatggcactcggcaggacacggcacagattgtggtgaatgtcaccgacgccaacacccatcgtcctgtctttcagagctcccactatacagtgaatgttaatgaggaccggccggcaggcaccacggtggtgctgatcagcgccacggatgaggacacaggtgagaatgcccgcatcacctacttcatggaggacagcatcccccagttccgcatcgatgcagacacgggggctgtcaccacccaggctgagctggactatgaagaccaagtgtcttacaccctggccattactgctcgggacaatggcattccccagaagtccgacaccacctacctggagatcctggtgaacgacgtgaatgacaatgcccctcagttcctgcgagactcctaccagggcagtgtctatgaggatgtgccacccttcactagcgtcctgcagatctcagccactgatcgtgattctggacttaatggcagggtcttctacaccttccaaggaggcgacgatggagacggtgactttattgttgagtccacgtcaggcatcgtgcgaacgctacggaggctggatcgagagaacgtggcccagtatgtcttgcgggcatatgcagtggacaaggggatgcccccagcccgcacacctatggaagtgacagtcactgtgttggatgtgaatgacaatccccctgtctttgagcaggatgagtttgatgtgtttgtggaagagaacagccccattgggctagccgtggcccgggtcacagccactgaccccgatgaaggcaccaatgcccagattatgtaccagattgtggagggcaacatccctgaggtctttcagctggacatcttctccggggagctgacagccctggtagacttagactacgaggaccggcctgagtacgtcctggtcatccaggccacgtcagct

SEQ ID NO: 55374 - DNA, 2506 bp, Homo sapiens
cagctggccacgcggctgctggcccacgagagcacccagcggggctttgggctgtctgccacacaggacgtgcacttcactgaggtggggcttggaggatgcagggctggctggttagataggggtcatggtgagtgagcctgctcatggcaacctggggggcagagggggccctcccatcccacctacaaggagctccctgctggcaggaggcctccatgaaaccctgtgacccctggcccagccctcttcccaacccttctcatagtaacatatgtgtgttggggcatggtctgacccagagcagaggcctgcctgtggtaccatgggctgggaggaagcagtatctcaggacatgtgtgtgggtccaggcacagggctgggaagctcttatgtagagaatgaggaggagggcttaggggcagagcatccagtgacctgagtgggcagtgcggtccaggagcatttcaggggaggcaacagtgagcacagagggaggggcctggtggggagcagggactggcccgggcacaggccggggctccatggtggggatgtcaggtgtgggttgtgagcacacccaccgtgaccttgcccaccccagaatctgctgcgggtgggcagcgccctcctggacacagccaacaagcggcactgggagctgatccagcagacagagggtggcaccgcctggctgctccagcactatgaggcctacgccagtgccctggcccagaacatgcggcacacctacctaagccccttcaccatcgtcacgcccaacattggtaaggctggtgcctgggttggggaggggtttgtggagggagtccccgacaagagcggctgtgctggggtcctgcctgcctcacaggtccgatctgtgaccatccccttccttagtcatctccgtagtgcgcttggacaaagggaactttgctggggccaagctgccccgctacgaggccctgcgtggggagcagcccccggaccttgagacaacagtcattctgcctgagtctgtcttcagaggtcagtggtggccatggattgagttgggagctggaccccagtgtctgtgcagactccacagagagcagggcccagctaagtgtgacagtgtcccctcccagagacgccccccgtggtcaggcccgcaggccccggagaggcccaggagccagaggagctggcacggcgacagcgacggcacccggagctgagccagggtgaggctgtggccagcgtcatcatctaccgcaccctggccgggctactgcctcataactatgaccctgacaagcgcagcttgaggtcagcagctaggggacaggtgtgggtaggggtatgggtcgggcggtgagtgctgaggcatggagggggtcgggggcgtctccccagtcatgtgactgccgtggtgactgtgcacctgactgccccacatcagagtccccaaacgcccgatcatcaacacacccgtggtgagcatcagcgtccatgatgatgaggagcttctgccccgggccctggacaaacccgtcacggtgcagttccgcctgctggagacagaggagcggaccaagcccatctgtgtcttctggaaccattcaatcctgtgagcctgcactgccctcgccccctcaggcttcgggctgaaagtccaggcccctgcatgcctcaccctccttgtctccctgaccctgccttcctcacacagggtcagtggcacaggtggctggtcggccagaggctgtgaagtcgtcttccgcaatgagagccacgtcagctgccagtgcaaccacatgacgagcttcgctgtgctcatggacgtttctcggcgggaggtcgggcccacaggggcagctgcagagccgtgggtgggcacccagggcacggggctgggtgctcaggtcctgcccttcctaattccctggccccctgccacctactctgcagaatggggagatcctgccactgaagacactgacatacgtggctctaggtgtcaccttggctgcccttctgctcaccttcttcttcctcactctcttgcgtatcctgcgctccaaccaacacggcatccgacgtaacctgacagctgccctgggcctggctcagctggtcttcctcctgggaatcaaccaggctgacctccctgtaagatgctcctactgcccagaaactgtccccaccttctcaggccgcctccccagcccccactggcaacccctgctcctgcaccatgaactctaataaggtgcctagtgcagcacctggcccagggtttcctcttctgtggctcccccgggatcccccagcacctgcctctggcccaggcttccctggaagcagttcccaacacccaggccctcctccatgcctgacccgaagcagagcctgtgctctgggcgggccccggtcgctgacctgccctggcctgggccctcagtttgcctgcacagtcattgccatcctgctgcacttcctgtacctctgcaccttttcc

SEQ ID NO: 55375 - DNA, 1034 bp, Homo sapiens
agccccctgctccaatttctaacaaatttggagtaaatctctaattccaggcagggagccaggatgggcctcctaggcaggggcctgaataggccctagggccttgagattccagcttatcaggctgtgactgctccccttgttggcattagacaaggacaggctgcctttccccaggtctcaggtatcattggaaggtccagatgaaagttaagtgtagcttaattcacagtatgtgaggctattaagctaggatctaggtagattcttatttatatcctaaacttgaatgtcctttactggcaaaataatggagcctcctagaaacgcaccagcttcttgtttgctctccctgtgagacgtgaaggccctttggtggtgttcatcttccctgatcacctcagccagagctgctggaacacctagtcaggctccaactaacatcactggggttgtctgtgctctcctcatctcccctgttagacttgggggtgagcgtcaggatccggaaacctctgcagtaccctagtgttgtgacctgtgtgtagcagagcatttagtttatttattcagaagatattcgagtgcaagatggtgtttgttgaaggaataacaaagacacgtttaacagatttggtgtagggcctccctttttttgcagcctttaactctagtaatcagaaccaattcaattccttctgagttttgaggaaacttccctccctgaaggtcaggccatgacttgagaaaagcagcaggtaagtgggcaaagagaagtgggactgccagctggtgcccccacccatgcctatttggccataaatgcctgacttaggcaccaaagtgtccttgccctgtccctggagccagaggcccatcactgctttcccctttttgtggctgattccaaggttcacctggcacattcacctacttcagtgacaatgcctagatatgcacctttccctgaattctgcagcaactcccgcagcctctgggattccaggaatcggtgggagggaaggggtatgcag

SEQ ID NO: 55376 - DNA, 2663 bp, Homo sapiens
ggagacctttgtgctgaaggatagtcctgtccgagacctgctgcccactgtgaactctttgacgcggagcaccccctccccaagcagcctgacgcctcgactccggagtaatgataggaaggggtcagtcagggctctccgggctacatctggaaagaggccctccaacatgaagagggtgagttgagagagttgagttggaggtgtgccccagacatggtgtgtgccatgatgcagggagtggtttccttattggtaaaacagggatagcatttctacatctagaattgttggaattaaatgagaaccatgaaaaaagagaaccaaaactcttaccacagtgtctgagtatatgtctatgataaactcaataaatggtattggcaatagtgatggtgatggtgatgtggtgatgttagcagctaacttctacccttccttactgggatgtagacaactctccacctctatttcttaattccttaagccacagaacagatattttttccactctagtcttttttctctctctctttgtgtttcaggagtcacccacttgcaatctgttccctgcatccaaaagcccagcatcttctcctcttacccgatcgactcccccagtccgggggagagccgggcccagtgggagagcagcagccagtgaggagaccagagcagccaagttgcgggtgagtgggagtggggagtttgtgggattgaccctgaaatttctccacccctctccaccaggcccacccacccccatcagatccgtcctggccccacagccttctaccagcaactctcaacgcctgccccggccgcagggagcagctgctaaatcttccagtcaactgcccattccctcggccatccccaggcctgccagccgaatgccactcaccagccggagtgtgccacctggcagaggtgccctacctccggattctctgtcaactcgaaaagggcttccaagaccaagcactgcaggacacagagtgcgggaaagtggacacaagggtaagaggtcaggaggaagaatgcccgcccttgcccagcgtgtcctcaccctcccagagctgtcaacagtgaccacttttgccatccttattgcaattcaattggaagatggggagactgagttacagagaggatatggggctggacagagtctgagtcttagttttcaaatacctcatggtcagggggagagtactaatcccacactcgctcccttcatccagtatttcttttcgaggtcagttaaacttgctgctaactcatttcttttgttaacccccatgaagttcctgtttcccagcgactaaatcttcctgtcatgggtgccactcgcagcaatctgcagccccccaggaaagtggcagtcccaggacctaccaggtcagtctggtcctcccttgcccatcctgtctccctaccccgccatcatctgggattccaagctgttatgcacatcagccctgaattttgtatggaaagatggagagaggaggggagcctggggcaggggaagggggatcccatttcttcccaccctgaggagcttgaattctgctgggtgacaaatgggcttgaggaagaagggcattttaaagcagttattccttctatttctttaggtaaagagatcaggacagcaagcaagacttcagtagcaaaccactacagtcagtacctggactcgcctctacccagcagaccctgactccagcagattctggcccagggacaggaggaagagatgccaccagggctggtctcccaggagtagagaccatgggaaatggggtggattaggattgagctggagaagacttaaactctctgggttgaaagaagattaggggaaaagaggtcaccttccagcagtgaaatgaacaaatagaagatgagaagtacaggcaagtggtttgtctttatccacccccactgttgtggtcagccccagagaattttatcttcttccttggcattggttcactggacatttccacgtgagcggcctccgtagctaacctccctgccctctgaggagccatcttcctgaatcgcattctctactggactctggcctgcttggagaggtggcagcaggcacctggtcttcagaaattgtttcctgtgaattctgtgactcctaataggccagtttgtgataagcttactctatgagtcttcatttttctaaaataaagtgaatgtatttttatattctctgtatatctggaagtcgatcctgctcctatttctttctctttttttagacagaatcttgctctgtcacccaggctggagtttaatggcgcgatctgggctcactgcaacttccaccttctgggttcaagcaattctcctttctcagcctcccgagtagctgagattacaggcgcctgccacccacgtccggctaattttttgtatttctagtagagacggggtttcaccatgttggccaggctggtctcaaactcctaacctcaggtgatccacccgcctcagcctcccaaagtgctgggattacaggtgtgagccaccgcacccagcccctgctccaatttctctttttttttttttttttttttttgagacggagttttgttcttggtgcccaggctggagcacaatggtgcgatctcagctca

SEQ ID NO: 55377 - DNA, 1572 bp, Homo sapiens
cttggaaaaaacccacaactgaggaacctcggccaatgcggcgcctgcatattgagtgcgcccaagaaaacgaatttcctcccgtagagcgtcggttagcggccacgttaggcagcacaaccgttctggagactgggtgctcggcggcccagcagagggagcggggcggggcgcgagttccatactcgtgggtccgtttcttccctcctggccagccgcgctctgctcccatctgcctacgggaaagagagtctccgcgcacgcgagcacgcgcactcgcagcctcaaccctcggctccgccaccgggatgcagtcttctgggaacggttctcccccagcccccaccggctgacttccggccggcagctcctcagcccctccccctgaggattcaccaatcacggtgcgcgtgtggcttgagtaggtggggcctgagagattcgaaaggagccccgccccctcggagctgattcccgggactaggttgcgggagaaagcctgttgcgtggaagataaggcggcgcgggaagtggacacagggtgggctggaggtgtgcttcgcgtgtgatgccaggggagtggaaaggtggcttggggagtgcagaaccctgaggatagtggcggggaggaagatggggcgtgcaggccgcccccagtgaggagaggccaggatgcagggcggctccagggcaatctgggcagttgggggagccctccgtatcgttcccggaggtagcaggagtagctgtgcgggaggtgccactcctgggcgcttgctttgcctccagcatgacccccgaccctggcttgcaccctgaatctagctgcgagccttgggcagaatggatacctgaggaaaggtatggtttctctccggctcagatctaactggactctcgctcctgctggctggacatggaggatttggaggaaggtaaggaaaggagggagggaagaatgaaagggaggagtgagacccagcgatggagagctgcatcagggacccatgactggctttcattcttctttccccttcagatgtaaggtttattgtggatgagaccttggactttggggggctgtcaccatctgacaggtaccagcctctttatcccacttattttcctctaacagtacctctttgtctcgaatcccttactgctgaattattggcttgggttggtaacttagcaaggtttggcgcacttggggctgctgggcggctggctgactcgggcctctatgacactattggtagcggggagagaagggagaagctggagttagatttcagggtgttaagaagaaggataagtggatttgctgcatctccatcctggcatcatttctgatgtccgtaaatgctaaaggcctattaggccccatagaaccaggtatctcatcgcccagaggccacatctcacagccagcatgggcatcggggcctagggtcatgtccctggctctgttgtggggcttttatgcagtctcccttgcataatctcctgttcccttttgcatgggcatgatgcctggtttgtttcctgtctcagccgtgaggaggaagacat

SEQ ID NO: 55378 - DNA, 1048 bp, Homo sapiens
agcaccatcctgccctagcagagcccaggccttgccctcatgaagcatcattgaaatagcaggagcatgttgatttcttggttaggttgcattataataacaagagtcagaacattaattcgaaacaacttgcagtatgcatttcttcacaccagtacattcttaagtgtacttgtttataaggaataacataaactaatctgtacctttatatatatgtgtgtgtacatatatacatatataaactgtatagtgtacatggtaatgatttattgctatgccccagatccttaatgtagttctcatcctccgcatgccctcagccacaagcgggtgactgactgttccctgatgatttggcccacctcctgtgtttggacctctagggaggagggttttggtcatactctccttatcctcgtgcacagaaatgctcagggtccccatgtgcctgttgttcagccctctctcttgttccctttctgagcatgtggtccttccccaggctgtgggacagctgccttcccacgaaagtgtaaagcagtattaagatcattactgcatgtgccctaaaaacccaagttttctattcccttaggacagaaaattgcatgtgaggtgggataatcgagtttcagtgacccacgtcagttacacattaaagccagaccccatgataaaattccacaaaatggaaataaaactcaaatttctttagcattgtgtaaataaatctgaatgtgtttaactttgtactggtaattttctgtatatttggaatatttgggttaaaaataaaacagactggactttgttacctgacctactgaaatgactaagctacagtttgttgatatactttttccagttttcttgcttcagaatcagactccagcaaccagagaacaagccatttaaagagccaggactgtacatttatagcatgaaatgtattcggtcatctatgaggaaaacgtctcacaaaaatgtgagccataaattacctaattttcttgttcttcattttcttgctcttagtgctcataca

SEQ ID NO: 55379 - DNA, 1090 bp, Homo sapiens
aaactcaatattcttctctaaccatatacgatagggctcttcgcttttaatgatatctgggatttctgtggaacttggcaaattttcagagcaccttcactcacataatgtcatttgaacctcacaatgttcttgggatggagtcagttgttcagggtccccgtgtgtgtgataagcagtgctggctggctgtcttcagaactcttggaaatctttacacatgcgagtgctaaccactttgagcaaggctgccttcttgtagatgacttgctgttctttatgacagggatcagtggcatttgtttcctagcagtatttagcacctttttgccaccttggtgaacagaaaattgtattttcctgtctttcatggctgaaaacaaaagtaatgggaattttaaatacgtttgcagaaactgcccctcccctcattgagggtcactgctcaagagtgcaggagtggactctccactgatgggtctccctccccatcctggtttccaccccgggctggctagctctgttggtttgaagactgacagccagcctggctcattctcattattggctagttagctttctttatcaacctgctcactcacaaatgtgtgccctcagccagagagtaagaaagcccaaatctgttacagcttctaaaaaaatagatttctaatttgtcctactcatgttaggagcattatctttgaaggtaaaacatagtgtatcattgtgtaaactcccaggcttgatgtagcagaagagatcatttctggaggcttcagcaatggaatttagcattataagagagattggacaaaccagtccaaagtggtccgagttcttaaatccaggtagggaactcactcttctttcttctctggacctaattgggcattgggctttagtgagaccacagaccaggcccgtctctcctgtaggcttttaattcaatggcaactctatttcaaagaataaaagcctttggagagttgcggcagttctgggggcgggctcaggagagtccatagatcagccgtaactggaacgtagaatctacgtctgcctctgaatggacttcccacctcctctc

SEQ ID NO: 55380 - DNA, 1076 bp, Homo sapiens
cagctgtagagatgaaaacaggctgcagaggctggcacagcctggccggcttttctccatctggggacagtcctactccaagaacactgcacaccagctcctcacacagatcccacttactctttttttttttttcagagaccacagaccacagtgatttttcttttcccttgtttaattaggcaatacccttgttaattgccctttggcaactaacttaaccatgtgcttcccacacagtacatcaggaaaacttacagggcaatatttttaacttggggcaggaagaagggagcagcagagaattgactagatatagcacctattaaaagagaactcttgcttcttctgagatttttcaagctgtgctttgtgtgtgtgccagtagacttacgcaaggacagggtacaaacttagctggaagtctgcccaggctgaatgatctcttccctagagttgattgtcgggtacacagtgtgaacccccgaagacggaacctcacagtcttccatgttcccttcttaactgtcgtgtggctcgttgctaaatcatgacaatggctgcctatctgctgcttcttaggttgctgttgtacatggaaccaggactagagattttttcagatttatagacttaaaaaattagaattttattaccaggctttccttctcaccccttttttctgactttgccaagtaatttgttgacacgaaaattttggaggaaccaattgaaaacacacttccagtctagatgatgctttgtgtgatacattaagttcttattttggattaaaagaagttttccatttgatacctctctaaattaaataaattatagaatgtagttgggtggattttggggtggccatatagtaatggaaagctgcaataattagttttaatacagcttgaatatttgctatatagaaatatagtatggaaagtttttggtcttaatgtagctactgtgcgggtcacagtttctcccaatgattatgactgggacattctttggtagataccatttgctactagtttattttgtggctagaaagtcagttttgtgtgtttttt

SEQ ID NO: 55381 - DNA, 1065 bp, Homo sapiens
gctcttggctaattagtatcttgtcctaaacaaagagctccctggtcctgagtggagaatatctggttgcttacctctgacagctcctactgactgagggcgtaggtgtgcaagacacacacagcagcctcttagtttggaaggaacttgagagattttctatccagcttcccacttcaaaacaaatagggtttttcctaatcctcagatggatgttgagatggaaggaatactcttttggcatgaggaaatgcgattgctagtaggctctagactagtgtaactttttgtttgcaattccaaaatgaaggaataggttgagtcagacattcccactttccctctccttgttcttcctatagcctggcagctgcctcccgtgggtgggttctgtgctgtgtactttcctgaacagtgtgtctctcctttaggtgaagagaaggactataccatatggctggcacactccacagaccctgaagattatgaagatggctgcattttgggctacaaagaacagtttctgcggctacgcaagtcatccgtgtgtcagaatggtcgagactatgttgtgaccaagcagccctccatctgcctctgttccctggaggactttctctggtatcagcattcctcagatttctctgtctccctttccctgttggaggaggtgaaagacagttttcttatagggctaacaaatattgaaatccagccgggtgcggtggctcacacctgtaatcccagcactttgggatgccaaggcaggcagatcacttgaggccgggagttcgagaccagcctggtcaacatggtgaaaccctatctctacaaaaaacaaacaaacaaaaaaaaattagcagggcatggtggcgcacgcctataatcccaagctgctcaggtggctgagacacaagaatcacttgaacctgggaggcagaggttgcagtgagctgagatcatgccattgcactccagcctgggggacagagcaagactcttgtcccaaaaaaaactgaaaccctttcccccaagagtggagaactgctgcttcttatcaaggaa

SEQ ID NO: 55382 - DNA, 1045 bp, Homo sapiens
aaacttaggggcatatattttgtttaccttttcattttctaatgattagtttttattatgttttacaatagcatcagtttgtgacatattggaaatcttacaaattgatccttcactacagatagtttgagaagcattgttctagagtgtaaagatttaaaaatatgtaaactaaacatagggcctctcccaccaaaatatatctgggaagagtttttctgtagcatctgattaatttattcaacaaactcagcatctgccatattccaggcactaagctgggtactagaattaaagatgggcataaagatcttgagtatcaaaccttgattaattctcaggtctgagtcttcatcatgaagagacacaattggctactgtgtttggtcaggcaggtaatcgtgtgtggttagactattgtttttctctttggttccacccaagacttagtatttttgtttgtttgcctatttcagacactgggtttggcacaatctttacctcagatgatcgaggcattgtctattccaagtctttggaccgacatctctacactaccacaggcggagagacggactttaccaacgtgacctccctccgcggcgtctacataacaagcgtgctctccgaaggtgagtctcggcatcgcagtggtgtactgtgccttcagctgcatgtggtaggatttgaggcttcggggaacctgtcccctagtaatgttgcttgccaagccaacaagcctacccatgtacatttttttgtttccttttttttttttattgtggcaatatgtctaacaaaatttgcagtttttaacattgtatagggtacaattcagtagcattaagcacagtcacaatgttgcacaaccatcacccctatttccagagctttttcatcatcccaaatagaaattgcaccaggtgcacaagcactcctcgttccccacccagtcacccagctctggtaaccaacattctattttatgtctcaatgaatttgcctattctaggtagctcatgtaagcagaatcatacactattgg

SEQ ID NO: 55383 - DNA, 1088 bp, Homo sapiens
ttacatcttgacttcccttgtgatctcccaaacatgggtttcatctctattttctagacccttaagtatataattctttaaattatgcaagcactgtatgaaagggaccaaacttttatgcagtagtcatcattttaagaattacctgagtgtatgcaaatggctataaagccaacctaatgttctcatcaaatccttagctctactgaaggaggtggactatcagagaccaagactatactatcttacagggccgcatcagaatgaagaattcaaagagaaagccaagatagccttacttagaatagaatggattgttcctttacctagaactttgctaggggctagaaattgctttggtaattggtactatgacctttcattcatagcaatcgtacccagtagagaaatggataatagtagttatttaaaacattcttgttcatgtccctgcccatggcatcttggcagaaaattagaaagataaatattgacatctgttctaggatacaacaagaaggatccacgtttcaacagatcaaggggacacatggagcatggcccagctcccctccgtgggacaggaacagttctattctattctggcagcaaatgatgacatggtattcatgcatgtagatgaacctggaggtaagagctttttagtggcttacccttaaaagcatagagatgtaagctttgagcagcttttatttttacatgtcgagttttcctcttacccctagaaatttattagtgccctactgatttttctgtcctagagatcatctgtagcccctgttaaaaatgccacttgttttggtagcttgtgtgtatgttcaggtgttctagagcagagctgctcaaagaatggtcagcagactggtactgatttgcaaactatctgttaccagataagtacagaaattgagagcaagagtttggaaactcttctagccttttgacaaagcaattttatgtctgttggatctaatgacaaaaaattaggggtttatggctgggcgcagtggctcacacctgtaatcctggcactttgggaggctgaggcgggcagatcacgaggtcag

SEQ ID NO: 55384 - DNA, 1052 bp, Homo sapiens
gtatcctatgcaaggtttttacttttgtaacatgtttttttttttttgtttagtgtctaaatatgaataaccaggatgctgctgtttactcacctttttagatctctagtttctaggaatttacaaccaaaagttctgaaagaacatgctcaaaaccaacacctttttttggttgcaatccagtaagtgccaggagggtctgaatctagttccctgcaaactccctttccaggttacattttaaataattcaacctccgacctagttgtccatttgagatggaagaactaaattatttaactcatacaaagcattgaactagattctgaagggaaacagcaaagtatagtacctgccctgaagaagctaatttatatagtaggaaaggtaaggcatatactatgcaagtaaaataaaaaacaggcaaatgcatgccaagtggctgtgcagatggtacagtgctctaaaacagagtttctcaacctcagcactaatgacattttggatcaaagaattctttattgtggaggaccgtcctgtgcatcataaaatgtgtagcaacatccctggcctctacccggtagatgccaataacacctccgccacccacccctcagttgtgatgatcaaaaatgtcagaggcaaatgttgagagggtgagtagaccagcatgactgcctgaaagagttcacgtaaagaagtggtggactgtagacaacacatgggccgggcagtggggagcttgacaggcagagctgtgaaggaccagggctcagcgcctgagaagtggtgcttgtcagtgcctgtgaatgaagcttgttagacctgctaggaagtttgtgagtaaggtcaacacagtccttcagcagtcttaaaccatttcttttccctgtttttgcctcattgtaggggatcagacaacaccatcttctttacaacctatgcaaatggctcctgcagtaagtatattttagtcccagaaaataatgtcctgttgtccattcatggtagaattttctgggttgtgcaaggtagaaacataaaaggtccct

SEQ ID NO: 55385 - DNA, 1785 bp, Homo sapiens
gtgaccaacttacatgcatgtgcatgcacgtgcgtacacacacacacacacacacacacacacacacacacacacccctacctctcatcctgccctgcaggagaagtcatcccgttctactatgctagcttctaaattcttgcagagcctgttcctcatggccagtgttcaagacctcattagctcttaccgaactaatgtggcagtcattccctgcttttccttgcctctagtctggaccctctgaaatccatctttcccattcacgtccaagtactccacctaagaaagtgaaacggactgtgtcatcctcctgcttagcacacattcctcctgagagcacctcatatgcaataaaccctggagtccttaccatggcacagaaggaaggctctctgtgagctggcctcacctttctgcctagcgttagttcctcatttgcttaccttggaatttgcactcaggtaatgcctgatggcttttagctccctgcacacactgcagggtttatgacctccttgcgtttgctaatactagtctctctttgtgcagcaacacctcatctccctgtttgccttcttttggtcccactgctcatcatttaaaactcagtgcacctgtcttcttcaggacaccatctctgatgcaatgttcctcctctcctcacttctatactagaccatattttataactctgcatagtgttgaactttcttcttatctatgcgccttgttaaactgtgagccccttctctcagcagggagtgtgtcttattcatctttgtatccccagtgcaacatctggtacagtgcctggcacataataggcacttcatacgcatttgttattctgaacttccaagaccccaaaagggcccagataaactacgtgtgtgtctgtggagctcgggcagctctgatggagcttcagtatgtgtttttcctgtcctgaatgattggatatgaaatattaaaggtcatacaagcaactacacaggataaagctagaattttgataagtcatttataatctttcagaatggcctgtgggtgtccaagaattttgggggaaaatgggaagaaatccacaaagcagtatgtttggccaaatggtgagtaacagaagactccatctgtgcagagccctaaacccttcctgatagcgctgccaaaaatcacatgaataaatattgagcacttactgtgtgccaagtactcttcagggtgccataagagatattggagaggggtgtgacacaggccttgacctggaggagcttctcattctgctggaaaagaagacttagtctcacttaaatgttagaacataaagtataaaacaaggcaggtgactgagttgctgctgcctgcccagggttcattctccatgaatggtgacatcaattaaaatacaataaaatatagctttaatttagggatttaaatacttctccatgcccagatttaccctcttgtctagagttccatttcagtcatgtagaacatggcaaggaatcaggaagaaagctgaaagagcttccagactcctgaagtcacattgcgcaccacaactcattcacttttctcggagagattccctgcccctccgggtgcctgcttaaagaggatggagtggagggagctcttacttgggagtctcgtcacctttgttctgtcctcactctgctgctagtcaggggctcaacctttctgggctttagttttttccttttgtgaaaggaggcttatttggagaatgtggggatggctaagcaagaactgaat

SEQ ID NO: 55386 - DNA, 1051 bp, Homo sapiens
ctacaccaatgttatatacctaattattaatatcacaaagactgctgggctattttattcctggtgtttctattgagaattgctcaaatttccctattaagaggttttgcattaaaatatattacatagtcaatgtaagtttttcagaatgttacttgagatttttttaaaaggataacttaaaggtatacaatgcaaagtgctgctagtgcagtaaaccagcttcttcaaggcatgttgtgtaacaacctttttaatgatatgctcagttcagttttcactgcagtagattgttaacaatgactgcatatttcagttacaaggttgggataaattccatttacaacatatattttcttgcttttttttttttaaagaaaaagtatattaaaatgtgatgatggcattttacctttaatacaacttcacttctatacacgtaaagttgtcaatcagagtaagatgaagacccacaaatacatattcatgttccttctgattaaaagttctgtgatttttttatttacaatatcttactctctttattttcccacttgtagtttcaaaatttctacagaaaacatgtatcctttcccaataatgataaaacacaacatagttaaataaaaacacaaggtaatatcagacagtgggggaaaaagacactgaaatattgggaattaagtttattatgaattcaaatcttgccaatattacccagcagtagtttcaggtccatgattattttgatacattttaataaactacattctccctattgatcttttacctggaaatctcagtgcagttggttgtcattattagtgatagttatgttctgtaaagttgtcatgaatattgaattagttaatagtgaaccattgctcctagggggacatatagggttaggtttctgcaaacttctggtcacagcactcattttcatcaaatgatcaatacataactttgttttatgtgtgtttctgtttaaagataccttatttaatgtgtattattgattcattaacactgaattcatggccaatagcac

SEQ ID NO: 55387 - DNA, 1142 bp, Homo sapiens
gtcgaccctcagccaggaccggctggacgcgccgccgccgcccgctgcgccgctgccgcgctggtctggccccatcggggtgagctgggggctgcgggcggccgcagccgggggcgcgtttccccgcggcggccgttggcgtcgcagcgcgccgggcgaggacgaggagtgcggccgggtccgggacttcgtcgccaagctggccaacaacacgcaccaggtgagcgggcgccgggcccgggagccgctcgggtgcgaggtgccgcccgcgtgcccctcccggcccgtgcgccccgcgactcccggaggagaccccagccctgccgcgcccgcgtcccccgggccgcagccccgaaactgcggcgggcgggcgggcggagtcgggcccgggcggccggcggggctgtgttttgtcataggggaggcaatcttagacttccaccgcattcttttttttttttttaagttgtcaaaatctcttgaacatcgtttttcgtctgtataaataatcaggacccagtaacgctgttaggccccaggaaggtgaaggagtaattaactcttgagcgcttgcagaagttgggctgcgcagaagcaaaggtgtgtcctctctgggtcagtactttccgggtgggagaggcgggagttcaggaggcccgaagcagcgatctggtcaccgtgttttaatagttaaggggactagcttggaaatgagatggcaatatttatgtgatctcttttactgcttcagatttgaccttctgtcatggtacggaagtctgactagcatgtctatatcccgtggtgacaagattttcaatagttaagaaacgcattgcacatattctgctttgagccagctcttggtcaaaagactttcaaaattatgggatttctgtccctggggacaagcagctcaacctttgcacactactggactgacaaaactaattattaagaaagtcctggttccttgcttcagcacaacttgggcatctttctcctatttctctaaaattaacaatttaatccttgctagccacatttgcataatgtattttcaattctatatattttctcccttgcctgttttcctctttcaaagaaaatgaattgcacttgggggcagagatgggtggcca

SEQ ID NO: 55388 - DNA, 1006 bp, Homo sapiens
tgctgggctctgggtatattgatgtgtaggaagttgtactatatgttaataaattatgactatttggataggctgaattcatactaaatccatactgtagttcaacaaaaaacaacatgtttatatacatttggaaactgcaatgataggaaacatttggaagaaagggattttgccctagaataacacataaggaaagcagagaattagagtatattgttactgaatgttccagagacttctagtgattttaacacttattaagtatagcatgttgatggggagatttgtttctctaaagatcactttgttttattaaatcctaatagaaaatacccttgaaaatcctatctcatttattcctgtaacaaatttattgagcacctacctactatatgccaagaaatgtattagccatcaggcagagagctgttcaaatggtagatatgatctgtgctcctgtgaaacttctagtggggagagccaaacaataaacaatattcctttttaactctaggttaatgcagaaatggataaagcccatgttgcttttgggagaggtgagttgtgtctctgaatcacatgcatttcatagggggaaaaatgcccaaatactaaggagtagctcttagcctatgtccgttcgcctcagcttaagttgttttccctcccactggctgggcagcatatttgtgttttacctggtaaaacagtaaatttcgtaccttctataattggcattcttcaaagaggtagaactttgatttttttgtagaatattaaaacaagctttcttaggttaaagaagtgatcttactacgaacagcaatggtttcatgatgtgtaattgctttatgttatctttctgctatagaatgtttcctggagaaaggtacggtttttagtaataagataaatttactttagtcctgcaaataaggtgaaatcttatgtccagtatctcacaaaggagaactgacagtgccacttttatatttaatgtcaa

SEQ ID NO: 55389 - DNA, 1053 bp, Homo sapiens
gaaaaaagtactgactccatgtactttgctgctgcttttgtgatccctgttgaagtgacttcaagaagtgacaatgatgccaggcatttggttaagtatgatgtggtgagttaaccttaaaatagaaaatttggtcaataagcatttttattttggagccagagagctattttagggacctgctgcctggaaaggatatccttgggacagcagatcccttagttcctaatgaatagctgcatcaccaacacagcttctcctgaccatggtagggccatcagcagggtaactcagcccagcttattaacccttctgttttctttccagctagccacagtgcagcctggccagaatttccacatgttcacaaaggaagaacttgaagaggttatcaaggacatttaaggaatcctgatcctcagaacttctctgggacaatttcagttctaataatgtccttaaattttatttccagctcctgttccttggaaaatctccattgtatgtgcattttttaaatgatgtctgtacataaaggcagttctgaaataaagaaaattttaaaatatttgttaatagactgttctcttctaatagtcttttttttttttttttttttaagagatgaggtctcactatattgcccaggctggtttcaaactcctgggttcaagtgatcttcccgcctctgcctcctgaagtgctaggattataggcgagagccactgtgcccagccattgtaatacagtcttttgtttgaaatgcaaatgttagtgggccaaaaggacagtgttattaatatccctattctatgaagatgtctgttctaaaactgttttagtgatgctctataacagaatcaactatatccattaatcccatggtgttgataaatgaactagtccagctcttcccagtggttaatagatgttaacagcactgtaaatccatttcggccctataatttctggagcaaacgtgtatttttgctgcttttcttataaggagatgctactaattgactatcagaagaacatgttttgaggtcctcc

SEQ ID NO: 55390 - DNA, 1721 bp, Homo sapiens
aaaaaaaaaaaagctgaaagaaataaaaggagaggttaggatagtgatggaaaagttatagaagaggtaaggcatggtacacatgaaggagttggttttgaaaagtaaaattcattcagcatcatattgagtacccattatatagcaggtattatgctagatgcccagggttacagacacagaaaatccaattcctattcaagtagtatactgtgtagtgcagggaacatatagataataagaacctggggtgatacttctataatagcagtaaaaacagattcctgtgagtatgtataacttagactaaagcattagggaagcttcttggaagaggtgatgtctggaaaagggagcagaaaggtattccaggaagacgggacaacatgtgcaaagggttcaagatgtaaaaataatattgtgggtaaaggaaactttgaggttttgtctgactgctgaggtgtgggatgtatataagatggtgggggacggtaagggatgagactggagaggtatggaccagcttgggaatgtccttttttagtatgctaagagtagacaggagcaaaggaagtaatgacgagtaaagataggtgggtttggcggtaaacctggagagatgtcccacatttccccagatttttcctagtgattgtaaagtcatctgccgagggtaggtgaatgcaacagtaaaattgagaatgggaaatatttggaaaagttgttatgagaagacagggaagagtaaaaggattgctgggccatattaaaatcgtagttgaggccagtaatcccagcactttgggaggccaaggcaggaagatcacgtgaggccagaagttcgagactagcctggccaacatagtgaaaccccgtctctactaaaaaaatacaaaaaattagctgggtgtggtggtgcgtgcctgtaatctcagctattcgggaggctgaggcatgagaattgcttgaacctgggcagtagaggttgcagtgagctgagattgcactccagctgcactccatcctgggcaacagcacgaaactctgtctcaaaaaataaataaataaaatttaaaggccaaccaaggctgtaattatatatcagtaattaaaccaatcagtacttaccaggatatttgttgaccacactcatgagaaaatggatggttggattaatccatggtaggggattgactagttaagaacagaagattagagaggactggagagtattgttggtgaatgtctcacccatagaaccagctttcataggctgctgtgaaaggtcagtctaagaaggactgacatttgggagccactgcgctagagcccatctgctttaagttcttagtccattagttgttccttggagctccagcctccctacatgaactgcttcccctaagaaaaggaaaatatccggccaggcgtggtggctcatgcctgtaatctcagcactttgggaggccgaggctggcggatcacgaggtcaggagattgagaccatcctggctaacagggtgaaaccccttctctactaaaaatacaaaaaaaattagccgggtatggtggcgggcgcctatagtcccagctactccagaggctgaggcaggagaagtgtgaacccgtgaggcggagcttgcagtgagccgagatcatgccgcgccactgcactccagcctgggcgacagagcgagactgtctcaaaatatatatatata

SEQ ID NO: 55391 - DNA, 2135 bp, Homo sapiens
ggctattgtagagtgtgtgtgtgtgtatgtatatacatatatatggcttctaatactaaagtttagtgattctataccgtttgcacaaatttggggattccatgaagaattcccctattggaaccagtgctaattctggaaggaattagaagtaacttgttactatagtcagggtatgttttagaactttgctctggaatgttgatctgatcctcatcctcaaatatttctaagataggcataaacaagtaccatatttatacatactatacttctaaatccctaaggaaggtactaattttcttaaacagtttttaaaatgtctggtttctccagacatagaacatcttttagatctgtgcctcaatatttcagtggtgtttcctggctgcagggccaagcatttatactttgttttagtgagacgtttgttacataaagtgccaccactcctgagcattttagtcctcattttgggggttttgcaggtttcatatggacccatctgggacctttgtacagtgtgatgctcgagcaattggctctgcttcagagggtgcccagagctccttgcaagaagtttaccacaaggtaattaagtattctcacaactcttactatttttttatcatggtataatttacatataataaaatgtgcaaaccttaagagttcagttctgttttgacaattgcaaaacaagataaataacactttcatcaccaccagaaaaatgctcatccacattccagtcaatctctttccctcccttgcaaccatgtttaccaccatgtttaccactctccattagttttgtctgttgtgctttgttataaatggaattaaacagttagtcagtttgtatctgttttgtttaacacactgtttttgagatccattcatgttgttccagtatttccgtttgatggctgagtaatataccatggtatggatgtaccacaatatgtttatcctctatattcacagctttacttagcactttacaattggctcttgaagcaagtgggcatttggtattttctttgtgagatgggaagatttggttttgggtaactcattggtgtgattgaaggctgctctacttattcaggtggttcatacagggatgcctgctcacattagctcctaatggtattgcttttacatgtggaagaaattaggtacaaaacagggtaaatttgaattttctaaaccattgggctacctcttagatcatttgggcattattgttcattggatattaccaataatattatcttctaaattaaaagaggaattcaaatgtacacaagactagtctatccctttccccttcttcaaagattactttggttggtgactttattgtggctcacaataaggtttgggggttttttttcctgaaaaaatgtattctacttatttgccatttacttgagttctggagatacttgtaatgcaccatactaagtaagatgtttgacatacttgctaaatacttttttcagtgagataaagggaaaatctttgaaggaaggacggattgtgcataattaataggcatcttcttgccttctttgtttcaagtctatgactttgaaagaagccatcaagtcttcactcatcatcctcaaacaagtaatggaggagaagctgaatgcaacaaacattgaggtactttctgttttattgttggatttttttcggttttttttttaagagatgaggtctggctatattgcctagactggtcttgaactcatgagttcaagtagtcctcccaccccagcctctcgagtagctgggactacaggtgcacacaccatgcctggttaatgttttttaatttttttagagatggggtcttgctgtgttgcccagactggtcttaaactcctggcctcaggcaattctcctgcctcagcctactgagtacctgggactataggtgagagccactgcacctggctgttttattgttttttattcagatatcatagctggcattgctgaagactacatagatcatggaaatgacatttttgtatgtttagttcctaagaaattattaacagcctttgaataataagcagcttcagtaaagtggtgctggcagaagccagaattcagtgagt

SEQ ID NO: 55392 - DNA, 4024 bp, Homo sapiens
agtctgcagacatgttaagcaagttatacataaagattcgtgggattctttggaactctttgcagtgctcacacttggcagtgattactttgtagaaataactaaatataatggaattcaaagcagaaagcatagtcatggaaggctttgatgagtggaatttggattgggggaaggaagaatgtattccaggggagacagcatgagcagaggggtgcaagggtaggagataacgtggcttgagccagtgggctgggctatacctgagggattttgttggagaataacgagtagtgaagttggaagggaaaagtggcatcaggatatgaaggctctggaagtttatttggatatattataggcagtatagggtgatgttaattcttgagagaagaaatataatgataatagcattttattagatcagtcaggttataacattagagatacattgagagagattaaagatgagagaggctattgaagtatctaggcatggaatatgaataacatttgttcatatttggcaggcaccattttaagcattttataatatataatgtgtttacccttcttattattattgtcatcctcattttgcaggaaatgggcatagaggagtagatgactgggagttacgtagagatagagatgaattccaggtatattgtggacttctagcgaccttaaataattaatagttttacgttgttggtggtgatgatggtggtggttcttttcgtccctccctaccttcctttattacttttttggaggtcaggtaggttggggaatatcatcacctcttgggacagaccaaggtagatggcagaggtgaaaagaggccaggtccagagaagacattaagagttttattactttcttgcccactatgtttagaacttttgaatcctccgtcctccaaatattggcattagagagtggatttttccagtgtttgaaagactttgttgaacttactcttttggggttctgggaattacatgggtaaattataaagaaaacattaaaaattttaaaaaaatttaagggagaaaaaagaactttttagaatcacaaaattctgtaaatcaatgttcttgctattgacaggaatagtatattaattacttacagtatgttagggtgctccttctctctgcctataagatgtggccagttgaagtttctatcatgtgaagatttacagagagctatctggtgagtatgtaagacagttatttgacctatatatggtaatcataacatgtttctctttagcttggttctacagccattgggatccagacatcagagggtgtgtgcctagctgtggagaagagaattacttccccactgatggagcccagcagcattgagaaaattgtagagattgatgctcacataggtaaggagtggaggaaagctgttctgtaggatctggtctgggttaattagtcctctatgatgttccaaggaaggtttatgaaatgaacacgttatccccttgttagctattattttccaggcagtaggccagaatgcgtaaatgtaggagtaggaggctgttgcaggactcatttatgtttaacctactcccataagttcctttcccctcaaatttagacttggtaaatgtgatggttgttgaaatatgcaaaggttgagatctttgaagtgactacaagttataagaataatatagacttgcctagatcagtcttcctcctttgttttcagattatctttgtattccttgttgcctctgcccacttttttggtctttaattcccctgccttggcttctgacatcattgtataatagtattacagggtgagtaattctacttatttatagaatggcattttatttggctatccaaattttcttaacctgtctagtcatctaattaatgaagcattggcaaaataattaattgcttgaaggcatcagaaccaaatgccatggtgactctgggagcttgatattatgtctttcatagatatagaaactgaaattttatcttttaagattggaacattgtgtcttctttaactcaagtcacttggtcttttgaaggtagctcagtgtcactgtgttcaacaaattgagagcctacaatgtgccagaccttatgctagataccaggatatagaaaggaataagacatagtccttgttttacaggagcatacagtctaattgtggtggtggacatgtaagtaagtcaatgcaattaagtgacaaaagtattaagaaagactagtgtgttcttagtaggagtacaagggaagaaataattagttttgcctggagtcagcggtagtggggctttcagaaaaggattccatgaaagtgattttgagctgagtttaattctgaaagataaggaagtgtacacaaggcaaacaagtgtctgggtatagcaagggagagcattctagtcagggggaatagaaatgactgaagccatcgtggtgtaaaatataaaataccatgtcacaagcagttttgtaggcctgggccatgaactgcagcagcagagtcggtcagagagcggaattccttttttaccacactgaagggcttcaatgtaatccttttgcaaggatgggaaaggttttaagcaatgaggtaataggatcccattataattttagaaaggccattctgataatgatattaaagatagactaaagagggctgaaactggaggcacggaggccagttgaaaaatttgtaatagtccaaacaaagagatggtgaaggttttaaccaacacagtagccagagaatggagaggaagatagaaattgacagaacttgtgatctgattgattgtgagggccaaggaagaagacggggtctggaagggaaatgagtgtgtgatatgtccaagtagatatattaaggaagttatttggctttatatgtctgaaacttgggagagaaacttaggctggagatttagatttgagccatggcatgtacaataacagttatagccataatcgtgacagcttgggccatcaggcaaactctctctgatataactagttgctttgtgtttgggacagagaggcaaaaggcttttgatttattcgagagtcctccactgtagtccatagtgaggtgattttcttttccttgtttcccaggttggggcattagtatttgcttcgtttgaaaatgtatcatcgtctacaaagagtgctaaagggatgcttagggatgtaatatgtggaaattcatgtttggttagctgcttttctctgggcttatttttatcgtctggacttctgtgtcattgtggatggttttttgtttctaatatcattaatacttgggttcagtgcagatcatttcctatctaatcttttgggtataaaatgccatgggatagctgaatggctgccgtggttccaatccagaatttcaggatttcctgagtggatgaaagagttttacaaggatttggccactgggtcactgtcgcttttacattgcaggttgtgccatgagtgggctaattgctgatgctaagactttaattgataaagccagagtggagacacaggtaaaattggcattatctcctttttaccaggatgcttgagttccttgtttagtgattatctagctgcctgggctatactgcaggtacctgtgtcaatattagatgtggctcttgggagtaattttgggtagaattcccagttagaacttcctggggcttggagtttagctgtccaatcattgcagttttaaagaggctctggtcagtagtgctgacagtgtcttccttttttttttggctttgcctatatataaagcatgcattgtttcctaattgactttgtgtgggagcatcatggcaggaggtggacgtagttaaaggatattctcccctcagctgcctttgctgccaggcttgtaaataacagcccgcctttggtgagtaataacttgtaccaactgacaaatactggtcagggatactgttttttttttttttaaactttgt

SEQ ID NO: 55393 - DNA, 1062 bp, Homo sapiens
gtgtttttctctttaatttgtccactgtctcattggaaagcccaataaagcctgagaatgggtgattccaaccttatcttggccactctgggcctgcactttccagaggcagaatgaagctgatctgcctagtggtttggctaccagaaagagaagaactacatatattgcagttgtgacctaaagggccctggagacacttgggaatacatggtcaccatgtctgggcagggtagatgagtggggtgggttggggagcagctgaggggaaggtagagttttactggaaatttcgggggagttcccatcttaactgcaaggttccttccagaaacttgcctccttacatgacccctttcttggctctgtaagagtcccctgctgagaactagcacaggactacttctgggccagggagagagaggattgcctgagctcaggatggcctcccctgccacctgcaggttgcaccggatccaatatgagatgcccctctgcgatgaagagtccagctccaagaccatgcacctcatgggggacttctctgcacccgccgagttcttcgtgacccttggcatcttttccttcttctataccatggctgccctagttatctacctgcgcttccacaacctctacacagagaacaaacgcttcccgctggtggtgagtcagcacaggccagaaggaatggggtggagaaacagatgtttgtgagggggttgaggtcagaactggagcagaggacaagcatggcggcttccacccccatggtggaacctctgcctccatcaacctcccgttgcttgctcctgttcacaggaggcacaatagcaccatacacaagcaggctctggagttagactgcctgggttcagatcccagcatggccccttacttgctgtgtgatctcggacaagttaaataacctctctaaatcgcagtttccttaactataaaatggggataaaataatacctgcttcatagttttgtgtgtgtatgtgaaaaaatgagaatgcatgtatctagtacatagttagtctcaataagcattagcgat

SEQ ID NO: 55394 - DNA, 1047 bp, Homo sapiens
caaaggacccgccgggtcctagtgcccgcccgctccgtcaccttcgcgcctccgggtcctagcgcctgctcaccgctcgcagcccaccctgccaacctctgcctctgccagtcgctaatacctgcccccatataggcttgcctttatctttctccttgcctgctgcccctcagctcgcgaccctcctgcacctgcctccagctttccctgtccgcaacagtcctccacgtgtttcccacgcaccccacttctgtgcccccttcctcaccccccttgttccttcgccttttgccccacacctcctgctccttttcggcatttgcctgcagctgcagtgcttttagacccccgccctctccgcgttagttcgtccgtccatccatctatcctccctccctccatccttcggtccatccatccatgcctccaacccactgtcctttcccaggcctcttgccctgcctcttggctctctgctcttactctcaccttctctaggcccctgagtgccttagtgagcgggcctacagccccttcttctgatctttgtcttctgggccccagggagcacctggcctcgtggcctttcggggtgacagcaggcatcacgcccctgaagaagtttgcaagtgagaagaggtggaggaggagactgcacggaggggtctctaatgacacttgttctcctctgagacatccgactcccagtttcgttctatccatcattccccgcacttgcatttaacggacttagagtgggagctgccccttgtctcttgcgtgcctaacccacgacccctcataatctggatattatataagattgtcaacaatcttctcatcctagaaaggagcatatctgttaatgggcatcagagagcagacctaagtgggagcccaggccaccctggggctgccccatgctgggtgggcaaagatggggccattgtcagggtctgggtgcattgagaaccggaaatggagtcagacgggtttggtgactcagaattgattttttttttcccaagggacagggagggggcgtag

SEQ ID NO: 55395 - DNA, 1197 bp, Homo sapiens
aaaatggtgggcagcagctcactttcacagaattttattatcagtattttcatgttgtaaatggtagccatcttaggctaaaagtatattcacctaatgggcaggttaatcttccttgacagtttagtgtgtcctaggcattgcgtggaacagaaaaatgcagtccctacgttttggtacagattcagcctaccagaaattggactggactctaaaactctaaccatgctgattctttggctcctctcttggtgattctagaagggggctgtcgtggcagattccaaagagggagaggaaatgataccaggaaaaaaattaaaagaatgcgaatttgaatacttacctaaagtcttgaccgaagggcagccctcctctatttggaaagttgtttttcacttcaggaggaacaaccaaggtgacgaggggtggagctactgcacaaccagccacatcagacaagtcaaccttggcagtcagtgaaatgacagctgttgatgtcagagcactcccatactctgcatttatatagtttttcatctgcaaagcagtttttctatggctgacaatttggctgacaggatgaagctgataaggagagcaagtctgatgaggactacttggagtttggagttctctcttctgttttggcctgtgccaagcccaaggaagtccatggctgcatctcttcaacaccccccacccacccaccacccacatcctcaccacctcccccaaaccacaagaagttccttagattctggccaagatgtgcaattttgtctgccatgccttgcagcacttaccctggctcctcttaggtagcacttgcggggagggaggaggctaatatgacagttttctttgagaataggtaagagttcagtgcattggttaacctggcctctcttccccccagtctctcaactccttccctttctgcatgcacttcttgcaccacttatcttgtatctcccaggaaaccagtggggaagcttcactttctccacccacatagcagaaaaggctcaggcccctgcagtgggacggttggcttttctggtctagtcacagtcagcctgtgctgaatgcttcctctcctggggcttgagagaggaaggctaaagcagctgccagtcaagccccttcatcaggcttctacactcttaggtggaaaatgcaaaatggtgaagacac

SEQ ID NO: 55396 - DNA, 1041 bp, Homo sapiens
ccccggggggagcccgcccctacaggccccggggaccctcaaccccgaccggacgcgtcctacccagcccggtgccctgttgaccttccctcagctcctcccaaaaggcacaccgaccccacctccaaaccctgcccgtgccatccctgtgactcccagcagtccctgccatcctgtgcatacctgcagcctgcacccctgtgaccccagcccagtaggccctcgggccacctcctcttcggccgatatttacagcccactgcctgcacagtgcctggaaactacccagcatctctctctcctagcccaaagggggtggaggtaagggtgggaggggaagtgggagagggtgtccttccctctggagtccttggtgaccacaaacccatcctctttctctcaagtgacccttccgtaccccaccagaacatgcccgggtgacctcctcccagatcttccttgtggccttcctcgcccactccagtgacactatgcacccccaccgtgacccgagaggcctctggctcctgctgccgtccttgtccctgctgctttttgaggtggccagagctggccgagccgtggttagctgtcctgccgcctgcttgtgcgccagcaacatcctcagctgctccaagcagcagctgcccaatgtgccccattccttgcccagttacacagcactactggacctcagtcacaacaacctgagccgcctgcgggccgagtggacccccacgcgcctgacccaactgcactccctgctgctgagccacaaccacctgaacttcatctcctctgaggccttttccccggtacccaacctgcgctacctggacctctcctccaaccagctgcgtacactggatgagttcctgttcagtgacctgcaagtactggaggtgctgctgctctacaataaccacatcatggcggtggaccggtgcgccttcgatgacatggcccagctgcagaaactctacttgagccagaaccagatctctcgcttccctctggaactggtcaaggaaggagccaagc

SEQ ID NO: 55397 - DNA, 1049 bp, Homo sapiens
aggagttttctggcaggcgagaaattaccagcagatattcccgcgcgggatgtaggctttaatttagaaatctccgccccaaaactggcatcttgaacgcgggagggcattatgagttagaggccccggtttttctccatttatccaaatcaggtagccgaaaggtaaatgaggcttcaagttgggcggcgggcagcgaacttgacagaacctcgaaactctgcagatccgccgcccaacccagccgccagctccccgtgacttccgctttcggtctcaactcctctccctgaggagagtggtttaaacggtgaaggctgcggggcgtcgccggaagtgtcgtaaacgtcggatatccggttcttctgggcgctaagggagctgacggagagggccaccgcccagcaatagacggtgcctcagcctgccgagccgcagtttccgtggtgtgagtgagtccgggcccgtgtcccctctcccgccgccgccatgggctgcacgttgagcgccgaagacaaggcggcagtggagcgaagcaagatgatcgaccgcaacttacgggaggacggggaaaaagcggccaaagaagtgaagctgctgctactcggtgaggggctggaggcggggactgagtggtggtcgggagagcctaggcgcttggaaggcctgaacggggtctggtcgggccgacggaaaggaccctaaagggatctggagggcgtgccgggcgtggggcggggtgttggggttcctagctgaggccccagagggcgtgatgaggggggtggggttttggggttgcgggaattaggctgtagagggtgtgactccgggctagaattgcgtttagcagagagacttgggagtatgggccggtagatgttgagggagtaggaatatgggaaaagctcataaaggaagagttgatactaggaaggttttacgttgggttggagcgtgttggtaacgagaacggcatagagtatatgttgggcttgtataatggtttgtgagtttggagcgtcgtggttctttggcaggataaagct

SEQ ID NO: 55398 - DNA, 1006 bp, Homo sapiens
ttaggataagttacagagttggacatattcactgtaaagactatggtagacttctggtggctgttttatcctttttggcctcttcaaagcaaaaccattgacttcaggaattactgtttatgttatttgatagtcgttttaattggctttttttaaacacagtcggatgtattttactcaacatgagtttcaaaatttttgagaggctcagtaaatcatacaaagaatactggcattagcttactaataaatcaagccacatttcttcattattagtgaagattttctagggtagtatttccattattttccaatattttctagggtagtatttccattagagaagaataagtaggagtaggggtttctacagaaacccttacaagcaatagaaatttactttttaaaacaattgatttttgaggaaaaggagtcactttaggggaaatgctaaattttcatggtataaagctccagagaacagaatgtacactgtaacccaagacttattttgtacattctaagtgcccctgttagtctcttcgtgtgaacatatttggttggttgtagattgcagaagctctggtaatagcttttttgaatatactataaagggaaagttatgtattggagcttaaggttccggtttgtatacctgaactttcagaagatgcgagttcaaattgtagttctagactgcgactgtctgtataacaggtggatatgcatggtccctggtacctagtaggtgctccttaaatatttactgttaaccagcctgagccagcaaatgttgaacactggtccttggggcctttgagaaatttgatataaactataacattcagggcgttaacttttttttttttttgagacggagtctccctctgttgcctaggctggagtgcagtggcgcgatctcgtctcactgcaacctccacctctcgggttcacgccattctcctgcctcagcctcccaagtagctgggactacaggcgcccgcca

SEQ ID NO: 55399 - DNA, 1062 bp, Homo sapiens
tctacaaattcaatgcaattcccattaaagtaccaccatcattcttcacagaactagaaaaaacaatcctaaaattcatgtggacccaaaaaagagcccgtatagccaaagcaagactaagcaaaaagaacaaacctagaggcattagattacctgacttcgaactatactgtaaggccataatcaccaaaacatcatggtactggtgtaaaaacaggcatatagactaatggaacagaatagagagcccagaaataaagccaaataacttccagtcaactaatcttcgacaaagaaacaaaaatgtgaagtggcgaaaggacaccctgttccacaaatggtgctgggataattgacaagccacatgtagaagcattaatcacttttgcagtctgaaaatacggcccttttcaggaattaaaataatgtaattttccctgactacgctattcctgtagtacactgatggccatagagtagggtgcttaatactagatttcacagggcatgtaaggttctaataagcgctgctactacgtttctttaaaaaataatttttagcatactaaacttatatgcattattacaaaaaagtcttttagtttttaggcagttgtctctaataaaattgattcgtagtctagagatcttttagagatggttagtaaaacctgaagcactatgctgttcctcccccgtggtgctgagcttctgcatcctctagcttgggaaggaaaagggagttgttaggcctctgcagatacttccttttttcctatcctgtctctcttccttccctggtttcttctacagcatactttctcctggggaaaggagtgcgtgcgtgcgtgtgtgtgtgtgtgtgtgtgtgtgtgtgtgtgtgtttgtgtgtgtttcatcaggtccttccattaacttccattctttttcttttttttttttgttgagtcttactctgtcgcccaggctggagtgcagtggtgcaatctcaatgcaacctctgcaacatcactgcaacctctgcctcccaggctcaaacgatcctcccatctcggcctcctg

SEQ ID NO: 55400 - DNA, 1336 bp, Homo sapiens
tgggaggccaaggcaggcagatcactaggtcaggagttcgagaccagcctggccagcatggtgaaactccatctctactaaaaatacaaaaaattagctgggcatggtggtgcgcacctgtaatcccagccacttaggaggctgaggcgggagaattgcttgaacccaggaggcagaggttgcagcgcgctgagattgtggcactgcactccatccagcctgggtgacagagcgagactctgtctcaaaagaaaaaaaaaagaaaagaaaaagaaaaaatgtctagagcagtctgcactaaatttgttcacgttactgaagttcatttttaaaatttgttttctagccaataaaatatagtagactagcaataataaaacacatctctttgaactggtaactcacatcagaaataggagataccatgcaattaatacagggcaaagagaatgaaaactgagagattagtccttatcactgagcttcattttcctttctttttaccactgagggatttaaattgaacctcaggggtcctttgtctgtgaacttaatattattagccagatggaatattttagcaagttataaaggtaactatttttgtgttatgtctcttattcttgagtttgattgaagttagcttaacatcataaagctggttagaaagatagttaaaaactgaagttaaaaacctgaaaaacataaattcatgaagtacccctaatgtacatgttcaaaagaaaatacaaagaaatcactcagtatttgacttcccctccaattttaattgtcttttggtataattcttttttggtgtttagcaagttaaagttatctttaagcatttatcttgtccaggtgatcctgttaccggcttagtaatcagctgtatcatttctgtaattcaagctgtttgaactgaataacatagtgttaggatcactgtttaattgttctagttttgatagatacaatgctttatgtaagtgaaatatccgatttttcatgactttctgttaagttgtgacaaattcatgtatctgatgtgaactaagcaaagaagaaagatacctaaaagactaaatttgtttgacttatacctgaatagtggtctagtgatgttagaaacaagtttcaggaagagctagtcttcagatctgaacttcctttgatttccaagttagacttagatacctaaaagtttaagaaagattgttaaggattagctgagatgttactgtgtttgttgatccattactaattgctgttagggcttctttttgttgccaagtcatgttttcagatggataaatgtttttaatgttaatacaaa

SEQ ID NO: 55401 - DNA, 1070 bp, Homo sapiens
ttttgtgctttcaaggattgggctttgagcttagggctagtggagtcctaaacaggcacaaacccgaataattacaataatttgaccaagtactaatgtaacagtgtatgacattaccctgtaaagccaggttgagcctggtcagggtgcccctgagggagaattacatagatatggaagggttttcaggttgtggcagaaagggtttcattactattttaatcaaaatcaagaaaaccagttagcagcttatgagaagcaaggagattaggagctaggaatatagtcaaataatttttttacagtagccagagctggctagagataaaatgaagtgaggtggctgggaaggacagtttgggggctagttttggaaattaacctcttgaactgatggtcaaagggaataatctgtgccagccaccagggtggaagtgataactgttcagaaagaatgaggagggcttcagcaaggagttgaagtctgagttgaataggggttttacggatgcttatagcatatgtagaggcttgtcatgtttagagggatagtgggctggctgaaaaactattttgagattgtaggctaaggaaacttagtaatttcacaagaaaaatagatctgtaacttctcccaccagaccgtaaagtccataaacttatttgtatttgaagtcaccatattcagcattttcaggcatgtaggagacatgtttgttgaaaaaaaatttttttatttgctcagtgatgtttttcctatctgttattcttctagccttttcttttattgaactaagaagcaactggttttttaattaagtatagtaccttgaaaagccgtttgaatgaaatgtcattcttttttgtttgttcgagatggagtttgctcttgttgcccaggccggagtgcaatggcgcggtctttgctcactgcaacctccacctcctggattcaagcgattctcctgcctcagcctcctgaatagctgggattacaggtgcccgccaccatacctggctaattttttgtatttttagtagagatgaggtttcactatgttggccaggct

SEQ ID NO: 55402 - DNA, 1145 bp, Homo sapiens
gatattatacttttatgttgattaccgagaaattcaaagtctggttttcttttcttacaggtgctggagaatctggtaaaagcaccattgtgaaacagatgaagtaagttggaatgtagcgttttgttagactaggatttctcctaatgcatataaagtccatagtatcttttcattttaggtccatggtattgacttgtggttttctttgttttaaagaatcattcatgaggatggctattcagaggatgaatgtaaacaatataaagtagttgtctacagcaatactatacagtccatcattgcaatcataagagccatgggacggctaaagattgactttggggaagctgccagggcagtaagtgtttctcatttcctcttcacttgctcttattcagcagatacagttaagttaagcaaaatttttgcttcatgttttagggaaatgaatttaagcaacaagataaaatgtagcaaagtactttgtgctcacttgagaaatgttagcaatctactttagcaggtgttagatataaccaccccaagaggagcctaggaaatgggattctgtgggtgcacggtaggtttctgggataactgttctattcaattgctttttttttttttttaacagcactgttgacttttatagtagtagataatagtacattaaaataatctaagagaaaggttgccatgatatgtagctctgctttctgaggtgtacagattaaaggccaaaatcagtctcccagaataaattctgtaaggacatgagcactaagtccaaattcttgaatatctaagtcagatattcaagaatactgtatactacatggaacctaaggctatagaattggagtataacatgccctagtataattctttaatgccttgcacatgtcagctatttaaaaagttgtattattataataatacttagtggaccctgaagatctagtttataaaattagagcatgtgtaattaggatgttttatgccattggggagggtgccaatatgaaggcaggagatctttgatattattatcagctaaaatccagagaaggctgggaaattatagaattatttcctacatctaagggactcactggctgtgttcagagtgtcatacttatgtg

SEQ ID NO: 55403 - DNA, 1052 bp, Homo sapiens
atggtatagcctgttgctcctaggctatgaacctgtacagcatgttattgtactaaatactgtaggcaattgtaacataatggtaagtatttgtgtatctcagcatctctaaacatataaaagggtaatgcaatggctatgatgtcactggggctaggagtgtttcagctccattataatcttacaggatcactagcatacatttatacagtctgttgttgaccaaaacattgttatgcagcacatgactgtatttgaaaacttgcttattctttcaatgagaacttggctttagaaacgtttcaggattcttgcctaccttttaataacatcttagttgcaagtattgatagcttaaataattctaccagtggtcatcaaaggtagattataattgctttttttcatctttcattcagaaagctctgaatcctctaactacatgtgcttatagagattttcataactgttgatctaagcttgcctctttacattagtgatagtatttggttttatagatcattaatgattcacttacattggtgccatctgctcatcagttttctagcctggaatcagcaaagaatacagttttgaagcagtcttttaattatttccctgaacaaattaatttttttggaggtatttacaatttgtttttgatttagattaaaaaaaaaaaccccagacctccccagctcttctgtttactgaaagaaaacggaaaatattcttactcactatagttctctcaattttagttaatcaaacaccattctctaatgtcctgtcaaatggttaaacacgcatgacctattgagtttaattgtctgaggacttttggtatagtttggttttgatattatacagtacacagttgatttagtattacatttcaggaatttttctttaataagaacatttcctgttcctattgttttaattttttaaattggccttcacaatttaattctgtagaattaaacctacttttgtgtccgggcgcggttgctcacgcctgtaatcccagcactttgggaggccgagacaga

SEQ ID NO: 55404 - DNA, 1004 bp, Homo sapiens
tcatttaacattgaatgtgcctcaatttctttatctgtataattgggataataataatagtacttctaggagtgttacaagggcaaaatgagttaagatgtttagtagtagtgtctggcaccatggtaagcactcaataaatataccattattattattatctcaaactgttttatttagctctttgcttttcctgtcttttcccctccttcctttaatccatttcagtgcttattctgctgacttttcacacatctggtacaagctttgatagagaagaggctcagctatctaaaatgagaatctagattattcacaagttttattttctcatgttgttgtcttgtacttttagccaggataattattttgactgcatttaatctattctttttcttctattataaatgaagttttgaatatgtaatagtgggaagtttcctaatcatttcagtttaggggaaggtgtatgtgtgaccttgctgaatttgctttctttccccttgcgcaggatgtttgatgtaggtggccaaagatcagaacgaaaaaagtggattcactgttttgagggagtgacagcaattatcttctgtgtggccctcagtgattatgaccttgttctggctgaggacgaggagatggtatgttggagcttctggtaaaaagcctgtctaatgtagccaggaaatggaaaataacttattaggaagattatctgcatccatttcctcattcaaccaaaacttagtatctttaatttttttgatctgtgccctattactctaaaaaagatgttatagccaccttgagtatgtggaaaggatgttagccagcccttcctcctacctcctctcccccaaaaattacaaaaatgaggactgacactcaactttatcttattggtgtttgacttatttccgtgaatgccatttagtgctgcaaaacttgttggtttgtctttttcattaacttaatccacttttactatttgctactgacctatc

SEQ ID NO: 55405 - DNA, 1094 bp, Homo sapiens
acatgtagttgcagagagacataaataattttattatagtgtttaattgcacataaataattttattatagtgtaaaatatgcattaatagaagtggaatagaagtggttacttctgatggggtcactgtagtctttttctagagctactaagaggatgaaatagaaatcatcaggcagacgggaataaaagcattttagaaaagaggaattgcatatatgagaatatggaggtaggaaaatggtatgaccagttgtggaacccagaaggaatttggtattactagagtttacagtggcagggaagaagtggttggagagatggtcagagatcaactcatggagggccttatatctcatgctgagacgatgatcagttaaaggtttaatatcctaccatgatccatatcatggggtgcatgatatagaagaaactgtgcttgagaaagattatgcaataaataataaagatagatagtaggggatttgaattagtaagaactcaggatggaaataaaaacttttgatggggattaagggatatatcatagaacccaagggcaagaatggacaggtcttagaatggaattagaactaggaaataattgtcaggaaccctggaagcactctttatccccatcttttttctctcctctctgtgtatcttttttattattctttctttcctaaccagctttctctgctattcagtttatgtgataacagcctagtcacagtttctgtatctctggtaaaaagatcagactaggctgggcgcggtggctcacgcctgtaatcccagcactttgggaggccgaggcgggtgaatcatgaggttaggagatcgagaccatcctggctaacacagtgaaaccccgtctccactaaaaatacaaaaaaaattagttgggcttggtggcaggcacctgtagtcccagctactcgggaggctgaggcaggagaatggcatgaacccgggaggcagagcttgcagtgagccgagatcgcgccactgcactccagcctgggcgactgagcaaaaaaaaaaaaaagatcagactagactgggattgcttggccttggtttcaaattcc

SEQ ID NO: 55406 - DNA, 2606 bp, Homo sapiens
ataccaaggagatctatactcacttcacctgtgccacagacacgaagaatgtgcagtttgtttttgatgctgttacagatgtcatcattaaaaacaacttaaaggaatgtggactttattgagaagcatggatgttagtgaaaggtaaagtttcatacaaggtagttatagtgctacagtgatgtctcttggtttttaaactttttctaattaagaatattcttctcttctagttactacagtgtggagtgttgagaccagacaccttttgctgtctcatggggcagctacaagcatgaacgggaccagggaatggcagcagcatgcagaatcttagcactctttagcacaatattttgtattagggaacttttaattgacatgagatgctaaagtcagacattggaattggaagaactataaagtgtgattcgatcgtcaagacatcacttggatttcttaatcttaaatgcttatggaagatgtgaagttgaggtgctgcattctagaacttcaatatgtagcttactctttttttccccccttcttaaaccaccagtggttcatttttaaggttttttcatcaagagaagaataactttactaaattttatttctttatttgcaaaagaatctttattaaaacaaacaatcttaactatgcacatgatgtgaccagatcatcttgaaaatattcctctttagtaggaactctttgtttttaactcttggtatggtcagaatataatacttccataattacttataattctttccggttactggggctataaatacaactttttaaatgaaatttatgttattatcctgctcaaagtaccattatggtttccatatggtaattacattggaaagttctgcaataagattctagttctctcttttctttaagcttatggttgaaggttaaccttgtttgtgcagattaccaaattactgctgatgtagtatgataaagtcagcttcttggatacagacacacccagggcagctgccaatcagaaatgcaaattgctaaattccaaacagaaccagtgactttgctgctacatatttactaaattgaccactttgattcttgcttgtttgtctcagttatagggagttttgtacatggtgcctcttgttttccatcttcatggccttttctgttgagaaacatctaaagtgtattaacagtgcatgcttttactttgtaaatgtggtgccaaatccctgtttgccatcgtttttactgtaccgatgttaactgtagtaatccttagccagtatgttcttttgctgaaactgttgcattttgggacttttttccactttgtcatgtgtacatttttaatctgttatagttggcggcagtattaaaatggtgagtaaagagcccaggtttgctcctgtttgtaactagtcttttctggaaatactgtcttctgtttccttttgcctttgcagaatgtgctttagcctttgtctgagaatgggtttaggtagaagggtttcctgaaagtctagtcttttggtgtaatagtattgttgaaccttaggttttatgttatatctgcatatgagtgatatgtgatcatgattcattttgcagatttacattttgcttgtgtggaaagttacgttcacttcaacctacagacccttttgtataatgtacagcaaatgtcattaaatattgaatgctctattgggggaagacaaatgaagagaatgcattttgagcatttcaaatcagtagtttgggcagtgccttttggggtccaatctttttggattggattctatttcatcttttgatgtgacttttcactagtttacaaaaaaaaggttggtggtcaacaaaaaaagcaagtcatagcagttcagtgcctttgttggtagtttttaactttttttgtgattctttttggaaaatcatagcttacagatggtataactgtattatataatggaattttctttaggtgtgggaaaacttgatctgaaagaaaattatcagcttcaattggcgattgattcagtgcccacaatgtaaacagggttggtagttgttactcattttgaatataccttttccttattgtattctgtaatataggatcctggaaatgagacctggtggaatattattttcaactgtagtctttctatactgtggactaatgaaatggtgttgttgataatctaaaataaccaataatccaaaaaagttcattttactttgaatttgtattttcatttgaatatctatctgatatgttaaatttttagcccttctgttaaagaaaaatagcaggtccccatttttctgcctctgtaccatttacatttgctctctgtttgttaacatgaagatcactcttatttcaccatcccaaataacttatctaaatgcacattccttgaggacacagggagacaatttaagtcagtagtttttaatatgacttaagtaaaaatcacttggacccatctaagggattgacttttggctggtgggctggcaatcgattttttttttttttttttttttttgagacggagtctcgctctgtcgcccaggctggagtgcagtggcgcga

SEQ ID NO: 55407 - DNA, 1008 bp, Homo sapiens
aagaagccattagtctctgtgtaaagaagaagtattcttaatggacagtcccccctaaccttataaattcagctttgcaacagatttcacctcctagcatgaaaattccaaaaactttaacaattactcataagtggatcttgagatgacattttcatcttggacagtttgaattctaaatctctagttcacagtgaatcgttttttaaatttttactgatggatcgttatttttcacaaggtactacattcttacaatgtaagactagatggaccaaaattttaaaaaaaacttcttgccttgtttttttaattttcatatatattctatttgttgtatatacacattagactattttaaaataacagctggtttttgtaattcattcattcaccctatattcttatattctgctcattattctctcatttatagctgtgacattctttggacattacttgcctggcctgattagttacttaatataatttattcatttgcttagcatgtgtgacatagttctggaatttcctgttgcagaactccttgctgtattgcagtcatatataaggtaaagtcagtctcttgttcctattaaaaagctaccattgattattttccctttttacatgttcaaaaaaaaaaaaataagcaaccctctactcatttgtataaacctaaaacgtcactgttttccttgagcgttagtacttgtgggttctttccttttcatgtgtaatactgattttaagagcaatgatcttagtttgccagtgccaggtaattattgtgttctactttaggcttcgtagtgcaaatcagggatctgacctggatcagcctcagctctttacatagctttatgatcatcatattttgttgtattgctcccaacaagcacaagagaaaaaggcaggcttcctagagacctcaagttgaaagttgattttgctgacaactatcagggagtaaaagaaagcctttttcaggcactggagaactaactt

SEQ ID NO: 55408 - DNA, 1017 bp, Homo sapiens
tccctcctttccccccagttttctcaacatttatgagttagttctgctgagaacaacatacttcagaacatgtcaggatagggcagttttttcttgtttttcttttttctttttttgagacagtcttgctctgttgcccaggctggagtacagtggcacgatctctgctcactgcaacctttgcctcttaggttcaagcgattcttgtgcctcagcctcccaagtagctgtgattacaggcatgtgccaccacatctggctaacttttgtatttctagtagagacagggtttcaccatgttagccaggctggtctcaaactcctgacctcaagtgatttgcctgccttggcctcccaaagtgctgagattacagatgtgaaccactccacccactcagggcagttttttttctgataccatatcaggcctaggcctgggctgactcaaatcttctcaggaataagaggtaagaaggaatgttaaacagcagtagttacctggggtacatggttaatttgatttagcagattctttggctaaaccctagtaaattaaaatgtctgagccaggtcatgggaatatacatgtttttaatacattccttaggtgattttgatgtagccaatctgggccaacatttggggacaactgagtaggacctaatacaggttgaatagcccttatccaaatctcttgggaccagaagtgtttgagagttcagatttttgtgaggttttgaaatatttgcattatatacttattggttcgggattccaaatccaaaaatctgaaatccaaaatgccccagtgtgtgcttcctttgagtgttatgttgttacccaaaaagcttttgattttggagcattttagattttggattttcagatttgaaatgctcaatctatattaaagatcaacacaggctgagcacagtggctcatgtctgtaatcccagcactttgggaggccgaggtaagcagatcacttgaggtcaggagtttgagaccagcttggcc

SEQ ID NO: 55409 - DNA, 1085 bp, Homo sapiens
gctagttccactttttaggaccccacatctagatccccctcactgggggtctgacatctgggcacaaccattgctggctggcatcccacaactgggggcttgactgtatctatcgtttgctatttgctcattcctggtctatattgtgagcctccttaggagtatggggtgtccttggtcaggtccgtgcagggttcaggctggggctgctgcccgcactgtgtgtgcttctgcaccctttggttcgtctctcactctagtaagcatctctgcatcatttggagcaggcagtgaggtgcggcagtgcctgtctcagtgagggcttggctgcctggctctgtgcttgcagagggatatctgcctgctgtctgctcccaggccttgtggctaaggaaagacccaccctgactttgatgaccagatcatgccgactgcccccacccttgcagctgtctgtagctatagcccaagtatcaacctcctatatttttttgtttcattgaagatgactggtgcaaggtctctactgtcctgagggtgttctctgtgcccaggtctgtgccatccagaaagggtgtcccctgggtggggcccttcctggccctgtttggttcagcaatagggcaactgatacggatctagcccagagctggagacccttcggtggtcagatggtaagagcatctgatacttgtggggtcaaagccgtggacacccctgtgcctactgaggcagtcgtggcagtgtgtgaggggctcctggtcgagaggggagatggggtgctcagaatctcagagttggtgggagtggctctggagcagcccactctggcttttgcttgacttctccgtaagtgtgggtgtatgtgtgtggtgctgacccctagagaaaggaccagtaggcagctgagtcttctaggcctggcctctgagaacgtagcggttactgcccgtgtgccaccttcagtgagcctgcggcagccctggagagtggtctggcaggctggggggatggcactggctgttggaatctgtcctgctcaccccaggattgctgtggagcctgagacccccctgctaggagag

SEQ ID NO: 55410 - DNA, 1012 bp, Homo sapiens
ttccccagggccctctgtggtgcccccggtccagatcctggggcctgagtggcatagactgtttgtggcagctccttttggaggggcaggctaaggccaggccacattttggcagccctggggccctgggggacagggcgggcctccagggaggaggtagggttcccttgccaaccaggccctccacttcctctcctcttcccttgagggctcgtccctaggtcagagctgagcagcagctgcggcttctcttgtgctgcacaggtctaggatgtcaggcacagggccctgcccctttgagtggagaatctgctagtccaggggcgggtctgatcctgggttgcctgccctgggagctgcaggctgggggtccctggtgtggccgcctggtccttaccaagcacctggtgtgtgtctctgagggtgtctgtgtgcgtacgtgcatgtgtgtgcacacgtacacacgtgcacctgcctctgggaggtagtcacgtggagattctcatggcctgagggatcaggctctagtctcatttgtggaggtaatgaatctacttgttctaggggcagactcagaatccccaccccaagcctggaatgggtgaggggtccctgcgttagaggtgagggtgagccctttgggagccacacacacaggcctactcctcagctactgaggagggactgccctctttcccgaccctgggctctctcgggagctggcctaggcagggcaggggcccagggctttcaggggctgcccctccaccctttgaccctggcatcactgtctctgcagaggctcggggtggtctgggggcccctccgctgcagtctgcccgatccctgccgggccccgccccctgcctcaagcacttcccgctcgacctgcgcacgtctatggatggcaaatgcaaggagatcgccgaggtatcacctggcaccacccgcaccctcaccccgtgtctccatgccctgcctctgctccccacacccctcacctcaagctgtc

SEQ ID NO: 55411 - DNA, 1029 bp, Homo sapiens
ttccagaccctttcagagccccttttctgcctctttccctcgcaccctgccttggggggtctgcacagggagcatagagtgggctttggagtcgggctgctgggttctgttctgtcttctagccgccggtgtggctgggtcatgttgcttaacttatgggtctgctttctcatctctaaagtgagtgagaacagcacagggttctgcagctctgcctttgaggatcacatgtgacaacatgtgcacagcacctagtgcggtgctgggacctgggagcaagggccgtccctcgggatctgcctgacttctcacccctcttgcctctaggctggagccagacatcctgcttcgggccaagcaagatttcctgaagacggacagtgactcggacctacagtgaggagggcagaggggcacaggggatgcggagctgcagcctgcccttctgccggctctaaacccctcccttgaatgcaccccctgcaggctctacaaggaacagggtgaggggcagggtgaccggagcctgcgggagcgtgatgtgctggaacgggagtttcagcgggtcaccatctctggggaggagaagtgtggggtaagtatggggtgtatgttgggtgagtcgccatcacctatgtcttagtgggttcccccagcctggagagctgggggtgggggctggaaagggcgtttctctttccagcagctggaggggcggaggggcagaggggctgcctaggagccacttgatgtgctggaccagggtgatctgagtgttcctgggggtcagggcctgtgggaggtggggatagtttgggttctaagataaggccttagggaggaggtctctgagtccaagactgaggagagtgatcgcatatcctcatctccaggtgccgttcacagacctgctggatgcagccaagagtgtggtgcgggcgctcttcatccgggagaagtacatggccctgtccctgcagagcttctgccccaccacccgccgctacctgcagcagctggctgaaaagc

SEQ ID NO: 55412 - DNA, 1025 bp, Homo sapiens
cctgtgtctgctggtgggactccccatctctgccccatgccatgtgccctagcctcctgggcttctcagcctggtgcctgggcacctctgccctgcctgcctctccctacaacccaggctcattccaacctcttggggtacaggggtggaggttgggcaggagctgtctgacctactgggtcttcaacatctcttgccctctgtggggcctttgggttgggcagtgggtggcttggaagagccctgctctgactttaccctcctcacccctgcagatgccccggtgcacccccctgcgctggagcagcacccgtatgagcactgtgagccaagcaccatgcctggggacctgggcttgggtctgcgcatggtgcggggtgtggtgcacgtctacacccgcagggaacccgacgagcagtaagaggggtgtggtgcatgttggggggatgcagcgtgggaggttgcgttggcttgggagaggccacagggctcggcttgctctcctcacccaagctcccctccatgccagttgctcagaggtggagctgccataccctgacctgcaggaatttgtggctgacgtcaatgtgctgatggccctgattatcaatggccccatgtgagtcccctgccatcccagacacttagctcccctcccagcccagattctccagccccagttctgccccagactcccatcacctggtgtcttgcccttcctagttgctgagccctcgacttccccgcagtctacttccctcttggcagcctccatccttaccctcccacctgctccctctgatctgctacccaagccctccccaggtgcctcccttcagggcctaagtccctgccttgttctcctcatgcccagaaagtcattctgctaccgccggctgcagtacctgagctccaagttccagatgcatgtgctactcaatgagatgaaggagctggccgcccagaagaaagtgccacaccgagatttctacaacatccgcaaggtgggccctcaccccgtggcc

SEQ ID NO: 55413 - DNA, 1170 bp, Homo sapiens
caatgtaactacccttccccaccccagccttcagcctggggccccaacttggattttgactaattcaccctttgcacatcaggccaagcctggattcccctccccctgccctctgctgtggcctggacccccagaaccactgtgccctgcccagcctcggggccacctgacaggccctccctccctgttgcctgcccaggcccccgtcctgcagtacctgtactacctggcccagatcggcatcgccatgtctccgctcagcaacaacagcctcttcctcagctatcaccggaatccgctaccggagtacctgtcccgcggcctcatggtctccctgtccactgatgatcccttgcagttccacttcaccaaggtcagagcccagcaggcagccaggcgggcgggcgtcccaggacgctggggtctcccgggttgggtggggggcggtggggggggcggtctctcgggttggtgctgccccctgctggtagagcatagctggccaattgacaagtcttatggagttgaggggttggggggttggggggatgggggggcgggggtggggagagtgagtgaggaggctggggaagggaggcaggggcagctggccagggcgcactcgtctgagggaacctggcccgtgcaggagccgctgatggaggagtacagcatcgccacccaggtgtggaagctcagctcctgcgatatgtgtgagctggcccgcaacagcgtgctcatgagcggcttctcgcacaaggtactacagcgcctgcctggaccttggcatggcatcactcctcccctcctctgcatttggggtcctgacctgtccctgggatggcttggggtggggcatgacccctcagcactggctgcagccctgcccattacccccgctccttgcaggtaaagagccactggctgggacccaactataccaaggaaggccctgaggggaatgacatccgccggaccaatgtgccagacatccgcgtgggctaccgctacgagaccctgtgccaggagctggcgctcatcacgcaggcagtccagagtgagatgctggagaccattccagaggaggcgggtatcaccatgagcccagggcctcaatgagcctggtccatgaagtgcccaccacatcgcagcacttttaccacgttttgt

SEQ ID NO: 55414 - DNA, 1070 bp, Homo sapiens
gaatctcacatcagctgagacacagcgacatccagccaggatacggctgagataagcggccttcgggttttgtcacagggtagcaggggaacctgggacaatacccagcggcccaccaactgctcccttgttggggaatattccttgcctcgtagcgtgggtgagcctgctcctagctggtcctcctgccttcctgatggcttcctcgctgcctccctctctctacccacctcttccttctccccagcaggccaggaggccaatacctgctgcaggtgcctcgcctttccttgcagctctttcctcagagcctggagtcaggatggaagttggttgggagagaagcaggtgctggggcaaggtggaaggaggaggggcgagaggaggagaggcttctccatggtgttcatcgaaagccctgggtggacagatgcaagatggaccagcagctggtgttcaggaggccactggtcaggccctcactccgttccctcatgcaaatgtgactgcccatagaaaccaactccctctaacccagcacacaggagctgataagctacttatcagcttacaataaagactgaaaacaacaagcacaggattttttttaaaaagtcaaccagaagtggcttgatgagcaatatattggaaccagggtttcgaagagtctgggtcagccctgggcctccttctcctctgcacccatgtgcacttgagcagagcccttctgcccagaaagtgcctttgtgggtttagaaaaagatgtcccttccttgggtagacacagcctcctgatggggagcacagcttggccagcagagcacaggctggcttgcagtctctgatcacccagaggctctcgcgcagcatgtaacccacctgacatctgtgtcagcctggctgggggtctctggagtgcccacagcctgagggtgcacgtgtagctgcattctcactgatgccactagttcttgtgcctactcttggaggatgtcacctatccaggtctgaacgttccaggcagcatcctacatgagtctgtaaatcaactgaagctccagcagccccca

SEQ ID NO: 55415 - DNA, 1049 bp, Homo sapiens
tccttgcctgtgttgtccttcccacgttaggtctgtcatgccacgtatgtccgcagtttataacaatctctatcatacattgaaaagttttgaaaacttatccagtgaatccctgagcaccaaatgttcttttgtgttatttttctttattaggctattattactttattcagaatctctctgttttagagagagcctttctttcttgcctaacctagagtgcagcggcgcgatcatagctcagttcagtcttgaacccctggactcaaccagttctcccccgccctgggcttctgggcgtcctgatctctctcctgaaacccacggggctgggaggtgggaggagatcctactcctagccccatgagcgcgctccaggcctccagattggcccgtttcgggggcagggcgggccgtggggcggggtcgcagcaaggcttcccctctaccctctctgggcctctcacaaacgctgagccccgccccgctgaggcctgtctgcagaatccacagcaaccagcaccatgcccatgacactggggtactggaacatccgcggggtgagccagggtccgctgggcggtgggacgggggtgcgtgggggcggggaagtgtggagcagctgcaggacgggctctagggacggttcctcttcagggctgtccctgacagcggggtctgtgcttgccgctgtctgtgcgtgtggctgggcgtgcggggtgggggcgggtgaggcaggaacgagaggaggagatggggctccccttgtgcagagtcgtcacaaagtcagggaccctccatctctgacccgagctgtgggccatctctcccagctggcccattccatccgcctgctcctggaatacacagactcaagctacgaggaaaagaagtacacgatgggggacggtaatggcaccctcgagtctgggccctgccccctcacactaagttggcaccaagcaaccgatagtggccacctgtggctgactctgcaggcctcccttgctggaactgcaggctgtcccttccctgagccctggtgaggg

SEQ ID NO: 55416 - DNA, 1106 bp, Homo sapiens
acctgctgtgtctgcagtggggttgtgccagccctcatgggcagctgaccttgagttctggccttattttcccccctctcagggcttggagaagatctctgcctacatgaagtccagccgcttcctcccaagacctgtgttcacaaagatggctgtctggggcaacaagtagggccttgaaggccaggaggtgggagtgaggagcccatactcagcctgctgcccaggctgtgcagcgcagctggactctgcatcccagcacctgcctcctcgttcctttctcctgtttattcccatctttactcccaagacttcattgtccctcttcactccccctaaacccctgtcccatgcaggccctttgaagcctcagctacccactatccttcgtgaacatcccctcccatcattacccttccctgcactaaagccagcctgaccttccttcctgttagtggttgtgtctgctttaaagggcctgcctggcccctcgcctgtggagctcagccccgagctgtccccgtgttgcatgaaggagcagcattgactggtttacaggccctgctcctgcagcatggtccctgccttaggcctacctgatggaagtaaagcctcaaccacatttgctgtgtgtcttgtcttatttgctcctggccatctacccagactgtctgtctgtctgtcactgcctcttccaagggactggctggtgatcctggcagtggctgggttctaaaggattctgctgggcatagtaaggcgcttgagaattcttgctcccattcctgagagactcagagcaggaagccccatgaggcactgtggaaaggatgtctctttcttggcctggatctcccattcattcatccagccgtattgagtactttccataattgcacagagcttgtgtctcattgaataggaccccaagggggtggaatctccatcagagagaaccagggtcccttttaccttctccactatatgactgcatcacttctgttaggtctccaggacccaatctctattgtttttctcagatggcttccaggtaccctctccaggcttgctgcacagctgtcatcaggacgttctctctgggttta

SEQ ID NO: 55417 - DNA, 1036 bp, Homo sapiens
atttggggccaggactcttgcattcctgcacacactggtcttaagtccctggtaccattcatcctccaagtgctttcccatactatcagcagttattctcacgactccaatgtcatgtcaacaaaagcagaggcaattcccaccaaccttaggacacgatccaggcatcccagggtagaaattcagttcctgtatggtaaagtttgtgttcagaatctccttcatcagctctggcctctgacttctgtcctgggtcatttctgtcagccagttcacatcacctgcctgctcctagaatatgcagactcaagtagaagactcaggaatgtaatggcaccctcgaattgcatcttctcctcaacagttttctgagtgctgtcattgacatgcacagggatctgcgcattttcataacagacagctcagaggcagtcagagggcctttattcctctccctccttcctttcaacttgaacttctcatctccctggaaactagtcaatgttcattgttttcttctgccaccccattagaaggaactttctactttccctgagctcccttagttctttgcatccttgattctgctggtctggatccagaggctgccaggtgcttgggcgctcctggggctgacccagaggctattgggaggtcagtgaggacagattcagggacagcatctcattcctctctgccttctgatcagtttagatagggtctggcactcagtcagagtctaataaatgctgatgtatccaattgaagcctgggcactgccccagttccagcttggggaagatggctgcttgcccatggccagcctgggccgtccacagccccggggaggccacgtctgtgcagggagcttttgtccgagggtggtgacagctgttttctgcctcaggagaaactgaagccaaagtacttggaggaactccctgaaaagctaaagctctactcagagtttctggggaagcggccatggtttgcaggaaacaaggtaaaggaggagtgatatggggaatgagatctg

SEQ ID NO: 55418 - DNA, 1055 bp, Homo sapiens
ttctcctctgcatgaggcagggtgtgaggcacagtgggagttgcatagatgactgccccatcctggaaatgagtgcagtgagaggcctgcaggcagagcagcctgtgaggtgtgtgtggcaccacctgggtaccgggcctggggcctgcccctcactcacggggaaccatccctcacctgtgttgaagttgtttgagagcagcaaatcctactttagtacagatttggggatttgaggcattagtccaacaggcttctgagcctagaatctgtttccctttcccactccccatcaagaaatctgcttgctcagctagttcccatcagctctggttctggtccagcctgagcagccttggggttatgtaagaggtggtgggaggggagcggtggggaacagccgagggctggggcatggagcctgcctgggcctggccctggccctttggggagagggagccctggatctctttgaattctttagaagttacatggtcattgaatcctggtaagattgtgtgcagcacacctgagtgtcatgtggcctggctagcagtagtagggctggagatgtgatgggggcacagggacatagggagatttagctcaggtaccaggtggagaagtttggactttatgctttaatgggaatgattagagcctggtctggccttcctttggtggttcacccttaccctattcagtttcatccaggttttgctaagtcattgggtgagatctgtgctctcttcttggctgcacaggtgtgttctgagcccctttgttctgctggaggtcctttctgtgtgtgcaatcctaggcaagccaagaacctccctgtgaaaaaggagaatgtttgtgccgacaaggagtgacaggatctggcatggggtgtggctgggtggaagaggaggagaatttggcaaaaacatgctagaactgaagacagaaccaggctatattccagccctgtcccacttactagctatttgagtgtgaggaagttgctgaacttctgttcttctatatgagaaacggtgataatagaactgacc

SEQ ID NO: 55419 - DNA, 1002 bp, Homo sapiens
tgggtatcaaggcagttttgcatgaggcataaagatgaatagatgtggaataatgattggggggcaggtggaaaggcatgacagtcattggaaagagcttgtgcaaagatgggaggcaggaagaagcagggaatggggaggtggtatagaggcttgtgtggtggagaatggctagacctggtgtaacccagactagacaaccttggctttcttctggagtgatgggggccctgatgtttttgggagaaggaggtaaaggcagcaggttggcgtttcagaaaatttcccccagtggtaagatgaggagtgaactagaaagcagggagacaccagttaggaggctcttgaaattgtccaagcaactgattgaggggtgaaggtggggatggaggagacagaacccagagatgctgagaggcagaaccagcagcacttggtggctggttgggtgtggggcaagtccaggaagggctggactgcctacctgcctgctggttggcctggtgaagagaagtgacatccttaagcaaagcttgtgacctggaagaagtattgatttgcctcaagccctacagccaaccttcctggattcaaatcaggcctctagcacctactagctatgctcctttcacctctctgtggataataaactgtatttgtgtaccacatagtggtactgtcagaactacattagcaaagtgcttggtacctagtgagcgcttgttatgtatcaggccaggagaagggaatggcaggggacttgagccctggatcctggcaccccagagttgagcacccatggatcctcacactctcaccctttccagcagtaggcattctgccgctttcatgctcccccacacaccccaccctgggagttgcatgcaggctggtgcatggattttgtaaaaagccatcactcaccaactgttcctggtctacaaactcaaatgtaatttggcacgaggtctccatctgactgtcaatctgtaagagagagca

SEQ ID NO: 55420 - DNA, 1051 bp, Homo sapiens
aatcaccatgataccctggctccagaagtccccaggatgccttgggtgtttcctcaagggacaaggctggatttgaagtctgagcatcattggaactcccagggctggctcagctgcatacatgtgtacactgcgtgtcctcgtctctgcgtctcgtgccacacgtgccctcctacattcaaccttgcttcccaaggcagggtctagggccctgcaacctgccagtggccaagtccagtctcgttgcttcaatcccaagtcctcaagccttggctgcattctagccccagcctgttcctgcctgtggctgtggctgtggctgtggctgtgtggctcctggctatgcatgaaaccagtgtctctggggcttgaagttgtcttgtattggtctggaaggcaaccgttcagcctcctgacctgactgctgctcacccctagcttggcctgtggccagtgggaacccctgcatgggctgttctcttatcttccttctccccaacccccagtgtgtgcatctcaaccctattctttgtcactgctcatgagaccctgcatacggcaccttccctgtgtcatgagcacccactctagtcccatcctcttctcagccccagggctgagctaggagatgagggccccccagactcacattcccctcttgccccgctctgggaaagctgtgctggaggctagtgactctatctcctccccatctttctctctccttctctctgtggttctttcagatgtggtgaccaagcctgattgcaactgcctgtaccccaaagccatccctagcagtgacccggcctctgtctcccctcatcagcccctcgccccctccatggcccctgtggctggcttgacctgggaggactctgagggaactgagggcagctccctcttgcctggtgagcagcccctgcacacagtggatccaggcagtgccaagcagcggccacccaggagcacctgccagagctttgagccgccagagaccccagttgtcaaggacagcaccatcggtggctcaccacagcctcgcccctct

SEQ ID NO: 55421 - DNA, 1030 bp, Homo sapiens
gcttctagtgttgctgccacctgtgacctcagagcaactaaacccccctttttcaaatgtggcctttataaggtctttaccctcctggagaatcttcagtagctctgtgtggcagccactgcaagccctatattcttggcttggctgccaagccccttcgacagcagctgcttgccagatcgccacccccgcaccagttaaccctcctccccagctgaggtcagttctgcttccttgcttttaggatcatgttgacatagaacctgagtcttggaagggctctcaggggtcatttggccctggttcccaccccaaagggactgcccctctccatgtccccaacagggagccagccagctggctgtcacacactcccagatccagcccagctccctgcctagccacagcccatgccatcttccagtcagactgggagaaacgtcttcctcatgcgaggcaaaactggcttccctgccccctccatactgctcctccctcctgttctcatgaaaaccctcagatatttcaagtcaggtatccatgtcccctttgagaattctctaagctaagtatggccaagtccctcaaacgttccttatatgatatggttttcagacccctcaccatcctggacacactcgtttgtcaatgtccctctgaaaatgtgacgcccagccccggacacagtactccagatgttgtctgaccagctcagagagagtacagtgggactgttaccttccttgatatggacagtattcttctatttgtgcagattaagattgcattagtttttttcttaacaactgcatcatactgttgtcatatgttgagcctgtggtctattaaaacccctagttccatttcccataaacttctgtcaagccagaccatctctaccctgtacttggacaacttaacttttttaaccaaagtgcagtttatgttcacctttgttaaagccaccttgttggtttctgcccatcacctgaacctactgaagttgtgtgaaatcctaattctgtcatct

SEQ ID NO: 55422 - DNA, 1075 bp, Homo sapiens
acctctaaccaggcaagccagggtgggagagcaatcaggagagccaggcctcagcttccaatgcctggagggcctccactttgtggccagcctgtggtggtggctctgaggcctaggcaacgagcgacagggctgccagttgcccctgggttcctttgtgctgctgtgtgcctcctctcctgccgccctttgtcctccgctaagagaccctgccctacctggccgctgggccccgtgactttcccttcctgcccaggaaagtgagggtcggctggccccaccttccctgtcctgatgccgacagcttagggaagggcagtgaacttgcatatggggcttagccttctagtcacagcctctatatttgatgctagaaaacacatatttttaaatggaagaaaaataaaaaggcattcccccttcatccccctaccttaaacatataatattttaaaggtcaaaaaagcaatccaacccactgcagaagctctttttgagcacttggtggcatcagagcaggaggagccccagagccacctctggtgtccccccaggctacctgctcaggaaccccttctgttctctgagaagtcaagagaggacattggctcacgcactgtgagattttgtttttatacttggaagtggtgaattattttatataaagtcatttaaatatctatttaaaagataggaagctgcttatatatttaataataaaagaagtgcacaagctgccatgtgagtcgtgggaaagttgcttttggggtgtgggtggcaaacatcagggtgggtgggcagcagttgccggatgaaccccagctcagagaacctttttccacaaaacacaggggaggaaggttctctccaagtttcagtcttggtaccaaaacctcctgtattattgctgtcccaaacacattcatctgcatatctgctcgtattgggcagaaagtggccaaacatcaggcctggtcactggcccctgctcctgcccagcctagcccagcctgggaaaatggctggttgggctctgtccaagggccccggcggcctgcaaggataaggctccttg

SEQ ID NO: 55423 - DNA, 1992 bp, Homo sapiens
tcaccctgggaacttcgctctcgagcgggagaggaacggcttctgtggcccagcccagcgtggtgacgtcacgacagagtgccctttctccccgcctcttccccctcccgggagctgccagtacttgacgtggcgtcaccgccctctaccctcgctttgcgtgcgtgtttgcgtacagcggaggtggcggcgcgggcaggtcggagctcggagctgctgttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcgggggcggcgggtcagccgctggccgggccggccggggaatgtcgatgcctgacgcgatgccgctgcccggggtcggggaggagctgaagcaggccaaggagatcgaggacgccgagaagtactccttcatggccaccgtcaccaaggcgcccaagaaggtgcgggggctctgggtggcggcgggggctcgggctccggcctcgcggaagggacgcgagcaagcccgggctctggctagtttgggacttctgggggtgactggggacggcggaggtgatgtagggggtggcggctgtgcggccccaggcctctcccgggctgaaaggccgcctctgacctcgctttcctttgtccctcggcccaagtcctccgggatcgttttgaaacccgacagggccaggccttaaatttgcgactgacttttcctggatgaagggcctcgaagacgagagtgggagggggtgaaccaactcagctgacccttgtgaccagtccgggggcatggggtgtacagaaaatctcccttcaggtgagtgggtaaatctggcagaacttccatcaaatctttgggagcagtggccgctttatccaacaactgcgtgatagctgggaggcaagagaaaagaatgcgtgaagctagctctgatatacaggtgaaagcgatgagggtaacatgaaactgaaaatctatgattttcactttctacagcattccaattacttcgaaatatgtaagaaattgacatttggaggttggtgacagcagacactgtcatggatacaggtggatcctagagtcatgtgaatagatcacttaggcatccctggagaaaggagcttgggtgggttggagtagtgggtggtaagggaagattgctcactcttgactgtacttttgaggcagaacaagtttgatctattgtgctgtaggttgactcaaaggacacccttcgaattctctcataaatggcaacctttggagattttagtctgactagctctccgagtggtggaattgggatccttattgctttctcatcatttactgccaaccacatcttgattttccatacacctggcacccagttagcagtagaccagagaacctttacaaagaggtgaccttcctgaagccagtgagaacccagataaatgtctcccttctttataaagacagagtcttacaaagctgtctctgcctgcatccagtgtttaatgggatgcagggctgaacaaagcaagggctgcaggaatagttaagtccttgaggcttcaactagttaagctgtcttaagtgggagagatggctcttttttttttttttaagtgaattaacctgccactccagaaatcaaatgcaagatcaaaaaagacgagtcgccattgtgtgctttcgctgttttctcacaaaattaagaatttaattcctttaaaagattgtggaagattccttgactctgaggcatctgattaactttagtgctgagagttcagttgactgctttgttgggacaatgaccctttgcaatctgcactattctttggagaaacagtcacagtccttataagcagaatgattgagggtggga

SEQ ID NO: 55424 - DNA, 1021 bp, Homo sapiens
tgaggatgttcttgatgccagaggatataggttacttcagggtgaccttgatggtcctcagttagatcagatcccagtgtcactttctggtcagcttttattcattttgtttgctttgtttgagacagagtcagcttttattcattttgtttgctttgtttgagatagagtggatgtccatcaattaaaagcataaatatctagattcttcagctataatcatgacttactcagttttgtatgccaaggtctatcacactgctatgaacaaaataggacttgttggtttgattgaagatttgagatgtctgggtgtcgagaagtcaactaaagggatatgaccttgagcaaattaattagcttttgtacctgcatctcctcatctgccaaataagtgcctattttttttggaacaggtggagataggggcatgttggggagttaagatagcagtgtaattttttaaaagtctattcgtatatttatattctttcttcaatgggcatttgaagtggcttataacacagaacatatatgtgatataaaaggaagtaaaaactatagaaagaatgaaaaaaatattgttaacctcgagggctaagatagttgatgaggttgatcacatgcaacttgaaacttttagcagccagaggatgaaaagaatcatagttacagtctccttagcaggcatgggaaataatacatgtcaattcctcaaggggacgacttttcctgacacagagttctaaaataatttttcacgggaatgtcttaatagctgtagtgtaattcacattgtaaggcttgttcacgactgtcactggtgatttcagatggtatggctaggaaaatttgaggtaagaaaaggaatccttgagttttaagagttaagtgtaccacaactgaagaagatccttgtttaatgttggcagttatcggtcaaaccaagtaagtaatctagttccccataaccactggttatttatccctcttttgctgctactttgtgtaacaggagtgg

SEQ ID NO: 55425 - DNA, 1021 bp, Homo sapiens
ttacaagtccacaaactgctaagagatttaagtttccagcctgcagtttgtccttatggcttggaacaaagctgaggttgttggcattgtcagctccctctttgggatgctcctcagcttcccaaaagactcattataagtgccttgagagttcagctcaggaacttaacacacattcgaaccggcatttcggccactttgggggaatttttggtattatctcaactctactgctcttcatatgaaatgcagatgcccctgaagctccagagctgattccgtaggagtgtttgaaatagtagctcacatagtagattatcaaaactaaacaaaataatttgcttctgtatgtctctcaaaaataggttggatttcaatgtagtacttctcaaactattatattttaaggactgacctgatatttgaattttactcatcatttgacttttctagatggaatatgttgagggcaaagaccgtatctcacacatatttatatagtacctggcacataatactgtcaataaatgcttattgaataaaataatgtgagataatcattccttggagaaagtaagttggacttatgtggtggctttgactcactttccctttcagttggctggggtgatttttctaacttagagccctctcacataggtataaggaagtaccaagaactgcaggtgagaaattgatgagaatttccaacttaatagatccctttataaagccagaaataggaggtcagggagaagacatctgaatatatgcctccagcttcttagcccagtggcagtgggcatagggatatccttagacaataatggggaaggtaacttgaatttctcaccattgaaacaacttttaaacccttagcattagggagactctgtccaaagttgaaactggtatcctggtttatacatgctcttgatttaaagaacagggaggctttcacatagggtatttgaggtttggggattagcgatgagttgaatagtttgattttggaaagtac

SEQ ID NO: 55426 - DNA, 1941 bp, Homo sapiens
cccaagtagctgggattacaggcatgtgccaccacacctggctaaattttttttggtgttttttttgtttttgtttttgtttttagtagagatgggatttcatcatgttggttagggtggtctcgaactcctgacctcaggtgatccacccgccatggcctcccaaagtgttgggattacaggcatgagccactgcacccggcaaattttgctattttggaagttgaaataggtgcttcctagagatagcagatgtatccagttgctttggtaactaattcagtttcttatgggtggccaggtggtatcccacttattattcaatacttgagggttcagtgcccagcttctgagcaccagctttcttagcaagcaagacatgaagattcccagtgttcatttatgagaagtagcccagctggcttgtcatgctggactagatgaattgtgaatgttaattatattgataatacagtggccttggtaacagacttgtagctgctgtagaatctgtttacttcaggtttgtaacagaaaagagaccaagctggttgggaacatggtgttctcagtgtaataagatgtattgtaagtccaaggaaaatgcatcttggtggggctgaccttattgcaccccttccccaagatttcccggagagaaacattattctggggatagtttctgttcttgtttgccaatcaataatgaattgaggttggcaaaggctgggtttttagtggaagtggggtaaagcatgtttacaaatcataaagtttagaaggagaacacctgtgttaagcaccttatttctctacctagtttataattaggaggggatggttgatgagattagtttcggcccttgcattcaggaggtggagcccctcctatttggggagcagggggttcataattctgtacattcttttcttactccgcagcgaggggattagctgagcactgggcatgtctggaatgagagcactttgccaatttttactgaatttggaccaaactaataaaaatacaatctcggtcttcctcagacagtctctttgtcatgttctcctaacccctaggatccatctgatggattgtctgttcctaacagatggagttggcattaaaggtagattctctacttcctttgccttattgttttatttctgaacaaggcatatctaatgcatttgttccctgtattggaagttgctttatcaagagcctagtaaactcagtgtacttgtgtttccttttcagatcctgcttagattatttcttagatcagcacttctcattctgtggaaggagaagaaggtatcagtcacatagagggttttttcgcaataactcattacctggctctaaactagagctgtgtaatcagaatgggggaggagctgagagtaagagaacagatggagaatgggttggcattttgaaacagcttcaccagataaacttgaaatctcccagatttagaaccattcttttagattatctagcaagactggccaacattgttcggaaatctaacattgagatggtaatggcccaggcacggtggctcacgcctgtaatcccaacactttgggaggccaaggcaggcagatcacctcaggtcaggagttcgagaccagcctggccaacatctctactaaaaatacaaaaattagccgggtgtggtagcaggtgcctgtagtcccagctacacagaaggctgaggcaggaaaatcgcttgaacccatggggcggagcaggttgcagtgagccgagatggcatgactacactccagcctgggcaacagagcaagactatgtctcaaaaaagaaaaaaagatggtaatgcagctaccaactctcctggatgattttgatcacgaggagaaatcttggtcctccctcatgtgaaaggtcctgaaaatagtctaccgttgctc

SEQ ID NO: 55427 - DNA, 1070 bp, Homo sapiens
gagagtacaggtgtttattatactatgcttttgaatttttttatgtgctgaaaatgattataataaagttggaaaagtaaagtacaacaatggtgctagcgagtggggatggagggtagggggtgggagaggagactttaatgttgtcactaaagtagtgggtatgttccaggaaccaggatttcttcagtcacctgtactgatttttttttttaaacctagaattgatgataaatcaatatcgggagaaacagagatgactggcatgtgtttatataatattggtggtgggactgagaaaagaagtatggacaggtcaggcaactaggtaggtagtagatagctaaataggcattgaaacagtctgggtgtgtgttacattctgttgcaaattgtggtgttcaaaagattgggaagcccttttctgtcctacttactgccttttttctaacttcttatgtttacttctagttggcagttgcaggcctcgattactcattgactggagcactttaggagataatagtgaagtgaagtcagtgaagtgtttagtcttacaggaagagaggggagtagctcacaagggtcaaactactctttggcagagtttttcaagctgtgtgttccttaccttttaagtgactcagcagtttggggcctggtattgcctcacctcttctcgccgcgagcattgacagaagatctagttgagtcctactttgaaaggagtattgcttctgactgtggaattggattctagctgtgtgtgtgttatatcctgttactgttgagacacagaggcgggagtcggcgggggaagatatgtgctgagattagtcagcctgccctccctctcccccaagaaactcaggccccatctggggagagtgagaacttaagaaacttgagacagggaaggagagccgggagcagccaaaacctgctaagtctcagaagactggtttctgcacaagggaatggaagaagtgactggaggtggctgtggattcaactctggcctgagattgattcccttgagataagttgttttctggtgggtgtgtctggga

SEQ ID NO: 55428 - DNA, 1036 bp, Homo sapiens
tcttaatgatttgttttcctagtaattgttgtttatctttgaatctagttcttgacacttaggaagaaacctttttgaggaaattaaaagctgttagattggtatttgaaataacgaatttgacaagatgtctaagttaaacctaagttaaacaatatccagataaggctgtgaagactataatatctggcatgttcctcatggagcagtgaaattccatgccaaagccacttacattactatactgtgggtcaaaacatgtctacagattttaagggaccgtgtttccttgcatagaactttcctggagtagcactggatacttagttggtgcctagcaaatgtgatgactaaagaatataatgcatcacagatattatcctgatcaccatttcttggctaaaatgttgtagtggaattctggtggctgttaattctttctcattcaggagatagcaggcaaaattgggtgggccctgggaaggagtgtagctgggctatttaacatctgagaatataggatgtgtgtttatgaaagtaaactcagcttctaatggtaaaaaaaaaaaaaatcaattaggatcaactaaaggaatagcatacaatttttcttctcttgaggtatgtaacttttttggattgtctctgatccccttctcttggtaaggtctgcacaattctttcagctcactttgtcagcagacttcccactaggtagtgcatataccccaaattattcgtttggtagagcttttctttaccattctcagtatcacatggaagaaagtcaaccattgtacctgctaagctatttgaagaggtgctttaaatagcatgttaaactggcctgatatttaattgggtttttaagacacagcaagtagacttctgtatttgggtgtgctatttgaagaatgggtcaatctgaccttctagcctttcataaatatgctcttagtgtaagaatggaacactggtatgcttgttcagttgtgggtaaggctgtttatggggtggtgagttactcaagcataac

SEQ ID NO: 55429 - DNA, 2069 bp, Homo sapiens
agagcatgtattagaaaattagcatggaaaagaatatagaatcttggcagatgaatacaggagaaaacattagggacatctaatggggcatccaatacaaccttgtcattgtttaactgaagactcattgttaaaagattaagaggttacagattgctattaatgtcagcagagatatttgtaccaaaagccattcattgtcctttgccagaataccttttgcattgtattatcaacattaaggattaacataaatgaaaagctgttatatatgatcctggagtgacagataaaaagtggtgtgtgacaagcaggctaactgtagccaagaaagaagaaaaattaattgtgaaaaattgagttatgagaggaagaacgataaaacgactgaagaaggcttttaaaaagtcttcaaagatcttgacggccatgttacagaaatgtattagagccttttaaaaagcttagtgatatggttaaaatgtcatagtggggaagataatctttagtagtatttgtgttagctggacaggaggaggacctgtacatagaagtcagtcagtgagagagtccaggtatactagcagaaaccgtgatgaggaaagtactcaattcagagaggaaagaagtgatttgagaggtaaggaatgattgttgtatatcctcttgcatatctgtcagataagtggtatttttagcttttatgtgaaaccactttttaaagttgatcattttgacagactttcccagggctatcagtagaaccagagctgtttgccttttgtgccatttctttctttctctattccttgagcacaacttagtgtaaaatcccttgtaagactatcttatcacttttgtctatatccatggttctcaaagtgtgatcctctgactagcagcatcagcaacacctggtaacttgttggaactactaatgcttaggtgccactccatacctgccagatgggaaactggccacagggtctagcaatatatgttttaacaaaccttccatgtgatcctgatagatgcttgaatttgagaaccagtgatctatagaaatagcattccttatctgccctaaattattcttctgtttttgccaggtctggttccaatccagatgggaccaagtacctctattatctgggattactatagctgcaggtttataatcagtggtcccttgtcataggcactaatagcacagtattgttagggtgggtgaaagagctgcaacatggaagtacccacaacagtttcattcataccacctattagaacctagaggagcagaactgagagcgttgtaaaaggtagctccaattaagggtgttcccttaacttaaatgaaagtcccttggggactgcactctgtagagttggggaccactgaggtttttctatccttgtttttttctttcctggctctagctgcatcctacacagatagctctgatgatgaggtttctccccgagagaagcagcaaaccaactccaagggcagcagcaatttctgtgtgaagaacatcaagcaggcagaatttggacgccgggagattgagattgcagagcaaggtaaagaaagggagtgggttaggggaccagaaacaaccctcttgttggccatcagaatccacaaacaacttaagacttgaaagctgacttgaaagtgtactgggaagaaagacagtattatggactttcggataaacacttctctctctatggaacttaagtcttgggattttgttctctcttccttctgttctcagcatgtggtgattacacacagagtagtttctgttttcctccttgccccaccccaccactgtattcaaagatctacatggcagaattgacaagtcctagatcactacgtggtagttggttatatgggatcttactatagctgccaatggcagagacccagattgcccagaagcagctgatgaggaagggttttaaggtaaggatgtggtgacctagagtcttgtttggtcctgagcaccctctgctggagcagagtaaaagtgactgacagttaaatcttggtttctctaccc

SEQ ID NO: 55430 - DNA, 1524 bp, Homo sapiens
ttatgttgtgccagctaacttggtttttgtttgtttttgtgacctcttctctctttaggctgtatcagctctccaaagctgggaagctctgtgttccggccatgaacgtcaatgattctgttaccaaacagaagtttgataacttgtactgctgccgagaatccattttggatgggtaggttgaatgtatatatattcaaacttctaggggctctggtcttcctttggctttaaaagtttattagagggaccatttcatactgagctcaaccagcttccaattgatattctcatgggcattggcccacacttttaactttgtgaagagggactgagtttgagctattaacgtttgagttgagcccttgtctgtttccacagcctgaagaggaccacagatgtgatgtttggtgggaaacaagtggtggtgtgtggctatggtgaggtaaatagctgggtctcagtgtctctttctttttgtgtacttattagaaatattgggtaaaggaggcttgtgctgtcaatctagagtcactgatacaaggtttaaatttttttagataatgtatctcaaacaatagcaaaagccttttattcagatttatgaatagaaacatacaaaatgaattgagttttcagattttaccattttgccttgtggaatagatactagtatcatcttccccaattataacaataacctttaatgagacttaattcaagtgaatatatagcattttagccccacaagtgacttgcagtagaattaagggtggaatctgaaatggcatatagttgaatatctccaaactggaataggtcacatattttgttgtcttcagcaatgacccaaagaagttcctgagctacgagggtatccttgagtagattcttctcaagtaagagaataggaaattagaggttgcttagagtaagttgcttttgcttagtcttgtttccctgatgaaaactgctatgcaaagccccagtccttcctatgacatgtctgctaaattacctctctaactgaggttcacaacgtaatctgggtctgtttctgttctgcttgggattggagcgtctgtgcagctgctcaccagatgacaggctatttcatgaaggttaattcctgtctcacaaataacctacctaccctaaatatccatgacttaatgaacctaacgacttgacctttcttttgttctgcaggtaggcaagggctgctgtgctgctctcaaagctcttggagcaattgtctacattaccgaaatcgaccccatctgtgctctgcaggcctggtaagaacagagtgataatactattagattcactctaggtgctttatgttattgagagttcataattgagtatattaatcatttttgcagaaatcacctaggggaagagaaggctaggactgctctgttcttctcactctaaccctagggctctctgagagcctcttggcatttttccttcctagagggagtcttggggactctgaagaggccagtgtatatagtt

SEQ ID NO: 55431 - DNA, 1255 bp, Homo sapiens
tcttgtctcatttcatgaccatcttccctcccactgccttcttgctttactcatagtgttcctttcttttcttccagcatggatgggttcagggtggtaaagctaaatgaagtcatccggcaagtcgatgtcgtaataacttgcacaggtaaataacttgcatagagaagtgtttattcagaggctaaatcttgaaagtagtctgagtgactttcatacaaaggaggtgagacctctgttcagtataaaggtctcagaactagaataagctatcagaaccttaacatgttttccagagtaaaaaacttttttccctggtgactttttatactgcttgatctgaagaccagatagcctaaggagcggttatgcatgtcttctctcagaatgtctacatgttctttaatgccagcaagcctctggtctcctatgttctacctgaaagccagccagtacctttgttgcccggcatctctttccttaaccacccatcttttcttttaggaaataagaatgtagtgacacgggagcacttggatcgcatgaaaaacagttgtatcgtatgcaatatgggccactccaacacagaaatcgatgtggtaaggcttctctcatttgttgctaggcatttctctactacctttcattaataaccatagtcaactgtgctttcttcctttcagaccagcctccgcactccggagctgacgtgggagcgagtacgttctcaggtggaccatgtcatctggccagatggcaaacgagttgtcctcctggcagaggtacacacagagaaggaccctggcagagcagcacaagcagagtagttagatctatgaggggggaggggagggaaacaaatattaggcctatgtttccctgaattttatctttggagagagagatatttcacaaattggtccccaaaataaaaccactttaaaaaaatctactttttactaagtaacactatttcctaaccacagctgattctttaacctttcagactcagatggatttgcagaaaataggaaaaagcctagagtcctgatctggaactgtaattcttcctcttccaactgagtctagaggggtgtaaagtcctctcccgctttggcttgacttgtatgccattggaatctgagacagagctcatcccagggctctctcttacctttccagggtcgtctactcaatttgagctgctccacagttcccacctttgttctgtccatcacagccacaacacaggtat

SEQ ID NO: 55432 - DNA, 1937 bp, Homo sapiens
ttagaaattcatgatcctaagatccatggatcttatcctaaatgagtgttattgacacagggtctttctagcttactggtgtccactttgattgctaatttgactataatctagttaaggaggttgctgcaggaaggtaggagtagcatgtgacatgtgggccactgcagggaagccccctgctttgccagagaaggatagagaggtaaaagcccactcccttttgttaccctggtaagtggcttttctgaacgcactgtacatgtgctgagagaagcatcctgcccagaaaggcagctttgaggttttttttttaattaagcaaatatttcaagttgtggattctttcagagttattccatcccttgtctgctttcttaaaaaagcttcaaatgaaaatgggaagttataacttgagagacattttgaaaaggagtctgctctcctgccactttgctcttcctagatgaatacgttgccagcttgcatctgccatcatttgatgcccaccttacagagctgacagatgaccaagcaaaatatctgggactcaacaaaaatgggccattcaaacctaattattacaggtaacctggggagaagcaagtgaaaagctctttttcccagtattaaaccaagcaggctagcctgcttctgacataaagatcaaatgttgtacctgattttgaagaatacaagaaatctgttccaggccaggcacggtggctcacgcctgtaatcccagcactttgagaggcctaggcggatggatcacttgaggtcaggagttcaagaccagcctggccaacatggcgaaaccctatctcttagccgggtgtggtggcgggcacctgtcatcccagttactcaggtggctgaggcacgagaatcacttgaacctgggaggcggaggttgcagtgagctgggatcatgccactgcactccagcctgggtgatggagtgagactctgtcttaaaaacaaacaaacaaacaaaaaaactgttccagttaacaaggtagatagagaaattgtgggagatatcagggagttagggtttttttgaaattttggagcctgggcctcaccctaagagattctgatatatttggtctgcgatgggaccaaatttacaaaacattattttgtaaaacctccccagattattgtaatgtttagtcagggttgaaaaaacactgactcattcctgggaacaggcggtaacaccagaaatggcattgtcagagaccctgtggaagaataagggagactggtgccctggggaatgactgcagggatcccacccaggctggggaggggccctggagaaggtgctctgtttccgattgttttttggaattctcatatggaagacataagtgttaaccaatcactctctctctttacagatactaatggaccatactaccaaggaccagtccacctgaaccacacactctaaagaaatattttttaagataacttttattttcttcttactcctttcctcttgatttttttcctataatttcattcttgttttttcatctcattatccaagttctgcagaccacacaggaacttgcttcatggctctttagatgaaatagaagttcagggttcctcactctagtcactaaagaaggattttactctcccagcccagaaaggtgattctttctttaccatttctggggactttagtcttaattaggtaccttattaacaggaaatgctaaggtaccttctctgtggaacaatctgcaatgtctaaatcgccttaaaagagcccatttcttagctgctgaaatcagtgctctttcacttcttcagagaagcagggatggtacctacccggcaggtaggttagatgtgggtggtgcatgttaatttcccttagaagttccaagccctgtttcctgcgtaaaggtggtatg

SEQ ID NO: 55433 - DNA, 1098 bp, Homo sapiens
agtatagcccttcctccactcccaccagacttgctcatttttcgagtttttaactagactacactctattgagtttaattttgtcctctaggatttatttctgttgtccaaaaaaaaaaaaaaagaaaagaaaaattaaggagaatttttggtgttaatgctgaggaattgcttgagtggttagttgttaccaatttctcttttgaacctttggagctaaggatgctgagtctagagaaatgctagtctcaagccctgttaagtccctctgtttctagcccgtagttcatagcatcagtgaactggagccacaacagcaaattctatcagctgtgtaccatacagcttgtgctgaaggcgaatttcttgagccattactcagtataaagcactgagttctatctttaggatttatctttaagagcaaatttctggtcagctgtgcttctgcaacctaaaatatttaaagggaggtaggtgtgggcaggaggaggaatgataaattgggccagggcaagaaaaatctagcttcatataatttgtctgggactatacaccctatataatgttagttttacagaagtaatatgacttttgattgctacataccacaaagagtttatgaactgagatcataaagggcaactgatgtgtgaagaaagtagtcagtacatcctggctcatgctctgaaagaatatccagagaggctctctcaaagatcagggagatgtattcccatgccatgcaccctgcttcccagcatttctgcatggtcaagtgagctttatgctcatgagctttaagtatataattatccaggattttaaatcctcaacttgttctagcttgtgatccctcaaagttgggtcatacgttagtgctagatactagaaattttcacttttccactgatcagagagacagacattaaaaacaaaaatagaagaaaggaaagctttcaccctgcagcttcttagcagggaacaattgtcttgccaaaacttttttcccttttctctcccattttcttttacccaatcccttcttactccttgccagtgtgaccatgctttcttctctgtagatgttaacagtta

SEQ ID NO: 55434 - DNA, 1101 bp, Homo sapiens
cctccaggctccccgctgtacaacaatgagccatttgccatcatgctgtttgggatggtgaccaaattttgcagtggtcacgcccctcactttcccatgaagaaagttctcttgctgctctggaagacagtattggtgagcacctccttggaggaggagaacggtgctatgggatgggcagtagggagactgttccttgaatatccttttgaatattgaattatgtgactgtaaaactgctttggtaaaaaaaattatttaaaaagctgctaaaaggagatgacaaaagaagggccactattgtcccattgcagccaacgaggacataggccttgagtcagagtaggctgttggctctctgaccccggaagctgttttctgtcatagaacagctctcccccagacaagttgcctctcagcaagcagctctggacctggagtttgtaaagggatttgaggcaaagttacagctgatgtaattggggccctggttggatatcacttaaaggggcaagagtgagccctgagccagcctccattttcttcagggtatggtgtcagcccgactctgtgtctaggtagggagggactgggtgccagagtgggccgtccagcacactgggcttggagcgttgttagcagccaggccatgccaggaggccttcccaggaggagtgacatggggaggcggtggaggtgagttgggcctctgctacactggggctcatccttcctttcagaatgggtcaactctggagccagggctcagtaagtataggatttcttaaaagtcattgacacattttatcttggccacacattctgttcttcataaagccttgctaaggctagagaggaaagctgaattgctcagaaacagtaaaactaagcagtctaaagctggatgttgctggcgtttctgcttcttgggagatgtttagatgaagctttttttcttcttctaaagttgagcaaccaacagtatttctaatttgactttgaaagacttgcatgtacaacttgtgaaacatgagtctcaccaacttttctaggaacttgcagggttaggctctttgcttctttttaaattgaagagtatgt

SEQ ID NO: 55435 - DNA, 1053 bp, Homo sapiens
tctttcatgtgagagtccagattgagatcatgttctactttgagaaggacctggaccttgacctgatcttctgcctgcctgggccaccagccctgagcccagctcctgggtggctgtggccccggagtatggcagtgatggccggctgagggaggaggcaggggttggctaacaccagagggaggatcacagaacactaggccatcatgtgatggtccttggaaaaaaggttctagagtcaaatactgtatatttgattcatggatttctcttataaggaggaattcctcttacaaagatgtacaatgagaagtcctgaattaagaaaccaatgtaactcagtgcttcctaaatttatcttactccaaaaccctttttttccatgacatgaaacttgccaatatcctggtattccacagaacacatttggagaactcaggttaatatggcagcagaagcttaggggagatcttggaaaggagaagaagttcatttttggaggaaaggcagagaaacagactgagaatgtatttgagggcatcatggggaagaaataaattgtgcgaggctacattgcttgggaggtggatgggggagccctcggctgacttctgagatgtccttggggtgagtggggaggtaggagtctttgcccagggaggctccggagtccatcttttctgtgggcacctagaaatgaggtactgcgcatgctggtggcttacccaggcaattatgtttccagcaccacagtgttgcagagcatgaagctgggggtggatgtaaaccgccacaaagaggtcattgttaaggccatttctgctgtcctgctgctgctgctcaagcactttaagttgaaccatgtctaccaggtacccacagggctttccctcctgtcctgtgggctggggcctcgggcactgctgctcctccagcccacaagaacgggggccttggcctttgacccacttgaactctgcatgaatgttctaagacatggcccttcagccaaggcctttcatccctggaggaaagagggcaaggtcccaaggg

SEQ ID NO: 55436 - DNA, 1069 bp, Homo sapiens
aatcagggttctgagaatcttccttaactctgggtctgtggatgcctttggggtggggaggtccttgaatcctctgataactgtgtgtacatgtacaccggaatgtttctggaaggaatccatagctttcttcagattccaaagtgacacatagttagggtgaccaaccatcctggtttgtctggaactctactggttttagcatttaaagtcctatgtatcaggaaactcttcagtccaagggaaactgggatggtttgtcaccctgacagtaacttccaaagggttaagcagcagtgtgacctgggatgtatgcatttatttttgtcttcaacttgggctgcttgcttgtttcccttcccagatgctggtggtgttcaagtcagcccccatcttgaagcgggccctaaaggtgaaacaagccatgatgcagctctatgtgctgaagctgctcaaggtacagaccaaatacttggggcggcagtggcgaaagagcaacatgaagaccatgtctgccatctaccagaaggtgcggcatcggctgaacgacgactgggcatacggcaatggtgagactctgcactcagccagatttgggtgggagtgtgtcgggaaaagtgacatctttcactccctgcccgtggtactcaggtacttctctgccctgagcttccccccaaggaacaggaaggagcccagctcctgcttttgtagcatcaggatgggcactctaggaaggactttgagaagctacccagccttggcatctgcgatcatccccatctctccttgtacctccaagtcattccttttctagaaattgtcataagactgtgtcccctcttttcatccccattttggccacctaaactcttacagctcttgactgacttccctgcctctaatttcttcccctccatcagtgtctcagatttccctagtgatccttttttactttgatgttttttaaagatagggtctcgctctgttgcccaggctagagtgcgatcctggctcaccacaacatctgcctcctgggctcaaactatcctcctgccttagcctcctg

SEQ ID NO: 55437 - DNA, 1069 bp, Homo sapiens
acagccccactgtgtcttccgcagtctgtcctgggcttgggtgagcccagcttgacctccccttggttcccagggtcctgctccgaagcagtcatctctgcctgagatccattcttcctttacttcccccaccctcctctcttggatatggttggttttggctcatttcacaatcagcccaaggctgggaaagctggaatgggatgggaacccctccgccgtgcatctgaatttcaggggtcatgctgatgcctctcgagacatacaaatccttgctttgtcagcttgcaaaggaggagagtttaggattagggccagggccagaaagtcggtatcttggttgtgctctggggtgggggtggggtgtttctgatgttattccagcctcctgctacattatatccagaagtaattgcggaggctccttcagctgcctcagcactttgattttggacagggacaaggtaggaagagaagcttcccttaaccagaggggccatttttccttttggctttcgagggcctgtaaatatctatatataattctgtgtgtattctgtgtcatgttggggtttttaatgtgattgtgtattctgtttacattaaaaagaagcaaaaataattcccgttggcttgtctacaggaaatatggcctctacgtatctcctccaggtctagaaagtggttttttctgctagcattgctggtcaacgcttgtccttgtcaagctgcctgcctttcccatcctgggggaagaggagagagagttggcatttatccagtgtaagttaaccccacagtaatctgggattgctctagcccaactccagggcactaggttactttactgacacattgtcctgcacccctgggtttgctgtaatttcagtaggagccccaggtttctctggatcacatcactgagctggcctcagccaaaccagtgtcagtgctatggagggaggggctaggtcaaagcaagggggtctgctgctctaggtcctccctggggcaggtggttgggactgaggggaaacttcagtactcagagcctaggaagcagaccatc

SEQ ID NO: 55438 - DNA, 1086 bp, Homo sapiens
aaagtgcagagctgcgcagctcgagggggcagggaggactgccactgcccccaccccatgaacccctgccccttccacgcttagtggagaccactgtgcccactcctcttgcacccaaggaccctggcagagacacctctttcctgcctcataactggaccaaggctggaaagaaacactcacatctgggagacagtgcctgggtgggcagtgtcctgctctgggcaagttcatccttccctccccatactgatgtaaggatgctgctttggggtggagtcagaagggcctcaccccttcccctcccctcccctccccattctaatctagcaccagcattcggggaagtgtcttcatctcaggctccgttgatgaccagcagttcacatcttctgcctttggttttgcatagttgctagatctgtgcagggcacccaccttctcccggggagggcctgggtctcctctctcctctctatcccccttaaggtcagcagggctactttctaagaactggtccttgagcatagaggctggtcacactcgtgtgtgatctctaccttgcttcctttccctttgcatctgtgtgctctctgtacccggagctgtgctatataccagacagaatctctgttcttggaggacccataatgtagcgggggaagcagactggaaaacttatataatagaggagagagaggctgtaatgaagaaaatgctggctttagggccaaacattcaccctataataatgtgagcttgggagatttgtcaatgtacacataacagcataccccaaatgagatattttatttagtctaattgcctcttaacaggtttggatgcagtagatacactgaatacatagattcaaaatgtaaattttgtatccctaatatattcagtcttttcctagatattgcatgtgtcccccacccttggcacagagcaggggctaagtcaaggtttgctacattggattggattgacttacctacggtggaggtgggaaggggagatgactcacagttgtaggagacactctgagaaatgagactggtctcggccaggagggactgggagatg

SEQ ID NO: 55439 - DNA, 1045 bp, Homo sapiens
caacagcctgatccatatcaccatcatcgcttacctaccctccctgtttcttcacttgtcctaccagcagccattgatccctataaaaacagtcaggtcaggccaggtgtggtggctgacacctgtaatcccagcattttgggaggccgagggaggtaaatcacgaggtcaggagatccagaccatccttgccaacatggtgaaaccctgtctctactaaaaatacaaaaattagccgggtgtgctggcatgcgcctgtaatcccagctactcaggaggctgaggcaggagaatctcttgaacccgggaggtggaggttgcagtgagccgagattgcgccactgcactccagcctgggcgacaaagcaagactccatctcaaaaaaataaataaataaaaataaaataaaataaaaataaaaatagtcaggtcacattactcctctgcttgaaaacctccaacagcttcccattagccttgaaagaaaaccccaactcctttccatgctccttgagtcctgcctgttctggacactcactgtcttcctagcccagcacctcccactcttccattgttcagggtgctctaggcacatggccgtctgtctgttccttgtactcaccaggcatgcaggtcctgcctcaggacatttgcactttctgttccctctgctctgaatgctttcccaggacatccacatggcccactctctcactccgttgaagtctttatgtcaccttatcggagcatacgtccttacccccatctctgttgtagcatccctgctgtgctccatcccctcatactctatattgtatgtgtttatttgatatatatactatcagatatagtgtatgtttatatgtacactataaattatatatttgtctgatttctatttgtccctctgcactagaaataaatccaatggagcagggacattatttgctctgttctctgttgtactagaacagggcctagaacataatgttcagcaaatatttgttgaaagaagtaaaggaaaagaaggagggaaagagattt

SEQ ID NO: 55440 - DNA, 1136 bp, Homo sapiens
aaagagtcacattataaatacatacataaataaataaaatttccatgtgggtagagctaaaccatatgcagcgttagggaaagggggaattttctggtcaggtgaccagctcaagcagagcttggacagtgtggggcctgggtgggcaataaccaggaattccatttgactgaatagcgggttcttggatagtgatccgggctagactgaattccttctggggtagggactcatccgttctgggcaacccagaggccctgagaggccccaagtgctggctcgtcggagggtgagcataggtagaggtgggttctggacactgggaccagaaggtcctggctcagcatggggtgggggcagggccaggtcctgttcctaggggcacccatggaggggagaggaggggatgtttctctgctgggacctaggccttagtgcgggccctcaaccaggagccagggatagctcagagatgctttgtttggcagaccttctcatttcctgcctcttacccccgggactgccccactgtcttccagcactgcctgggcacaaggatcttgcttccctggaaggctcagtccctcagtccctcaccccatccccacagatcttactctgccagtgtctttggctgtgttctcaattttcccttctcctacacttcatccttaatataggtttttgggcctgagtctccttatgtttatctgtccatctgtctccctggcccttcttcctgggctctcctcccctgcccccgctgattgtatgcagttcccaatgattggtgtctgtcacctctcccctcgacccagcctgtgccagattcctggaatgctctaggctttgtgctgagttttacaagtatcatttctttgcatcctcaaaacaactgtaccaggtagatactaccctcatcccctcaaacatagcaagcagattgtagcctcaggacctttgcactactcatcccttctgcctcgaactctccggttcttcgtatgactcactccttcactcttcagggctgttcaggtgtcaccttgtcattaaggccttacctgacctctctattggaaacaactcccctatcctcccacccgttatctcctttttctctttattttttttca

SEQ ID NO: 55441 - DNA, 1393 bp, Homo sapiens
tagtggtttaaaggacgggtttataagccaatgaaagggataaggaggtgggttgctgctgtcactgagcaagaagtaccgttacagggcagactttttgtccaatcaacacctcaacactttgggtcacgtgaccgcagagtgcgaggggcggagctacagtctggcgcgaggaaccgttaagatagacaacaaatgtaaccaatgaggtactccgactagggggttgggaacccaataacagtggttgggcgggcgccttcctggagcgcggggagatgtaaagatagacaaataattttcccaatgagactgtagaagagagagcaattggccaatgaggactgcggggcgggaccctgtgccgcggcggagtccaagatggcggcgtgcggttccgctgtgtgaaacgagcgcggggcggcgggttactcagctccgcggagacgacctccgacgacccgcaacaatgaagggaaaagagcgctcgccagtgaaggccaaacgctcccgtggtggtgaggactcgacttcccgcggtgagcggagcaagaagttagggggctctggtggcagcaatgggagcagcagcggaaagaccgatagcggcggtgggtcgcggcggagtctccacctggacaagtccagcagtcgaggtggcagccgcgagtatgataccggtgggggcagctccagtagccgcttgcatagttatagctccccgagcaccaaaaattcttcgggcgggggcgaatcgcgcagcagctcccggggtggaggcggggagtcacgttcctctggggccgcctcctcagctcccggcggcggggacggcgcggaatacaagactctgaagataagcgagttggggtcccagcttagtgacgaagcggtggaggacggcctgtttcatgagttcaaacgcttcggtgatgtaagtgtgaaaatcagtcatctgtcgggttctggcagcggggatgagcgggtagcctttgtgaacttccggcggccagaggacgcgcgggcggccaagcatgccagaggccgcctggtgctctatgaccggcctctgaagatagaagctgtgtatgtgagccggcgccgcagccgctcccctttagacaaagatacttatcctccatcagccagtgtggtcggggcctctgtaggtggtcaccggcacccccctggaggtggtggaggccagagatcactttcccctggtggcgctgctttgggatacagagactaccggctgcagcagttggctcttggccgcctgccccctccacctccgccaccattgcctcgagacctggagagagaaagagactacccgttctatgagagagtgcgccctgcatacagtcttgagccaagggtgggagctgga

SEQ ID NO: 55442 - DNA, 7357 bp, Homo sapiens
cctagacatcactgtaacggagagtgatttaagaagggcgtttgatcgctttggagtcatcacagaagtagatatcaagaggccttctcgcggccagactagtacttacggctttctcaaatttgagaacttagatatgtctcaccgggccaaattagcaatgtctggcaaaattataattcggaatcctatcaaaattggttatggtaaagctacacccaccacccgcctctgggtgggaggcctgggaccttgggttcctcttgctgccctggcacgagaatttgatcgatttggcaccatacgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctcccactgagggaaaaagccctctgaaaaaagaagaccgctctgatgggagtgcacctagcaccagcactgcttcctccaagctgaagtccccgtcccagaaacaggatggggggacagcccctgtggcatcagcctctcccaaactctgtttggcctggcagggcatgcttctactgaagaacagcaactttccttccaacatgcatctgttgcagggtgacctccaagtggctagtagtcttcttgtggagggttcaactggaggcaaagtggcccagctcaagatcactcagcgtctccgtttggaccagcccaagttggatgaagtaactcgacgcatcaaagtagcagggcccaatggttatgccattcttttggctgtgcctggaagttctgacagccggtcctcctcttcctcagctgcatcagacactgccacttctactcagaggccacttaggaaccttgtgtcctatttaaagcaaaagcaggcagccggggtgatcagcctccctgtggggggcaacaaagacaaggaaaacaccggggtccttcatgccttcccaccttgtgagttctcccagcagttcctggattcccctgccaaggcactggccaaatctgaagaagattacctggtcatgatcattgtccgtggtgcgtcctaaagtccatgtgtaacttgtatttactactttgacatggttcctgttttgtgatgtgtaatgggatacagcatcagatgcaattttctttttagttgttagttgtagcattttcttttttatatttttataaacgtctttaaaatagaaatcaggacagtttagctatttttttgtttgtttagctattattttaagtgaaagggatgccctaaaggtagcaggcaggcagacagatttgctttaattaggagttcccacccttatgagtaattttttttctctattcagttgttttttttttaatcttgagcttaaaaaatcctcagagttacaaaaccaaaattttgaaaagtcagaatttggagaaaggagtccactgaccatataaagagagtaatagccacctaaaaatgactcgattggtgtgtaggtaaataattcttttaccagaaatgtgtgtgactgaaatttgatcagggatctcaaagatatgctggtaaattgtatagcaatgtaattattttaatcaggtatttgagtatttcttaagatacagtttattcccagagagtttgctttaacatgcattttttaaatcatttgttctagagttctgtatcccatatatgcacttttggtttgtagcagtaactgttcagtaaaaattaaggactatgttacaaaccatatatgtcttatgcttacactagtatgcaagaagtgagtaggtgcttttaaaatcagaattctttggtcagttattggtgtgtggtggtgtttttactgactttttcagagaggtgtagcaggtacagttctaatcgtgcatatttcgaaactaagtgttcttcatcaaagatgagtttttgtttttgtatcaattcaaatttctggtttcaataatagaaagaagagttgtctgcaggctcatagtcatcttttatttcagtgggcatttaaatcagccatatttggattgcagaatttcttaaaaagtcatcataaaatgcctttgacatgctcttttaaaattttgcttgtctttttattttcatatttaaacagtagtgacattacattattgaaaatgttttgaacatcttggaaattttatgttcaatattctcactgctgtccagctacggaattgaaatgtcagtgtaggaaaaccttttttaattgttttattttcccagacacccggaattaatacaggatcatttaacttagcctcacagttttttttttttcaaaggtgagatgatatcaacctctggttctcaacaaggacttttgctgcttaacagtaatggattttttttttttaatctatcccctctgtcccacccctaatttgtcaggtcattagtaagtatatttttctcccttgatttaagtgctgaagacttcagctaaggcccttgatatttaattatgattagagacttttggaccttctggatcatggtcatgtttctgttctatgaaagtgacttaacttgaagcctggcagaacccaactgttttctttctgttatcaaagctggtagttttgaaatagcaccaataataacccagggaaatgtcatgtaatttttattttccattatgacaggtgtctaatgcatgtcagcacaaaagtgtcatcactgctgtgtcatccctcttggttttcactatgcatctataattttttaagtttgcaggttttgtgggggtttttgtttgtttgtttttaaactggaaaaactagccattttgagagaaggaaggttctaggctatgagcatgaaggtccttgtgcctcttgggaaaatacctgaaatcctataatgaagacttttgatgcttcttgctttcaaaaagctgtggttggtttggagtagacacctgttcagaaactaatgcaagtgtggagtctacatacgtgggctcatagtataatttgtggccagctacatttttccagtttaaataaactcactaaccattaatttttgaatatcttttgttgagatagttggacaaatgattttgctcttttggagagtgaagtccatgacatctaattttactgtcatccaaaatgtgtgttttatttcttttcttttactttctttttttttgtttgttttttgttttttgttagtgtgacagcgtacagaagagtactgtgtttttgctccatgtttgtttgaatctttacctgacattgccgcttttgttaggtctgggcaatttgtgcttcagtgtttttgaaacaatggcttgataccatttctaaatgtatgtattataaaaaactaattatgtttagttggtcattacctacagagtgccatagtccacatgaacctcatatttgtactgcccattcttttgtgcaggttcataatatccataaagtatctagttaaaccttaagaattcaaatgaaagcaaaagtctaaaaccggttctacttctcattagccaggatttaataatcccaacgttgaatgttctttgtaacaaccaatttttttctatctttcttctttaattattttaatgtagttgatttttctggaactcagttaaaatgaatggaaagaaaacttcaggatatcatttaatgactattaagtattattggtaaaaacgtgaagataagacttttagatcacagcttcaaattttatggaaaattaagcaagcaatacctagccaatagttctgcttaactttttggttaagtattttgttgggattcctataaataatttttcacacaaagttttaaatttctggtgtactttgactctcaactgagagtggatagagtttttcttttgaggattacatcttaaaatgtccatcgcctggctggttataagcatttgtcaccttttgaaggtaaaatatactctggcccttcttgactcagttacaggtcattttaggtccagtaataagagtcaggtgtttggttattgctttcagagtcagacattgtttaggtttatttaaaaactattagcaggttttcactgacaatgcttttttaaaaataaaaaatgtaaatccacttttttaaggcagattgttcattatgcatatacagcttgaactatagtttgggtccatataggaaccaatcaccaaaaactctggtaacagaattaggaaatcctcttgagaagagggccttaatgaccttttatgtgaaaaaaattttggagagaatttctggacatttttttttctgtctctctcacagggtttggttttcagataggagttaggtatgagaacaagaagagagaaaacttggcgctgaccctgttatagtggttatagtggtgtccctaaagggaggaaatgatttcaggtaaccacagtgaaatgttaagctgaatgaagagttttatatgtatggtttaaacagagttgaaaagtgagattcctgaagtgttctttggctgtttaacaattatttgtatgagtgttttattaaaataacggctgctgtctttggtaacatagatgagggtggatttttaaatggctttgtatcgacccctttctacaataatggagtagtctatgttgctccatataaattacagaatgaaaatagatggggcaaaagtttgactaaactttacctttttatagtttcactttttaagttatatttagaatatattgatagattataaattgattgtgaaacttttttctgaattttttcaacatgttttactcagttacatgagttaaaggatattttcagtcctgttatcttcaattgcagtctttaaaaaaacccaccctattgttctacttgttatatgtctattcatacagtaaattcatttcaaggtttatgccagtgggtattattggtgctttttgaagttgaggtgaaccatccaggaaggtcttgttaatgttatgttcatctataatggcataggggaaatatatatatttttaatattgtaaacatttgtactgaataacctttttttccccccctccgcaagcaaaactggttgaacagcggatgaagatatggaattcaaagctctaatggacctttttgaagagaagttgtggcttatgtggagtttacatgggcctctgatggaagaaagctaatctgtttagtatttgtgcattttactaaaatggcagcttaaagttgtgtatctgctattgtgatgccaatgccggtgttttaagtggaaaaaaaatgacctctttgatttgtgctgtgtacacaagatttctggaaaagtaaagaaaaaccctttttatggctcacacagcttaagagtagctgtctctcaaacgtgcgctcacagttgagctgcttttgttttattctaaataaattgtttcttttgaggaaaatgtttttctgcctggaagtgaattgacggcaaacctttgacccctttgtttgcagccgagggggtgcttgctgctgctcagatcttgtatgtcttgagcaagaagcagggagaccatcaatttcattttgactatcacggtgtgtcaattctgaaggatcactagtgttactgttgaccccctttgtttgcagtgaaggggatcatttgcttctcggttctcaacgtgatgaggaaatggtgctgtttgctggcacgcaagaagccggggcaggcaccctaagcctcaccacagtgcctgagtcgggggcttttgctggtttgaagagctggagttgctgaaatttaagttttgatttattttgttcacccatcacgtttggccttagtttcatttttaatttgaagaaaagtttgaaattgctttatcttgcacttaacatttgcaccaaattgccaaaagaaggagaaatgctccgtttgctttttaaatgttaatgatgatgttaataaagcctttcctgacacatttgaggagctcctccgtctccaggggcttcttaccagagttatgcagtgatgggtttagttctgaatggatgaagagttcctgagagctagcgtttgtaattagaaccgttacttggtatctgtgccttatttgacctttggttccacatgccttggatgtgcatgcaccgtgacggtttcataggtacgaacgcacactcaggcccagtcacttcggttggtagtacagattgtgaggaaaaagatggaggcatccttaaggaggaaaaatgtttgcctttagttcctgcattatcctgtacagaggggctcctgagttttggaagcctgttcccagtacaggagaacaactcccctgtttgcagcaggagacttcagtgcacggtgacaacgctggagttcaagaggaagccagcaatgctgcaccattggcttcagacaccattgttgttgtttgccagttttaaacttaactagttgcagacgaagaccaccttgaaatgcaggcttgttgggcttgttttgaattttaacctcggatggaagagccctagtgctgtctgtctccatgcgggatgatgattgctaggcaacaggtgattatcaacaaaggatgccacggttatactctgcaaggtggtgttccagtggcaaacagctgtataaactcttgtaaacaggtaagagggttttt

SEQ ID NO: 55443 - DNA, 1099 bp, Homo sapiens
tttggcaacttatcacaagcccagcttttttagtatataatacaacttaggtttccttgctttatttcaaatgggatcaaaatttttgaatagaattgttatttttttcatctcttctggaagacatccagtatctagtaactacaatagctgatctatactagctactttttccacaagatagagctccttggattgttttgctaggcagcttatgtacccatactttgatatagtaaaagggaaaaaatgaagtacagtggaatttttcaggttctcagtgtgtcataagaatttttaaaacagctggttatgagatgatggctgccatctgaggcttttctaaatggtctctcccctgcatttctttaaacattttatacttgttggaaatgtcagttttcagtgtgttttctttttcttgctagttcacaccatgagcctgctgagtggttttttccagttagtaagcaaatattttaaatcactatggagatttagaaagattatgttacactttctacatatttctatatgtctggtatctttttaaagtttcaagcttcatctctctagtaagaacaaggaaaaaaagttgcagacagggcatttgtttatttgtgtataaaaccatgtcatacaaaatgggaaggtacacagcatgacagttttttgaaattactcatgaaatcattttatttattcccagctgcactgtgaaaaaaattaactggactgagtgttagattcagtgttctggttttataaattggaaacttctcttttgaagtatttgtgtggtttcccagtgtccttcatatgatctaaatttagggttctgtaaaggaactacttccaggaacacctccaagttgacttgggctcgatttgaaaagctttgttgttagtactaaaattgaaaatgaggattaccctgatttcagtaaaacaacccaaattttataaattgccacttccatagcttaagttgtataattgtttataagctgtttatctgaggcaatatatttagtgtttacagcttatagagcatctatttttcttctgacaatagtatatctgattatggcttctgacc

SEQ ID NO: 55444 - DNA, 1672 bp, Homo sapiens
taagttattttgatcaatctattctcttcagcaacttgtactcttaattggagaaactattaaacaggtgaatagttaatttctaatgatttttttttcctgtcacccaggctggagtgcagtggcatgattttggctcactgcaacctctgcctccggggttcaagcgattctcctgcctcagcctcctgagtagttgggattataggtgtgtgctgtcacgcctggctgattttttgtaatttagtagagacagggtttcaccacgttggccaggctggtctcgaactcctggcctgaaacaatcctcccacctcagcctcccaaagtgttgggattacaggcacgagccactgcgccctgcctctaatgaatttttatgggtgatataggtgtatgaatgagcatatgaacaagttacttgaaactgggatggtcaagaaaggctttacaaaagaatttgttagagtaggacatggaatggtggagagagattgggatggacgtgtcaggcagacaagcataagtaagaatatagcagcttatggattgatgggaaagataagatgcaaactgaagcctggaatactagtaaaatgattgggtcaacaaaaatagggaatcctgaagggtaggccagtttgaggggtggagagtggaaacagatcatttggggcacattgatagcagtcatttattgactgtctacttcaagccaaggattctgccaagtactgtacacacattgtctcatttaagtctcaccacagaccataatttgacagtttagtgatagagccacagttctaaccaggcctttgtcccagctaaggctctcttggttaccgtactcgtggaggctaggaatgagattaaagctgcaaacctgaaaaaatgggcaatggatttcaaactatagtttatgaacattggcagtacttgggaaatgtacaggcccttggtacctccctagacattctggaatttgttaggaccagcatgacttaggagtctttgttcttttacaaacccctcaggtaattctgatatattctgtggtcagtgggccatgtgttgagcaacactggcccatagagagtagagtactaaggtaaacttaggataatgtcatatttgaggcatgggaagagaagatggtgctggaaaaaagcctagataggaaaaaaagaattgtgttgtctcagaaactgagaggagcttctagaagataactttaaagctgttgcagcaggcaaggagaacaaaactgcaattgccatggaatttattacttaaaattgccacttaagtaacataacagttttctagtcatgtaattatttctccaagaaactcaatctagattactatttaattttgcctcataacagtcctgaagatgggccactgttttgtttatgaaatgctaaagggacaccagaaaagttttgtgactaactgaaggatacacagccaggaactgattgaggtatctttgagttttcagatgtctatctaaaaatactgtgactatagtcttaaaattgaaagtgatgctgggattgagtgtgtacacatgaaacttatttccattaatggaccatcacctatatctactactcctaagttatcaataggattgagacaaaggcattataggtaaagttgagtg

SEQ ID NO: 55445 - DNA, 2951 bp, Homo sapiens
ctgtcagattgtaactatgttcctgttcagagatcagcactgttcttttatttaaatacaataataaagattttatttctttttagggctcatagttgttgaccattctgaactttcaaagcagtctcccttctgaagatgcctcattttctgaatgtgctgcttcatattttctgctttcaataaactgtcatgacagtttccactgtagtcatatatatgactgatataacacactgaccatgctttctatatttcataacttgcagtttttctagtgatatttaaccagactcccttgctaaaaaatagtttagagggtctttttgtgaaatggctgttatcctatgcaaataagatacatgtgtgtatacagtttttaagtgctgaatttatctgacctttctgaggtaaccagcagattcctttttacctaggaaaaggacttaatgaaaaatttttatgcataagcctaagtcattacactagtgtctgcaatataattattacaggtaaaattattaacactttgggatgctgtattcgtatatgttttttattacacagtttaagacctattgggaaaattaatgtttcataaaattgattttcattttagcatatagaaattgactatcagaggccaggcacagtggctcacgcctgtaatcccagcactgtgggaggccaaggtggttggatcatgaggtcaggaatttgagaccagcttggccaacatagtaaaacgtgtctctactaaaaatacaaaaaattagccgggcgtggtggcgcatgcctgtaatcccagctattcgggaggctgaggcaggagaattgcttgaacccgggaggtagaggttgcagtgagccgagatcacaccattgcactccagcccgggtgacagtgcgagactccgtctcaaaaaaaaaaaaaaaattgcctatcaggctgggcgctgagtcttgcacctgtaatcccagcgctttgggaggccgaggtgggaggattgcttgagcccaggagtgcaagacgtatctcttaaaaaaaaaaaaaaaaaaaaaaattgagtatcaatagttttacctagctcccaagataagtatctttctttctttctttttttgtgatggagtcttgcactgtcgccctggctgtagtgcaatggcgtgatcttggctcactgcaacctctgcctcctgggttcaagcgattctcctgcctcagcctccggagtagctgcaattataggtgcctgccaccacacccggctaattttttgtatttttagtagtgttggggtttcactctgttcactaggctggtcttgaactcctgacctcgtgatctgcccaccttggcctcccaaagtgctgggattacaggcatgagccatcgcgcccagcctacgataagtatcttaatatatgccatttgtgtatatttatgtacagaaacacttcagtaaactagaccccttaattgtaatttttctgcattctatggcagaggtctcaactctggctgtacaatggaatcacctgaggaactttaataccaatgactggggcccactctcagagattcatataaattgatgtagattgagtgggtttctgcaaaggcccagttttgttttcattttgttttaagtgctcccaggtgattgtaacgtgcagtcagggttgacaaccactgctctagagacacattttatacctacaaacacacacaatcagccttttaaggattgcttgaaaatcaaaacacaaaactttgagaatgtaatttgggttcagtacagtatgtatattgctcggtcttctagaatctgttattgaagtgtggtcctcagaccaacagcattagtctcagccggaagcttattagaaatgcagaattgcagggccttatcccaaacccactgaatggaacaagatcgtcaggtgatttgtacatatataagtttgagaagcagtactttagatgtagatataaatgttctatgtgataaaaactgataattagaatcttcttccatgtgcataggattctcagatttgtgcattagtcagtgacatttactataaagcatttttaaaaatactttcaacaagaaaagtggaacaaagtagttcttacttagtgagcctcaggtgaccagaaaattaccagaggtctctgtcaccaaggtaggggaaagggttactattttgcctatcctagttggttggttcttgattactttgctctgcttatctcttttcttgccttcccattctatcctcgtcacctgtcttctttatgagatagaaaatgttacttttttacaagtacaggtgcagatattggagacactctgctaataggtgccgcaggatttaggaaatttggtagtggtaggtttagagctttctgtgaggggatagatatgggcaggattgaggaatggttcctaattgcctttgtttcttaagtgtagtatactaacttcataaatcaattttccttacataacaagaatcaaatacctattaaagtacacagtgacaaataatgtattaagattcatatgtattgaatggttcagtatgaatgctcagagacaaataatgtattaagattcatgtattaaagggaatggttcaatatgagtgttcagatagtactctaaattgcagtgtatcaaattaggttcaggaatgacatttttattttattttatttattttttttttttgagacagtgtctcactcttgtcatccagactggagtgcagtggtacaatctcagctcactgcaacctccacctccagggcttaagtgatcctcccgcctcaacctcccaagtagctgggactataggcatgcaccacactgggtaatttttgtattttaattagaggcagagtttcactatgtcacccaggctggtcttgaactcctggactc

SEQ ID NO: 55446 - DNA, 1322 bp, Homo sapiens
gcagacttctggcactggcacttgtcctcctgtttctatagaaactgggttggaagtcagagctgcacaaagggaaagggtaagtttcttttaattccatatttataaacccatatcttattaactgtgacatgttttcagttttcacataagaatatacatcctcgaactagaactcaaatatgtactacttattttcacttgagtggaaactgacatcaagtcactaaatataataggagggtttaaatatggatttatttttcttgtgactgacttcacatttcttgaagcagtgaattcaatgtcaattcgcactttgagctatttttaatttgggggtcagaaaattgttttttattatcttagatcttattctcttgtacttctctggtaagtgaaaattggaaggacattttgaaagtctgcatggattataaaatcttgttgtagcgaagtctgattcttctttccattataaagtactatactactgatcagtttttttagtctctctactctcttagccaagcaagatgagttcgtctgttggggcacatacatttgttttcacctgggcagacacccattatttgtagaacctaagacacctgccagttggtgagtcatcttattgctatggcttcagaggactgctgtacagctggagtatttaggcttgaaattgtttgattaggtatgataagcacattcctctgatttacaggttgccatatataggtaacttatattgaactgtgactagttttgaggtagtggaaggaaggtaatatttgctgttgctctttaaaagttgtctcacttatttccttggtcctggcgtactacccttaagggatggacttacttttttcctgctaaaagacataagattggttgacagaagtcaaagggtggaacaccttgccattacttctgctcaatttgtcacttttaaaaatagtttaaaagctggaagcttgtcaataggaaaagtaaactcatttttaaaaatttattttcacaaggcaaataatgccttaaagtggcttcttttttaaaatttaatttaattaattctattctgatgaattctcattaaaagtgttgtatgcctcctttgttggtttctgttttgctcattagtgcttgcacgaggtaaaaatagaaatgaatttgtggattttttgtttgtttgtttggaaggtggctagaaaaaactttagtctttcgttgtgtgctatcaagtattcagatgtattctccactacttaataaggagtagccaactcatcctggctttaaaactgaaagttctatgt

SEQ ID NO: 55447 - DNA, 1026 bp, Homo sapiens
ctcaaagtgctaggattgaaggtgtgagcaaccatgcccggcacaagtatattttcatgggtttagtcctcacagtatatctgtgaggtgggttggtggtattttcattttacagagcaggaaattgggtctcagataagttaattttaagtaactttcatgagggcatatggtaacaagtggcagagctgatatttattattagttaactatttttgctgtttgtatgtgtaaggggtggttttttttttcattttttttacatgtaaaatgtaaaaatattagacatccacatctaaatgtaaaaatgatatttctttttttttaagtcagaaaaccagttttcttttttcttttgctttagtcagaaagccataaaaaccatatttaaataggatcaactactgttttttaacataactgagatttgaaccgagattaatttggttccaaagcttatgctaggccttggagaatacaaagatgaatgaaaccccattcatcttgttgatcttgcagactaatggaaaggattgacatgtgagttcatgtagtactctgttaaaagttagataggattccagatgagaatgacaatgctggggaagatttttccaaaggaggtagcctttgagtgagtcagatagtgaaaagtgaaatggtgcctggtagagaaggcatacataggcagtgacagggtatggagctaaaaccagtcttctagagtttttctctgtaagttgttaatagacattttaaagcagagaggaatggaagagtggaataacgatgatggtaatagtttaagaagcattttggaccaggcatggaggctcacgcctgtaatcccaccattttgggaggccgaggcgggtggatcacttgaggtcaggagtttgagaccagtctggccaagatggtaaaaccctgtctctattaaaaataacaaaaattggctgggcatggtggccgatgccggtgatcccagctgcttgggaggctgaggcaggagaatagcttgaactc

SEQ ID NO: 55448 - DNA, 1010 bp, Homo sapiens
agacatttctcagaatgctaaagcaagaaggaaccttaaaaacttatctggccgcgcccagtggctcatgcctgtaatcccagcactttggaggacaaggcgggcggatcacgaggtcaggagatggagaccatcctggctaacatggtgaaaccccgcctctactaaaaatacaaaaaattagctgggtgtggtggcgtgtgcctgtagtcccagctacttgggaggctgaggcaggagaatcccttgaacccaggaggcggagattacagtgagccgagattgcgccactgcactccagcctgggcgaaagagcgagactccgtctcaaaaaaaaaaaaaaaaaaattgttttccttctcatgttacaaatgtagatgcgatgtgtttctttcaagcttttgtttccaatgacattagtttaggttttcttttgtttagctctcacttgattgcagtcttctttctttcaggtcagactgtttttccatctttcggccaatggtacaaaaaaaaaggaaactgaagagaggagatagcatatgccagagaagtagaaagagccattgtatgtctgggtataatcatataaccagcctggaaggaaggaatgatttctgttagggaaggaaattttgccattagtaactctcagccatgaatagctcctcaaagcaaggagcctcctgtattgtgacccatttgaacttagtgaagcttcttagctgccctatttttcactgatgaagttgaatcagctccacctgagttagggacttacaccatctccaatcttacagtggaagttggagaaaattaggaacacataccgttttattttaccatgaattttattagaaggccgctattatgaagaaaataatcataaattattgttttccagagaaaaaaagaagtgataataatcagttttcttttttttcctttactaaacaaagacttgagtacttactatattcctgttaatattgctaggtgttgaggataca

SEQ ID NO: 55449 - DNA, 1937 bp, Homo sapiens
aaataattacttatagtgttttagggagttttcagaagatatttgtgattaaataaatgattatatatgtatattagcatactgtatgcatttgtcagttgggaaagaggggaatatggagaagtggggaactgcattcagtttttattttataggcaactaatatggtcctttggttttattttaaaatgaaactgagccttgagcattttgagctttcatgtcaaatgccttgaatggaagagtaggaatttcatgtaagtagcttacatctgccctgtatgttggagaatgtgattagatatacttgcttttctgcccaaggcactatttttgtatttatattgctttttgcaggtttacttctgttaacaggggtctgtgagaaataaggcttaaaatatcaatacttctcatttttccacagccttccaaggcttccatctttgtgccagtgtgtggctctgggtgccatctaaccgcaaaagcagcagttgggtttggatgagctgtgtgacatttggcctacacgtaggtctactcaccaccctggtcagggaacctggaacaatcctaaaactcacctactctaatgcaggccatattttttaattaaaattgaaattgtcactgagtattggaataagaagggactttggggtggagtgggtgagcagggcattgtcttacagaggaggtgtggggaccggtaagttttaactttcatcctttcaatctctcagtttcagcaaagatcttataaagaattttgttgctttcttaaattcatgaaagaaatgtaagcaattgaggtgtgtaattttcttgcccgtattctctatattaaaaaaaaataagaatatggttctatgaatttcttgtgctatttttgctttccttgaattattaaaatatgttgcatagaactaatattgttttcttttttatttttatacaggaaggagagaaatattgttcatgtaatgtgttacctttttttgtctgtgtgatctacaagagcatggctgaaatgttaccatttttaactagtgttttgactgaagattattatgaaaagttttacttttgttagattcctaattaaaaatgcctatactcttttataggagtttcaacttttgcaatttggtaataacagatttaggtaagtaaaaaatgagaatctcatacagttctgaagatctaagtttggttgagaatttaatgtttcatcaccagtaaattcaattaaagacttttgattcaattaaagactcagttctgcctacacctgcaagaactgagttgatctgtacatcaacatttctgatgtttctttggtagttgctgctggagtcagaagttaggaacaaatctaatggcctttgtaatgtcctctgtcatttcacggaggaatgacttagaggaacaaagctttcctgtgatttctttcttcaacagatggctaatggcacagcattgcagttagaatcttgtttaagatactaggagcacgtcctggactaaaaatttctacataagctttagcaacaaccttatagcttcctttgacttttttgtagagcttacagaatgtatggctgcctaagtaatagtctctgaattaatgggtaaaaaatatattatgagttttttatcctcacgtatggtgctaggctatactggatttgggctaacaaaagcttgttaacttttttttgtctcattgacagaagtattttatatctcatattttacattacataggtgtgtgtgtgtgtatgaaataaaagtttgaaaataaagtgatatactcttttttaatctgctctgtggtagtctatctttttccataaaaacaatgagatcatgacccaacaaatttatttcagaactcacatatatacctgtagctttttcttttcaggtaatggtct

SEQ ID NO: 55450 - DNA, 1034 bp, Homo sapiens
aggatcgcttgagcctgggaggtggaggttgcagtgagccaagatcacaccactgcactccactctgggtgacagagtgaaaccctgtctcaaaaagaatatcactattaattcatattgtaaatatcatttcctaataagagaaaagcagcaaggtttggggaagaaaaagtacccatgaaccacctaaaaaattaaaatgaaaataaaaacttgtgttcttactaataaactgaaaacactgcctgcctagcatttactgttcgctattagtcctcagctctttcacaatattgggggcaaaaagccaaccaactcaccccagaagtcactgttcatagcttgagatgatataaatagtatttgtcccttttaggcataggtctctatagaatttcacccttaatatggctaacactgaattctaattcctacaggttgatctgtgtaggaattctacagtaaacaggtttttgggacttgccagtttctttgctgggatggctgtcctttctggaccacctatagcaggtaacaccttcaccacattctgaacaaatttcaatagcaataaaagagaaaaactgatccaggattaatggtaacatgtaatgatggtatcaggttaaaagaaacagattatttctgcttttcctatatctactcactccaccaccaatgcaggaaaatctgaaggctcagattcttgtattatcttaagatgtgccttaagcagattcttatattcttgggagttgtagggcagacactggatctatgtctacttgtctggggagacaatccagagttttttcagagcctcaaagacccatgatgctttaaaaaaaaaaaaaaaaggctgggagcaattgctcacgcctgtaattctagcactctgggaggccaaggcgggggtatcacttgagctgaggggttcaagaccagcctgggcaacagacagaccttgtctctataaaataaaaaacaaaacaaaacaaaacaaaaaaaacaatgaacgactagcatcttgtatc

SEQ ID NO: 55451 - DNA, 1038 bp, Homo sapiens
cgccttggcctcccagagtgctagaattacaggcgtgagcaattgctcccagccttttttttttttttttaaagcatcatgggtctttgaggctctgaaaaaactctggattgtctccccagacaagtagacatagatccagtgtctgccctacaactcccaagaatataagaatctgcttaaggcacatcttaagataatacaagaatctgagccttcagattttcctgcattggtggtggagtgagtagatataggaaaagcagaaataatctgtttcttttaacctgataccatcattacatgttaccattaatcctggatcagtttttctcttttattgctattgaaatttgttcagaatgtggtgaaggtgttacctgctataggtggtccagaaaggacagccatcccagcaaagaaactggcaagtcccaaaaacctgtttactgtagaattcctacacagatcaacctgtaggaattagaattcagtgttagccatattaagggtgaaattctatagagacctatgcctaaaagggacaaatactatttatatcatctcaagctatgaacagtgacttctggggtgagttggttggctttttgcccccaatattgtgaaagagctgaggactaatagcgaacagtaaatgctaggcaggcagtgttttcagtttattagtaagaacacaagtttttattttcattttaattttttaggtggttcatgggtactttttcttccccaaaccttgctgcttttctcttattaggaaatgatatttacaatatgaattaatagtgatattctttttgagacagggtttcactctgtcacccagagtggagtgcagtggtgtgatcttggctcactgcaacctccacctcccaggctcaagcgatcctcccagttacttccaagtagctgggaccacaggtgcgtgccaccacacctggctaatttttttattttttgtagagacggagtttcaccatgttgcccaggctggtctccaactcctgagctcaagcg

SEQ ID NO: 55452 - DNA, 2528 bp, Homo sapiens
ttttgatcagcaacccatccagaaataatctgactgaccgtctcaaggatacctggaacaatattgaaatctttttattttcctggtccctttgaaaaatgtgaatgcatacagcatcatttcccaagtaatatgatctcatcctgaggccaggatatgtgaggaaaaaaatgatttgatttgtgtaccagtaagctctattatatacttacctattccaaatacatttaataaaatagcaaaaaagtctccgctagagtagtgtagaagacccatgtagttagtgtttttttctgattgtgtttggaaagcttacgtcactacagtggtaatccctggttacagaggaccctgggcacagaaggccatgcagtctcttcgtctaagaggtcctgcaagtgagaaaatgaagtttctaaaagacaaatagaccttcaggtcagtgtcttggggaagtcatattgtagaagattggagtataaataagtcttctgttaaaaaaggagatgttgggactcataattgcatacgaagttttaggaagtaagtcctccaaagtttatgcttaatttgaaaatatgtaggaagtttggaaatgggagattgtattttggaccactgcacctggccaaatccctcttctagatcaagcattctgtctttaaacagttttatgagtagtcaactaaaatagttgtttttatttatttatttatttttattttattattattttttgaaacggagtcacgctccgtcacccaggctggagtgcagtggtgcattctcggctcactgcaagctccgcctcccgggttcatgccattctcctgcctcagcctcctgaatagctgctactacaggcgcccgcaaccacgcctggctaattttttgtatttttagtagagatggggtttcaccacgttagctaggatggtcttgatctcctggcctcatgatccacctgcctcggcctcccaaagtgctgggattacaggcgtgagccaccacgcccggccagttgtttttacttttaatttacattttaacttattttaaatatcagacagtccataagtgactagccttaaaagtcatatttatctgttttactatgagttcaaggggaaaattccttagctacaaataataaaacattattgaatgcttactacaggccaggcactattctaaactctacatgcattgcttttttgatcctgacaatcttatgagggtagatactattatccctatattacagatgaggaaatgaaggcaccatgaagcaaagtaacttgctgaagttcccacagttaagaaatacagagcaggaggttgagccagggaagtcttgctccagaaccaatccttgagccactgcactgtgctgtctacctggggttttctgctccttatagtggctattgccattgagcatcagctttttgaaatttccgcatttatccaataaataatgtctactgtgtcaaacactgttatatgaagatgaataagacttgatttagggtccactgtctagtaggggagcctgtgtgcagtgacagagatctcttcctgggaaatgcccaggtgctccatctagcctcaaaaattttactttctctggcccttctacaattcctcttttgtttttctttagctttttattaaaatgtaataagcttgtaaaattaagttgatctttccttttgggtaggaggctgatgtaggctttcttacctgctacagaaacaaggtaagaggcatccatgatgtcaatccccagtgttttggctctggctaccaggtgaaaggtagggatgaagtatgctaactgactgaggagaaaagaccaagtaaatatgtagaagaaaggatttctaaagagagaaatgtcaaacagttgtttgcagctccacgaaataaccttatcactttcttcatcactctttaataacagtctgttcctgttaggcccattgtagaactcttcactttgattttgtgagactgttaaatttttgctaggtagtccagccttctgcgtagtactgtccttgatggtagactcttctgtctcatggcagtgtgtttctgttgcatgtgcctctggaccatgtgcagacaaactgctgcctttatctttaataccagaattgttctcacttttgatatggatgggtcttaagagcatactagaaggcaccaaattcaatgcgatagctccaaataatataagggctcctaaatagggagagattgagcaattaaaaatagcctttcagttcacaatactgctttgtgttcataggctcagaagaggccccactggcatagcccattaattcttgaaaacattactttgtctccgatttgacttattagtcatatacactgctgtatccgtgtaataatgtagtgctttggagatagaaaaccagaaagctgcaccaatagatgggataaaaggagagatggtggttatttgtgttaaggggggtagggggggcaagtttttggaggga

SEQ ID NO: 55453 - DNA, 1817 bp, Homo sapiens
agtacagatttaggtacagaaaaaatagaataagatgaaagaaatcatttggaaacagccttagaagaggggacagctggccaggtgctatggctcatacctgtagtcctagcattttgggaggctgaggcaggcagatcacttgagcccaggagttcaggaccagcctgggcaacatggtgaaaacctgtctctacaaaaaatacaaaaaaattaattgatgtggtggtgtgcacctgtagtcccagttacttgggaggctgaggtgggaggatcgcttagcctgggaggtggaggttgcagtgagccggtatcatgccacagcactccagcctgaatgacaaagcgagagagcctgtctcaaaaaaaaaaaaaaagcagcgggagggaggaaggcatggatagcctttcatcccatgacattttttagatcttccttaaaagatgacagatgctaatcttgcctttggagctgaatagttgcttgcattcagcgtgtcctgatcaaagctatgatttgtatggtgcttctaaagatagaatgggctataggttctgctatcctatcatggatttgtcagctggtcccattcaccatgagactactgaatagttaggaaagattcaacaaaactgccatgtagatagcaataggcatatgaatacacacatatacatgtattttttccagtagtttaggattattttaatccaaatgtcttagttacaaagaaaattgtgagttgaatcattttttattcatttgtgaaaatttatagttgacattacataaactcttaaggaacatactctttttaccaaagtatttgtttcttttttatctatttcagtgagtccgatgggggaggagtttttttaaatgcagatttttgtcttaaagggaaaatgggaaaagtgagggtttttgatggggcgggggcggggggggaagggggaagccttatttccccagaagtatcgcttttactgcaagctgtttccagctgcacggaatgccctccatctcctcagacattgagccctatggtgaattctgagttgcttgtgtgagctggcaaagcctgcaagtatttcaagatctcttttgcgtatgtattctccagggaagagaagcatgtttactttagaaattatgctcatttcctctcttgcaataccttgtgaaatcgattgctctgaaagtcttaacttccatttctcaaagggagaaagctgaacgctaaatcttgcacagttgatagtaaataaacttagaatgacgtacctgtccagtcatacagatctatcaggaattttgtaaagggtgccaaaagaaaagtcagtcccatcccagaacgggcaatagctgtagaaagagccaatcgttttttgaagtatttggtagttaccacagcagccacttggtataagaaagcagaacccaaacctaaaagaaaaacgtaatagtttagaatcactcttacattaagtggcttggtaacagaaaagataatctcctggatccgagataatacagctaggccttttggacccaggaacagtagaagggaagagtcctgttccatcttctatcttctatggatggatgcatatatacatacacacacacacacacatattttgagacagggtctcactttgtcacccagactggagtgcagtggcacaatctcggctcacaacagcctcagcttcctgggctcaagcaatcctcccacctcagcttcccaaatagctgggactacaggcatgtgccaccactggcctggctaatttttgtatttttagtagagaca

SEQ ID NO: 55454 - DNA, 1332 bp, Homo sapiens
ttcccgtcccttaacttgaagtcttccaactttgtttcagttttgactcaaagatattaaaaatctctcccaaggtctaggtttttccttagttaatttagcagactacataaatctgcattattctacataatcccatgtcttagaccaagcttggtgggttttagttctgttaccagagtccacgtcatacattgtaaatggctcactccaaaataaagcaaaaaccctagaacttctccagtcccctcattttctttttgtttttaagagcagttaattgggttgaacctggcaggaacaccttaagcaggacttcccccacaccccacctccaataagagcttcctcactagatcattttaattattgtctgggaaaggagttggatcagcctcagtgacttattttcaatacaggcaccaggctttgtcagagttagttttatctaataacaacttcttatcctgcgtccttttctagtatcaccctagctcctcctgaccttcacaggcaaacttctgtaaaaaatggtctattaggtatctccactttctgtcattctgctactccactgaaaactaaagttcactaactttggcccccactgctccactgtactagctcttatcaaggttattagatttctttgttgctaaaccaatagagtcttgttatttctctcctatttgacctctcagtagcatctgctcgtcacatttctctgaaatgcaaatctatcacatccctgcttaatttttctcattagcttctcatagcctcaagagccattctcatctcttcagtttcatcaactatccccttcatccttatttgtttattcataaatgtgtgcagctatcaattcatccatccatctatccatccaccaacagtattttactgagtgcctactatgttccaggctgtatactggcactgggcttacggtaatgagcatatactcatgagcaatgcagacatagaccctgcccccatggaacattcagtctagtaagacagactgaatacagaaaacagtcatacaaatatataaagtgtggtaagttggttagaatgaatctctctctctttttttaagtaggaagctcccaaagaacattgttatttttcacttactaggagctcatctgttatagaaaagaacagttgtaagtcatacagaaacaaaagcacagtcattcaagtatccacattacaactgtgggggattagcccctgaatttattgttaacattttgaggatccagtgcattttttgtgcttagtaagcagtatcacaccctaaaagtgggacagtgtttattaatc

SEQ ID NO: 55455 - DNA, 1061 bp, Homo sapiens
tcctgggccacaaacagaaatcttcagtaagctcaacccattcgtgtggccttttgtatattgactaaagattctggttactaatttggggtttcagaccccattttaattgcatttttgagatctgattacctcaaccacctcctgcaaaagacgtatgctcgtagtaattttaatgagattttttttattatattttggaaatggttaaggctgagacccctagaaaattactgggataattcaactttctcttcccatttcctccctctaccctccacataaaacaaaacaaaacaaacaagtcaaatgggaaattgtctttcgtctcccacaccaatattccagattttaaaccagagtatattttagacgaaaggatgtgtttttagttttatctggaaaatctgcacatatttatgcatgttcctttttaagaagcaagaggcttctcagattcttaaaatcaaactctataatactttttgattaaagtgcttgcagaaggacagcttagtggtttgggagggtgccctgtaagtgtaagcatggaaggattatgcagttacatgatgctggtggcaaggatcaaataaacattcaacagaaggagaaaacccaaagagagaaggcaaataaatgcttttcagagagctgtttgtaattatgaatacactctagacaacttttttttttttgagacagagtctcactctgtcgcccaggctggagtgcagtggtgcaatttcggttcactgcaacctctgcctcccgtgttcaagtgattctcctgcctcagtctcccaagtacctggtactacaggcgcataccaccacgcccagctaattttttgtattttagtagaaacggggtttcaccgtgttgcccgggctggtctcaaactcctgagctcaggcaatccgcctgccttagcctgccaaagtgctgggattacagacgtaagccaccgtggccagcctgaaaacattttttagtaaacaagactgatttatttatttttttggtggcacgcttgttgctcttttaaagcagggctatc

SEQ ID NO: 55456 - DNA, 1097 bp, Homo sapiens
gcctaatagcaagaagaaagaattcttaagccacctttgggatattagttaacattttggcatctgtacccaattgtcttaataaagcttgtagggtctttaacgaaacataaacaattccctcaacttctaaccttttaactcttggccctaaagctattcagcaagaatgcagcatgatttggcaatcaccactattacccccatcccagtgtcaaacatagccagcccaggaataatttttaacacttatggatttagactttaataagctttaccaactagaattaagatactttatttttagttgactctctccttgccctcattcaatccttgttcagaaaagagttaacatcgctggcctgagattcctattctttgaaaggcctgtttacatggttggcctctggctggcaactgggaacttagatttcaggagggttcctaccattccttaaatgataatagtgaatcattgtgcttaaactatgtaaacaatacaatttttatgctgaacatttgcttttttcgggagcttggaattttgatatgtgctaggcagagagggtactttggtgaccagcccccttgggcactgagtctctactaagctttctggattggcaacatttcacacatgttgttacaactcattgctggaggaattaactgcatcctgtgtatcttcactgatagaagaattcttgcaagcttctgcctggtttcttctggactttgccccatcctccttttgcctttgttgagtcagctttgtatcctttcactttaataaaccatgtaagtacaacaactaaatgctcagtcctgtgagtcatcctagtgaattatcaaacctgaggggttgaatgagtctgggttctcgagaaagaatagaatattctccagagcaagaaccagtgatgggggaggagatattaaggttgatttactatgagaattgactcacatgattatggagactgaaaagcctgcactctggtcagcaagcgggacactcaagagagttgatggtgtagttccagtctgagtccagaagcctgaaaaccagaagtgctgatggtgtaagttttagt

SEQ ID NO: 55457 - DNA, 1035 bp, Homo sapiens
gagcttcaaaattgtacaccacccaccttgccgggttgttgtgaaaattaaagataatgtatttagagcctagcagtctcagcatatggcatacattcaataaatggttaacagctgttattatctgaagtcctttctagactcaatttaaaatgattcaaatattatttttagtagagacaactatttattgttataggactgcaaggaacatcttccttcataaataccaactgaaaagtttcaattttctgatactgttatttggagataatctctactctcaaactcagaaagacctggcaaggtaacaggaaataaaagctagaaaataatagcacgctaggctccaagtcaacatcagatgctatgcaattcatcaaatagttggtatgagagatacttacaacccagattaagtccttgtgaatctgtgcacaggactccaacaatggagggattcttcattctaattccaggaacacaagagagttgaagtacataatgggagaaaaaggatttaaataagtacaaacatacaggtgttctatgtaccaggcattaagtgctttaaatcaatatttctcaatcttttttcattgtcacaccctaagaaaaaaattaagttctagggccgggcgcggttgctcacgcctgtaatcccagcactttgggaggcccaggtgggcggatcacctgaggtcgggagttcaagaccagcctgaccaacatggagaaaccccgtctctactaaaaatacaaaattagccaggcgtggtggcgcatgactgtaatcccagctactcgggaggctgaggcaagagaatcgcttgaacctgggaggcggaggttgcagtgagccgagatcacgccattgcactccagcctggaagacgagcgaaattccgtctcaaaaaaagaacacaaaaaatttaagttctagttaattaattgaaataaaccagtttctctctgatgagagaaaaaaatgtgctaagtactgctgagttctggagggccacaaacactgcgtga

SEQ ID NO: 55458 - DNA, 1052 bp, Homo sapiens
agtgatagaagtgtttgccttatgatctcttgactccttttacacaagaagcagattggtagagcttaagcaggtgtctgtgctgtggtgctggctctgccaaaaactctcatatgccctaggaaagttcctttaacttctctgagcccgagtttatctgtaaagtgaagactttttaaatttagtaatctgtatgtctcatctctgagaattctataatgttttcacattgttatatgtgtatatgtacatgttgctcccctctagtcactaagatgccacatatttctacttgagtgaacagattgcaagtccaaatgttcttgtttctaatactaataattgatctcagcaagacataaaaaagtaaaaaaaaaagtaatcttaccttttattttgaccttggctttaaattattatgatttatcatttcatctttgaatgctgagtgaattacctaaacagaatgtctgttccagttaatcttctctttaaatttttgtagtttaataaacatgtaacaaatcagaagcaagtatatcatgcttatcgatgaactgtagcagattgtaatggtgcatttttgtcacattaaaaagttaatgtccttttggtcccagaagcaattactataatttaaaataatattcacaaaattttgtgaatgtttttgaatacaaaggaggcctaatacagccatattgtagttcattttgctcaggagtgagaaacaaaattcagggataacccaaacatgtctgtttggcaatagtggatagttaggtaaagaagggttatagcttttgcacatcacagataagaggcgactatacctattgaaaaacagcagtatattctggttcttggttttatgatggaaagatattagaatgatactaaaatttggatgcttgggaaattgaataatacagaaatattttgtcatactgagattatttgtccagaagtttagtcttatatcccttccattcagaaaagggggcagtttttaaaggcctctgtcataaaaggaaatgtatattttgactagt

SEQ ID NO: 55459 - DNA, 1215 bp, Homo sapiens
gtgcaaaggaaaagaaaaaaacaatcaattttatatctcaggcactttacaagtgctattatatttctgtggtgagtcagtatgccttctaatacttgacttgagcaagaaaatgtgaattaggcaatttcttcttactgaatatgattaagacattttggtaccatacagtgggaaatatttccctcttgctgtagttgtcttccataaattttgttaattgtaatagctagatatttgtttctgcagacgttgttaagtttggtagtacccggtgcatttagcagtaacatttcgtttttgttttggaatgttattcaatattgcagcagaattttgataagaaaagaaaagcaaaaactaataagaagatggatcacataaagaagagaaaaacagagaatgcttataacgcaatcataaatggggaagctaatgtcaccggttcccaactcctaagcagtattttaccaacttcagatgtgtcacaacataacattctcacgagtcacagcaaaaccagacaagaaaagagaactgagatggaatactatacccatgagaagcaagagaaaggcactttgaattcaaatgcagcttatgaacaaagtcatttcttcaataaaaattataccgaagatattttcccagtgacaccaccggagttagaagaaaccattcgagatgaaaaaataagaagacttaagcaggtgctgagagagaaagaagcagctcttgaagaaatgcgtaagaagatgcaccaaaaataaaatctcctgtaaagacttcagtgaaatagctgttttttaaaatatacttcagcattaataagttaattgtaggtgtgttctgaaagtgtctttgaatatgaagcttgttttttcatcagtcgattgtacaactttaaggaatacagaaaaggttgattcacatatgacttgtgaataatttacatggggtatctatacctttgtcttagatacctttttttggaaggataaattttatatttttctattattttaactagaattctccaagtttgaatatttgggcagggtttttgttattgtttgtatctttacctaaattgctcaggcattattccagcagtagatagtgactgtgtattactgaaattttacaattcaagagaggaaatcagctccaaacttagcttttccagtggatttgtatatgtacttgctttatctc

SEQ ID NO: 55460 - DNA, 1137 bp, Homo sapiens
ttaatacccagagtcttccagtgactgtgaagtctccagttttgccttctgggcatcatttacagattccagcccatgctgaagtgaaatctgtaccagcgtcatcattgcctccttcagtgcagcaaaagatacttgcaactgccaccaccagtacctcaggaatggttgaggcctcccaaatgccaaccgttatttatgtatctcctgtaaatacagtgaaaaatgtagttaccaagaactttcaaaacatttacccaaaacctgttacagaaatagcaaagccagtaatactaaataccacacaaattccaaagaatgttgctacagagacacaattgaaaggtggtcagcattctcaagctgctccagtgaaatggattttccaagataatctacagccttttacgccatctcttgttcctgttaagtcttcaaataatgtggcttcaaagattttaaaaacttttgtagataggaaaaatttgggagataatactataaatatgccaccattgagtaccatcgatcctagtgggacgcgatccaaaaatatgcctattaaagataatgctttggttatgtttaatgggaaagtctatctgttggctaaaaaggggacagatgttctgccatcacaaattgaccaacagaattctgtttctcctgatactccagtaagaaaagacacgttacagacagtgagttcaagtccagtcacagaaatatccagagaggttgtaaatattgttttggctaaaagtaaatcttcccagatggagacaaaatcactttccaatacccagcttgcttccatggccaatctaagggcagagaagaataaagtggagaaaccatctccttctaccacaaatccacatatgaaccaatccagtaactacttaaaacagagtaagactttattcacaaatccaatctttccagttggatttagtacaggacacaatgcccccagaaaagtaacagccgtcatttatgctagaaaaggaagtgtcctccagagcatagagaaaataagttcctctgttgatgcaacaactgttacttcacaacagtgtgttttcagagaccaagaaccaaaggtaattttcccatgtcagggtgctctttttatat

SEQ ID NO: 55461 - DNA, 1031 bp, Homo sapiens
aaaatgtatctcttgagaaatatcatttatgccaagacttgagctatgtgaagagttgagttgggtgaggcgtacctaggtagagtgatagtatgtgtgacatgaaagctcaatatttcccaggagctgaaaaatgttttagatataaataaggtaaggtatttacattcaagtaatctccaaataactaattatgcaaacagagattagtatatattgatttttcttaagattagacagtctatactaagaaataattcaaggcatgggggtcagaattgattcagttaaaaaaaattgatttccagtctgttccacattgattgaaaaccattcagctgaaattgcagtggtattatatgtatgggttgataggtgattgacaattgactaatataaataattgctataccagagactatgtagcactaaacctcaaatgtgctgaaacagtaatcagaagaaaatgattcctatgtaaacagttcagtgaaatctatagcacaaaaatgtggcaaactaaggtaacaccatgagagatagcttaggcaaaagaagaatggctggcagaacttgtgagttattgaaggaagaagacagaacagattgagggggaaaagagagaaatggaataagagtaaggggagagggaatgagaatcttcagttagagtagaggaggaggacaagaggaaggaattcagggaaagggggaagggaggatgctaatattttaagaggagcttactttagtagtataattttatatagggcaaaaccttagaaatgtctacttttagtcttaggaataaatgttattatctcatacccattgcctaatcatataagcagttgactatatcattatctcttctacttcaaaatatttgttttgcagtctttcactttaaaaactcaaaatggaaaattatatactttattttaatatttacaaatatttacaaatatttatttttaaataaaatgtatataccatgtagtatgttgtatttatttactcaatgttctttt

SEQ ID NO: 55462 - DNA, 1048 bp, Homo sapiens
ttgtgtatcccttttgttcctttattaccagtttcttccctgaactggctcacttgagtatttacatatgttctggttaatctaaccttaaacaaagaaaaaggaaagatcccttctttgattccatttattcctgtagcttcctgccagtcgttctcttccccttgacagtcaaagtttaaaaagagttgtctacttgcttcatacccactcctcagcaacttctttcccctaccacactgctcttattaaagccatcagtgatcttcacagcactgttttcagtgtacatttttaatccttatcctatttggcatctcagaaacttttagtataattgcccaattttcttaaaatcctctgttcctttggcttaacattgcatcagaagcaatggttttcttcctacgactctaagaataatggaaggccactgcaatgttttaagcagggaaagatcagttttagtgtgctgagtaaattgaaaggtagaagatatgattggagaaaaaaatcagtcatgaagctattgtagtattctaagccagagatgatgtttgcttggagtagagtggtaacagttgatttggagagaattgaacagatgaaaggaaatttaggagacaatatcaacaggattttgtgatcactgaatataaggaataagaaaggaggatttatctattctgacttaaggcacctaaggtagatgagatgctatttagcaaagaaaaccctgcagaagatggaacttggggggattaggatgggcagagatctgctggccatgttgaattttaggaacgtttgagattctgaatgaaaatgttaaaagggaatttggatgtataagcctaaatttcaaagaagccacagatagaaatattgaaattgttcatgcgtaagtgataatttaattgaagttatgcattgagaagaaagcatctaacaaaagagtacagaataggaagagaaggattctttctaagctttggtaaactcccaacatttgaaagttgattcaaaagtatgagttggcaaagaagac

SEQ ID NO: 55463 - DNA, 1041 bp, Homo sapiens
ttcccctatttaacaaatgaagaaacagattcaaagaggataagtacattttctagtcaacttgtaattataagaaccagaattagtagcctgtaatctttctaatatgttcctcttttctcttttaaactgttaaactgtattatttttcaaatgtagtttctcagtttgaacaccagctggtttaaagtaattactttaaagtaattaggtgaccagactagaaaatgggatgcagaatctggttctagttttagttctgacattagcccgcagaatatgatctttcagaaaacagaatctttgtaggactttaattatttaatctcttcaatggaaggctccttctagatatgaaaaactgtatattgatagaaggagtacgaatttcatcctgagttattacttcttagcattctgcagattaatttttagaactcattacattttgttgccaagaaatcatggatttttaaaaaaattataccttgtaggattcaattcagctaacattattgtgtgcaatttccagtttctgaattagatgcggagtatatagatatgaataggataatctaccctgcaggaatttatggtctgtggtagattatgtgactctcactgatacactgacatggaagaagcttaatttttcttccttttttttattttttggaggtgaaatagaggaaaagagagggaaaaatttagtgatcagattggaaaatagctcacacagtatagttttttttataaagcagaaatatagacatcatataaaatactatgcttggtattggaaggatatttgcaaaataaattataaagcctctcaccttaaggagtttcagtcttattgaatgaaacaatactcattttaaaaaattagctaatagattaaagtcaataaagaaagcattatataatttccaacattaatagcaccaatgggagtacattcgggattccaagttggaagaaattaagctggagtgactggcagatattttatggaaaagatagaattggaaactaatttta

SEQ ID NO: 55464 - DNA, 1029 bp, Homo sapiens
aaacccgcagaggaaaattcaggcaacgcctcgcgttggtaagtaccggtttcgaatcctccccacggctgcccctctgtccgtcttagggatgtggagtcggccgtcgtttccggacgctgtgtagttgagaggagttggagcccgcagagtgcgccacccaggcgggaagcgcttgtctccgcggcgcttaaagcccatagagcgctttcctctgggaaatgtaaaacctctttagagcctgacacagcggctccgcgggaccccagcgtctcaagtttaataggcggaccgagtagatctccacgggagatgaaaaccaagatggccgacgctcttatgtgactcaaaccttctggaagattctcacgcacacgcagaaacgcagcagtcagcacggattagcaagtgcagccctggtggcgctggaccttcagtgaaaatagattttaatagtgagacagaaagggtgtgtgattgaagaaaaagggctttagaatgaggagatcgaatatttaaaatttcaagtaatagttttatgtgaagagagagaagtaagactggagaaatcctcgtgtaaagtcagtccttttgaacagcctttttgaagtagggtgtaatgaagtgccatttcattggctatttatatttggcatgaggagagtccagtatttctaaggaagatattcttgtaaagttagaaaatagatgatcagtaacttagtttttgggtttttttttttaaattgtattacaaggaaatgaattggaaacaatgttagctaaagcagaatattttcacttgtactctcacatggttagtagattaagtgatgaggaaaaaatagggtctgcagactctaataagaaaatgaagaactaagatgcaaaactcatggaagaggattttcgtttgaagaaaatcaagctacctggggttaatctcaactttgctagttagcatttgtgaggccaggtacctgtttccagtctgtaaataatagcacttagaaatattttaaagattag

SEQ ID NO: 55465 - DNA, 1047 bp, Homo sapiens
gtacaggtaaagaatagtttacagatccctgctgaaattaaaaagaaaaaaatgctcatttggaaagtgcccagtgatgaactggtttgcagaataatctttgaagaagattaatcaggtttttatctttttagaagagatggttccctggccagaagaaaaggtggggagaaaacatttaaactgtcagttggagcaattcaaggaataatgcttatgtgatggagacctcaattataaattagttgctagatacaagaatcagtaaataatatttctgaagtcttctggactaataagacagaaagggaataaaatactatgcctatattaaacagcaataaacctgggagacatttccataagcattgattgactaaatgctgacattgctagaaataatttggatacaaaccataaaaaagtatcatgcctttgaaaagcacggtgtaacacacctgcaaaatgtcatttagtcctgattcccgtatcaaggaaactattatttaagttatgaagcatgatagtatggggagaaggaaattgacagagtcaaagtttataaaattataaaatttgtatggggaaagtggctcagggaaaaacatagactttgtccattcctagaacacgaggcttagcgatacataccaacatattaaataaattattttaagacaaaaaaatactttcataatatttgaatcccattagttaacttttacccttagaaataacataggctaaaaatgttaatacagttggcttgcattatccatggcttagctttctgcattttcagttattcgcagacaaccatggtctgaaaatattaagataatttcagaaataaacaattcataattttcaaattataggctcttcagagtagtgtgatgaaatcttgttgccctcctgcccaggatgtaaatcatctcttttttctgcatatctgtgctgtagacactacccattcattagtcactttgtagccatctcagttatcagatggactgttgcagtatctcagtccttgtgttcaagtag

SEQ ID NO: 55466 - DNA, 1030 bp, Homo sapiens
tttgtaggagagattcttaggttcacaatcctaaactaaagaatttgaaatatggaattcagattgtacatagtgcctcagtaattgagctaggaacaaaaatgttgagcctgatcatactcacttcaaagaaatgagggatgagtaaatgccctttctgagaaccattatctagttaaagattatgatagaactgctaattttctgagcaaagaggtggggtttgactgtgagaaccattttgttgtgaccctctgagcagcacatttttagttttacagtaccactgctgtgtaacattaagtctttaagaaaatgggtttagaccttagcaataaatgtgtgagtaatccttttagactgtaaagtgatttttgttctctgagatcgtctctgagattcttccttgacttatgtttttatagtgctgacttgctcatcagttttgcacagtggcaattttgggactgatttagaacagaaactccattggaaccccgaggacaaagtaagaacttacagtctataaacttagttttatattaaagatggttattttgattgatcttgatatgtttttcatttcatcagtaacaatgaaagtcttctggtagaataatcagttctgtattaaaattattttcttgatatggtagggtttatgtagaaccttccatattctcctgtcacctgtgatctgtagatattgtcaaaatatgaagagcattgcgatggcagaagagttttctgagaaattgactcccctaaatgtgggtatagtatataatatagccaaccgagatcatttatgttttgaatacttgttttctgaattgaaaagacatcttctcccactttttgttatctggaaattgattatggactctgcatttaggattcaatatagtggatatctgaatgtagatataacatctgggactctgagaatagaggaagaggaacatatactaaagaataaaatgagttcatctgttttcacaaaccacttggtggtgttttatataagaat

SEQ ID NO: 55467 - DNA, 1024 bp, Homo sapiens
agtaagcagaaatctgtattaattttctagtgctgccataataaaatatcaaactgggtgactgaatagaaatttattctgtcaaagttcgggaggccagaagtctgaaatcagggtgttggtagggttgattctcttattggaggctcagagggagaatctgttcctggcttctggtgattaccagtaatccttggtgttccttggcttatagcagtgtaactatatataaccaatcaagctagagccaagggagaatattttaatttcttgagtctttaaattttatttacagttaaattgaatttaaatggaaactccctattcccagcactgcagtccatcctaatcttttcttattgcactatgcttttcctatgacccttttcaccatcagacacactggaatttccttatttctgaagtttatatttattgtttatgtacctttactaaactcagagctggatttttgcctgttttgttctctaatggatctgaagatttagaacagtgcctagcacctaataggcaccaagtaaacatattattaaatgaagaaaataataaatgaataattcctattatattttcagtggaggtatatgaaatagtttggtattactataatccttaggtttaaactgagtattatgagagaaaattacttcagaaagtaatttgtttgtagaattggccgagcttctctactcagtgaatgtcctattgaaatctctgggttgtgcttttaaatgttgtgttgccaatgtgttctgagtttcttttattgacgtatttcttctctctatctctcagaaaacaaccctttttgctgcacatgtaagtggagctgtgcttacctttggtatgggctcattatatatgtttgttcagaccatcctttcctaccaaatgcagcccaaaatccatggcaaacaagtcttctggatcagactgttgttggttatctggtgtggagtaagtgcacttagcagtatccttcactgtacaatgtggctacact

SEQ ID NO: 55468 - DNA, 1019 bp, Homo sapiens
catggcaagggaggaagcaagggggtggtggtgccagtctctttttaacaaccagctctcacaggaatgaatagagtgagaactcattcaccacccccaaccccccacatcagtctattcatgagggatccacccctgtgacccagacacctgccattaggccccatttccaacattgaggatcaaattgcaacttgagatttggaggggtcaaatagtcaaaaccatagcactgacctaataggattcttggtgaaggcaggccagggtgattagacatcacttgagggatggtagaggtgatatatttatggtgatcagatactgagaatggatgattacggctaaactgaacaagattcttgctaaaattggacaatgcagagatgaacatggcaacccagaagtcaggacctagttgacaagaaagttcagaggaacctgagctgggtttggtgaaggacagaatttttgtcacctgacagtaactcatgtaattccactgacattcatgtttgctagatatgggggtgcagcgggtgtgcacaggtcagaaaaaatggaccctggagaaaatttagttttgctggacattagttcccagcagccactttatactatgaaaggataacaacaatttgggtggacaactagctagctgtctgtgccacaaatagagttctgccttccctaatcagtttctgtagctcattattaaaaaatgttttggagaatttcagtgtgaggatggtgattgtctgtctcttggtcaatttaacaatgtttctcatcacttttatggtaaacatgaatctccagtatttgtttacacagcccagcaaattccaatagcagttcttgatagcacccacacaagccgcctttccacttttatctcaattacttaaggtagcctatatactttctttattgttttgcttttagcttttattctaatttaccttcacaagagtacttatggccgtgtaattttgactaaattactttttctcttttgt

SEQ ID NO: 55469 - DNA, 1042 bp, Homo sapiens
aaaaagctgaaactagagtagtatactagcagtgtgtttcctttgggggcatttggctgatagcagaagtagagcacaatcagggacaggtgacaggctgctctctacccaaagcagagagatagaattcatatccctgtaacctcccaggcacatgcttcaatgtcaatgggtgccattccatggtagttgaggtaaatggtacctgtgtttcagggggtgatgttttcatagaataaagtttaagtatttccacttgaaattgtacaactcatggtattggagaagcaccttgccccacattcagccaggacccacaaaagtctacacagtcagtcataggtgggccagaaaaatgtctccctcctggcaaagggagatcacagagaaatttgttccttttcatcacagctccaggtgggggaataaagataccacctgaaaacttgaaactggagggtctgccatcactcattcaaggttcaaatttacatatctacatgatctaaaaaaccagaagccaagaaattaacataaagttggcccgggttggtaatgtgccatactgtctggaaaaaacaaatacggatcctctctgtaatgactcacccttagttaagccttttaaaatactcccagattttaagattgtccaatataggctcagagtcaaaaactgtaaaacatatgtgtaagggacagctaaactgacatagactcctaaggacttataggaatgatcagaaacaaattaacatttaaagagatgaaaaatgaaaaaattaaagatcttagaaatgattcaaaattatgtaaattaagaactcttgtcctggaaacctatgctggggaaagcaccaataggatttggcaaggacttgtcatgattaactgaatagatgaagaaaaaagatattgatgggatgttaaggactgacaaggaaaaaggaagagaaaagagaagattatgaaatgcaaatgtgtatatttagcaacaaatcagatggccagagtaaatgacaaataccaataaaaaatggct

SEQ ID NO: 55470 - DNA, 1050 bp, Homo sapiens
ctcgcgcgcctgcgacgcgggtaagggggctccaggctgcgcccacttccccgagctgccagatcccaccctctgacgcacccttctagagggagcgggctgcaagcgctggggcctgtcccttctcccctacttcgacttaccttaccagaccgactagcgctggccgctggcgccgaagcccctatgctaaaaggagacagggctgggccacggggcgcgctcccgagcagaccggccggccccggggcgcgctcacggcaccgaggagcgcgcctgcggcgctgctcgttcaaaccttgttcccctttacggcaatcgcgaaagtgtcgtgaacgtgctgccgccgatcagtcacccagtcggctggagtcggaggcgatatttctaggggtgtacttgttggggtcagggtaaggctgcggagcgcggtcaccggacgtgaaggatttgaagggcgttgtaggggccagtggagagaggactggatgctctggggcgggtcattaggatatagctgtgtatggactcgcgcgaggcgaacgccgtccttcttcctggcgcagggtggcctcgcgcgcggggttgtggggaggcgaggggcgactgcccccttgcccctctgtggagactgcccccttgcccctctgtggagacattggggtggcggagcgccggcgcgggagccggggggctgttgtgtgggagcccaaggtaggggtgggaagaaccgtggagggccagcgctgagcgggccgagggctgggagcgctacccgtgccgaacggaccttgcttgtcaggtccacaccctcctgcccgaatgctggcaagtccacacaccgtgtggcatcctctgccgggtttgtctccccttaggaatgcggtgctgatgtttgtggctgggacgcgcttctggtcagcaacttttctggaaatttcagcctatattgataagctgtgagattgctagctggcgtttatttcagcagcattcttgcaaggagaaataaccaaaagagttgctggtgtttgccagtattcccagaaa

SEQ ID NO: 55471 - DNA, 1044 bp, Homo sapiens
aacattactttaaaacagttttaatcagtacctttgtgatacagttgtgtgaaagaattcctcaaaatgtaagaaattagctttgatttctctccttgatttgaaatattaattttttttttttttaagacagagtctcgctttgtcactcaggctggaatgcagtggtgcgatctcggctcactgcaaccttcgcctcctggggtcaagcaattctcctgcctcagcctcctcagtagctgggattacagatgcctgccaccacgcccatctaatttttatatttttagtagagacggggtttcaccgtgttggccaggctggtctcgaactcctgacctcaggtgatccgcccgcctcagcctcccaaagtggcgtgagccaccgcgcctggcgaaatattaaatatttttatttcagggcatctcagttggttaaattgtggcactgatgagtctcttgagatttttgaaaatttatttaagggcattaacttgactataatgactattttctaaaccaaatattgagatacgtgattgacagaggttttggatgccaccttaggtcattagtaacattgaaattttggaatttgatatttatagggatataggaaaaaagtcctgttccattgtgttcacatgtccataccaggctgtggggtgagtgtccccctggctggtacctacttgtccatgtggttactcatgagctgagtgcctacatttcatgttttgtggcatgtgaccctgtgctccacttcccagaatgcacatgtggcctgggttcatagtcctctagccatggccgggtctcagttcagtgccttccatcctgggcagcaggagcaccatgttgcagtctaccacagctgcctctgggccttggcctggcttcactgcattccagcgctgcctcccctccaccccagacaggggggaacctgccactctcaggaccaccctgcaaaggcagaataaaccagatcctctcacagcaaaaaaaagttaaaagggacaactgagcatgttttgatagtag

SEQ ID NO: 55472 - DNA, 1291 bp, Homo sapiens
gtgcttaagttttgtaatatgaagggcatgcccaataaatgttagctattaccattaaataaaaatctagtttaagactcattgaagtcattcctctgatactaatactaatttgctagccttgggacctcagtttccgtatatgtgtaatgatgagatgatttctaacatttgttgcattatacaactgaaagcagtgtgggatggaaaaagaatatgagcttcaaagtcagacagactatcagataataggaagcatactactattaaagtctcttactattttttgcttaaagttgaggttatacactttcaataagaactagaaccaaaatcaggtccctccttttctggtcctgtttgatacttactactttattgacaatttgattttttgtttcctaatttgttaatattggcataagatgtaaatagtggccaacaagtgtattttttaatttttattttattttattttttaggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacaggatgtgtattaaataaattgtttcagttaccaacaccaccattgtcaagacaccaactaaagcggctagaagaacacagatatcaaagtgctggacggtccctgcttgagcccttaatgcaagggtattgggaatggctcgttagaagagttccctcctggattgccccaaatctcatcaccatcattggactgtcaataaacatctgtacaactattttattagtcttctactgccctacagctacagagcaggtaagagtttcttaacagatctcaacatttgctatataccaaaaacgttgtaattgggatcgtggggtcattttaactaaagataaagtaatctgacagctgtcaactattttaaaatatcacacacactgtgataaagcttgtaagtacagcctacacacttgcttattggaaaccagaagcaaacggtagactgtgatcctagtgcttaaattaatgttagcagggattaacatgtaaaatgttccttttaaagtcactaaatctcaattttttacaaaaaagtttttcatttttttaaatggtagaataaagtcttagcaaaaaaaaaaaaaacagtgagaaaactctctggtatttagtatggcatgactgtaaactagccttatcaaaaggt

SEQ ID NO: 55473 - DNA, 1040 bp, Homo sapiens
gcccaggctggagtgcagtggcgcaatctcggctcactgcaagctccgcctcccgggttcacgccattctcctgcctcagcctcccaagtagctaggactacaggcgcccgccactacgcccggctaattttttgtatttttagtagagacggggtttcaccgttttttagccgggatggtctcgatctcctgacctcgtgatccgcccgcctcggcctcccaaagtgctgggattacaggcgtgagccaccgcgcccggcattcttttacaattctaattgtttcagtgagttcttcattatgtagcacttggatcttctctcccatagcttccaactagctttccaacctgcaggtaaaaatatgttagtcaaacatggtaactgtgtgtctgaatactcttgcctttcttattttatttcacaggcacctctgtgggcatatattgcttgtgcctgtggccttttcatttaccagtctttggatgctattgatgggaaacaggcaagaagaaccaatagtagttctcctctgggagaactttttgatcatggctgtgattcactatcaacaggtattgttgatttttttaatgttattgattattaacaatggttaaaccagtgtgctaagcagtgttagaatacatgtttagtcatgagaataagtaattttgtattaaattttagtatttctcaaaagactatgaacctagttaatatttgttcattattggtagtgttaggaaatttagaaattactttctgcttgttatttttagccccaaatattgttttggcatcttttgtttttaaaagcttggggcataattgtcaccatcaaaactcttatgaactaaatgagagtacagtggtgggagactagttaggtaatttgtggtcttcatatatttaaatgaatgttatgtagacattcagaattatgttaatggacttggattataactacgtcataagaagctcagagaaagactatgacaaattaggagtatcgttaatattgcattgtgtactggaaa

SEQ ID NO: 55474 - DNA, 1623 bp, Homo sapiens
catttatatatatggcatgttttacacctcatatacaatttttaaaagaaacactaaagtgctagcaataactgagttactctgtttggattataagtgatatctctttatttgcactgttttgcaagtttttaaaatagtagtttattatgtttttagagaggaaaaagacacttaaaatctaaatgacagtttttcagctagtctttctgacaggaactcatccctcccctcttttatttttgttttatttagtttctcaattattttcttgtttgacatggcacttaaaatatttaaaaagaaactaacaaaaaccccttatagttttacctcctgaatccacatttacaggtataggtgcatatcaaaatcattgcttcattgtatcccaacagcagcttatttagtagaggaggagaagcaactaaggtcatataattttttaagagtcaaatcaagaaatactcaaaacttctgttgaataaatggtagttggctgtcttgaaaggcaacaaccagctgactgcaggatggcaggatggcaggcttcctattatttattttaaattgcagtcatttttgcgttgtagtttgaggtctagacttttataggaagtctttttctatgtatgtcacccataacaatatctgtttaaaaaaaaaaagacagttatcaatctgaagcaagtaagtcggtccgtctggggattatatagcccctttgtttttcttttttggctgtctgccttgtaatgatttgctgatcattagtactagtgtctctaagtcaggaaaatactcgaagaaatgttgaagtattttagttgccttcaagaactttgcttccactaagtgatttggtaaaaaaaaaaaaaaaaagagagattgaaattatggggtaagagattatgtaacagattatatcctacttttctgttacaatagataactgagagaagattatgcatttacagcatatctttttgtctcatctaaaatcatttccagctcagttgtttgctattcatattatttggttttcatcgtgatctttcttctgcagtttttgtggttcttggaacttgtattgcagtgcagctggggacaaaccctgattggatgtttttttgttgttttgcggggacatttatgttctattgtgcgcactggcaaacgtatgtttctggaacattgcgatttggaatgtaagtaatacttaatggtaatttttgttttctctttcacatatggagaatgttgccttataagtatttgagtattagaaattgatcaaatcactaagttagtttaataaattaaaaaatttatgcttcattattatagctatttcctaatagtctctgcatatgtccctctattatacttttttaaaaggagatatcagaacctcccagccagtattttaaaagcaatacaaaaagcagtagcccctcatctttgtctttcccacagaaaaattcactttttttccccaccattatttaccttaattccatttttattttcacatataaaaatgcatttccaggaaaaagaagatggtttctgagagcagcgccctaatccaatattaatttttagtgtttctactattttcaa

SEQ ID NO: 55475 - DNA, 1282 bp, Homo sapiens
gttttaatttttttaacttctatcttgatttggataagaactatgtatgtatgtataaggatagtatagtactgtataaattgtatcattccatctttaggtgtctttgcaagaagaatgctactttttaaatctatttttgttacctgtgttagtagggctctttagcaaaagttctgagtaaagttattttgaaatgtttgtttccttatgcatagattcgatgttacagagtcccagatcataattataatatgccagcttctcacaggaaccctggggccttggttctggaacttcacggtaactgctagaatattcatgctatctgatgtacaatggtgtgaattcaataaagacagcacctttgtcatgcacagaataattaaaacatgaaaaatcaaaagtcttcctgttggtatgtcacaaacaggttattagaaaacataattttaatatattagggcaataaaaatccaccctattaaataaaatttttaaaaagtggtatttctggtgatttgatgctaaagtcaattctcctgtttgcctattgtgcctattatttttattctatgtactattttttaaaacaaatacctttccaccagtaaatagaattttttttatatttctattttgaaaacagaataaagcaagcagagtttttcttaggtaaggaagttgagatgattctatattaatgtaggaaagattctgcttattctgttaacttctttagcatatactttaagcagtctagtactagttctgcttgagtttacagcagtcttggtgttgtataatatttatgctggaagctattctcatttctgtttgttttgcttaatgtttttcactcttagttgtgcttttgaaactaaatatccttagcttttcatgttactatagtcattctttgaatactttccttttttgttttgttttcttttcagtaaatacatatttctctaatgtactgctaaaagtaatgtatctttttccttttttttttttttaattgagatagagtctcattttgtcacccaggcaggaatgcagtggcacagtcataggtcactgcagccttgaaactcctgaactgaagtgctcctctcacctcacctttctgcactgtcacacctggctaattttaaattttttttttgtagagacaggtcttgctgtgttgcctaggatggtcttgaacttctggcctcaagtagtcctcccgcctcagccttccaaagcactggaactacaggcatgagccactgcattc

SEQ ID NO: 55476 - DNA, 1552 bp, Homo sapiens
tacaatgtcagtattagaatggttaagaaaattctgtcaaaagtttcaaatgactattctataaaacttgccctaagaatcccaatttgagactttgtaaagatcttttatgtttcctgttctcttttatattcatccatggtacaaagattaattgcatgaggttccctccatttttattttgtaattctatacttctggcccttccccttccaaaaggctacttcatatatccagcaaaatgttctaagatgtctaccctcctccacccaagacagaatcgatcatctttgacacctacctgcttagtctcctgaatctgctactgagtgtaattccccttattggcaacaccactcaccaggtcagctctacagattctttttagcctaattcagtccattttttttttcaatgtgtatatcaagataactacatcactgtatgtttgcagctaaataagcttctgtttaaaaaacattcttgggcaaacaaagacccatttttttttagttgcaagacattagtttcaacccagttatttatcacagcatgacagcttatgtatcttaaactcacattacagattatctgctttacatatttttagaaatggaggctctgttctgttctgggaattgaatccctttgctgttgttacctacttttagactaattacttttaatagataaattattcactttgttgaaaaactagcattataaaaaggtatacagtgaaaagtctcctcattcttatttcccagctccccagtttctatactatactccccaataggtagccaccactcttagtttgtaatgtgtctttccagaaatttgttatgcaattactggcaaaaataaaagtagaatattatttgtctctttttttacacaaaaaatagcctgtacacattctgcaacttattttcacttactatatctttgctactttttatatcagtatatagagagctgccctactctttttaaaagctgtaaaatattctattttatggaagtaccataatttatataactattccctctgagggaatttttttaaattatgctattataaatttataattccatagtgaataaccttgtacaaacatcattttgtgcaagtatatctgtagggtaagttctcaaaatagaaggcatttgaatccagtaatctaagaatgataatctcaaaattgtagaaggtgctaagtttacaagaggaaaggaaaaacagcatatgttttgcttctcaatctttttgcccatgttcttttttttcacactttcaggcttctaatttctgctgccctgttgtgcatgaggtttgtctcttcttgactgtaaaattattttcagcaaccccaaagctaattcttggctgctttcagtatcttctttgcagaagtctcagagtagttaacctagtaagaataggaatttgagaactggaggagttttttttttcacacctatacaatggcagacattaaatgaatatatctaaagaacagtaagttttacagagtcttagtgatttatg

SEQ ID NO: 55477 - DNA, 1028 bp, Homo sapiens
tctcataaagttattttatgcattaaaggagttaatatattgtgtaaagcacttagaatagtgcctgtcaaataataagcactcaataaaagttgttgctgctcttatagttttaatgtattctttcagatttgggttgtcatggtatgtactcccctggtcatcagttaattgccgatttctaccatcaccccttcagaatacagtatttatcattcatttggtgaaatcttaacaaagaaaagatttactagacctaaattaatgcaattcttaaaaatcagattaattttaaagtataagggaaatttactgagcaacatttttcccttacctaactcactttatgatggaaaattaggtgcttgaggaagtgtaattgatacactacccacagtatttattgccagaaatgaattgttaagtatcttttgttgggaagatgaatctgtgaagggggaggagatgaaggaataaaaataatccacagtcaactgggaaaattctgaaactattcagttatgtacataatatcattcagttatgtatcttagatttcactatagagaccctattggcttttgagactaatgtgtaggaaatacgaattttattacttttgctcttcagtagactagttcttttttttaataacagttttgccttatgggaaggaaataatagtttttgttttcctgaaagcagatcataaagcctaaagcttacccccattcctaaagtttttatatcccttgactatggtgattattatttttataagccttgtataccaaagttttccccccaaaattatttgtaatatgttgtacataaagtttcagcataccaatatccaaaaagtgggatttctggcttgattattggaaaacaagtcagtgtttggtttatacaggttaagtatcccttgtctgtaattattgggaccagtatttcagatttcagatgttttcaagttctacaatatttgcatatacatgatgagatatcttggtatcttgagataccaa

SEQ ID NO: 55478 - DNA, 1078 bp, Homo sapiens
atactttttacctttttccattatgatttatacatataatctacacatgtacatagtagatataattttttcttttataaagatcaaatgttttgtcctgtcttgtaattaatataaacatcctttttaaattatatgttttatctgaggaactctcagattcacatctgaaatggagttcccagacccagtaaactagcaatctaatttcaggattcatgaggtgaggttgcaacgggaaaacagattctccccctgccccttcatcctattgttagcactttggtcctactgttagcatcattaaaccaaaagggaacaacccgacttctctggtgatatatttggagacttagtgaaatattctgttttttcttttttaacaactcccaatacggattcccataattgaccccagatcactatattatttttttctttttacttagcattaagggttcattactgaatatgctgttttgaattgcattctgttaatacaggaacaaatactacatattgagctctcacatttttgtgtgccaaatggagaaaagatatttacttagggttcaggtatgaaatttacatctcttctgagattgaggccataaaatggaaattgccttccaaatcctcattaagttagaaggcttttactgacatttagaaagcaagtttatggtcagaacaaataaaaacagtgcagatgtcttcataaggctgattccagaagatcagctgttttgtaaaggtaagtgatttgcatctattacatatggattacccattctttcccaaattttttccccaaagagatgaatttttaccaaagattatagttattgttgttgttgtggttttccttttttttttttccaaaggaaagcagttgtcttcatgcataaaagtcagtgcttgttttatacattgcaagaaacaaaaagcatattttttgtttgttgcttccccaaaagacattccttttagaatgccttggaactatgttctatcatatcactctttaaaaaaaacaaagaagaatatattcttatttggaagagacttaatataatca

SEQ ID NO: 55479 - DNA, 1001 bp, Homo sapiens
tggtccaaaggaattcttactcttcccaactcttaaagacttgaaacttcaagcagacctgacataaagatgtctttggtatagctctttggctatttctaaagagtggatgcactttggccacctttgataagttccaagatgatgacagaaagaaaaagattgggaaagacagaatgtgcctgttctttttgacttgagggagagagagaatgtgccaccctccttgatcttaagcgtggggtgagaatggcaacactttgtgttttttataagtagtgccaatttttaaaggatcacctggtgagacttgggattcctttgactcgagcttttccttcactttgcctcatattttcttggtagctcactttctttttcattgctaatgtgggggctagatgtttcttcatactctcccaaaacaggagttctacatagaaaggaagagaaagggagattttaatcttcatttaacaaatgtgtattgagccacctacaataaccagggctctagagagtgtacaaaatcaattcaaacaaaatccaacactcaggagcttatgttttggtgtatatagctaacatatatgacaaaagtgatgaaaaccttaagaatctatgatactttgcgcctaggtcaatagcttgcttccttactttgtggtccaagccatgtactaattttcctggcttttctaatgtttgtgtttattcttctttcaaagggcaacaatttttatgatcccaaagcaatttcaccaaattttaaatacagttatgactctcattcagttcatttatgacacagatgactattatacagagatggtactcatttagtaccctggccctaatacagggctgtccctgtaatagaataatgctttgcttcttttggaatctgagggaagtatagtattttcccttttgccagagagatcttttgtctctatggagtcaaaagtgggaggggtgggaagagaggttgggaaccagga

SEQ ID NO: 55480 - DNA, 1054 bp, Homo sapiens
aaatgatagatattgtgtttgcaaaaatgcatgacatcaatccactctgtcccccatacttcaggtaaataaacacattttcagtatactttatgaatatattattcacttttctgaaaagtacatttaaacttcaaaattttgtatgcacaatagtagaatctgtttgaatgtacttgacctgttttttcttctgcattgtgaatgccttcttaattgccttctgcttttactagctgcctgtatcctaacaatttggagttgggaactcttctgaatagaaattttatcttccattctctatactctgcagatttttatatctagtcgcaacatttctattatgattcatacttcctcacaacaattatgaatgttctacagatttagaggtagaattcaaaaacatatacaaggaaaaaggcagggtgcactccttttattaaaaggccagaacacatcctggttcactgttgcaagaccactgggatgcattaggtgaatctaacttagcttgtgacacaagttaataaagttgaatctggtttttttgttttttttaaggttgatggctgaagtgagattaatttctaaatagtctcaactcttgagacttgctatattgcttataatgaagaggaaaaggacactttcattactttacgtatttatgtaattggagggaatggaaagtttttgggaatatgaatcaaatattagactgttttcttattttagtttgtatatgttttaattgttttctctctctacccattaaagattccagtgctgaatattcaaatgaaaatttttcctgcactttgtactgtagcagggaccatattttcctgtacaaattacttccgtgtaatcttcacaggtggtgttggcaaaaatggatcaacaatagcagtaagtataccttaagattttcaacacttgtttacactaggacttggttttgttgtcattttgttttttatttcaaatgtataaaatcatttgttaatttataatttatacttagcctttaaagaaactaatgttcaaaact

SEQ ID NO: 55481 - DNA, 1540 bp, Homo sapiens
cttattttgatgacccagtcatgaaagatcgttcatataattgtaatgatttggaatgtcagaaatccacataaatggggctgtgtgagagttctatggctttatatttgagccttttattttttgcattaatcttactagtcctgcctacatcgggcagggctcataaattgcaaatttctgactgagtagaaaagcatgaatcagcatactacaccctgtgggcccatagcctgttttggtaaatacagttttattggaacacagctatggccactcatttatatattgtctgtggctggtttcatggtacaatggcagagttaagcaactgtgacaaagacaataaggcccataaagcttaaaatatttgccatctgtctctctaacaaagagtttgtatgtgaaggaaagattgcaaggaaattgaattattttatggaatggaaggtgaatctgtagagagaacagagtccagtcctctttactttcaggaagcttagggagagcctaaacgggtgctgagaatgtctcttttctttccaggttttctctttctttgatttgatccgctactgtgtcagtgtttgcaatcagattgcgtctcacctgcacatacatgtcttcagaatcaaggtctctacagctcattctaatcatcattaatgatgtaattggtatataggaacatcatgttttctgcaggaaagaaagtaacatattaaggagaatgggggtggataagaacaaatataatttataataatcaatgttgtataacttttattctttattattggtaacacgccctaactatcctgtgtgagaatgggaatttcaagtcccatcttgtaaattgtatatgttgtcatgcagggtttgggccaagaaagcatgcagaaaaaaatgccatgtgattgtaattatcctggattcagaataatactgtgatggggagccagatccgcagtggtggagagttctaatgttgactgtttgcaggccaaaagatgattgctttataattttaacaaatcattgtcttttagtaacatccttgtttagtgtcttctcaagctttctttactgaggaattcagcttgtgacacagatacatcccactagcttgtgaggtggaactagtaataaagaccttgaatttggattgaaaagtttcctatctttacattgttgaggaagtccttttttttttttttttttttttaattgctcaagaaatgattctctcacaggcttgggaaatcctgttagcatgcagaataatgtggtaactttgtcaatttcccattttatttttttaaataaatatatgatctaaaagccaactttttctcagttttactcagtggaaagataaactaagttttaatgttatttttttaaatttaagcaaaatttatttctgttctttaataaataagaaaatgtggtccactgcattgttgtgatgtgtcttgtgacatttctattttgtagaaactttaaaaaggagaactatgttcatttttcctgtcaatgg

SEQ ID NO: 55482 - DNA, 1114 bp, Homo sapiens
aactggttgccagatgccaagcattgggaagatacaaacaggacaaggtccttcacctgaaggggatgcggaattacatactggttgaaagcacagggattgaaatcagcagaattaggaggtttaaatccagttcttctacctttagctatgaggttcccattaagttagtttgttaacttcttaaaaatggaaataatgattgtgattacctcataaggttgtggtgaggattaaatgaaataatgcacattaggtacctaacaccctgctgagcacatattgctgagtgctagcttctgttcttaagttcacagttgagtatatccctgtgtatagtggaagcagggtactattgtgccatggtctctaccttttaggggcttcagatctgagaaggacgtggggagatgtaatagaatggagaatgaaagaagtcataaaacagtaggggtaggggtagaccttctattcatatctggggagggagaaaaccagtgattttaggttgacaaccctgcttttatcttttagggaagaagaaaaggatgttagggactcaacagaagtcagaggggcaggtgaatgccatgggtttcagaggaaaggaaacttgggcaagcagtggggtctctgtgttgaagattctgtaaaaatgggtgataaccaaagaggaactagttgtaggtaatccttgaagggagtggcatcatcttttgctttggaaatagctctttcactcccagccttgaatggaaaccagaaattcctgtgtggctagagctgggattctgcctttcctcctcagatcagtgtttgggaagtggaggtcggcaggattcacctctcagacgtttactttcttcagggaaatcccaccactccccacttccttcccacactgagtttttcagctccctgaagctcggacagggaggggacttccagtcagctagcctctcagagactcaattttgctaattcaggaagtgccagcttgaaacccagaactgaaacaaggattcccgcatctgtgcttttattggccttgactttgaggcaatttggctggagtaaagaagagccatgaaagccaggggataaaagagaaaga

SEQ ID NO: 55483 - DNA, 1056 bp, Homo sapiens
atggacaggaatgactagacgggaaggacttcccaggtagaggacagcaggtacagagggacagggtgagtactttaggcagtagtggaggtgctgcaagtctctccaatctctgctctgcgctggatggatgagggtgtttttctaacccaatgaagcatttttatgagtgctggcatagttgaaacaatgttcttgaagggcaaagaagctttgatagacagaccctttgaagcaccaaaggagaaaaggaatggcttagacattaacttctgcagcacagcttgcgtacctctacttttttgcagcatatagtttttagcacaatgctgggcactcagtggacactcaaatgcttaattatttatagcaacctagttctccctgccttcaagaactttaaatctactagaagttcaggtgctagtttgagaaccacctatatggggcagtctgtgctgggatctaatgaacaggagagacttgtttatgaaaacactttgaatgagatacagatttggtcaaggatcatgtatgttactcttactattttggtactggcattatacccctggcttggtttcttaaggatgtcatccactctttggttcccttttttccatcatggacagtagagagaggaaagggtaacagtaggaatttattcaaaatagagaggaactcatttgtgagtggcctctccattctctctttggtttaccttcttctcattcgctggttagggattcttggattctttatccttgggcaaggaacaactgtctcttggtgcttatctccatggcacttcccagaactaacctggtggtcctcttggcagatttgttcctttgtctggggagcgaagaagcactggattgattaccagtatgtcccgtatgccaacaaggggaaagagtgggttggctatgacaatgccatcagcttcagttacaaggtgagaccctggctctttcatgctccagcacatggtttcctaccggtttctatggggtccttatttgtacaatgcatgtatgtgtattgggtggagag

SEQ ID NO: 55484 - DNA, 1057 bp, Homo sapiens
aggcctgggttagaggccgtacttgccttgttgccttaaaggcatgagatacacgagagggaggcctggtgggctgggagtgtgtgaggatgcactttacaagatggaggaaagattcagggcaggggggtgagaactagctctgcccagcccaggattcacctcttcccatctctgaacactccctgtgctccagatgctgggctagggctgtacacgcattatcccgtgaacacttgcaggaagctttacaaagtggttgtattcaaaattggtagagcagaaagcacaagtcacagttattaaggaacttgccagatttgtcacaggtattcctcagagattgcccagcaaggaggtgggaaactgaccatggaacccagatctatttatgagtctggttaattttttaatcatggctcatctcaggattaccccagagttgcttaaagttcaggtccaataagttagaatttttccaaagtgtcatcactacggaagagaaaacaagtaaaatagaaaaatatcaaacaaaaaacgaacaaaagaacacaggatcaggatcccgttatcagaacacaggcctcttgtgccaagttatacagcccaggcccagattaactcatagatgtttctggacatgctggcccttgactcatgttctctcccctaatccagtcaggtagaaaatgtcagtgctaggacaggttgtgggaattgagtagttacctatgaggagacagcacagagaggggcagtgccttgccagtgggcataccatgttttgggggcagagctggactgagccatttctccacaccccaggctgcatgcttggttctgtgcctgctgttccctgtgccgtctggccttggggcagtacatggttttcaacttcttttagctgcctgaattccctactcctgggtattgagctcctggtgctgggagaggcatataagaaggtgggagagttttggaaatctgccttcctttcctccagccacatctgccaggcccaccacagggaaccaagcttgcaaggggccttgtagga

SEQ ID NO: 55485 - DNA, 1002 bp, Homo sapiens
gaactcctgacctcaggtgatctgcccgccttggcctcccagagtgctgagattacaggcatgagccaccgtgcccgaccagaaagcatggtttttgaaggaccatattttattgtaaaaaaatgttttggttcagatagatgtgtgctgatgggagtaattcacatctatcagtgaccaccaccaagatatttataaaccttatcaaatacagtaggaagagcaaccagcacaattttggataaatgtatatgttgcagtgaacaaagaagatagtttaaaataaaagatgaccacagaataattagaaatggtactgtcacatatggagtgatttgctacgtccttcacttgaggatagttctagtagagtgagtgcagagctgatgacaagttgaaatgagatcaatctatttgtttaaaaatatacaaatattttgcatttaatttcatcggttaaaatgtctaaacattagagtaaacccatttccctatctacatccttactctgaagtccactaatcaaacctactcttccacagctgttctctggtccaccaagggctatgaggctcaccccttggatggtgctcagaaccacaaggaatactgaagaagccttgcctatgatttcaggtggcatcagacattgggctaattttcaaggtgtctctccttcccaacaggacagtcggagtctggttctttaataaatagctatatggatcttacttactggttcacaatcatattacagcagcaaaaacacccaagctctaactgctctgggcctccagccatgtttcctccagatagcatgttagaaaggacaggagattttaaaaatcagattggacttcagagggctccaaattttcttgccacatctagacctgaaagtaaagagctctgattattaagaggcagattctcgttgcatttggacagcgtgagtaatggtcacactgaacacattagaatcagttgtgaaattgattttgt

SEQ ID NO: 55486 - DNA, 1730 bp, Homo sapiens
acacacccaaaaaatgtgccccagatgtgttgggttctctttttttctccaggtctgcttttcttgtctctactctgccccgactttttttctttcttctaggtttagaagccaagcccacagagactttgtgagagatgcgacttggtccccgctcaatcactccctgcttaccacagtgggctgggaccatcaggtcgtccaccacgttgtgcccacagaacctctcccagcccctggacctgcaagtgttactgagtagattggatttaagacaaaaagcaagtcccccatgagtgtccacttctttgccctgccctctcagcttgtgagacaacacaggagccttctatagtatgttgatatgctagatctgtgccgttaataggcatcgtctctcagcctgagggaggctggattctgggttcctgtagtcacagggaggaaaagctttcttaaaaatggacatgtatgtgcgtgtgagtgtgtgtgtagatttatagtttttggtagtggcaggaataaaaaaaatccatcctacatcttccctaagcactgcctctctctcaccccccaaaacaagttgacgaaagggttttatgtagctgtctatgaggaattggccgtgtctgggtgggttatgggatgtgggcatccctgggttcttggaagcagctcttatgctactcatagagatgggattgactttatttttttatagtgcttaattcaccattatgagaaatgcttccagtcacaaaaatgcagcccagctcactctgaggaagaagcaggacttggtacggttttacacaactccttaccattaaactgaatcagaaatccattttctggctgaataaaaagtttggcttgcctgtgtaatgcccactcccttccccctggctccctagtgatgggacatatatgagagagaagtgtttttctatcatagacaccataggggaaagtttggggatgaaggagagcttaaaggtgtttcaattaagttagaaaactgacacaggctgttgagaattctttgccacttttcccaccccaaaacagcatggggcctgacatcttctgccctggtcccctttctcttgatgtggaaagtctgaatgcagtatttatagacttctaaggttttaaaatccagtatcaagaagaaaatcagaaatactggttggtgaaataaagagtttaggcattgttggcctgtcttttttgaagcatgtgtgttatgtgtagttagatatatttcacttatgtgagtcatcatggtgttggtcttgtagcccattatttttcctgtgcttccccagcttcccaaagtagctagttagaacttaaggtaaatatttattcttgggttggtggagtggatattgccagttaggagtcatggatcaattactgattatattgaaagtaaatataatcaattatgtacttttgagctttgcaggttcaatttaggtaaaaatcacattatgaaactgggaaagtctgaaggaatatgggcaaaatatttctcagtaaagcttccatgcttcacccttgacatgattacccttgagtaaaacatgggaatttgtagttgtgtgatcctctggcgttgatgtggagtaggaataaagtcttgcatcatttttataatgtgggaggaaatagaatgggtaggtacaatcacttaagttctgcctctcgaagataaaactttaatt

SEQ ID NO: 55487 - DNA, 3009 bp, Homo sapiens
tcatattttttagttctcattattagacagaaacagagttaagtcacagagccatacttgtgtttgtggtgtgactgaaacaagatcagcccccttcattgaattttacctagatgctctttctttttgctctttggttcttatggaaaagccccttttgtcccttagtttagaacccttatatttttatacccctgagcattgtagcgtggaaagatctgggatgaatgacaggtatgtgttctttctatgaagtgggagaagagtgattgaaaacagaggcagttcaattttaagaaagagaacattagagaaattggctctcttaatactattagcgcccagaactccctcaaaagtttttgtatactacttggaggtgtgtgtactccagtatgaagactgctattctagaattatttagccctcacgtctaggatgcctaaactggaaattcctttgttattcttactaagcccctaatttctcattcattatcttcactaatacgttttttttttacaaggctttttaggttttataagtctataaacttctcctcttagcttttgtctaatccataatctcccacaaaatttgttaaattgcatcatgagaccagccctccctccctcctgccccttgattattcctgggctggccctctagtaatgcttcagcttgttttctatcatatttctctttctctctcctttatagctcatgctgctcaggtcacttgtgttgctgcctctcctcacaaggactctgtgtttctttcatgcagcgaggtaagagatagctccttcttccctaaacacactccagccatccataggccaaagtctctagtggggagactttctggcctgcaactgctcctttggattatgaaatcctttttctgttccaccttcctctaggacaatagaattttactctgggatacccgctgtcccaagccagcatcacagattggtgagtctgagattcattggtgggagaatagtacttggaaccctgatagaagagactgtctttggccagtgtcaaagcatagttgctagatgcccagtgtagttactgtgacatgagtgacataatctccttcttttccagtgaggctctgctaaccccattctgtgcaatgaataccaagaggaagggccagttcctgggtgggtgatttactttattagatggtaggacaaaggggccagaattgttatcgtcatgattcgtgcctgaaacttgcctgtgactcgtgtccagaaagggcaggaggctgctgggataaatggttatgaggctcaaggatgaggacactgctgccttagcagggtttgggaaatcaaataaaggtgctcccaggatttagagtgatatcatttgagaaactgcttcttctgtactctgagttttggtccagaccctcgtctctcctttgcaggctgcagtgcgcctggctaccttcctacctcgctggcttggcatcctcagcaaagtgaagtctttgtctttggtaaggcagcgtgtcagacttcatattgactctgggaaaggggaggaggaaaaagaaagagctgactccacaacacacaaggcccttgttgctcagtcttagccctcatggacactagatgaattatgaattgagggtggggaggtggggtgatgccaacgtagttttagtgtagttttggagaacatgattattttcccagtggatttgatttttgattgattgatccagcttctgtattctgggcatggctataagtcagtgatccacaaagcaagtggattgctatatagcgaattctgtcctactgtgggtaggtgtagcgctatcgtggtcatgaggctgtgtatatggtgacatagtttgtggttaaaataataactgcttcgttcattaacttaattttcacaatgatccagtgacttattattcctactttgcaaaagagaaaactgatgctcagaatggttaacttttacaagctcgaggaactaggattcaagtctttggcacaaaagtccatgctcttaatcactatgacatgttccttctcttctacaggtgatgagaatgggacagtctcccttgtggacaccaagagtacaagctgtgtcctgagctcagctgtacactcccagtgtgtcactgggctggtgttctccccacacaggtactgttctttgtcatcaggggcctgatgggtataaatgggaaccgtgagggtgtgtgtgtatgttttcaaagcattagctgatgaagtagttccttaaagcagacagtgttctagctgaggtttcggaacatcgaagatctcttaagtgtgaagtagaatcctttgggagtcaaaggatttttcagattagatggtttctgtctgaaatggctaaaatgtgatttcattcctgcccaacacccaaaatggttaatgttgtgggcttctaggactgtgagattggaaaagcctgtgtttctgggttattgctgaagctatagagagggaccagatggggtggttagttgccaggatggttgtcaaccctaactttgcttcatttccctcatctttacttgaaacttttagtgtggacttgtagtagccagattagccaaaagtgggaatcaggctgcctctcctgggtcactttacagtggcggcagggccggcccagttaaggttttgtcttgggatccaggctggacctttcacaaccctctcctccatctgatagtgttcccttcctggcctctctcagtgaagactgctcacttgctgtgctggactcaagcctttctgagttgtaagtgtgaagtggaatcctttgggaatcagggaaggggagcagtgggtgggcgagtcattttcctcttcagaaaactgtgttgtgcttttggagaacagattctccatctgtatccgaagggacttggtaatggaagcaggctggctgttgaccctgtccattcctggggcacattcacaaccccaa

SEQ ID NO: 55488 - DNA, 3467 bp, Homo sapiens
gccggaaagcaggatggagccatagaagcaattctcgcgagaagtagagttgcggttccctcgggagaggggcggaggctcagaggtgcaccacgtggggtttgctgccggagcggagtctccggccggcgtccagtttgagtctaggttggagttggaaccgtggagatgcggaaggaaaccccaccccccctagtgcccccggcggcccgggagtggaatcttcccccaaatgcgcccgcctgcatggaacggcagttggaggctgcgcggtaccggtccggtgagccgagatcccgggcctgggagctcccttaccccggcccagggcgcccctccccggagactgaccctcccagcccatccccgccctgcatgttatcctgaccctgggtcgcgtcaccgagctgtccccagccctgccccgcgttcctgagctcagatccagacccggccggaacgctgttctgtgcggtctccatggaggcgaacccttctacccttcacgcgctgacagcttgtaccccccgtagatggggcgcttctcctcggggcctccagcctgagtgggcgctgctgggccggctccctctggctttttaaggacccctgtgccgcccccaacgaaggcttctgctccgccggagtccaaacggaggctggagtggctgacctcacttgggttggggagagaggtattctagtggcctccgattcaggtgagtcactatcccattatccacccccacccccgggtggaacggtagaatggagacttggggtaccgtagggttgagctcaatatctaacgtcctatactcagtgcttggaggagcctgagagtgttggccccgaatgcaaactcttgtgtaggtgggaaataccttttctaaaattctaaattgtctggtgagatttcctagaaaaatccgtaacaaaattaagcaacggattggaaccatttttcttctgtgtaacctgccccttaacccccacagcccagaccaagcataatcttgattttaagatgacattgaagccaatctgtgctacatgtctcttcccatttcttaccgctttcttgtcttcattctgctttctttttgttgactgttaggcttagcgatgcaggctttggctttttttttttttaaaatcagaatttggaagttggccggcattgcatggaagtttaaagtcccagtttttgatagatttaacctctctgacagttgagcttgaacactacataatcaagacaacttttggcggattctctatacttaaccagtcactgtgcaagacgttcaattattcaacatatttttaaagactctgcaagacatttattcaactagttcagcaaatacttactagtgtccaaatattggggaagtgttaacatcactggatagtgtgctgcttaaacagttgtggaaacttcatccttgtccccttgcagctcattttccatattctctcactaaaagcagataatgaattttacagactgttccatctttgtctttttctggaagctttctgcacctacttgtctgggctgtcattaggaaaacagtaacgcagaataaagtcaaagactcagaaattagctgaactctccaatgatgtggactttgcttttacaggaataactaacttactttgttaatttagtgacaatggctctttgaatcctagaagtgaattactgccttggtataatccaagctcatgttttccttaccctacccccaacaggtgctgttgaattgtgggaactagatgagaatgagacacttattgtcagcaagttctgcaagtatgagcatgatgacattgtgtctacagtcagtgtcttgagctctggcacacaagctgtcagtggtagcaaagacatctggtgggtccctgttctcattgctcctgtctctaagcctcctgtgggtgcctttcctatcctgttaacctcattaggtaacattttgggcttattctaagaatccagtgacttattttagcatgtctataaggtttccttagggattttgcagtccatcgtaagtagaccatagcagcagtccaagaggcaaagacttggggaatgttgattacaggaagttcttgtttgaacacgtttttatgttgatagtgtaggtcaagattaaatgtctgtttgcttttgcttcttagcatcaaggtttgggaccttgctcagcaggtggtactgagttcataccgaggtgagtattctttcatttttagccctggtgttagctgttgtgtttttggactttttgaactttgctttgatgttaggagcagcaattccatgttctgatagttttcttgtaaaacaatagtcaggctccggtatctactccttgtccttttctcaatttccttgtttctttctttctttttttttaattcgactagtcaagtgcagtagtgaaaagggaggaaagaatagaacaaggagtttaatctgtaactgactgaacaatcaactgagataactcactaccttcagaccagccagtttccctgtttctattgatggcctcaccaccttggcaacacagggctcaaactcggtccttttccacctcttctgttttcccaccatcggttggccactaagttctttttagtcttttccactggtcagtcaccttcctgtccatttctatgcccgtattcactttcaggctttaccttacacaggcagtggcactcatctctccactagcaatctagctcttttggtcttttattagtttcttgtggcctgtggattaaaatcccattttcttgtcatggcattgaagcccttttactccatttcctctcttcaagcttactagatccttgacattcttgagggataaatcttgagacttttaaatcttgaacttttgagtatttaccttcataaaatgtctgttttctggtgagaaccattacttttttaatgcccctctttctgctcactttcattaacagcactagtagttaactttatcttgggagccattctttgtgaagataatgtctagagccttaatgtgtacatggttccaaggtttagatgctgggggatcactgtggttctctcaatggctaagtgcctttccctgccatttctaacttcaaagtacatgactaagttataggccagagaaatcactgactcatatccaaggtccagtatcctggaccctcagggtcacttggaaatagttttacaataatgttgaatgcccagctgtgcgcagtggcttaacgcctgtaatcccagcactttgggaggctgaggcgggtggatcatatgaagtctaggagtcagagactagtctggccaacatgccgaaaccttgactctaccaaaaagtacaaaaattagccaggcgtagtggtgcacatctgtaatcccagctacttgggaggctgaggcccgagaagtg

SEQ ID NO: 55489 - DNA, 2291 bp, Homo sapiens
agcctgggaggtggaggttgcagtgagctgagatcatgccactgtgctcccgcctgggtgatagggcaagattctgtctcaaaaaaataaataaaataagcagagagaccaggttttgtattgttaaactaagcaagaggtgataaggacttgaactaaggtagctagttagggagacttgtcagcctaagcataccatttagtgctatgatttaaatcagtgcttcttagcctggggtggtttgcctgcaggtgacatttagcaatgtctggagatatttttcagtgttaccataggatgggtcggggagggaggggctactggtacctattgtataaaggccacaaagatactgccagacattctacaatgcacagaacaacctcttacaacaaagaaatatccagttcaaacgtcggtagtgctgaattgagaaaccttgatgtaaatgaaggaatctcaagcatgattctcagatttcaaaacctggtggggtagctaatatatttggaggcagaaataatattcaaaagataagcattgtaccaaaataaatgaaataatgtaaattcttatattacaaggagatagaagttgagagattggaggaatggagggtaggaagtgggacagaaatacactgaaaacttgaaggagactaaatgacagcagatataaagggactagattttatttcatcagaagcttaaggagacatcagtatgctgtaactgttaaaagtgtagtcttaagctgctttaatacaagaatagtttccaaatccactgttgataatagttcaattgttcaagctcagtactggcaatagtaagttctcaataagtatttgtaggatgaataaattggccagactatacttaaagtattatattcagttctgtatacctcattaaaaaaaaaaaaaaaagataaaaccagagaagtccttacgggcaatcaggattgtgagggaacagatgtttgacccaggtacatgtgtgttatcttacatagaaaagcaaaattagaactaagaatggattgaggttccaagaatgtatgtatcatctcaattcaaagatgaacataattagagctacccagtactgaaaaagtctgttacatatagtgtttagcactctcatcaaagagagtattcaaaaaggtccaggagcttacaacatatcaggcatataatagctaaccacttacgtagaacttttccatgtgccaggcatcattctaagcacgtcacatatattaactcaattaatcctctcaacaaccatataaggtattatcttctatttccattttactgagagaaatctgagattacaaaagcttaagttctttactcaaagtcaaggagcaggtctaggatttgaactcaagatgcctatctgaccgccacgtccacattcttacatatttcagtgctaatgatagacatacaaagtgctagacagatgatctgcaaggctgatagaagggattccagtattgggtagaaggttaaatgtctgtgattaattctttgctgttgtcacagctgattactggaccctaaccttcccattcccagtccattctctttccattatgagagttagaaaactgcctcaattatcaaccctatttattgtttctgctcattattcatacactgtattctccttaaagaaacaggctttacatttgtacaattactacctgtagggtattgcaggcaacaaggacctttcatacagggcagccacaccttgtccctgtaccacctcttcctgaatacggaggaaaagttcgttatggactgatccctgaggaattcttccagtttctttatcctaaaactggtgtaacaggtgagcatttttgcctagtctctggtaatatgttttgatggcaccactaaaatcaagttaggtgggttttcttctttggtttttgttgttgttgttgttgttgttgttgttgttttttgagacagggtattactctatcacccaggatggagtgatagatcacagctcactgcagcctccacctccccaggctcaggtcatcctcccacctcagcctcccgagtagctgggacttggcgtgcacccggctcatttttctatttttttgtagagacgggctttcaccatgtagcccaggctggtctccaactcctgggcttgtgggatccacccatcttggcctcccaaagtgctgggattacaggcttgagccacccgcctgcagccgcaagtcagctatttttaaaaggaaattgtaacaattg

SEQ ID NO: 55490 - DNA, 2653 bp, Homo sapiens
ttgtaattaggtgctacaggaattgagaatcctaatatttattcatccttttatatacatatcactttgtagttgttttttgcttgtttcttgtgtaaattttatccggtctagtgtcccattcgataaatagtatattttgctggacaaattacttcagaaagttatctgacatctttgtagaatagtttaatttactgtgcggggtattgtgcttaacattatttctcaaatttatcagactgaagaaggtactgtccccattttacaaataaggaactaaattcagagattatttagattgctcagtttctttaaaattgtagagtcagtatacagatttccctgagtccatatctttgttctttcaactctaccatactgcttcccaatccagtgttttgtctttgaatctaattaagtcattactttgccttcagctaatcaaatatagaagtacctttctatcttccctcttttaggcatagcatatcccttcataaaataactctttcttcttttaggaccctatgtactcggaactgggcttatcttgtacgctttatccaaagaaatatatgtgattagcgcagagaccttcactgccctatcagtactaggtgtaatggtctatggaattaaaaaatatggtccctttgttgcagactttgctgataaactcaatgaggtaagaaccataaactttatttcctattttagactagcagaaacatgaaggtcatctagtgatatttttgatatgagtgttaggggagcaacatatagaaatgaatctaatgcttcaaataagtgttaacgttagttactaatttgagataatttttttatatctactaaacactttagcttttctatagtttaatcattcaaaagatattctatagttattatgggcaattctttttaaggatttgtgcgtttctttctatgtttctttgtgggtgtttttacaaatgagatatacaactttgaagaagcatgaaatgaatctcctttttttaccctttgtgctttcactgatctttgttgttgctatcacaattgtagcaaaaacttgcccaactagaagaggcgaagcaggcttccatccaacacatccagaatgcaattgatacggagaagtcacaacaggcactggttcagaagcgccattacctttttgatgtgcaaagggtaggtttcagaagtttctaggaagaatgaagttacttgttgtgtgcatttttttaattcagaattttttatgaagaatggttaaatagattgaacgtattttatttagaaaagagaagatttgtgtaggagttggcattcacggctattcaaacatttaagaactgtcaagtggaaaaatagttcaaattattataaaattagaatctatagaagctattaaaaaaaattttggatccacacaaaatgaaatagtcattaagttaaagctgatttaaaaatggcatgcactgtgtaaggaagactaggtaaaatacatcctgtgtatttcatacacacttgctgcaagaacatcttaacatctttgctgtaaggaaatctgatactgtacattctaaatccacaaagcaggcagggcacagtggctcacacctgtaatcctaggacttgaggagggtgaggcagcaggactgcttgcacccaggaggtcaaggctggagttagctgtgatcccaccactgcacttcagcctaggcaacagagcaagactctctcaaacacacacacacacacacacacacacacaaacaacaaattcagatagcagtagagctttttatcatggtcagaacatgattagattctaaaatatgcagcttccaaaacaatctttaggaatatgttcaagtattttgttattactgtttttattttgagccttgtactttatggctaatatttaaaagtgaggtgctgttatgttgaagttttatattaaaatgaaatgaaaaatgagatgctaaggtagagtaagcatctgaaatagttaggatcttggccaatatttctcaatattggccaagatactaagcatctgaaatgtttaggatcttggccaatgtggtcttggtaccacatggattagagttatctttggtgttaatttttttgtccctttccaagacttatggaatcagaacctttcttaggggctatccagaatctgtattattttaaacaagatccctaaagactcttaagcacatggatatttgaaaatctcagaaaatgttaattccatgtatatttaggttacaaagggagaatgcttcctgcttcttgcatagtatatacacacacgtgaatgcatgcatacatatattttggcttttttaaaaaaccatattggaaaatgtagctttttcctaagagtcaaatgatagtaatttaggtttttatttatttacatttacttgatagatatttattgagttcttcctgtgtagatattctgatcaaggcagagtgctgaaaatatagtggagaacaaaaagcttctgccttcatggagtcttattttctagccagcctttgggagaagcacagaaaataaataattgaacagatgcaaatgtcaacaggtaataaatgccagatagaaaaataaactagtattaaa

SEQ ID NO: 55491 - DNA, 2643 bp, Homo sapiens
aaaaaatgaattatagaataccagtatagtggaatccagtgtaacttaaaattgaggtaggtttgtgtgtcataattaataaaagtgatgtgtatatgcctatattttgatgggtatacctatatttttattaaatatttctgggagggaatacaagaaatacaggaagttaatggcctatgggggaggctgaaggagacttatttcatacagcatcacttttaaatatgtttttgccatatgctgttataatttctaggtacatattacctattaaataaaagaatttcacgtaaaatacaaaagaagtgggcattctcactggcagaatcttcagagtagaagtattccttcaagtatacaaacaatatttatcatttcttaattttgccccagaataacattgctatggctttggaagttacttaccgggaacgactgtatagagtatataaggaagtaaagaatcgcctggactatcatatatctgtgcagaacatgatgcgtcgaaaggaacaagaacacatgataaattgggtggagaagcacgtggtgcaaagcatctccacacagcaggtacacaacatttttgtaggttctgatgttgtactggtatctcttaacaagtatctgctgatgttttgttaaggtaggaatagctggcaaggagtctttagcctagaagtagcagtgtaaccccggtttgtttttctggatagtgataagcaggaagatgctgcatacctgtcaggatggcttttctctttccttaaatttgggtaacattaactgatatatttaatttctctataaaatagactgggctgggcacggtggctcacacctgtaatcccaacactttggaagggcgaggcaggaggatcacttgaggccaggagttcaagaccaacctgggcaacatagcgagatcctgtctctacaaaaaatttaaaaagtagctgggtgcggtgacaaacgcctgtagttcagctactcaggaggctgaggtgacaggatctcttgagcccaggaagcataggctgtagtgagctgtgattgcagtattgcactccagcctgggtgagagagcgagaccctgcctcaaaaaataaataaaagactgaacaaggctatttctaagccccttccattttctaattccatgacattccatttcttcttttcacctgcataacttgtctgttttgaacggaaatgttttctatttgcttaaactgaattaattttttttcatttatatttttgctttaatatgacttgattttttttttctttctcgagtttataacatttaagtatttctggttgttttcagcataacctatacaggattagaaaaacagtgtctatcaaagttttttttttttttttgataaacttttacataaaagtaatatatatgcttacttaagaaacttagaaaatacaaaagaagtctagaaaagagattaaaaattattttcattcttaacatttatatattactaatatttgttgaattggtctttttcaagcaactgttggttgtacaagccaacatcagtggcagatggttacaggaatatctggcctcaaattctatacaggtttcacccataaaggctgtgagccagggaattttaactaaccccctggatttgcttaaaataaattatatctcctctgtgttaattaattttacttctaaacctgtctagtagctgtatagtgttaagccagtaatcatcttgaggttctggtctggtaggaggtgtcttttagaataatggtgtttatactctatacttttctatgttttggaaaggtctaaccagatttctctttccttatcacaggaaaaggagacaattgccaagtgcattgcggacctaaagctgctggcaaagaaggctcaagcacagccagttatgtaaatgtatctatcccaattgagacagctagaaacagttgactgactaaatggaaactagtctatttgacaaagtctttctgtgttggtgtctactgaagttatagtttacccttcctaaaaatgaaaagtttgtttcatatagtgagagaacgaaatctctatcggccagtcagatgtttctcatccttcttgctctgcctttgagttgttccgtgatcacttctgaataagcagtttgcctttataaaaacttgctgcctgactaaagattaacaggttatagtttaaatttgtaattaattctaccatcttgcaataaagtgacaattgaatgaaacagggtttttcaagttgtataattctctgaaatactcagcttttgtcatatgggtaaaaattaaagatgtcattgaactactgtcttgtttatgagaccattcagtggtgaactgtttctggctgataggttatgagatatgtaaagctttctagtactcttaaaataactaaatggagtattatatatcaattcatatcattgactttattattttagtagtatgcctatagaaaatattatggactcagagtgtcataaaatcactcttaagaatccatgcagcaggccaggcacagtggctcacacctgtaatgcctgcactttggaaggccgagacaggcggatcacttgaggtcaggagtttgaaacc

SEQ ID NO: 55492 - DNA, 1036 bp, Homo sapiens
tcttgaaataccgctgtttccttctgtggctcctcttcctccttcttgccctttggttgtatctttgatcattgtctaatcttttatccccccttgtttttgctgccaccttcctaaatatctcccaaatccatatatatctcttcatctctagtgctaccatcctagtccacattactattaccctcctcaactgtatcactgcagtaatctctcagccggtctattcatatctattctggctaacttccaatctgtttgctccagttttagtgattgttccgtaatgcaaacctgatcatgtcacccttgcttaaatatctttagtacagataaacccacttctcttaaagacaaaagttgtgacggactggccccttcctgcctattcaacctcatcctcatcatgctccaccctctgcccacaacccagtgccacctcacatacttcctctttcagcttttgtcaaactagtcttttttttttttgcccttcaacttcctaccttccttctggcacaggatttttaaatgttctgttccctctgaactttcccttcctcttgttctagtggaactgcaactcacatttcagatttcagcttaagtgttgggtcattttgttatgttttttggctctaggaaggcttccctggtcctcttcccctctgttgtaggcatccatggcacagggtcctgatccttcacagcacacttaacaatcacaatttaccatttctttgtgtggtaagggcctcctttactagtctgaaagttccatgaaggcagcccctcacgctcgtcataatatccttaaagcttagaatggtacacagcacatagtaaatgttcaataaatgttttggagtaagtgaatgaagaaatgaattatctcagcaactgaggttcaaaaacttgaagtaatcattgactcatcctactgttttattcccaatatccaggtcccaagttatatgtcctccaattttatgatccctgtggtttcagcctatacccttactacacaatacccaga

SEQ ID NO: 55493 - DNA, 1326 bp, Homo sapiens
cggcttggtaagagtatctcttgcccccttaatcaggaagttaaggacggtgtcttcagccgagttgtgtaatttactgctacggggagaagatgagaggaagacatttgtgcctacaaaatgggatctcctcttagggctgagaaccagagtttagggaacctttgacctcttggaaaaagaactgccattgaggagtaatgcattctgttttgggagggaaaatcattttgttacttctttgaagggaggaggtataagaaatgaaatagaataatagagcagaaggtcaatgagccacagccctacaggtagccagccactcttcttaggtggcggatgatgtttttgttttgattacagtaagaataaagtatcagctcttagatttaacttggggctcctaccttcaaaagcatgaagggccgtctcagaagagatgctgctggaaacaggatttggaaactttctttgggtttcctgtcagaatgtgtgggggtggacatgcctatgtgtagtttttctttccttgtgatgtaatttatttctgtgatactttgacataataagcattaaattaggccccagactttctgtctttattatgctttcctataacattgttgttttgaaatcatatagttcgatattcttttgtagcgtgatatttcagtgaatcctgtctagttttcttggtgttttaaattatggcctacttcagatacgattagctgttaggtattgaggatcatacgtgttaagtatttgttgaatgaattgaatgattacaaagatgagtctagttattaaatcttctgtccttttgagaggtaccctatattaggatactgcagtccatttccagtttgtaagatagtaattcttaaccttttctaggccactgacacctttgagaatatgatgaaatatataaactctctccccagaataaagttaataggcatttattcacaaaattttgcattagttttagggaccctctgaggccaaccatgaacttatgtcttagaagtgaactggatggaatccctcagtgttacacagttccatattaaaacagctcaaaagcctttgttcactttttgtatggcttcaagaaggacagtatctacacttaatataccccagaagacaggtatattcatatacgttgttcctgtagtccttctgaaaatgaatcccaaggaaatattccaaaagaaagaaaatgttgtatatgcacatgttcatttaattattttaatagatgggaagaaaaggaaactacttgcccaacagcagaaagatacacaattttgcaatcac

SEQ ID NO: 55494 - DNA, 1054 bp, Homo sapiens
ctgaggtgtctgcacttaatgtcctctctgcctgtaacctttttccccaaggcagtatatatccctcacttcttcaggtctctgcaccagtctcaggtcttcccttactacccttccctgccactgtttctatcctctcaccctaccttatactcttaagactaggttatactgattttgacagccacagttgttgacaaacattccatggtaatgtcgcttgtatacttgcattggacattattgtttaacatttaaaaaataatgtcagtcataaaaagataactttcagattgttaagttgaatttttcaatagctcacatttaaattttggatgttagcttacctctcttcaacatttaactacaggatgctaattgttggatacagagatgaattagacagggtctctgccctcagggagtttcacagtctgtcattgtttgtattgtaatagttaagttactccagatcttgccagtgtttagttttacccatgaactttagtgtatggttgatgatattttatataaaatagggattagacatccagattttcatgttggtaattgttttttttccttacaaagggatatgtttaaaaattaaattttttttgagacggagtcttgctctgtcatccagcctggtgtgcagtggtgcaatcttggctcactgcaacctctgcctcctgggttcaagcgattctcctgtctcagcctccccagtagctgggataacaggtacccaccaccacgcccagataattttttttttttttaatcgttagtagagacgaggtttccccatgttggccaggctgatctcaaactcctgacctcaagtgatccagccaccttggcctccaaaagtgttgggattacaggtgtgagctactgtggctggcaacaaaggaatttttaatggtatctgtaatttgtttaatttctgttttgtatgatgcttttagaatattatagctgtgaccgccccatgttttgttctttgagacagagtcttgctctgtcacccaggctggagtacagtgatgtg

SEQ ID NO: 55495 - DNA, 1050 bp, Homo sapiens
tagctcatttacattttgaaacttttgtaatagtggtatagatttgcactgcataattcacattctctcagtctcctgcacacagttgtgagatgactggttaagagggcactttgtttcaaagttaaatgatccagatgagtattgaacctataagcttagctttgttcattatcatgaggttctgatcaacaaagcagttcaacagagaaccatgccatgctgtcatttctgcttgaaaataagccttttagaggtagaaggtacaaacatgcatatacacatgcaccaataaaaaaaggaaattgtgtatggttattaaggtagagttgaaacaggaaataacgtgcgtttataagtggtttaaaaataattcttttaataaaattttcagaaatacttgatatacgcatggaaaattaaatgttttatgaaataaactccaatcagtagacaagttaatggcttttttaaaagcactaatgacttatttacttaggctatataaatttaggttagataaatctgaaaaaaaaattctttataaatcactcaaattttcccagtgtttcttacctctaacctatttagtttacactggtagagtggttcaaagtgttaaagttaaccaaatttaaaattaaatgtgtaatcatatgttttagtgtccgaatgtatttaaattaggccatatttcataagaatagcagtatattaaactaaaaaagctaataaaagatactattgggttaattaaaacttgaagtgccttaccttgaacacctaggtgtatacgcctataacatgttactccttcacggttttttgcagtgcagtgctgtacccacttattctggaggtaaaagataattttgttcatgataggactgtggttagctgtctttcgttttttaactgttttcttttttttttgttttgtttttgtctttagaaaagacaaaactataaaaagaggcacaaagaactgaatacaactatttggacatatcccaaatgcagtttatatgactctaagttagtagtggaaat

SEQ ID NO: 55496 - DNA, 1019 bp, Homo sapiens
aaaagacccttgtcatcacaaggctaggaaaagcctggtagatgaggttgatagggaacagctcactggatatcattatttctctttatgggtaaatatatgcaacttgtgaatttgaagatggtgttactaataatactcatttaaatctgtagggtaaccagtagtttttctagacatacagaatcactaattcctggtccataaattatgtttttcccagggatctgcagagataggaaggaattatgattagtattacaaaaagtcaaatgaaaattgtgcatttaccctaaatagacttatacagataaaatattatgtatcttttctttgaccagtgattatattgactcaaatcattatcatacattgtagcgatttgcagattgttaaggaaataaaatattgtacttatcccttcaagatcctagcactgggttttgttagtttttaagtctttggcaatttgagaattttgattagcttttacttatgtgattaataagatgtcattgcagttggtagacaaagatctttaaacacgtgaaatccatggaatagaataaagtttttttatagaaaggttgggagccattgattaatgtcctatctgtaatggacctacagggagaagggaactcatatgtttttgagtgtagaccccttacatcctatttaatttgcacagtaaatctacaaagtagatattgttattgtccagtttttttacaggtgatgaaactcaaagtaattatgtaatttgtgaaaatttacacagctctaattatagagaatcacgtgggtagtaaacttccagaagaagggacttttgcaatacaaagcagaaaataggtgatcaatacatatttgtatcttgcttaaatgtaaacatgaatgaatgagtaaatgacaggagactgcctctgtccctatactgttttcagtgagtcacaccatttttctcctaaatgagtctagaaaatttcttcagaaataaagtgacttaacctgtcttt

SEQ ID NO: 55497 - DNA, 1051 bp, Homo sapiens
agggtgctgtggcagggtcacggcttatccactcaggtgattcccccaccttagcctcctgagtagctgggactacaggcgcatgccaacatgcctggctaactttttgtattttttgtagagacagtgctttgctgtgttgcccagaatggtcttgaactcttgggctcaagccattcacccacctttgccccccaaagttctgggattataggtgtgagccaccgtaccctgtgttttctatttttttcattcctttatttgcctactctggtattggaccagatgttaattacttttgtatcaggaaatataacatgttctaataagtaggcagataagtcacagttgaattttggctaggtgttggtttttatcttttttttttttaagacaagtatatgtattttaagtagtctagaataatacagatttttgaggacttttaggtccaggcagtaattcagaactctaaaggcacatcaaagttgcatagtgaacaaacaagctattgagctgtgagctttctgggaatacttggaaccataacatttctgtcaaatatgccttttaatctttggtttattgattgaagtattttggactctttctgctatcaaggttttattctttttaaaggagatacactatcttttttacatttctggtaatgtgtttagtttaggtacatcatactgtgttgtttctgcttatttctgtagttctctacttataccttcagagttatacatagattttcctgaggtttattaatctaatatagctcaaaatatcagaatagatgttatagtaggtaacacttttctgaattagaatccgattttttaagagtctggtgttttggctggatttatgtaggtttctttatgagaaaacagtaaacattgcagaagaattacactttgctttttaaagtagaaatgtgtttagtttctaaaaatgctaatttttttctgagactattctttctttaaatgtagccactcacagcattgttaaaatttttaaatgttgattctgatactatata

SEQ ID NO: 55498 - DNA, 1035 bp, Homo sapiens
accaaaagaaggaggaatactagacatgcacaaataaaagatatccacttcgccaactcttgatatctcacatagatggtcagctggtaaaactaacatggatcagagccagattatgtagaatgttacaaggcctgataatgagcttgggccttattctctagaataatgaaactttttttggggaagggggagggtcatagatctctttgaaattttgaaattttggggccacatattgggccctcttctctcctagaagattatgcttatgctttaaaaaagatttgtttttgttttgttttgtataacatttcaagagtttgttttacctcttgaagtatatccatagttggtgggaaaaggagctagtctcaacctgaaaaacaatcagaatattatatctctctcagcttctgatatttgcactgctgattctccttaatctctttgatttctcttggaggaatttggttaagagatgatgagggtcttattaacacagtgtggaaatagggataaaaataatttgcaatttaaagaattatttaggaaacaatatgcagaactagctcgactgttgattatatatggggagtacagtcaagtatgacttataggtttttagcttgtaggaattgcaggggaaatatatagggcaggtagaaaggttgaccttaaatgtgagaagggacagcctcatcctttgagtgggactttaggaaaaaagatcatagtaactggacttaagtttatcaagaaggaaggtaatgagagaggaagtggagtagagattggtaaaaggattgatgtgcagtactgagggtccaggtgagatttcagaccaggaatttgaagtagtgacatcagttatataataatattttctccaccaatgaagagaaagtttaagattcactaacagttgatgtgtactggctgatttgcgggtgaaacaacaggaatacatggaatagaggaatctgagcaaagactaactcaaagatggtggtgtataacttatagaactcccat

SEQ ID NO: 55499 - DNA, 1045 bp, Homo sapiens
gggtctgtggtttggtgtctatcctctctttattttttagcagtcttttttttctcccaacttgtctcttcgtttggccctgtcttcaaaatgtatgtggaagttaaccaattcttactacctgcactgctactcctttggtcaacattcctatctcttgcattatttcagttgccttccagttcttcctgattctgcccttgaccttctcttttacaaccagagagaccttttaaaaatttcagtggaaacttgacatcctctgctcaaaactgtccagtggcttcccacgcataccaagtaaaagctgaagtccttaccgtggcctaaaagcctgtatttagctctctatttaatatcttaccttctcttctcctaatgacttcctcattgtcctccaattatagtgccctacttgttccttatcgaagtcaccaggcatctcaaggcttttctgcttccctcagatgtctgcccaactctgtcctctaactgcccatcatctttagttgtttactcaaacatcactcttctagattataaacctacatgccatatggactacgatctccccattgctttttgttttctggaacactttaccagctgacttgtttctggcaggagagtgcatgatgcattggagaagatgtaagaaagccagttggctggagtgttgagaatgaagggagcactgttgtgaaataaagccagaatgggagttagggacccaactgtgcagacccttgtaagccatgttaacatctttggtctttatctttaagggaaatgggaaatcactgaagtatctgaactggagggattcggaggaggtcactaagtgattaaatttgtcattttacaaagttcattttagcttcattatgaatatattggagggggaaaagattggatgtagggagatcagatgagaggctattatagggatccaggtgtaagctgatggtagcttatttagtctgttatggttgatggccatacaaaaagaatgattctctgaagtaatgtatttatatacatctgt

SEQ ID NO: 55500 - DNA, 1086 bp, Homo sapiens
aaattgcagaaacaacaaagttgggatcaatttaattcacaaagacaatcaagtcatattatttttgtaaatgttagaagtaggcttcctgaaggaagaatgaagagttagattataacttggaccataatgttagggactcagaattgacttaaaatttaaacatagtgtaatgtttattcctgtcttccatatttgtcagggaatcttaaccagagtaagaaattttctggtgctgtgtcgggagtgcagggcacaagagatttccataaaaaggcatgggatttgcttggaagaacatagaggttttctaacttggcagtaatgagttagaactaattccccttagaaagaaaaattaacttacattcttattgggagttcatttgtgtgtatgctttcttgtgtgacctatttattatatttgtgagtgtacctgtgtgtatacattcgtgacccatggtgtttgttaggtgtaaataaaattttctatacatactctgtgaaaaatggctttggaacttgaatgtcttgccattttagttgaggaacaggggccaaatattttgttgttgcagaatatccaaaataatttgaccatctctgagttctttccctagtttctgttgctgtagaaaagctggaggcatttggggaatataaatgatccatgctatattaggattctgtcttgaaagatacgcatttttggattagagagatgatgaattcacatcttgttaaaatgtcagcgatccccagactggaaagggggtagggatgtaggcatccttttacgtgaaatatatgctcttgtgtttagctgtcagtatttttcttttcatggacatcacttttttttttttcatggaatcacctaatacagatagaggtataagatgcctagtgtcccacacaaaactctcccacctcactctaccttttcaaaaatgtggtggttatttttaaaggctcacccagttcttaccttgcttctctttctcattggttgacctcatccactgctatggtttcaatgctaccatcttgaccaccattgactcccgagtctgtacctctagtcca

SEQ ID NO: 55501 - DNA, 1026 bp, Homo sapiens
atgagtgaatgtttttaaacagtacataagttgtttaaatgatagctttgcaaagaattgggtttatcattgtagtcataaggttatcaactgttggatttaatcatcttgttttctaatcaaagatttttagaagtaatatgaacataattgatgcctagtcaaagatgatcttcggtgaattaaaatatctgaaagtaatcctataaacttatgttaaaatctgtatggattttgccatgtagcttctgttgtccctttgatagtcttacaaggaaaaaaacaaaacaaactcctatgtttgatgcagtagtgtacattattagactgttagcatgtttcttaatctttgatttttttgtttgtttttcagatcgtcagtatttaaacagatcacatcatgcgtgagtacaagctagtggtccttggttcaggaggcgttgggaagtctgctctggtaagttagccacctaactgtaactgattaatataatacaagaagaattttgacatttccttgctttcagacttctagatgccaaagagaaaaggtggcattattatatatctgatatctgtcccacaaaggacaggaaatcatttaataaccacagatgtatatagttttataacattggctcatttattcttatatttaccaaatatttattggctatcttatatgtcaagcaccagtgttgatgatgcagagaggagtaagattgttctctttttaaggaatttacattgtattgggggaaactgattattacagattctagtgggataattcctcacctgcttccaccctagacttagatggaatgaaggtcattttttgtgttcatgctgtttttatttagtacatagttactgagtttctatagtgtcagattctagggtcacaacagtgaatgaaaacagtcatagtttcttatggagcttgcattatagtggaggagatgtaataaatacacaaagaactacttggttctacttgtgagcgagatactctgaaagaaaaat

SEQ ID NO: 55502 - DNA, 1094 bp, Homo sapiens
ctccagggcagaaatttttgcctctcatgatcactaacatatccatagggctacaactatgtcagtggatatttgttgtgaatggatgaaacttgtagaatgtccttaagaaggaggttggcattctcaataggagggaacaccaaccacagcagttctgtaaggacttttcttaaactggattttcagaactcaggttgcctgtatgtttattcttttgatttaataagaagcagagaccatgatctctagagaacatcatagaaatagtgttgctagtatttgtagcacttaacatttgtaagtaaactcatttattatataaacatttggacagtggcagaatttaattggttaccatagtggtgcaattctggaatatgcaaactttatcaatgaaaaatccaggaaacttccagtttttacatctttcccagaaaatacactggcagcagtataggaagctcagccatgttcctgtggcacaccttagacgaatttgaagctggggaaatggctgagtggtagcatagctaactccctggaatacaagaaagagtacatcagccagggtagaacaaccagaactattttagatgtagtagacaaaatagaggtagtggtcatggggaacaaggaagccaaggcacaacaagcttaagaaactttgtggatttatcttttacgtttaatgcatccagaggtaaaaagatccaaactgtatagttatttaatataaagacccaagacatacacatttttaatattctgccatatgtgctttttaagtaatatatatatataataccaaaacttttctaaaagaagattttgtcttatattaacctccatagttacaacataaagtaatgattgtcaccaaataaaaggaagtttaaaattaagtaattttaatttggcatgactaaagctcagtaactaaatgttaaccattagtaaatttaactaaaggggatagatagtcattgcactattctcacatcttttctaaaggtttggaatgagggggaaaatgaaaatacatgaacaagctcttttttttttttttccgagacagagtttcactcttgttg

SEQ ID NO: 55503 - DNA, 2143 bp, Homo sapiens
attgcccctgaccattaacaagctcttataaagagtttattgactgtcaagatgataaaaatattgctatgccatgggaatagaaaaagaaagatgataaaatctgccagtagagatattgattctggatgatgaagtcatagtttagtattgggcttatacctcagattgttagcacttgggcagtagttgtgtcataaatttgcaaataaaattatttaggatcaaaagatctgtttctaaaaaattatatacagctctaaatcacacaaaagcaaattaaagtggttaagaattcctttttaattctagtttactgtcattgtttctagtcacctcagttgctagaaacttgtgttatgtcttgttttctgtcaggatagcaagtaataaaaaatgttactcacttgtaattatgctgttttaaattgttgcagtatacattcaagaaatttatatatttataattgcatattttttaaatcataggagcaatttacagcaatgagggatttgtatatgaagaacggccaaggttttgcactagtatattctattacagctcagtccacgtttaacgacttacaggacctgagggaacagattttacgggttaaggacacggaagatgtaagtattttttctctctgtaagatgttatgccatctctctgtggccaaataaaaaagtgcctgttttctctattagtagaggatttggaagctatctaccacatgcctgaaagagcccctgtgaccaaaagaaaaaaatttaactttcaaaattaacctcaaaattatgtggtgagatgtttagaaaatgaggacatatgtgataaagtactcattgtgctataggttaaaaagtgcagtagaggaaaaagaggagccaaagaatacttcatagaagtgggacctgagttgagctttgaaaggtgatggttgtgtcagaaacagtgttcaaagaacattattaagatccatagtggtgtgtttttatttctaaaattccattggtataattcacacatcacagtctacctcccgggctcaagtgatcttcccacctcaaccccctgagtagttgggactacaggtgtgtgccaccctgcctggctgattgtttttgaattttttagtagagaccaggtctcactatgttacccaggcttgtctcaggctcctgagctcaagcagtcctcctacctcagcctccctgggattacaggcatgaaccattgtgcctggccaggattatattcttaaaataatttggcatatctatgtagtaggatctcttccattttttttttttttttgtctcttccttcttccttcgcctcttcccctcaacatatacttttcgttagtatttgatgaagcttgcggtcccaactaatgcatttcagttggtggcagataattgcttatttatttttttaaaaggctaagtaatgagtatgttattgttcattttacgtttttttcttcccacaggttccaatgattttggttggcaataaatgtgacctggaagatgagcgagtagttggcaaagagcagggccagaatttagcaagacagtggtgtaactgtgcctttttagaatcttctgcaaagtcaaagatcaatgttaatgaggtaacctacaactgctgggcagcacaaacaagtgcctttttagtttgctttaagttaacagccagacttttaagaaaaaatttttatcttttaagcaatcttgattccataattttataggaaacactaagtaattcctggaaactatattttttagcttgcataaggtcactttgatggctgtatgaggatacttaaatttaccttattgtaaaagaggaagctaaaattgaagaatgtgtgtaaaatcctgctaagcctctaagtgatatgcgataaagtggtgtgtaaaaattgttacatcaccttatattgtaataattatttacccaaatgtatataaataggttgtaaagtcaagttggaaaataatatgtttttatggatatcacagaattgtgttctgagtcttacctcacctttggtgcatgactcataagtgggtaatctgtgtgggtatggacatgtacctggaattcactcagtcctttaggcctgataca

SEQ ID NO: 55504 - DNA, 1052 bp, Homo sapiens
cttatagactatttgacttttaaaaatgaccaggttactttaaacacctggcaggtaaaaaaaaattaagcttgcttcaacttctgtattttacagataatcaagaatgccaaagcttgtttttttatgtgaaaccatttttaacaagtacataaaaacaagaaatttataaattgtatttattcagcaaatatttattgactattgtgtgtctggcactgtgtcaggccctcaggtaacagtcactcagacagacactattcctgccctgaagaagtttgcatcctactgggggaacaagtctttcagcaataattaaagaaaaaaagtgattttgataaagaatttgttagaaattgtgaatatgtttggctagcagaacagtgacatgaggtcactatctacaagataattggccttacgggatgtggttccttgctgtccttgtccttacctccatgggacccaccaaccaagttcatcagactccaggctccggtggggctgggttgggcctgagtccagtgcataggacttctccctttgggagccagaggacagtacactacatgtttgtgagaacctacatgctattaaacttcctctggattagtttccaatgcagcagagatactttttcatagcagtcttgttaaagcagagagtttataaacgagggtttataaaaacaaacatagaaaaaccataaaatgaaatgcattagccatctcaagaatctttactttttggaaaacatacaaactttatgctcagttcttgagagtggggagaatggagcagataatttgagtttcttttaatatttttctctttataacccaataatccagctacaggatttctttggtagttaatagttcctcacacaacttttgccttgtaaatttttttgtgagttttgaatgcctgaagtatagagagatactttcaaaaattcacctcttggccttaaatttgaaaacagacaccaggacatactgcttggctaaagagccccctaattcattcatatatatatatatataattttt

SEQ ID NO: 55505 - DNA, 1091 bp, Homo sapiens
tcaaggattagcagactttttctactttttacgtttaaccaaaattaacatcaaaaaaaggcaaacaaaaatcatgcgcctccgcatgtgataccttgaaagggagacagtatctcttttgtcctattttagacaaaaatgtatataacctgaatctaatcacgagaaaacctcagataaacccaaatcaagggaagttactagcctttatttttcagaaatgacaatgtcctgaaaggcaaaggccaaagaactgttccagatttttaaaaactaaagtgagaggaaataaactgcaatgtgtgatcctgaatggatcctgtccttggaggggaaagttactataaagtacattattggggcagttgacaaaattggaatttgctctgtagttatacaaaataatgtgtcaatccttaaatgtctcaagtgcaataactataacgtgtttatgtaagagaatatccttgttcttaggaacaacttaactgttaaaggacttaatagttaaggtctactctcagatgattcagaaagtgtgtgtgtgtgcacgtgtgtgtgtatgtatgtgtagtaaaagtggcaaaatgttactaattggtgaatctgggaagaatagaaccgaagttgttggtactatttttgcaacttttccgttggtttggagttttcactatttttcactaccagttctttttcttgatttgatgtcgaatatctaggagcaagggcatttccttcattataaataggtaagtcctgctttctaccctgattgaaagtcagcagagccttctaacaaacctgactttaaaagaaagaagcagaatgcagatctaagaccagaatagtacttaccagaattgttttgtggaacaaagtctcaaaaactggtggagtaagtactttttttcttgtttttacttagatattttatgacctggtcagacagataaataggaaaacaccagtggaaaagaagaagcctaaaaagaaatcatgtctgctgctctaggcccatagtcagcagcagctctgagccaggtaagatgctaaaagcagaacaagtgcctttctcatgctcctatttt

SEQ ID NO: 55506 - DNA, 1010 bp, Homo sapiens
atcccaagctctggaagaagaaggcatatcccaagctcggcctctgactcttcttccttgggtgatggcatcccctggggtcagtctggaaaggctgttttgctggctcctctcttagtcaagaaccagctaacgctcctgccccaccactgtcctggccctcccaggttcccacaactcctccttcgcttctcatccctctcccagctgccttcttgcccttcagtgtcggcaccctggatgtggctgggctgactgaacgtggctgggagtgggcaggagggtgccaagacttcccttccttccctccccagcccctgcatggggcaggagtggggagggaaaaaacaggaccttctccttgtgcttctccttgattagaccagatataaggaatggaaccctgtcattactatgtgctaagtttcaccaaggaagaaatgttgtgaaagtacatgggaagtcttaaactaacagccagaattcacctaatgctttcttggtttcatgcagagatacacattacctcacctaatctgcacaatagctgtatgaggcaggaactgttattcccattttaaagagtggagaaatttggctgggcgcggcagcttacgcctgttagccgagcactttgggaggctgatgtgggaggatggcttgagtccaggagttcgagaccagcctaggcaacatggtgaaaccccatctctacaaaaatacaaaaaagttagctgggcatgctgacctgtgcctgtagtcccagctacttgggaggctgaggtgggaggattgcttgaacccaggaggcggaggttgtggtgagctgagatcatgccattatactccagcctgggcaacacagcaagactgtgtctcaaaaaaaaaaaagcatggagaaattgaaaaacagaatgtaaataacttgcccaggtcacacagctactaatggcagaactgagatttgaactttgttccattgtctccagaaaccaaattattaaccaatg

SEQ ID NO: 55507 - DNA, 1035 bp, Homo sapiens
acctgccacctttcttattccttcacccaccggaattcaggcaaatgttatgcacatacagccccatctctgctttgcccatctctccttccactaggctctctgttgtgtctttgccctcgtctctttttgtctcttttagtttgtctctcttggagtcgactcttctcagtctcacttttctgctctcctctttcttcttactttacagagccaggggcactcaggccacacaacagcaggcctggatctagaaagggccagcttatggctctccagattctgtgacagcgtttcccactgctgcctgcaaaggctacactcttcctgcttgggaaggaacttggcagtgtgttaggggccagctctgggggtagggggcagagtttgaaactgcaggtgttctcactgatgcttcctgaccaagtaaccctgccactcttcctgtcagtcctactccagggtcagcctgctcacatcaacgatcatttctctctctagtcctccctcctggagccctttctgtggtgacactcagatgcaaaagtcactgactcagagataaatttcttgagagacaggagtattcattgcttttcttctgaacttacgccatgtcccttcccatagtcgtttgcacatgcttctcatgccagattgggatggctggccccagcccacacgtacacaattctcatttttttccatttatgtgtgcagtaccagaaagaaagctcaaggtcatcacagataatgtctgaggtccaagacccatgcagagaaaagaatctaatggaatcctcctttttgtgcttcgaattggggactacaccacccacctcaggttctgccttaatggagggtttgtgggtgttcctggcatgggctcgaatttttaaatcctactgatttgcattttttatagcagtctaggtgggaggtggtgaggggaggaagacagagactacgagtgccaggagaataaaaaaggcaaataggaatctgcactgagctgagcttcacatcttgatttgc

SEQ ID NO: 55508 - DNA, 1051 bp, Homo sapiens
cacccccagcaccgaccgcgcgcggctagccgctggggaagcgactctgagtcccgggctcggagcgcaggctcagctccgcgctgcgagcgctacgggcgcaggggcggggagccggcccggagcgcagtttccagtggggccggggtttcacccgggccctctctgtttgaaccgaacccgacaaatgggcgcatgacgatggagagcagggaaatggactgctatctccgtcgcctcaaacaggagctggtaagagcgaagctggcgccggggcagggagggctgctccgccccgacgggcacctggtctccgccccggcccccggggagccgggacgtaagcagggcggaggagggccagggaagagaggagaggacgcgggcccgcaggcagagggcagggcttgtcctcaggaaaggggaccacgaagaaactttgagcaaagatttgtgatgagacaagaacaagtgacagagagacagagggagcaagccagccaggctgaaatgtgacacagagaaccccagagagaagatagggcacgcccagagacggccaggcacacggacgcagtggggcccccgcgccgccgacgcggaaagcgcgagagcgaaggcctggggagcgggacgcgggcgcctgggtgcggggctgcgcggggcgacctggagcgcggggaggaggagggtgctgggtcctgatccctgcgcgggcacgaggtcagcgggactgctcgctcgagggaagcgggtaccaccctgggcccccagctctgccgggcttggcagagctggcgcggctgcgggggcaggcttggccggctgtctgcctgggcttgtctgccagcagggagggggctggcagctggaaaggcgggggagggccctgcgctggaggaggggctctgcctggcaaatcgagagcgggagctgcggaggcccagccagatgtcaggtctgggcttggggagtgcgcagggagcgttcggaggccccgcggtacggggagggggagaagtagctcagtctgggggggtggaaatcaccg

SEQ ID NO: 55509 - DNA, 1043 bp, Homo sapiens
ggtggtggcgaaatttggaattttctatgcgtaccttatttaaatagaataaagctaccatatatgtcaattttgtcactacttggtaatacagacagggattcttcttttacttactgactagattaatgtgagacttaacatttgacttgattcatggtaatgtagtgctctggctattgttggtaactgcagagtttgttttttttttttgagacggtgtcgctttgtcacctaggctggagtgcagtggcggatcattgctcactgcaaccttgaacttctgggctccagtgatcctcccacccatcttcctaagtatttgggactacaggtgtgtgccaccacacctggctagttcttgtattttttgtagagatggggtctccagtgttgcacagaccagccttgaactcctgggttcaagcaatcctcccacctttgcctcccaaagtactgggattacaggcatgagccaccacagccggtatgcaggtggttcttaaagctctgtaaatgtatcatattgatctcccatcttccaggttgtcttagagtgtttctaagattgccttacccaaattagcaggaaatttgagtttggggatcatttctccaacaaaggtttgttgagtccgtattacgtataaacagtgtgccaggcattggggattcaaagatgaattagatgtgattctcatagccttacttggtagtttagttgttatggcagactgtatttcaagttctcaggcattggtatatctgatgatgaatcttcaacagtggtttttaacccagatatccatgttcatcacctgggaagctttttgagtccatcttatgtctaccaaatcctaggtgatgttgcacattggaaatcctcctacttcccaagaacctgagttagtctaattgtagactaagatgtatttgagattttggcttctgacaatttggcagcagataaaatgctgaaatcctggaaaagtttcatcaactcatttttttttgagaccgagtctcactctgttgcccaggct

SEQ ID NO: 55510 - DNA, 1575 bp, Homo sapiens
aagatataaacaaaaatacggtgtaaccatttacatagcatttaaattgtattaggtattataaataatctagagatggtttaaaatatgtgggaggatgtacacaggtaatatacagatatatgcaattttatataacagacttgagcatctgccagttttggtatttgggggcttcctggaaccaatcccctgtggataccaagggataactgtaccttaccttatcaataaaaactcatttgaaatgatcatttaaatgaaatatagtgtgtcatgtaatgaatataccagtcccctatgtatttattcctctgactcaaaggtgtaatttatggtttttttttagattttgatcttggctcctacaagagaaattgctgtacagatacattctgttattacagccattggaataaaaatggaaggcttagagtgtcatgtctttattggagggaccccattatcacaagacaaaaccagacttaaaaagtgtcatattgctgttggatctcctggtaagataacaatgcctgttggtaaccagggcttttaaggaactacacacttttaatataacaataaagatatatgggagtctttgataactgtgataattattttgattagaaatgaagagcaggccgggcgcggtggctcacgcctgtaatcccagcactttgggaggccgaggcgggcggatcacgaggtcaggagatcgagaccatcctggctaacatggtgaaaccccgtctctactaaaaatacaaaaaattagccgggcgtggtagcgggcgcctgtagtcccagctactcgggaggctgaggcaggagaatggcgtgaacccgggaggcggagcttgcagtgagccgagatcgcgccactgcactccagcctgggtgacagagcgagactccatctcaaaaaaaaaaaaaaaaaaaaaagaaatgaagagcattagaccagtgagatttaggtacatgactggtttaccagtggaatttatgaaatctccattcctaagtatgtttgagaagacatgggataggcttttgagaagaggagaaatgcagtgactttcaggaggcccttctaagccatggattgggattattctttggcttctctattatatttggttgcgaatcactcagaatcagcatcttgcattcagtgctttaggtcttttgatagaaatggtgtttatttactggtgatgaaacgtgaggggaaaacaatgagtttagtcaagatcagagctccagatttctaatttgtggtttagtgtgtacatgcataatgagagttgaatcaggaaattcagcagaacaacctgtaagtaataagtagagtaacaatattggctgagatttacacaaatttggtacatcataaatatttcaattttttttttttaattaggcagaattaagcaactcatagaacttgactacttgaacccaggcagtatacgcctctttattcttgatgaagcagataagcttttagaagaaggcagcttccaggagcaaataaagtaagaaaaataactaacttgactattaaaacagtgt

SEQ ID NO: 55511 - DNA, 1449 bp, Homo sapiens
gtttggtgtcagcttaatttttaacctgttggcatgagcttgtttagttatggtatatcacgagatactggggagactattttctaatgaaccaatacttaaactatagatcacactttaacaccaaattataaacagctgattaaagcatttttattttcctaagaattgctagttatacttcatatgtaactttgcaaatagaatgttatatattcaggcatggcctgatcactatttaggattgatttttgaatttcaagttgattgcctaaaccatagtttaaaagattttaactttggatcttaacctagatttgcacagaaggacagaattaactgtggttggtgtattaaaagtgttaagactgggtgttatgctttttactttttgtggattggataaatatgtattagcttagttgtttttatgtgactttcttttggggtccttttaggcaatatgaatcagaatcagcgtcttgatgctatggctaaactgaagcactttcattgcagagtcctcatttccacagatttggtaaatttcctattcagtttgggtgactaatccatcttgacatatgttctattatcagatgtacagatttcatatattattttatgtaggcgtatctaacaagaataccagaagataattatctttccagtgctgaggaaaatactttcttaaaaatgtctttaatatgtttatctttgtccttgaaattagtcattaggaatgaatttccttttcctctgctcctcagtattcagttcttaatttgtctcttgactgtactggaagaatataatatgcattggtatccatgctgtatagttaatgcaaacaaataattgctatcttcttcaattcaagacttctcgtgggattgatgctgagaaggtgaatctggttgtaaatctggatgtaccattggattgggagacatacatgcatcggattgggagagctggccgttttggtaaaaaaaaaaaaaaaagtttgagtgctttctttaaggggagggatctataatgtgacaggtgggctttgaatattatttttgtgaaaatgatttactacctaacattctctctgcttttaggtacattggggctgacagtgacctactgttgccggggagaggaagaaaatatgatgatgagaattgcccagaaatgtaatatcaaccttctccctttaccaggtacatttcatctgtttcattatttcaaaataattatagtggtgataagcataataaaaatgataataatagctaacagagtgcttatgatgtgctgggtactgttcccagtcctgtatgtacgttaactcatttacttctcaccacactcctatgaggtgtgtgcaattgttttgtagatgaggatatttagacatagagagggtaagtaaaggtgttacagctagtaagtagcacg

SEQ ID NO: 55512 - DNA, 1050 bp, Homo sapiens
agagtagcttgagaattttaatacatttttcttcctttttatgtagatcccattccttctggtctgatggaagaatgtgtggattgggatgtggaagttaaagctgctgtgcatacatatggtatagcaagtgtacctaaccaacccttaaaaaagcaaattcagaaaatagagagaacccttcaaattcagaaagctcatggtgaccacatggcttcctctagaaataattctgtatctggactatcagtcaaatcaaaaaataataccaaacaaaagcttcctgtgaaaagccactcagaatgtggaatcatagaaaaagcaacgtcaccaaaagaactgggctgtgacaggcaatccgaagagcaaatgaagaattctgttcagactcccgttgaaaactccaccaacagtcagcaccaggtcaaagaagctttacctgtgtcactcccccagattccttgtctgtcttcctttaaaatccatcagccatacacgttgacttttgctgaattggtagaggattatgaacattatattaaagaggggttagagaaacctgtggaaatcatcaggcactacacaggccctggggatcagactgtgaatcctcaaaatggttttgtgagaaataaagttattgaacagagagtccctgtgttggcaagtagtagccaatctggagactctgagagtgacagtgattcttacagctcaagaacctcttcccagagcaaaggaaataagtcatacttggaaggctcttctgataatcagctgaaagactctgaatctacgcctgtggatgatcgtatttctttggaacaaccaccaaatggaagtgacacccccaatccagagaaatatcaagaatcacctggaatccagatgaagacaagacttaaagagggggctagccagagagctaagcagagccggagaaacctacccaggcggtcttccttcagattgcagactgaagcccaggaagatgattggtatgactgtcatagggaaatacgtctgagtttttctgatacctatcaggat

SEQ ID NO: 55513 - DNA, 1049 bp, Homo sapiens
aagttgacctcacctatagagttagaattgtaaaagagctacattcctattccaaaatttctgcaaagtgccagattgcagctatactcttctagagccccccataattacgttctttttcttcccagaatcctcctcactcactctctattgcagccaagacatgtttggcatagaaccagggaaagccaatagaaaataatgtaacacattattcagtgtcttgtatatttcaaatctaattgttatggaggggacctatactatatttggtcctaattaaattttatttaaagtggttttctgttttagaaggaatcatgtcagaaaaaaaaaaacttctttatgaacgtctttcccttttattactttaatttcatgaataagaacaccaaaggaataccctctacaatgaaagcaaattacattgctcatgaactgtctgggggaagcagagagtggaaccacatagttcagcaggaaagcctcagttcattaattccaagcaaatctagtaaatggcttcctaccataggctgtgattgcttcagaggagaataaaggaaggttaatcaatggccattttaaaaaatctgaaaaatagatttgactgctaataaaatttagattaaatagtttatttctgaatattccacatcgggtatattacatctgcacatcttagatctgatgcaaagccacactaaatggcttctgtgactaaatagaatccaccttgcatttattggtattgctttattttaaagcattctttaaatcatctatacaatgataaatggtgaaatattacagctttcatgtgcgattaacttaaggagtcttgaattcgtttccattgatgcctcaatcataaaatagggatatcctcttttaaaaccgaggatagaactttgttgtgtttggccaaatgctgttgcaaaatcccccaagcaagaagatttacaggcaaaaatgttgtagacatgacaaagttagaagtatatttagagtatgagattatgtaatacatcattctataggtttaactg

SEQ ID NO: 55514 - DNA, 1023 bp, Homo sapiens
agccaccgcaccaggccatagctagcttttttttttttttttttttttttgagacagagtctgactctgttgcccaggcttggagtgcagtgacgtgatctcggctcactgcaaccccttcctcctgggttcaagtgattctcccgcctcagcctcccgaatagctgggactacaggtgcgtgccaccttgtccagctaatttttttgtatttttagtagagactaaaatacatgttagtagagactaaaatacatgtttcaccatgttggccaggattatctccatctcttgacctcgtgatctgcctgcctctgcctcccaaagtgctgggattacaggcatgagccactgttcccggccagctagctcttaaaaattattgtctggcatcagctgtttgctgtataactttttatcatgtcatcattcatattacaaattgtggcatttaggggtttaagaatgaagatgccagaagaataagcaaatttctcgtttgactgatgtcttcctgtgggttctgtgttttgttttgttgttgtagttttaatatttttcaagaaaggggaaattcagtttataaaacagtacctatttagagaacatacagttttccagcagttacggaggggcttcagaaaagattacagcagtgaggaatttcattgcatttattcagcctgtaactaaaacaaataaaaaagggaaatagcttattcctattttgacttcctcttattgtgtcttccttgcatgtgttagccttgtgatttgagattaatcaggggttatttctagttgtccccataaagagaagagaagcaaaggaagacaaagaggttgcttctaaaactaaaacatatcatttagtattccagtttagccagttgtaagaataatttggaagataggagaaaaccatcttgtatgtttgctgaaaatatttatggaaaggaggcatttatagaatgaactgggagttttattatgtgaaattgttttgttagaaaagcatagtaat

SEQ ID NO: 55515 - DNA, 1056 bp, Homo sapiens
ttgctgggtttcatttattcgtttgtttgtttgatctctggaactatctaaggtgcctgatttggcacttattattggttgtattaataaatgtgactccttgatatttgaaaatgaaatttaaaaaattctttaaaggtgatcctagaccttgaggaagaaaggcagcggcatgcacaggatacggctgaaggagatgatgtcacctacatgctagagaaggaaagagagaggctgactcaacaggtaattaaggtagagggattcacagtagcatttgcctggaacagcatttcccaaagattattctgcaggatgccaactggtattgttcagaaaaggggctttgtggtcaaataagtttaggaactactggattaagcaaagttaaacaggtttctaactttgttaggatctttagtatgcagaagcacattgtgagtcttcaagaacaagatagggtattctgtgtttagcaaatccatggttttataaaatcttttattggcatagatccctcactgtgggattattattgttccgtagaacactctttggggaatggtaacttagcgcttgtagctctcaaacttttgacttagaacccccagtaagaagtgacattttatgtcacaacccagtatatgtagacatacacagttacgcctgaaacaaaaatctcatgaaatcatatataacccctactgctacagtacacattgatgttttctgtttatatatttttttaaaattctagtcgtggctcagttagtttccccatccattaatggatctcagagtttgaaaaacactgagtttcttcaaccctttccctctcacgcagagtctctgcctcaaatagggttgggaagacaattaaaacaggctatatttgtgtaaaaaatatgattcaggctgggcacagtggttcacgcctgtaatcccagcacttttggaggccgaggtgggtggatcacctaaggtcaggagtttgagaccagcctgaccaacatggaaaaaccctgtctctactaaaaatacaaaattaggcgggtg

SEQ ID NO: 55516 - DNA, 2607 bp, Homo sapiens
aaagagaggcttgcagactgaggcccaggtagagaagcagttatcagagtttgacatcgaaagggaacaactgagagcaaaactgaaccgagaagagaaccggaccaaaaccctgaaagaagaaatggaaagtttaaagaagatagtgaaggacctagaggcttcccaccagcacagtagccctaatgagcaattgaagaaaccagtaaccgtgtccaaaggcacagcaactgagcctctcatgctaatgtctgtgttttgccaaacagagagttttccagcagaaagaacccatgggagcaacatagccaagatgacaaacactgggctgcctggtcctgccactcctgcttactcatatgcaaaaaccaatggccattgtgacccagagatacaaactaccagggagctgactgcaggcaacaatgtagaaaaccaggtgcctccacgggaaaaatctgtggcattggcccaagagaaaccagtggagaatggtgggtgtcctgtggggattgagactccagtcccaatgcccagtcccctctcttccagtgggagctcactgtctcccagcagcactgcctcctcctctctaacatcctctccttgctcttcgccggtactcactaagcgtttattggggtcatcagctagcagccctggctaccagtcatcgtaccaagtagggatcaaccaacggttccatgcagctcgccacaaatttcagtcccaagcagatcaggaccaacaagccagtggcctacagagccctccatccagggatttatcccccaccctcatagacaactctgccgccaagcagctggcccgaaacacagtcactcaggtgctctccagattcactagccaacaagggccaatcaagccagtctctcccaacagctctccctttggcacagactatcgaaatctagccaacactgccaatccaagaggtgacacaagccattcacctactccagggaaagtgtccagtcccctgagccccctgtctccaggaatcaagtccccaaccatccccagagctgagagaggaaaccctccacccatcccacccaagaaacctggcctcaccccttctccatctgctaccactccattgaccaaaactcattcccaggcagcctctttgaccactgcagaagaccttgccagcagctgctcttccaatactgttgtagcaaatggtaaggatgttgagttacttttgcctaccagcagctagtccctaggagggagtctccacgtttgacattccatcagatttcgtccaaaagctcagtcagacttctgagtcagattatgttatttattttgatagtagctgaaaccatctgtataatacatttagtatatttcaccattttgtatttttttaagtagaaactgagtagtttggatttttatggctcacatctttttactgaagccagaaaggcacctcaaagatgtctcaagctcagcagtcaccgtcatgttgtgatgaagaaagcgaatcaccaggtggtgatttgctatctatttgagaactagaatcactcaacactcattttgaattatgcagaagtggttcatgcagatttttattccagatgaacatgttttaaaagtgcctgaaatatgactgccatatgaatgtgattctgcagcaaaaaacacaaaatagatcatttaattacagaaaatgagatcctctgtgaattctgaatgttaaaaaccaacactgcttttaatcctcttttaatgttttaatacaagctttgtgttctgaaacaaggctgcataagtagaatgggaatccttctaaaggtgggtgtgaactcaccacaagctgagctttatagagcccttgagaaaccctcctgagcactaagcagttggggtgctgattttcttgtacttttgaaaaattaagtcactcccagtttcctgcataagttcttgaacagaatgaaatcacatctccattcaaaaaatgtctcaagcatctactgttgtgtaaggaacttctgattctgattgctgttacttgaataggaaatggttactcattctgtataaaagttttgcaagagaatgaattttttattctgtaatcaaaaagcaataacttgaaattcactctgtaatattataggtcagtcagaattatacaagttttaccaaattgttacacttattctccaagctgccagaacctggtatctgtatctgtaaaaccaaattaacttttgcttaaatgggaagtatacatatatctgtatagatacattacccctttacatgtttaacatacacacacttaaacacataaatactagtgtgattatatctttggagtttgcaatatagcataaaggacaagtagaactgcacattaagattacctaccgaagcaactagatgtggctgggacacaatcaaaggaggaattttgtccacaggaaggtgaggaaattccaaatgaagcctagatcttcagtatcataaaaaggcagagctggccaggcacagtggctcatgcctgtaatcttatcactttgggaggctgagatgggaggatctcttgagaccaggtgttcaaga

SEQ ID NO: 55517 - DNA, 1004 bp, Homo sapiens
cggacaaaagcctccaaactttccaactgtgtaggccagtacagctggcaaggttcatagaatataatggctatccccctctgccaaataagactatccacaacccagctcagacacagtggttatatgattttgtgtccatacaggagaggccttggtgtcttcacatacattctctgagccaacatctatccagcagccctgacctcctgctataatttaagtctatttccttttaatctaataagagttgatagtaaaaaggcaggtgatggaaatcagtgtataaatcacaatggagtatattggcaactccacagcttatagtttgataaaggcaaatacatgaaaaataaaaatgctactaatgccccaaggtgtctatcaaaatgatgtagggggtatcttaaactgtccaaggcaatcatgcattgaactttattcctatgcagagccaaaacgaatagtgttgataaaatagctaaactttctaaactggagaggaggctacagtgccagagagttattgtctcttttgctttaaatggtaatcttaaaagttgcattgtgctcttcctttgttttgggatagatatatatagagagagatactataaggaagtttatttcttaggaagtgcactgaataatgtatttcttttacagtgtaatatgggggtggggatatgcgaaagaaatgtgtatttttgctagttgcctaccttctgagataaataagcacaatcttgcaatggatccaataacccagttaggtattatagattagtatttaagtttgctgtagattgtgtgtgtgtgtgctaagtaaaagttccatgattcacaattttagtattaacccatgttgcaaaagctgttactggccaacagattgtaatgatgtgtaccatataacacaagcattaactaggcattaacgtttgtaaagccaaatataccatgcagaagtcttcatttttatagcagactgcattaaaacaagt

SEQ ID NO: 55518 - DNA, 1045 bp, Homo sapiens
tggagtggggcaggccaaactcgggcaacaagtccttcttgtggtctgacttaaatccattctgctgcagcccacataggtcctttttattacatcctcactgagtgtgggaacatctgttcagtatctaagatgggaagataattaaatgtctctattaccacccttactccactaagtaatggcttcaagactccacagagcatggcgcttgcttgctctccagtagtcagccccttgtagttagtgtagggagcctccaataaagctgagcctgaggctaaccacatcttcctctcagttcaacacatgcctgcaaaatgtctaccatgtgccaagcactgagctcagatgtcagggacacaaagatatttaaggcatctcccacctcacggtctggtagagtgttagatgccctgactctagctttgtttttcccttctggaagttcttcacttccttcccagcttcctgccccagaatgcttctcttcacctgcttttggccaattcacatcccttcatttgacaaagtgaggcatacactactctagccccttgctactcaaagtgtggtccccagaacagcagtatctgtatcatgtggggattcgttagaaatgcagacattcaggccccacccaaggcctaccgtaacagaatctgcatttcaccatgatcctcacatggtttggatgcaccactccacaaaggcagggatttttgtcggttttgttcaattcaatatccccagtactgagaacagtgcctggcacatagtaggtatgcaatcactatttgttgaataaacacctaactgttctgatttatccccaactcccttctccctctagccagccattaactcccatttccattacagctttacttgtcaacagttgccagcctatctgcagatgttttatgtttgtatgttaaagacacaaacgggccagggatctgctttttttttttctttcctcctttcgtgtacagcccctagtgtacatgattcagcccagcacatatagaactttgaacacaga

SEQ ID NO: 55519 - DNA, 1217 bp, Homo sapiens
cttaatctacagacttttgttaatactttatagtcctaaagaaggactgttcctagagaagtcatgatgggctagaccagccaggggctttggtgaagaggatctgcgggctggagtttggtgcataattaaaactcagcgtctgacagctgggcacagtggcttgcgcttgtacgcccagcactttggaaggctgcagtgggaggattgcttgagaccaagaattcaagaccagcctgggcaacatagtgagctccatctctgaaaactatgtttaaattagctgggcatgatggcatggccctgtagtcccagctaatggggaggctgaggtgggaggattgcttgagcctgggaatttgaggctgcagtgagccatgatcatgccagtgcactccagcctgggcaacaaagcgagaccctatctctaaaagaaataaaaagaaagaaaaaaaagaacaggtacgtatcctcattttacagatgagaaaatagaagctcagaaaatttagctaccttgctcaaaatatcaaagcaaatggcacagctgtgatttttaacccgggtctgtcataaccgcaaatttctataccactctgctgctttaagatatcaacaggcaaaagataaccactgtccaactcacataaaaataggacatcaagttttgggggacttcatgtcctacctccagcttactaagcctgctatctctggagattccactactgcaaacctagttaggcaatgggtaatagcattacccattaagccaaatgtggagtgaacaataataataatcactaggacttggagagtcactaaataaagatttgttgagtaagtggaggaaggctgccttctaagctgtgtatcactttggccccaacctgcagtactccttcccactgtagccactgactcctgctcccagcttcaaaggctaggatcctctcataaagaattaccaaagccagagatccctacctgcctaatatatactgatgcctcatgtgggcccttgagatcagacctgcttacctgctctcccaccatccatgagttgcctatctttcttttactccatgtctccccaaacctggcaaacctccagaatagtgcatgggaagagaagaaaagaaaagaaaaaaaaaaaaaaaaaaaaggcaacacaaggcctagccagacttactacattaatctatcctaggagtgtt

SEQ ID NO: 55520 - DNA, 1061 bp, Homo sapiens
aattagaataaagttcctcatttattagtgagctggttttgcagtctctaaagctcttttgcagctcttctattcactatggcctcagatacgataaatctgctagctgcaaaaattcaatataccaagtagaatatgtaggaccagtcaagttttaagtttgggagtgaggaaaagcagcatgtattttctattttaaattattttcttttcacattctaatttcttaagggtttggcttgatttatgccaggttctgggcctgtaagcctacattaatgtatcacagtactggataggatatttgatatctcttacttagcccagaatctcaaatgataaggagctgtagttaatgatatgtagcattttgttgaactttacagtgtagatctctgttagtccctgggtctgtaacaaatggactcatccttgtgcttttccataggtgccctgatgtttactgacataaatcaagatactatgtggctctataggggatgctgaaccatttgacagtctaggtgcacacagtcacctcacattatttaagccctgatctcagcattctaatttctctgtattccccagtgtatataatgtgtacttgcttgaaattccttatatattgcttgtacattcctgcttctaagtttcagcacataccagttccctctatttagaatgccttcttctgactgccctcagtcagttcataaaacacataaagctatcttttaaaaattcaactcaaaagtcacctcctgtggaatgccatctctgcttaatctcattaacctaattcctttattctcagacttctgcttcctagtccattaaactgtttcattttattgtaattgttgcttctgtatattgtcacccagtaagcataattattctaggaatgatcatcttcctccagcctcttgtgtctacttattacacacaaatattttgaaggcctattgatgaccttttcagtttccccagagttccagttcaccttccttactgtttccttttacttcatagttacattcctaaagaagcagcgcatg

SEQ ID NO: 55521 - DNA, 1703 bp, Homo sapiens
agtctagactaatagattatgcttcctttcagaagaatttattcggttaggtcaagcaagaacatatagaaagagatatctttattcttttccaaatatgtgatgtggagtactttcatctttatactcagcagctggaattcatctttttgtaagcagtgttatttattataatgtttatatgaatataatttatcaaaaaatggagagctccacaattcaaaatttaagaaatgtctcacctcagattcacagagtaattgccttagacaaaagctctacactcatacattttatatacctcttttatatcctctcattcctaataatgacagattaataagaactaatagccatcctggttttcagtatgaaacaatgtgatttcatgtgaagaagaatagaatagtaagagttaggaccaaaattacttagttctttgggcatgtgagagaataggaaagagctacccagaattttccagagctcacttgataatgtcaagagctgcagctggcagtcactgattctgaaaataggcacacatcatgttaatcaaaaaactaaataaaaggatattgggataaggcactaaaataaagttccttttgccctttctttatagctgggttttgctgatcaattctgcattttttggcaattctacctctttacagggagaaccaccagtattattttctctttaagtaactgaaaaaatatttcctatctttattgagctgtctcattaaagtaacagactagctggatcactggggatatgactttgggatatatgttttaaaataggcacagaggctgggtgcggtggctcactcctgtaatcccaacactttgggaggccgaggtgggtagatcatctgaggtcaggagtttgagaccagcctggccaacatggtgaaaccttgtctctactaaaaacacaaaaattagcctgatgtggtggcaggcgcctgtaatcccagctactcaggaggctgaggcaggagaattgcttgaacctgggaggcgaaggttgcagtgagccaagatcacgccactgcactccagccctagtgacagagcgagaatccatctcaaaaaacaaacaaaaaggcacagaacctctccttgagtttatacaaattaggcatgtaatcagtaaatatggtaaaatatggtaaaatgtaatcagtaaatatggtaaaatggtagaagagcaggcccaaggctaaattctaaactactcatgcaaatattataataatactagagagttgtagaatgtactgattaaactagtgttgcagtagaagaaaggaagataaactatttgaacaacaacttggaggcagaaaactggggattcggctttggaatttactttattggtaattattacttctctagcttgtcgctcacttctctgagcttgtcacacctactggaataagcagaaattgttattctttgcctaggttaacaaaatacacatctccagatagtaagttagttgcatgatggcatcttctaattcagaggtctgatttgtagcatattggtaaggaggcacattcatatttctgggtggtagggagcccactttcatccattcatctgcattcctgttcaaactagcaactgtgtctgctaacattaggttcccagaaaaaagatgtaagtaaaccccagttccactgagc

SEQ ID NO: 55522 - DNA, 1065 bp, Homo sapiens
ttatctttgttctgtaataacattaagattgtcttaagtctgtcttgacagtagccagcttcaaggagagaaattatttgggattcaataatacttaacaaaattaagagtaggatattcagagaatgcagatcacataatcaccttctgacctcactctgtaatttcaagcattctagaaataaaactgttcaaagtgtagaaaagggctatgtttcctttaaacatccttgcagatgaccaatgtgacagagaaagatgcagcttaggggacagttggagaagggagcacattcccacactctttgttaggaacatgccagctctcgtcttcatttattcaatatgctgcagtcccagtttctttctgaagccagagctcatgcttttactcccaggtagcagcagctttacaattaaattttaatccgacagtgttgttagactcctatcaagagtacagccacagctgttcttggcaggcaaatacattgctggttttccttcagtcacagtgagatagaaaaatgttctctgtctagggtgtggacgaaggcactttactaatcttatgcataattcatccttggttgctggggcactcaaagttgaaactttgccctctgataaaattcagctggatgttttttatttattagactctgatccctttaggggtttagcccttattgcgagcccagggattctaatttggctaagccctagctgtgaagacttttcttactaatttgcccttggtgaattttagctcttgtaataccacctttaaaaaacaaaaaacaaaaactgcagtagaacatgcagttcagagagtcctggataacctgaaaagagtcttctttgaatgttggcttattgaatggaaggactccaatagggcctgtcttgatttgttttcaaagtttagatttgtaaagagcctcagcaaattaaaacatggttttaattgtcctataacatgctaaaatatggtaatgattgtcctataacatataacaggtctttgcatttcaaattcattgggtacctgtgaagtataaaata

SEQ ID NO: 55523 - DNA, 1048 bp, Homo sapiens
gtgactttagtgttttgaattcagaagtgtgtttaaatattaaagtctctaattggggccagtcatggtggctcacgcctgtaatctcagcactttggaaggctgaggcctgcggatcacttgaggtcaggagttagagaccagcctggccaacatggtgaaaccccgtctctactaaaaatacaaaaaaaattagctgggcgtggtggtacttgcctgtaatcccagctacttgggaggctgaggcaggagaactgcttgaacctagaaggcggaagttgcagtgagccgagatcgcgtcgctgcactccagcctgggtaacagagtgagactccatctcaaaaaaaaaaaaagtccctagttgggttttaactaaacagggtagtctttgcaattttggcagaaaagggtgttacaggtaaaggtaggaatcagagattcccaaataaattgtctgttttagtacagcaaaactttgttgaagtttgttttactgaacgcatattgtagctgtgctgcggtgggaatgggctttgtttccacatatttctactaatctttatgtgggaaaatgtggttggacatgccaatgatgaatttctgagcaactcataattggctggctccactgtaactagggccttacaatctgcttgattaattctttaaggactacattagccaagttgcatgatttccaaagatatagaaggtcagatgttacactaacaaagaacctctctacagaatgtctcactggggtttctttagtcccttctcaaaaataattaaaatttttcttcccaaattacatttttaaaagaataagcagatataaatgccaagtgtcttttactgaaaagtgaacaaaacttttgggaagatttgtccactattcttaccatttttttcagggaaaagattgatcttcagaaccgggggagttaataaacaattataactatatattaatgtataccaattgaaaaatatatgtttttttaaaggttctgagttttccattattataacctgtgacatgatagt

SEQ ID NO: 55524 - DNA, 1125 bp, Homo sapiens
gacctacaggcacacaccaccatgctgggctaatttttaaaatttttaaaaatttttaagcacgattttgcttaggttagtgtcgcatgcctggctttaagcgatcctcctctttggccccccaaagcgctgggattacagacgtgaaccaccacctgtggctgcaactcacattaagcacttaaaatgttcatcattacaactctccatagcaacttctagagggtttagcaacttattcaagatcacatagctaataagtgacaaagctttttttcaaaatcacctcagcatgattttgtaatcaatattctttcccatgacgccatcctgttcccacacccagcacagttgtctggctatttagatatgctgttgatgctgggataaataatggataactgtcttctaccttgcttagccagagactttcctttttaaattttttttctttttaatttttaaaaacagatttcatttgaaaagattaagacttgtttacatgttattctgaaataaaattgattcttacctattctccattgcagcctttcatcatgtttctgtttacccaaaaaaggagcttcctttgttcatccatttcacagcaggattttgctcttctacagcaatgatagccattctcactcaccagtttcctgaaatcatgggtatttttgctaaagctgtaagtatgatctcaaggacttgtgtagattatttgtaaaacacacaagaaaccatctctgatctgcctgtgctaacccagctgaacaatggaagatatttgttgtaaattaaaggaattgatttgtatatagttgctgccataaatacatcaaacataaatttttggtgatttgagctacttctgttgcttaaaagtttaaagaatacaatataagattgtaacaatataacattataaagtttgctcttatagatcacttttggtgataaacagcatttgttactatctttggtatttttaaaaataccctattttgtaaacaaaccctttgatttttttcatttaaatgaaatcattagttctcaggatttgttgaactttaaactcaagagcacaactaggatggataataagtacataaggcgggggaacag

SEQ ID NO: 55525 - DNA, 1010 bp, Homo sapiens
catgaaaacagccttagccaatatgtaaatgaatggcataactatgttccgataaagttttatttataaaatcatagtgggccagacctggccaaagggccatactttggtgacccctgatctagattaagatctgctcataggccgggcgcggtggctcacacctgtaatcccagcactttgggaggccgaggtgggtggatcacaaggtcaggagatcgagaccatcctggctaacacggtgaaaccccgcctctactaaaaatacaaaaaattagccaggtgtggtggcgggcacctgtagtcccagctactcaggaggctgaggcaggagaatggcgtgaacccaggaggcagagcttgtagtgagccaagatcacgccactgcactccagcctgggcaacagagcaagactctgtctcaaaaaaaaaaaaaaaaaaaaaaaaaaaagatctgctcatagaaagctttggtgaaactcacatgtgaagttaggaaccattgaaaactattttaggttgccaatagtaatggccacaacagttatatacatcccagttatatgaagatttctgtaaggggcagaattatcaattctgctttggaattatcaattgtgtttgtaatgaggagactgaatgaagcaaagaaggacccagccagtctcatctatcactccctatagttttactccagccagactagaccattcactattatctaaataaatcttatccttccccttatttattattttgcttactttgtttctcgtatctaaatgtctcactaaaaaaagaaaatagtatgtgaaatttctatataaatttgtctccaaatataggatggtaaatgagacagaattgagtatcaacacatgcttttttttcctcagcttttagaatgattccatacccgttagagaaaggacatctattttacccttatcccagctgcacagagacggctgatagagagctattacctagtaagtaaatattttagtttt

SEQ ID NO: 55526 - DNA, 1183 bp, Homo sapiens
agaccttgtctcaaaaataataataagaataattcaacatctgtcagatatcacttaaactattagctccagacagttcacagtttcaacattagatcattctccattcctttcaatatcattatatctttgcaaagctggagttttgttagttgctctgattaaaagaagtaccacacaaaaatcaatgtgatataggaaatgagaatggtagtgtccaatgtgattccaagttttgagaagttgtacagtgtctaataggctcatacctatatctcattagtaagaaattatggtcatttaaaaatgaaataagaaaattgatttattgattctttaaatttatgtgcatttttttccaaattgctgctaaattatcagaacataaattttttaagttgtttggactcactattaacaagtgaaattatcttgaaccaattttggaacctctgcattaaccatttgctaaaagccagacactgtggcttgacaatgacaatgtaaataaaattgatgagccaagtgttgtgactcacacctgtagttccagccactagggaggctgaggcaggaggatcacttgaggccagaaatttgagaccaccctgggcaacatagcaagattctctctaatatgtgtgtgtgtgtgtgtgtgtgtgtgtttaaagaaaagattgataaaactgggattatgtgcttgagaaaccaaatgtctttgagtaattcaacttacttttgctttttctccagtagtccataagctcctcaaaagcagatattgttttttgttttgttttgttttttttaagtctatactcaatgaatatcttttctttttttcaaaagcagatattctgtctcactcattttgtgcatgtcttcactgcctgacattctgcttggcaaataggttttcaataagtgtatgattttattttcttttattactttttatgtagtgatgaggtcttgctatgttgcccaggctggtcttgaactcctggcctcaggcaatccttccaccttggcctcccaaaggagctgagattacaggcatgagccatcatgcccaaccacctatgatttatactgtatttcatgaatcatgatcaatgatttattagtgttatcactaatttactctatgactttggacaaataactacttcttattgtggta

SEQ ID NO: 55527 - DNA, 1072 bp, Homo sapiens
atttagccaggccacacatatgccatttatcaccttatttttacctatagaaatattctggttttcataatttgcgtatataagcattttatacatgttatcagtatcttcatgtcatttcagttagttttttaaaaatcagtttaactttctaacactttgaatctacatttttgtgggtgtttgaatttaacacaatttaatttttcttttttctgttgtgtgtatatgtgtctgtgtgttactctttcagtatttattagagatgaaaagtttaattttacctccagaacacattctgaaacggggtgatagtgaagcaattgcctatgctttctttcatcttcagcactggaaacgaatagaaggtgctcttaatctgttacagtgtacatgggaaggcagtaagtattcttttccaaaagtaacactaatctctctaactattcattgaattcacaggcagtctttttaaatgagattgtctgggtttccataaggatttgtcgttcagattggtttcaaatggaaattagtgatgagatatttggtttattggtagaaatgcataatgttatattgatcccacaaaagcagaatgagaaattgttatggtattctgccatatgttaatttaagttacatatttgtaaggaaagaaaatgaaaacttggccctttgacttacaactttttttgtttttttttgagacggagtctcactctgtcccccaggctggagtgcagtggcgcaatctctgctcaccacaagctctgcctcctgggttcatgccgttctcctgcctcagcctcccaagtagctgggactacaggcgcctgccaccatgcccggctaattttttgtatatttagtagagatggggtttcctcgtgttagccaggatggtctcgatctcctgatctcgtgatccgcccacctctgcctcccaaagtgctgggattacgggcatgagccaccgcacctggcctgacttacaacttttttaatgtggttgagctattctaatattttaaaaattggtctttttgttttgttttgttttccgatgtat

SEQ ID NO: 55528 - DNA, 1039 bp, Homo sapiens
cttcttagaaaattaaagtctgggtagcagagtttttgtatttggttttagttttcccagagagttaaaatatatctttggtaaaaactaaaatataaatatgaatttgaagacatttcagctgtatttatcagattaactcagttaataagtttttttttttttttttctttaagatgtagttttgctgttgtcgcccaggctggagtgcaatggcacgatctcggcttactgcaacccctgcctcccgggttcaagcaattctcctgcctcagcctcccaagtagctgggattacaggcacccaccaccatgcctggctaattttttgtgtctttagtagagatggggttttaccatgttggccaggctggtctcaaattcctgacctcaggtgatctgcccgtctcagcctcccaaagtgctgggattacaggtgtgagccaccgcgcctggccaataagtattttaatacttgcttttagtgtaatatgctaggcatggtagtagaattttaaggatatggtttttatagtgtaataagttacagcctatgctgggtagtggaaattcctgagtagcagtttgtgaaggagataaaataaataatcttataatttgtatacattttccttaaattgaaatttttctcttatattttggggatcaacttttattttactgtctaatcaggaattgaaaaattgcttttttgtttttgttttttggtttttgggtttttttgagacagagtctcgctctgtcatccaggctggagtgcagtggcgcgatcttggctcactgcaaactccgcctcccgggctcacgccattctcctgtctcagcctcccgaatagctgggactacaggcgcccgccaccacgcccagctaattttttgtatttttagtagagacggggtttcaccgtgttagccaagatggtctggatctcctaacctcgtgatcctcccgcctcggcctcccaaagtgctgggattacaggcgtgaaccactgcgcctggcccgaaaaattgctttg

SEQ ID NO: 55529 - DNA, 1048 bp, Homo sapiens
ttttcccctgaacttactataagcaggttttttttttattgttttttttttttttttttttacagagtctcgtactgtcacccaggttggagtgcactggcacaatctcggctcactgcaacctcggccttccaggttcaagtgattctcctgcctcagcctcctgagtagctgggattacaggcacctgccatcacacccggctaattttttgtatttttagtagagacagggtttcactatgttggccaggttggtctcgaactcctgacctcgtgatccacccacctcagcctcccaaagtgctgggattacaggcatgagccaccacgcccgtccataagcaggttattgtagacattggttgaacgcatttcaccgttgtgcagacggctttcatagacataatttcatctcggtcagaaaatatcattattttgagaggtgaaaactgaggtcaaacaagttgctactagctcaaagatgcttagctggtaaatagtaagataaagattcagattcagctttttcaacttcatatacgggtttttcctactatattatagatttttcaacatcacgtccaggtttttcctatataactattgaatttgcattgcattgtgaattattcttttttttgttttgttttgttttgttttttttggagacggagtttcactcttgttgcccaggctggagcgcaatggcgcaatcttggctcactgcaacctccgcctcctaggttcaagcgattctcctgcctcagcctcctgagtagctgggattacaggcatgcgccaccatgcctggcaaatttttgtatttttaatagagacggggtttctccattttggtcaggccggtcttgaactcctgacctcatgatccacccgcctcagcctccctaagtgctgggattataggcatgagccaccatgcctggccgtgaattattcttattaaaaaattgtctcaataccttttttgtaattcctacctaaattgaaaattatcgttacagatataagccttccaaagtcagcag

SEQ ID NO: 55530 - DNA, 1053 bp, Homo sapiens
aactggcagaaactggcaggatcaactttattaaaactctggaaactaatgaaaagtttacagtaacctagtgaatgcttaatcaaggggaaaaacacctaaatctctctaagaaagctttgtagtgctttatttatcctggccccatccctcactccctagctcagtggcagtcttgaagacaacagagtacattccaggtataggtttctagtaccagaggaagtggaatggaccttattttcaaagaactgtggtcgtttgttttgacctgtctgttggctttctgaaggactagctcaaagggcttgctttatttcagcttactgaaagaagagagttttcaatttcaaaactctcccagaattgacataactacactctgggtcatttgttaaaaacatttaaaggcaaatgcattagctgctgctgcctggggcaagggataacaggaaggacaaacaatagacaaaccagaaagcttgtgagcaaagtctcgggaattagacactttgaggaataaaggctctaaaaagctcccacatgtttctgggaatcaaggccccacacacagccagagctgggcatatgctcagaaaagacttgagaaagtcctaagctgtcaagtctgcctaaccttcatgttctgtacaagtaggaggagaaggctaaggcagagttgtaaactgtttggctgaatgttgaaggtgtgccctagcacccacacagagcccatctgcaaatacttttgctttttgtgttttgtttggttttgttcccaggtgtttaaggaaacctctatcaaatcaccaactgaccacgaggctaaaatagcacacacatcactggtcacacatgacagataatatagattttataaaattggttcagaaaagtcactaaacaaacaactgcaaaagcagcaacaacaaatcctagggagtagagaaaattatgtctctagagttgccagaatataatatttaaaatttccagttttcaacaaaaaattacaaggcatgcaaagaaacaagaaaacatgtcccatacata

SEQ ID NO: 55531 - DNA, 1056 bp, Homo sapiens
ttgttaggtaggatagggaaaccagagaaacattctttggtagatcagttataggaaagagtgataaagttgaagctttagaagttgattttcttaaaaccatgtattccattttggtccttgcaaagttttatgtacttctctagaggtgtgtctaaccccagctaaaggttgaactcaaggaggacagagtgtatctgtgaatgatcttcagaaatggactgttgattccatattgatcttttcagaccctcacataaaggtcatgatttatatcagtagttttattttcagaaatacaaatgtgtatttttgtgatgtggcaaatttctcttgacttactgtcatcagtaataactaaattagattttgttcttattctattaatttatctagggcagagaacaaacttatccagaagggcccaccattgttttttggatttttttcttcagcatttaaaaatcaggagattttacattaaaatctgaatttatgccttttgaagtttgaaaaatagggcaaaattgaacttgaatttacacttgacagtaataagatggaactgagttgtggctctccctttgagacagtgaatgtgctttcagttcactcatttatgtttaatgcctggcatttgtaggcatttacatatttatgacccctgaccttatgataactgctgatctgttttgtgcttgttagcttattagaatgttatttaacttgaaaaatagataaatttgagtgaattgctaattgcttgttttaattatattcagcatattaagagcccttaaagaggacaattgaataccaaatcagcattttgttttaaattactcctaagccttattttagaaaaaaatatatacatttttcccccatcaactttatttctcctttctgcttaggcttaggactgctttggttgtgaagaatactcttgaaaggctaggtagagcatttgaaaacaaaagaataagataaaatatttaaaggtgaattagatgacctcactagaaatttaaaaaaacacaaatgaaaataagtttc

SEQ ID NO: 55532 - DNA, 1056 bp, Homo sapiens
cgccctctctcttatgtcctcgtttttccatggaaaagccacctgacaagctataagcttcaggtattaggacagaagagtgtctcagattaggatacgtaatttatattggctcccccacctctggtaggatcccttaaaagtcactactttgagtctcccgctgcccagctgaaagaactcatatccaggcaacaaagatgagcacatctgtaatttaaagatttcagagaaagaaaatggcatgattttaattgaggattctcttgttttaaaatagttctgttaagaaatcgttttcgtgatagttttgtctgttcttttaggcttatcttgagtaataaaatagtacaggaagtgagagcgccacaaacaacagtgggtttgctagttctttcgacgtctgtagaacacttgctacgtattctgtgctgacaatacgaacacatgtaagaagtgatgatcctgatggattctcatatactgtactattctttagctgtagacaggatgaagtgtttagggcccaggtccccttaccatgtgattatatttcactcaagatctgagcagcaacctcagaacaagatataagtatttccattacatgattcagtatggtggttgatttttctgaagcaaaaggcagcaaatgtcccctttcctgttcagagatgacatgaaagactgtgagttaatgttcggaaatattttggtttttttggaggataggtatcaagttcaaatataactagcactctaaaataagctaaactgaagagctaatttggcatctctgtaacaggtgaatgaagtgcttaacggtggtttctatgcacagtgttactgattgacttgtcatttatttttctacgttaaccatatgcaacatttagatgagaatagttgattactatagatttttcttttttacgtttcgtgtgtgtgtgtgtgtgtgtgtgtgtgtgtgtgtgtgtgagagagagaaagacagacagagtctccctttgtcacccaggctgaagtgtagtggcaagatcactgcagccttgaact

SEQ ID NO: 55533 - DNA, 1055 bp, Homo sapiens
agatcatctgaggtcaggagttagagaccagcctgaccaacacggtgaaaccctgtctctattaaaaatacaaaattagccaggtgtggtggtgcatgtctgtaatcccagctactcaggaggctgaggcaggagaatagcttgaacccaggaggcggaggttgcagtgagccgagatcgcgccattgcactccagcctgggcaacagagcaaaactccatcaaaaaaaaaaaaaaaaaaaaaaaaaagaggtattatgatgtaatggaaaagagtgattgtgagtgttagatatggcctttccctttcgtgcttctagccaccttgtcactgattttggaaacctcacttaacctctatgggtgggcctcaatttccatctaaaatagagaagtagggaggaattggatcaaaccagcccaagaaaatttaattaactatttcaaactctaatgaaaaatctctactttaaaaattgaaacacaaaaatgttctgggaggttctattcattgtctgctttcctacatttgccctgattacaagactgagttccttgataattgaaaccatgtctctttatctagtgcctagcatagtgccaagcacacagtgtatgcacagcctattggtatgaaagagaacacaacttcattaattctcatatctctccagttcacaccccttcatctcctgtaaaacaccccttcccctacaattatttctgttagtctctaggtgtttcttgtattcaagagtatgtccacagtttgggtgcctctgtgcattccttctatctgagcatctgccatcattggtgctctgccatgccactgctgggaacatttgacccctctgggagcatcttcctaatagatcccataaactgcaaagccttatggttaccaaaatgatggtgtatatatatacttggagccttgcaaagcccctaatgaaagtatttccttcaccagctagaagtactctcctttagcgatcagattaaaacacacacccaggtgtgtgttttaaagaaaaaggacccaagagggaaaaa

SEQ ID NO: 55534 - DNA, 1753 bp, Homo sapiens
aaataattgtttttatctcatagagttgttgtgaagatttaatgaattagtaatatatgtaatatatgcctggaacagtgcctggcacaaagtaagctctacataaatgttagatgaatgttaggctaggtgtcattatgtttgattttttttttttttttttttttttttaatgagaatacccattatggtggactggacaagtatagaattcctgttgggaagccagtattgcaaaggggagacatgatagactcccatttagaaattgactgtttaatcctaaatatactttgaatttattgtttgttacctgttcaaagtttgtcactacccattcttaatttggagagctccagcaccaaataaccctactgtgtccttagctatcaaatgacctacagaaagtcatggaattgttgtgatggtgtctgctgtatataagtatcctatgtcttatgtcttcagctgacctgcttagtagtccgtaatttcatctccttattccctatcacattttctacatagtatgttccaaacatttttcattgtcctctgacaggcatctaatcccccatgttttgtaaggattgaaactgacagaaattttttttttttttttttgagacagagtctcactctgtcttccaagctggagtgcaatggtgtggtctcggctcactgcaacctccccttcctgggttcaagcgattctcctgcctcagcctcctgagtagctggaattacaggcgcctgccaccacacctggctaatttttgtatttttagtagagacggggtttcactgtgttggccaggctggtcttgaactcctgaccttgtaatccgttcgcctcagcttcccaagtagctaggaccacaggtgcacaccaccatacctatctaatttttctctgtgtgtgttgtgtgtgtgtagggactacaaggcatgagccaccaggcccggcctatttctccttctttgtctgccctttccaccttgccctttctccctcttctccactttttcccttctctcatctctctctgcatcaccaccacgtcagtacatattctttgcctgctaatgccatttcctctatctacttctgaaccctttaattttttactttagtctccattctacagaaactgctctgagtttactaatggttcctgagttacctggtccagtgtccttttccttgtccatgacttccgaatggcatttcacactgaagccaatcaaccacttctagaaattatcttttacttaggctgctgtcagcaacccctaattcttttttttttttagagatggagttttgctctttttgcccaggctggcgtacagtggcatgatctcagctcactgcaacctccgcctctcaggttcaagcgattttcctgcctcagcctctctagtagttgggattacaggtgcccaccaccacacctggctaatttttgtatttttagtagagatggggtttcaccatgttggccgggctggtcttgaactcctgacctcaggtaatccccctgccacagcctctcaaagtgctggggttacaggcttgagccattgcacccagccccctaattattcttactctatactaagttctttttttcccctacctttgtaaatgtaggcattcccccaaagttcataattcatttaatgcaggtaaagtaacacagacttcggtgtcacaaaaacagtgggtttggattctacctttaccacttcc

SEQ ID NO: 55535 - DNA, 1055 bp, Homo sapiens
cagatttattagaggaaaaagaaaatacatgtaagaacatattttgtggactataaagcgctattttttttttcttactttcccttggtgattgcatttccattcacctctcccacactaaagaagagttagtgtttctaactactaactagacatctccatctgtaatttccagtttgttaatgacaccaccatctttttagtcactcttgagttccttctttcctttgcccatcatttgcaatatactgctagactttgattgtacttctacattctgtgtgcaactcttcctttccattcccattaatataactctgacttgttgcctagattaatcctgtggcctcctaaccaagcttcagcttttcttcgttttatcttgaataccagtattgattattctcccacaatattagttctagtcatgttttgctgtctctccattgcctatagaataaaatcttaaacttcttactttacatctactattacatgacctaaatctaccatcctgttttgtctttcattagtccacttcacacacaccctttaaacctgacagtcttgttcactgaacaagtccttagtttcctgtcttgcctttattttcagtctctgcttatcagaatctcatctgtcttgtatgacccagcctaaatggcacccgccttgtaccccaaaccaagagcagtatttccctctgttttcattgtatcactgtctctggtagaacctaacatgttctgctttgttttcatatcccatgtgcactattgtgttctaagctcattttatgtgattctttgtctcccccaaggatttaacactctgcttttgtacaatgcatgttgtttaaattaaaagtgtttggagtctttaactatttttttttcccaacaataggtttatgctaaaactatcgatgggcaacagactattattgcatgtattgaaagccaccagtttcagcctaaaaacttctggtaagaagtagatattctcttctatttacatctgaaagaaaccagcagttgagacttggtttttaatcc

SEQ ID NO: 55536 - DNA, 1054 bp, Homo sapiens
attattattttttgggacagagtttcactccatcacccagactggagtgcagtgacgtgatctcagctaactgcaacctccacctcccagcccaggctgggttaattcctaaaaattataactagagagaatggcaggtgttttggaatataaatagccaagcagaagtagattgattgattgattgattgattgactgattgattgatttttgagatggagttttgctcttattgcccaggctggaggtgcaatggcatgatctcggctcttcgcaatctctggctcctgggttcaggtgattctcctgcctcggcctcccgagtagctgggattacaggcatgcgccatcacgcctagctaattttctatttttagtacaggcggggtttctccatgttggttaggctggtctcgatctcctgacctcaggtgatccacccgcctcggcctcccaaaatgctgggattacaggcgtgagccactgcacctggcccagaagtagatttttaatgctgatgtcagggtagacaggcagctgaataagatagctgttaactcatttgatgcctgtctggattgaagtttaatatcctagcagaggtttgactttctaaactcagggtgatttaatatttaagcctcactaactgtaaggtcagaataggtacaggtaaccgagaagatcagtacctaatcgtacctgtattatattatgtgaagctgtgctttaacaacaattaccaagagttgtctttttttttttttttttttttttttgagaaggaggagaaggaggagtctcgctctgtcgcccagcctggagtgcagtggtgcaatcttggctcactgcaacctctgcctcctgagttcaagcaattctcttgcctcagcctcccaagtagctgggattacaggcacacaccaccacgcccagctaatttttgtatttttagtagaggtgggatttcactatgttggccaggctggtcttgaactcctgacctcaggtgagccactgtgcccagccaagagttgtcttttttaatgctct

SEQ ID NO: 55537 - DNA, 1993 bp, Homo sapiens
tggtgagttctgtttctcataggtgacaccttctgcattctcacgtgacagaaggggtgaacactgtcctcatgaggtagaagagtggcaagagagcttgattgagcctcttttagaacggcactaatcccttgaaggcttcatcctcatgacctaatcacctcccaaaggcccctcctcttaatattatcccattgcatattggtccaacataagaattttgggaaggtaccaacattaaaatcatagcactagataaatggcattacctggactattgttctggcattatgtctccaatagcagctccttcgttttattttcttcatagcacaagtataatctttctaaaacattccttttcccgtgtgtcacctataataggataacatctgcattcttttttttccctaagatggggatcttgctatattgcccaggctggtcttaaacttctggcctcaagtgatcctcccgtcttagcctcctgagtagtctgaattcttaacatggtttataaggtgctttgttcttcacagtctgtgtttccacttcatagcaatgtctcctgccacactccttttttacacatattcatatgcagtgagttctttgttcttctccaaattaaaccagttatactccattctgttatacttttttatctccttggtgtagatgtcattctctacctgtctacttaggtgacaactactgttttcaagatcctattcaaatgcacaaaaggataccctcatcctattgtgtatgaccaattagtagccttgtcaaggtgactaaacctatcttaagttgccaaaacttaacctaaaatgtcattgacttgttagtctcttctcctttttgctaattgtttgcataattgtagcacttcactttaccttacatattcagaactacttttatcttactttttaaaaatatctgatttaccaataaaatatttgtttttctgtcctgtctttaaccctcaatgtgacttttcctgtacctggtcagttctgcttaccaacattgatgataatgtatatggagaaatgtgccaaatattaggtatgaggatccattaaaattccttggttttcacagagaaaaactaatgtttaataactttaattattttaatattgttaagagtgggatctcatttacctttgtattcacaatgcctagcacagtgcttagaatgtgaaaagcatgtaataaatgtttcttgaacttaataatcagttttccttgctaaggaaaaagcgttcttaaacttaagtgttctgtggattaattaaccaccattgtgaattaccactgcttatattaattatttgttcagagttggtaaaatggctcatcaacttaaagatagcttaaagcatggatttgtgtcctaaataacaggtttctctatgaacttcccctaaaaaggctcaaacattgtctcacacaggttcactattatgaagatggcaatgttcagttggttagtcataaagatgtacaggattcactaactgtttcggtgagtatggaatatttagtgtctgtcttactcatgtctcgtttttctttaaaaaattagttttgatcctgagtgctgattctgccagtagaaattcagtttgcttttaatgttttgattttggccacttctgttagtgcctcttatcaccaaccagcatatattagttcacagtttttgactcacaatattgattatgactttagacaaatgtccttcttagtcgctctctcaattgtaatagttactcaaggacagcaataccttcattcaataaataccaagagcaaggaaagtttaccaaactgcatcctatagggctgcatttatatcattagagaaacaacatttttaggagtattcaattagaatgttttgtggtttggtggtggtggtctatttgagacaggaattcactctgttgcctaggctggagtgcaaggaaggacatgatca

SEQ ID NO: 55538 - DNA, 2317 bp, Homo sapiens
gcattacttttctgttcacaaccagccccatttctgttcaagcaactcatcttcaattatctattgcagacagcaattagtgaaaactatcaaacaatgtcagataccacattcaaggccttgcgccggcagcttccagttacccgcaccaaaatcgactggaacaagatactcagctacaagattggcaaagaaatgcagaatgcttaaaggctgaatgtaggattcttcagtatgtggaaagacaaggattcaacgtgtggtcatatgataaataagtgatttataaacaagagtgatattttgctagggctttcaaagttaaccggttttctagcctcatggaatactgttgaacctatagcgttgtcttgattcttttgtgttctctgccttgtaattttctgttactgctatatctacgtgtaaatctttttttctttttttttttttttttttggttaattctgccacatttaatgttggtgagagagtgatctatcctaatgacattttactgtttaaaaaagtttcctagccatgaagccctgctactgatttagacaaggtattatggtcattactttgtacccctatccttccaagcacttctggtacttcagtcgtttttactgatccaccaacacctaaagaggctatgctacagtctctagctaaatggaagacacattcatccttctccctctgactgctttgatcatcatttattgcatctcataactaattttctaaagtttggattgggacttttcaggtcctttttggagggcaaaggaagtgccagcttctctggggaacttgtttttaaatccaaagacttgaaccacattccctgcacatgaacatgtttgcttttatcccttctctcattgtctccttcccatcttagtaccattgtagttataaacatctgcattttttagaagcattttacccatttatttttttaaacattcaagaactgctgacgtactgtggatgtagagtataaaacttgaaaaatgcagatgttgaaggaataataggtatcttgtgctttaatactttatggcaggattgtactataagcaaatgaattaaacagctatgtaaatcataaagaaaaactaaaaatgaaccaaagtgaaaggataacttccaggcagtatctttctattgtaacctgttatttaaggaaatactagtgatttcttctaaataggatgtaaaacttctttcaaattactcttcctcagtcctgcctgccaagaactcaagtgtaactgtgataaaataacctttcccaggtatattggcaggtatgtgtgtaatctcagaatacacaggtgacatagatatgatatgacaactggtaatggtggattcatttacattgtttacacttctatgaccaggccttaagggaaggtcagttttttaaaaaaccaagtagtgtcttcctacctatctccagatacatgtcaaaaaaagaaaggtgtttgtgcttccgttttgtttctgctcagtaatatagtcaagcaagtttgttccaggtgacccattgagctgtgtatgcatttttgtttatttcaataaaatatatttgtattatttgtccttcatactatccatccataccacactatcttctgtatcaggtagtctaatagaaatatacctgttttgttctaaaattgtctgagtctctcctttttgattcatcgcttcagccttggttctcaaggtaagatattcagctgtatttgatcttatgttgagaatgtttagggtttctaaaattggtttctaccttcaactatttatagactctgaatatccacagatttgcaaagaacagctttttaaagcgtgagcaatgtctatggatcatactgctcttcactcaaagactacccatgtttcaaagggaaaaatgtagttgtcttctgtacctgtcactcagaaagcaaggcccaagtacagttgtagtcactaggcagaagtagaaatgaaagaatccctgccttaaacttggtaatatttcacattgcgttatcttgaaatgctgctttcctctccttagctggcctagctacaaacttgtgggagaggcttttatcctggttcccaaaagaaaaccagagggagtttttatgcttcaagtactccatccaaggccagttcaaattcccacctttttgaggaatatttagctgcattccattctatttgtaatgcaaatagattgaaacattcttgcttttaatttattaactctctcatcctgcccctgctatcccattgattccttagctta

SEQ ID NO: 55539 - DNA, 1077 bp, Homo sapiens
cagccgacctagatcccagccctgccctttgctctcctgcttttcactgagtcccgaggctctggagggtgggcgtgagggtagccctggctgaggctcggaggtcctcccgggctgttcagagggccccaagcggtagccacgttctgatactggctagaagccaggggagggagcttggggtaaggggagggccctgagggaggggtcagacgctttaggaaagagttaatgcgaagagggggaggggataggacgaagaaaccgaagggaaagctcaggtaagaaaagaacggaggagggaagcctggtggggagaagggagcccgcaggatcaggggtcagagttagggggcttccctcctgctgcaccctcatctcagggccgccaacttccagctgcagcggcgactttcagtttcatttccacggaccctcctgcctgggccgcagccgccgccgcgatgcccagtaagttcagctgccggcagctccgggaggcgggccagtgtttcgagagtttcctggtcgttcggggactggacatggagacagatcgcgagcggctgcggaccatttataaccgcgacttcaagatcaggtacgggccggcccactcccggccccgaatcgcgggcccagcttgctgccacgacccccgcgcgagggccacctttcccgccccggggcgcagagggacgcagctcccccagcggctcaggccagtcccggggcggcgcagacctcccctcccgcgcctcgcccacgccccaccagcgccgcccggagcccgccagttctgcccgagctgggcccctgcgccaagtcgccgcggagagcctcccgcgctgcccgcgcccccggaggccggaacccggggccgggagctgcgtcccgcgtccatgcgccgctcgcgggggctgagggacagcgctcgcggtgggggaggggagcctccagagggggcccaggcatcgcgggagcgcgggttagaggctgcctgttgggggctgcgagcccgagcgcgggctttacagggacctctgccaccttgttgaggcgctgctgcctcggggg

SEQ ID NO: 55540 - DNA, 2272 bp, Homo sapiens
gtctggaatatcgttttcactaatggttatcacatttggagagggatattaacaggcttgaacaacatctgagaaggggcaaagatgatgaggccctgttttatgtcaccatgctggacactatggggactcttaagatgaaaaacacacaatcccagaggagcatcagaggctatgatatgcatgcaatatacatgtacacaatataggatagtacatggtaaaatggaggattatactagggatggtaagagaaaaatgctggaggaaagagcgagcatttgcatcacatggtatcaacacttaaggtatgtgaattcacctatatccacagagtacaacatggctaggaaacaagtcacctacttcttttggctctgttaaggaaaaagtaattggttaaaacagtaaggctgacttgactcaaggctatggtaatagggtattgcaataggaaagaagagagttggagctcaattccgaatacagcaaaaacagcgggggatttatgaccaatgaacagagtaaggggatcaatatatagaaaattactaagaggagtcataaagagtgggaggatttttgctcacctgacctaacaagattcttgttaaaggcagaccaaggacttgtacatcaaaggcgggaatgaggaacttgatcagatatcaagcgtggtcatgcatcaagggtgaggagtctcactaaaatgacttcagtattcttgctaaaactgaactaggtgggcctaagactgaagggtttggggaggcaaggtcaagggctagtcaaaaagagggctcaggggagtctaacaaaagtttgatcaaggagagtctttgtcagctctaaaccaaaggtacatagtatgttttagtactggggaaaaactggttgtgttggattgcatacagaaagccagatatactgtatattatgggtgaatgtaggcattttccaaagtagtttttactgtatgcacttgtgtttatgcagataagataccactcctctgtaatcattaggggatgtgatggagaagatggcattgactttagccttgaaagagataaaattttagtacatagaggaggtggaaaggccttctatgtgggttcatattctatcctgagacccagtgaaagaaactcagaaatatttgcctcaaaaatagaaaaatcagacagtacaaggtaattatccttgactattttggagtgttataatggataagattgcactcctgtgtcactccagaagacagaagcgggtttcatcaactatccccgctctgtaccctcatcatgttggggaaatgtatgttcagattaaagaacttgcctacacatcctttaaagccaggctggaatgctgtgaagtcaaccttcatttcccagtaggaattacttgctttttctctgggctctcatggctcattctttataccttgggtatagcctggtattatggtcacgttacactctgctttatggcacgtggtcatctcctcctggtaccaaatcattgtaatatgctaaagccagtgtattatgctagccacgcaaatgctagatcctctacctttagtcaggtttatatctgtctgcagtccccagcatagagctttgtatgtagtagatgctcaataaatgcttgcagaatctaagtgaactagcaactagagttaactaacaagagaatgggccatatagcggggggtatagcaagtcacactctttaggaattctaggagattcctacactgagaggggataggtctctccagctaggttattttatgatgttataaagtgctctgctctgaactcttgccttttcccacctacctttattcatttagcaaatatagttaatgaggctctactgtgtgcctgtgccttggtccttgcctccaaagaatataatctagtaaagagcagcagatatgtgtagacaaacaaatgcaatacagtagtataggtgctagtaatggtgtttagatagccctgccatttagtggttgcatttaactttgaacaactctctaaattttccatttccccaactgtaagagtatgtaaaatagtacctttctctcggggttgtgagagaccaaaatgagttgtcctaggcaaagcatttgtgtggctagcatattacactggctttgttaagtggtacccctcattagtgcgatgatgattaggagtccattgtatggggtaaggactgatgtcacgaaaaggtttctgagagaagatgattcttgctt

SEQ ID NO: 55541 - DNA, 1030 bp, Homo sapiens
ggccatccggggcctgcattccctactggccccgttcgaagataagcagttacctgcttcagacagggcatgcacttcccagtttgttcagtccccacaaagccctctttctgcccagcattgatctgggagcctggagccacttttcttggaggttgcactttgttttcttagcgttgtgagggatatgcatgcagtattcttacactagtgactctcaaaaatggactgaacaggtgtctgaaagggctgcaaggatcaagatacctgtgaagcatagctgctgtaggcattagcttgtgcctcgatccatgggactttgatggactctaagaagcccttgtgaaagttactgatgatctcctgatttcagtccctgtattactggacccctcagcagcttttgatcctgatacctgattttgagactttgctgattctcctttctctcttgagggtttcttgttttcccttcctccccgggttgtgctagtagctgctctcaactactcacactccctggggagattcctacacttccttgattataaccactacctggggactccctaatactaggctgtaaccttgactttggcctgagttctcagcttctgactcgtggagctggttgcctctggaccacaggaatctcaaacgcatcatatccaaatccaaatgtcatggtcagtccctccaacccctcctcctcttgtcttacatcctatctcagagatagtcctagaagccaggccattgatttggggatcctagactcatccctcttcccagccttcattcccccttctgtcagtcaccaaatttctgctaattttacattctaagtattagcgaatcttgccgctcttcttctgtatctctacccactgccttgctcaggcctttgttatcttttaactggacaattgcaagggccttcttctaactggtctccctgcctacagtcttgcctccagcaaatccatcctccaatcctgatgccagagtgatctgaaatgcaaatatgatc

SEQ ID NO: 55542 - DNA, 1062 bp, Homo sapiens
gcccctccgacgcttgttcttgcggacctggaggccagcccgagtggccatctcaaacacctcccgcactccctccttggtcttggctgagcactcaaggtagccaaaggcactgatccggttcgccatgtcccggccttcctcagaccgaacgggctcctgagaagacataagatgaggggtcaaaggaagctgttgactacatgaacctctcctgcctcacccataagtgtagcagctggaacaaatgcctccttctccagccctgacccagaaagcgcccaggccccagctaccctgggcagcttcgtggccagggatccaaaaatccctccagtctactccctccattcccatgcagccccacctcctcccacacacagcccctggttctcttgcctgaatgagcgtctcccacctcctgactgctctgcctccatcctcactctcttccagtcagaattatttttctaacacacagacctaacatctccccagtttgaaactttgccataattatctttgcatttcttatcctgacagctttctctaataaactctagtcctctggctagagagccacttacaggtccctgaataagccagctctcacatcccttcttccagccacttacacaatgcctgccctcattcccgcatccacatccctacacctcccccaggggcactctgatggcacagcctgggtatcccaagtgaaacataagctgtctccccgagggcagattttcttaatcatcttaatagtcccaattctgaacggaatggacaattaactggaataaataaaaatgccaagtgactttggacaagtcacttcattctgatacctcatcagacacaaccctatgggtcctccctcaccaggagatattactgtttcccctaacacacggcagtagctggagagaagttccctttgcccgtctgcaacccctcagagggtgcattcttccccaggggctccagcctggcagccgtacccacctgcttcatcttggccagctctctcctggtgtgctcgtcttgcctcaggtcctt

SEQ ID NO: 55543 - DNA, 1043 bp, Homo sapiens
accccgccccccagtcactgaatgacctagtatgtccttccccattcctacccctgtctttgcttcattctccctgctggaaccagtaaaagttaggaagtaaatctgcagtcttaaaaaacctggatatactttctggttctcccacagactggctctgtaacctgggccgagtccctttgcctctgggtttaagctcccccacctgcaaaatggggatgatggtaagacctccctcaaagggttgttgtgagaattaaccaaaataatggtgctcacagtggcaactcaagggtcaaacacgtcttagatttctttaacaaactgacctaatttatgttgtgggacagtgattaatataatgcctggtgcatagcaggtgctcaaataaagaagttcagtgagcccgaaggacagtggtttcaggggacctttgggtggcagggttggggccctcaggccagctactcactggccctgtgtgtcaggtggagctggctctgtgggacacagcagggcaggaagactatgatcgactgcggcctctctcctacccggacactgatgtcatcctcatgtgcttctccatcgacagccctgacagcctgggtgaggggattggagggaggggactgagaaccccttggaatcagccagaggtctcgtgccttggcctgtcttcagtcatcttcagaggtgggggtggggatgcaggggagcactcaggccctgttggtctcctttactgtggtaactggccctctgagggcatactactgttgaggttttgagctgtgaaagggaccatcatgctgaatggcttctaagactgctctgggaagatgagggcccccccaggggagctttctagcttaagtggaggcaccgacacctgttggtgcatgtctacacagaaaacattcctgagaagtggaccccagaggtgaagcacttctgccccaacgtgcccatcatcctggtggggaataagaaggacctgaggcaagacgagcacaccaggagagagctggccaagatgaagc

SEQ ID NO: 55544 - DNA, 1143 bp, Homo sapiens
ccacttgggagctggaaaacatgagtttcaatctaatccacttgccaacctggggactccaggtagctagagagctgctcagggatgcgggacgtccagggagcaagcttctatctacttcacacatcagggtttcgagtcagacttcattggttaccaggattttgatgcatttacagtttaataatctctaaggtccaatctagaacagactgtccctcagcacaagtcatacctgtccagtcacaaatgaggagtccctctctaggaccagagtagcagaaccagctaccaggtggtaggtgggtaaaggaagaatagttatagagcccctaggtgccaggcactctgtcgggcattttggcaggaattatctccttcggtacccagatgcctggaaggtagatggtgcactttccattttgacaaaccaggaaactaaggctcagtgaggttaagacagattcagagctgtggcttataaggggcagggacagcacccaaagcaggactgtgtgactcaaagtcgtgcctcttcgacatgtcacctcaggggcaggagggagagcagaagcagggaaacccagacagaggacaggggtagcagccagccagcttccctggtccaccccacccggtccccaaagccccaagtaatacaaaggaggctcagtcccagcaatgcccacagctcgagtttgggcaggctgccttcctccccccttcctcctaggcctgccagcaacactgggtcactcagcccccggcaggggacaatgaccacactgtagggagccacacatctaccacagcacagtgactgagaagaatccaccagggaatcacctccacccactctggaacagccccttcctccctcagtccagctcacccgcatgccctgcccacccctccctgtgactcagggcaaggagtcagcttcccgggcttccatgtgtcccccacccccagcacacacagcgagcatctgcacagttcatcacaccttcgcagcttccctcacttcctccttccctggggaggggaactgacctccagccggctgaagttcccaggctgcaggaagagagggcgggctctggagctgagatgaagtcaaggctgttgggaagggggaggggg

SEQ ID NO: 55545 - DNA, 1820 bp, Homo sapiens
tcttaccgtagttcccctccccctccacacccagaaatagcccgcgacaccaggaggccgccagcttccccaggagcggggagggggacgcccggggtagaggagggtcccatttagatgcccttcagcctgccaactcgtgctggcctggcaaagaagcggaccccctgcccggagcggccggctggcccccgggctgtgtgtattttaaatgcatctgccgggaacgcagagcaccgagggagatgggggcgctcagttcgctgaggaaggtggctggtggcccatggacccaccaccacctcccttagcctcctgtgtgggaggagtttatgggtatgtggctcctgcccagtccaggtgggctttcacttctactctatttcagttcctctttcccgatctgggctggagagcttcctcattgttaaggcagcagaaactttcgctggatggttttaggataagggtgggtgtgcccatgaggatgaggtgctggggacaaggcactgggagagttgatagtggttgagggtgggatgtagggtctagctagcagggaagtaaaacttctgctaccaactagcccctcccccagaagcaccactaggaatgcctttttcttttttcttttttttttgccagggatgggggaagtgaggcaggcaggggacatagcggttggccagaagctcctgctggcctttctgtgaagtggtagggctggccacccaaacagtactccttacaccttgccagccctcccttctcctcctccctctggcctggatcccaggtggctgtgacctttctcagcttggccagcgggcgcaggagacggtgtgtgtctaaggtgggggttattccaggacctggtctggtgtccaacctgatgtggtcattctggcctggcagggtcatcaatgctggcaagagtcggcacaatgaggaccaggcttgctgtgaagtggtgtatgtggaaggtcggaggagtgttacaggagtacctagggagcctagccgaggccaggtaagacccatcccctttcccagagacacagtgacacctctccccagggactcaggcctctggttttaaatctgagccatgcggaagacctgatgaactcactggctatctaccttctggcacagaacctttacctggtattcatcagttagattctaccatgtaagcatgaatgttactttcccacctaaaatgtagaggctcacatatttatggatgatttaattgccagtgctgagttttggatctgttatcctctgagtttgggtttttgagcctttcctttctcttgacacatacgaagccttatgtgaataaacctaatttgccttcagtagcaaacactgacctctcagatgtttgtatggatgcccagagtcttgttattcaccttgcataacacacacacacacacacacacacacacacacaaacaaaactcacctccaacttttcctccaccagggactctgcttctactactggggcctatttgatgggcatgcagggggcggagctgctgaaatggcctcacggctcctgcatcgccatatccgagagcagctaaaggacctggtagagatacttcaggacccttcgccaccacccctctgcctcccaaccactccggggaccccagattcctccgatccctctcacttgcttggccctcagtcctgctggtcttcacagaaggaagtgagccacgagagcctggtagtgggggccgttgagaatgccttccagctcatggtgagtgggtgacctgggccaagagcctgctaggcaa

SEQ ID NO: 55546 - DNA, 3395 bp, Homo sapiens
cactttaaggaaagctttcttgaccccacttctttcaaactctcctggtagtacttgtcacagtttgtgtagttacttgattaacatctcttgtccactgaactgtggatcctctgttcacccttatcctcagggcttagctgagccagtgcctggtatatgataaaggctcaataaatattgttgaatgaatgatgccctgagttagaaagccatatggaatcatatttaaattggttgtattaagtcctgtttaagcatagagtagaattttcccagagataccagttcaatgagatgctaataaattttacagtaatgaaagttacatgaccaaaataaaatttgtaaacatcaaattaaatagggttctttactaccagacttcacaaagcctttatgagaaaataatatgccatttatcaattcatttgacttttgaaacattaaagcagtatccttgtagcacatgcttaagggtgcagacttccgagtcagactttctaggtttaaagccaagtcatttcacttattagttttgtgaccatggacaaattagctaacatctctgtaatttagtttttaaatctgtccagtgaggatgataatagaatctgcctgttataaagattaagcacttagaatgggtgtaagatattgcttttaaatttttagcactggacaagtgtttacaggaatactctttgggaaatgctgagagagaaagagcattggcctgggtaaatgggacagcactatggccttggacaagactcccaagcctcttttagcaacacttatttctatagtgtattaagagaattgactctaggtgatcactacgtctcttccatttccagtttgccaagagttaactattttcaagttactaaaaataacagaatatgcaaaggccacttaaaatccatgatgcattataaacagaggatcagctaattttcagcaattccttatactaattcatcattttgggactctttaaagattggattgacatctttctgaatggatccttaagctttgcttgggggaaaaaaaaactgtttactcttagaaacaactgtttgtgttgttttacatatttaggtcggctcaatgacatgtatggagactacaaatacacatactgggcatgtggcgtcgtcctaattatttcaggtatctatctcttcattggcatgggcatcaattatcgacttttggcaaaagaacagaaagcaaacgagcagaaaaaggaaagtaaagaggaagagaccagtatagatgttgctgggaagccaaatgaagttaccaaagcagcagaatctccggaccagaaagacacagatggagggcccaaggaggaggaaagtccagtctgaatccatggggctgaagggtaaattgagcagttcatgacccaggatatctgaaaatattctactggcctgtaatctaccagtggtgctcaatgcaaatagtagacatttgtgtggaaatcataccagttgttcattgatgggatttttgtttgactccttaccaatagcctgaatttgaggagggaatgattggtagcaaaggatgggggaaagaagtaggttctgttttgttttgttttaatcttagcttttaatagtgtcataaagattataatatgtgccttaagttttagtctttagaactctagagagccttaacttcttaaaccatttttgctgaattcatctatttcgagtgttgtgttaaaaggaaaaataacaactaacttgtttgaggcaaatctaaaatttaaaattaatcttgcttcattgttacatgtaatatatttcagacattttcactggaagatttatgaacagaaatattggttgaaagttagagattttacaaaatgctgacaaaaatattttcctagcatcagtagatttctggcatatgtttctgctagctatatatttaggaaattcaaagcataaaactttggcaacatcttggctgttctagacacagtgtacttgtcaacccctctcaggtaccttttcttgggatgcttattagaagccaagtaaagtgcttaaggtttgttttcattaaattagctatttctgctcccctgttcaaagatgcattttgagtgtttatagatcactgccctttttgaaatcacctggtattatttttcttactggaaaagttagtattaaaatctacagaactacatatttgtgcctccttggtaaatacaacacatctaattaaatgtagacagatatttcaaacatcagctgaattcacttaagtttttccaaaacctcagttaaactgtgaagctattggaatttttttttcctggaatttttcccctttgattcacagtggtcccatttatatctgcttctagcttagtgctatgtgtgagatatgtgtgtgtttggtgtttttgtttttttgtttttttttttttaaggtttgcaaattaaaaagggccagaaaaatttggcaccaggcaaacgaataaagataggattgggaaagaagttgctaagtgtgcttagttttaataagtaattccttctcttttttcagagaaggccttacagaaaattgttgtgcttagaattgctggatgcatttttaccctccacacaaacctaaaaattttgtgacccctttcacttacctgaaaagtagagaaatggattcagtataaggataaggagggaaggtggaccagaatgaaaactgtaaatatttttttaacctaatatcacttaaatcgaggcagaaagatacagacattcaatgaattatattcaatgcatttaaaataccactgtaattgacagagtaaaagtatagatacaaaaccttgtgtaagaggctgacttttccaaataaacattttttaagaaaacatttcttctcccaaatgtctattttcttgaggaaaatattgctgtgtcttcattttcattaccaggtttcattttgggccttgctaaattgattgaattaaatcctccagcttttgaaccttgatatttgtgtatatgatttattttcatttgaatttctcctttcctcttctttgctgtaaggcaaggaggaggggaattttaaaaccatcttatttgaactgagagcatccagagcagttaaccttaaggaaacaatgaaaaactccctttgtatgcctgggcatcatggcagatagaggaagagtgttagaggagaaaactgctgctgagagtattggcaggcttggcctcagtttggactctgtaattttctttggacccaagtctgtaacctctgcgtacttcttctctcttaccttctataaaaatgaggattactgttggtgagggaataaggaatgtaagtaaaggaaa

SEQ ID NO: 55547 - DNA, 1777 bp, Homo sapiens
gacttaatgatcttatatggttataataatccttccggtgattttgttagattagacaaaatagttattcaccttcaaataataaaaacaacaataataaaaataacatgtattaagtgcttactacatactgggcactgggtactaagtgcttaacaaatcttttcttcctcacaacagtgacctgtgcccgttttacatattaggaagcagtcataggagggtatacatgtctgagattatgcaaccagtaagcactgatactgagatttgaacccatgtctgttttagaagtcatactttaaaccactacataacatgtcctctaataatgaggatttatatcctattccttccattatttatacctcttattatttatttatttatttatttatttatttatttatttatttatttattgtcttcacaggtcttgggcttgccttcaacttgaatccagctctgaccatgattggcaagtatttctacaagaggcgaccattggccaacggactggccatggcaggcagccctgtgttcctctgtactctggcccccctcaatcaggttttcttcggtatctttggatggagaggaagctttctaattcttgggggcttgctactaaactgctgtgttgctggagccctcatgcgaccaatcgggcccaagccaaccaaggcagggaaagataagtctaaagcatcccttgagaaagctggaaaatctggtgtgaaaaaagatctgcatgatgcaaatacagatcttattggaagacaccctaaacaagagaaacgatcagtcttccaaacaattaatcagttcctggacttaaccctattcacccacagaggctttttgctatacctctctggaaatgtgatcatgttttttggactctttgcacctttggtgtttcttagtagttatgggaagagtcagcattattctagtgagaagtctgccttccttctttccattctggcttttgttgacatggtagcccgaccatctatgggacttgtagccaacacaaagccaataagacctcgaattcagtatttctttgcggcttccgttgttgcaaatggagtgtgtcatatgctagcacctttatccactacctatgttggattctgtgtctatgcgggattctttggatttgccttcgggtggctcagctccgtattgtttgaaacattgatggaccttgttggaccccagaggttctccagcgctgtgggattggtgaccattgtggaatgctgtcctgtcctcctggggccaccacttttaggtatagtatatctccctactaatgtgggtctattacaaaacaagcatgtaagatgggaatgctgacagaaagcaaacattagtgagctatttgggtaagaataaatctttctcatttatgtacccttgatgctgggacaatgcttggcacagcataattgctcaaatatagaatctaattaaatggaaccatcaaggcaaaagggggatcaaatattgttacaaatgtcagtgttttttctttttttttgagatggagtcttgctctgttgcccaggctggagtgcagtggcaccatctcagctcactgcaacctccgcctcccaggttcaagcgattcccctgcctcagcctcccggtagctgggattacagatgcatgccaccatgcctggccaatttttatatctttaatagagacagggtttcgccatgttggccaggctggtctctaactcctgacctcaaacgatccactt

SEQ ID NO: 55548 - DNA, 1563 bp, Homo sapiens
cacgcctggctaatttttgtatttttagtcgagacggggtttcgccatgttggccaggctggtcttgaactcctgacctcgggtgatccacctgccccagcctcccaaagtgctgggattacaggcgtgagctactgcgcccagccactttctacatacatgttaatcgtatcctagatacatcaagaaccttgtgaacatccattaccaaggtgttttcagcctgccctgccataaaagagaaagattaaggataacttcaggtcttttgtattttagtaaaattccatccagtatttttagatttagaacctgcacaattaattatgttttctaacatctttattttagtacacatgtgactcagaagtaattatagaaaacaatattcttatcattgctgcttgtttattttggaggatttgtcattcattgtcattcatacttgtgtagatgtgagggagcagtttcctttatattactacatttttggttgtcttttaggtcctatcagcagtatcctggtgaataaatatggaagtcgtatagtcatgattgttggtggctgcttgtcaggctgtggcttgattgcagcttctttctgtaacaccgtacagcaactatacgtctgtattggagtcattggaggtgagttactactgattcatttggaagcattagtttatggctggctattttgtatttacctgcattcatctttcagatctctggagtgaaattcttttcttatagaaatgacttgattatcattttgaagaactagagataaaagtactagaaaagcaaacttttaaagaaattgccattatataatggatatttattgtttgtcgaatgagtgaatgaattgaaagaatgattgcattccttgtcctaagaatagccagtagtggtagatacaatgtgtgtggcaacttggtgcgagagtggcaatttgatagaatgtccacataacatttctgaggggtagaggatacgcttcataattcctccccccattttaaaaatcactaaattaagataatgaactgttgatgagcataatgaataaaagttacccataacctcacaatccaaagaatatcattaacatttctatgtatatccttccatgtgtttttctatgcacagatacacctttttttgagcaaaaaaggatcaaattatgtctaatattttataaccagatttttgtcagtattaagttgaaagttttgtgaacatgaatatattcttcgtataaatttgtagaaagggaactgctgtgtgtttgttttaatatatgtatgctaaattgtcctccaaaaaagttatactcacttattatcccaccacaatatatcagagattccaagattatcccttttgtcaacaatgggatattgccttttttaaaaaaataattgccagtttaacacgtgagaacagtatctcttggttttaatccttattttcttttcttttttttttttttttgagacggagtctcgctctgtctcccaggctggagtgcagtggcgcgatctcagctcactgcaagct

SEQ ID NO: 55549 - DNA, 1807 bp, Homo sapiens
gacaggatcttgctctttcacccaggctgcagtgcagtggtgcaatcacagctccctgcagccactacctcccaggttcaagtgatcctctcacctcagcctcccaagtaactgggaccacagacacacaccaccatgtctggctaattttttaatttttttgtaaagttggggtctacttatgttgcccagggtggtctcaaactcctgagtacaagtgatcctcctgcctcagcctcctgagtagctgggactataggcatgctccaccatacccagctaattttttaaaaattttcttagacacaggatctgtgttgcccgggctgtcttgaactcctggcctcaaatgatcctcctgcctcaacctcccaagtagctgggattactaataggcatgatccaccacgattggctatatttcttatttcacaaaagagttttataggtgtgccttatattgacatactattttaattttatgtctttcagatatttggatttgacctgcattttggaatttatctacacttaaaatgccaccagcagttggaggtccagttggatacacccccccagatggaggctggggctgggcagtggtaattggagctttcatttccatcggcttctcttatgcatttcccaaatcaattactgtcttcttcaaagagattgaaggtatattccatgccaccaccagcgaagtgtcatggatatcctccataatgttggctgtcatgtatggtggaggtaagtacccattaaggcctgctcttttaattttcatgaagcagccagagtgtctgtattaggtaactttaaaaaaaaaaaaaagtcttattcagtgagatgttttgaaatgttatttcttaaagtttggtgtttagagtcacatttttcattcctgataacaatagcaactcttgctatagtatactgtagtatttcaaaacagaaatgagaaaattgtgagggaccttgatttgctccaactgatgtatcattgagtttaaaagactgttataaaaatgatgtattcacagctgtattttttttgttgatctctgctggactcttgaaatgtaaacataaatatagatttttaaaaattgatgttgggaggattaaaataaatcagactagcctgaatggcatggttcagattctcaggtaaaatctttatatgatgttagaattaactgaaaaaacctcctccgtattacttgcgatgttatgagtcctaaaagcatttcagctgcaccctaaacttaaattttaccatttatttctcttttgttttttttggcatattgtaaaggaaatgttggaagtaagttgctcacttaacatcatctaaaatactgtttctagccaatgtaatgattcttggtttcaactataaataacttagccttaggctgctaaggtggtgccagagtcaaccaatatctgtcaagttctatgaatatattcagcactgggctaggtattgtgagtgacagaaaacactgatcccttcctttgagaagtttataatccttttgagacagtaatatatgatcgtgaaacaggaataagcagttgaaatcataatttcattaagcctgtaattaaatcgtccagaagaaacaggtaactggctgccatggagaaagagaaactgggtgactgggaacaggattaggaagacttatgtttccactgtttatctttttgtgccttttacattttgaacataggcctattttgtctatcaaattaaagaacctaagtgcttaattgtagtgtttttttttaataagtt

SEQ ID NO: 55550 - DNA, 2238 bp, Homo sapiens
ctttagcagcaatagcttcaggaaatcagcctttctggatttgaatgtttccatgtgtttgaaacctaaaactagtttacactcattaacagattattttaaggttattggttttagatactttctgcttcttttaagttcacaaactggtcattgtcattttaggaaaagacagtggcttcattttaaatgttgatgaggaaagtgtacagaacatgatgaatactattttcaaggcttttgtagctcttctctttgggagtggggcaaggacatggcaggtatggagcacagcttcggctttccagattagtttactagcacaattcatgagagttacgagaaaaaaatatcagaaaatctagaaggtgattcttatcaccgtcattgccaagaaaagttagggttattgttttctatcatcctttagaagatgaattaatgaagaatttttctcattaccctatcactttgttttttagtctccccatcactcttgggcagtaatagctaagctgataggaaagctactgtgcatattgtaaggattaaaatcttaaactttagtcccttttagcctctgggctttagcatacaaagaatgcatgtgctctgctttctcaagggaactctgagtactctgcaagggggcctgctctcataatttactttttgaatgagcccttctgtttatagctgagatttgccagttaaaaaaggaaataatatgcttagataatattaactgacttttttttttcagttatgtaccatcagtatttttaagttaacagggatagccatttgtcaggtggtggcagaattgtgttgaatctgtgtgtggttttttgaagtgttctgtttttcataatgattttgcatgctcttatttcttatactttcttatttccttttaaatttttctaaagtttcttgaggctttaaatctaattttggcactgtggaataaggtattaacttgatgaggcaagctttagtgactaaaaattgtaactgccttaattgggacaaatcatagctggcagctaaactcaaagtttaatcacgtccagcacgtattagctgttctagtcagagcttgatgtgttaaacagccctactgtctgtgtgtgggtgttctatgtgtgtaaatattctgagatgaattaatctttttagtggttctttgaaattttttaagtgttctcttttttcatacttagaagaagaaaaagctcataaaatcaatgcctgcagcagttttatttaacatcattttagaattcaggctgttgctgttagcagagctgacctgttaaatagcttttaatcatattcattccagtagaaattttaggaaaccttaacttgtaaatatttttatctcacccaaatcctaggtagatgaaatgccctaggacaaagaccttcaatttttaaactgggttatatttttgaaggaattattctgcacatcctcaggttgagagataaccttagctaaaaattacctcttgagaatggatgcctgatctctactttttcttttccaacttgagttatccaaaagccttttactcccactacaaaagagaggtgtatctcttattcatcccatttcttatggtggttcactgtcctaagcaataaaaatctcaaaggaagggaaaattccagaatgcatagtcctagagagagtcccatgatagaaatccaaaaagagattaggtcagaaatattggagaatattgaaaaattatttcatctggacaacaaactcctgccttctccttttttttttttttttttttttttgagacagagtcatgctgtgtcacctagactgagcaacctctgtctcccagagtcaagcaattctcctgcctcagcctcccaagtagctgggattacaggtgcctgccgccatgcccagctaatttttgtatttttagtagagttggggtttcaccattttgaccaggcaggtctcgaactcctgacctcaagtgatccacccgcctcggcctcccaaagtgtttggattacaggcatgagccactgcccccggctgccttctctaagttagaattattattataaaaatgagatagttatcacagagatgtgtatcaacacatttatttgaattaaaatgaagtgtgcttttgtttaacagaaatctcttttacttgattggtttgaaaatgaggactggccagctatttcctgtaagttaca

SEQ ID NO: 55551 - DNA, 1034 bp, Homo sapiens
actagaatacctctataaagagaggtacagtttgaataggaaggacaagttaaagtttatgttttaatacaatatgctatgttattgagacactgtcgttttctggaaatgtatttaaatgtattgaggtatatcctcttaaaaggccactattttaagttgtaaaagtgtttttagcacttgatgttaacatttcaaatggcttttagtatttagaatatttaaaatttttgtccttaaatttatggcgtttcttttggtctttcatgctctttcttggaggactttgctgttcccacagcttttagagaatacctagtagaatcactactaaatccaaatctttagctataaaaggattccagattgtaagttcctcaaggacaggggttgaacactcttattgatgatctgcttttccagttgcttcttgggcattttgaacttaatatgtcacttaaagctcattatctctgcctgttctcaactttccttcatcctccaaacctagtttttttcttctgattctaccattcttgaaggtagccaggcttaaaacctctgaatcttcttaatatttctcctagtaggcccccctgccctaccacatgcagttggtgccaatctcttgtcccttttgttatttctcgtccaaccccccacttttcatttgtaatactgctacctagtttatatatttttctctttgcaggaagggagtgttataggagatttttacaatgaatggaaggactagtttaggtggcatgtttggttcctagtgtcatcctgagaagagattaaaatgcaataacaatcttttttttaaagatagaatgtatagaatttatacattctaaatttataaattataattttataaatctataaattataatttataaatttataaattcactctgtcgcccaggctggagtacagtgaaaccatcatggttcactgcagcctgtaactcctgggctcaagcagagccacctcagcctcttgagtagctaggactacaggcatgggc

SEQ ID NO: 55552 - DNA, 4374 bp, Homo sapiens
ccagcggcacccgcatccattcaaatgctgcccattccccgctcctcagtcgcttcccgctactccgcacgcgcatctcccccacccgtcagggtcaggcctctcggtgacttttcctttttctctggcagaaactgaggggtgagaccgatggttgtgtcccgaacgagggcagattgcctagagctcgtcagacagggacccaagggcgagtctggcagggcgtggtagctccgcgccgctcagcaggggcgcagcgcgcgggtcggactgggacgccggtcacgtggcggggagggggcgccggcgcgcgcgggcgagctagagggcgcgcgcggctgaaagcgtgtggaggcgcgggctgcagttcggatgtctgtgtggcggggagggggcggcggccgggagagacgactccgccccctgcgcgcatgctccggccccggcgggttataaggcagcctcgctggcccggccagacaaagtggtgagctgcgacgtgactggctagctgcgtgggtactggaacaagcaaacgaggcagcgagcgaaggacgggagccggaccctgggccccgtggaactccagcctgcgccaccacgtcacgcacacgctcggcgctgcgatccgcgcatataacggttagttgggtaacagccggcggcacgcggcgcggaccccacggtgccctcgctgccctggtggggtcggaggggacctccggggttgggagactttgtctccggcggagggaggcggcccagcagagggcatcgtggtcacaggcagccgcgtggcctcggactgcagtgctggtgaaggagaccttgaggcgctggggtcagcgcctctcttagccgagccgcgggccccgtgctaagatgccggtcccaggcctggccgaggagttgggtcgtggtgcccggtgacggtggggaagtcccttcccccctaagtcttcaataggctcctcgagagatgctttgatctggaaaagggataacatgaggctgctgcatgtggtacctccagactctcctggccgcttctgccccaagggaagggactcggggcagaagttatttatgattcgtgacattgtccgccccaaccttcttggcccgccgatccttgccccacctggtgacttgcgagagtggtgcggagagccgcattccccacagccaaggcgtgactgcagggttcgagtagactttgcggaggggacggggcagcccgcagactcctgggagtggtgctgacgggggctctttgtcattcaacctgtggctgccagcgtccgccgcagcgcccttctactcatggacttaaggcggccctgttgagagaaatctggaggatagcgttacacttggtccgatgcaagttttttgttccaagtacgtctttttttttttccagcatgcgttttaacattttattactttgtcatgacatatttgatggaacaagcagttgccaaaactagtttgtaattaatctaaaccaggagacaaacttgttactactttagtctttctttgggtttccagtggctgattagaaactgggctgctactgataacagtaaaatgtttacacgctactttatttactgtaacttactaagctactttatttactgtaacttactataacttgttttgaatttttttttcaaaaattactctggtttcaacaatttttttatcccaaccaccagcccagtgaggtgatgcaaagactatgtatcttcagttttttagttaggtgttaaatagtacccataaattcaagtcttacaccctggggcacgactttgccttcagattgccatagaaatgaccaacaattcaagatatttagcacttaaaacacgtggtaagatttattatttacacagaagttgaatatatttcagtaattcattttggtcttaggtagatgctgttgtttcatcagattgcagttaccattgttaaatatgcaagttaatgatctgaggagcattttgtaagatttttatagctgaatagatttgaaggtttagttgtaagcttaacgggatagactgtaatgtccttaaacagattaaaaaggaaaaaagtcatatcactataggatgaaagcaaatgattagtatttcactagtttacatgttttagcctttaaatattagggcatatattagccctggaaaggatcctaatgaccagctgatcaggatcccttgttttacacataaggaaactggggctggagggattaagtgatctaacatcttaggtctgaaaacttgttatggtttggtgggaactatgtgtgtctttggactcatttttgttagattggcactcctgatttttctttagattgtaaatttggatacaaattatctcagcctgaaaatagatttctcagctccttatgttctgcattcccatcgtgttttcaattcactttataatgctcactcctatgcaagattaagatctctgcgtaaatgcctacatagctgtcttgtttttgttgcagttgaggactaggaagatggaacttgggtatgaggaaaacagtccagattgttgtgaattttatatgttcggcaatttgttattggctaccaggcaccatgagagacttaggattcagcagtgaacaaattttaccacttgccctcctagagttatagtctagctggaaaacagataaatatataattgccacagcaaatactctttacaaacaagtaggtactgttataatagggtgggtacaggttcctgtaggaacaaatactgtattgtgtaggtgtgagaagacacccaacttagtatagaagcaatttggctagacctctctgaggaaatactgtttaacctgagacttgaaggatgaaagagctagccaggcaagacagtgatgatgggtggaaagaacattccagacatgaacactgaagctacactcaagagtacagggtgtaatgcaagagctgaattttaccaaagctaaagcataaaaaagtcaaagagaatgggaagagatagaagttgaagagatagacagtatgagaaaatggagggccttgtaagccattttaaggaatcaaggagggtaaaaaaattaaagggatttttaagggataaaggagggtaaaaaaattttaaaggagcgctcttgtcttgaagctgattgaaagcagttgaaggattttcaagctggtggctcacgcctgtaatcccaacactttgggaggccaaggcgggtggatcacttgaggtcaggagttcaagaccagcctggccaacatggtgaaaccctgtctctattaaaaatacaaaaaattagccaggcatggtggcatgcttctgtaatcccagctacttgggaggctgatacaggagaacagcttgaacccaggaggtggaggctgcaatgaaaactgagatcacaccactgcacttcagctcagctcaggcgacagagcaagactctgtttcaaaaaaaaaaaaaaaaaaaggattttcagtggggctggggataacctgattggattttgtgttttaggaacatcactttggatgcaatatggagaacaggctgaaaggaggctgttggagtggtgtgagaccacagtgatggacaagacaggatttggtagagaaacagacaggatttggtggaggatttggtggagaccagatgtgggagactgggaaagtcagagacgttaaggatataacccaggtttctggcttgaacaaatacgagtttattaggtggtatttgtttgtctccatttaaccaatagggacactaaaaagttgtgtgactagaccagggctgctcagcttgtaaggcttggagacaaaattcaaactgttgttttcagtttttgttggcaacccctgagaatggtgtttttcttttttcccttttgaacagttaagtatggaaaatttcaaaacacaaagagttgagcgacacgatttctctcttcccctatctactttccccagaccctactggattactgtgaagcaaattctacaaatgatttcatttgttttatttcaatatagatatctgaaagataactctcgagaaagtcataaccacaatgccattaccctacctttaaaaattaacatcgccaaatatccagtcagtattcaaatattcctcagttgtttttaaataattggttggtttgatttggggtccaaacaaggtaacatattacatttgtttgggatgtctcttaaactttttaatctataggttccctcatcttaattattttcctcgtaatgtattttccttgtaaggttggtgcaaatgtcattgtggtttttgccattactttcaat

SEQ ID NO: 55553 - DNA, 1124 bp, Homo sapiens
gctgagcggcgcggagctaccacgccctgccagactcgcccttgggtccctgtctgacgagctctaggcaatctgccctcgttcgggacacaaccatcggtctcacccctcagtttctgccagagaaaaaggaaaagtcaccgagaggcctgaccctgacgggtgggggagatgcgcgtgcggagtagcgggaagcgactgaggagcggggaatgggcagcatttgaatggatgcgggtgccgctggcacccgggaagacgctgggggccggcgctgtagagccgggcatgggctgggatgtgtttggattccaatccgggcctgacaccagttcagtgacctcgggaagttccccaaccctccgggcctgtttcctccctctgaagtggcgacagtagtagaaccgacctcgtaggctcatcgggaggtcctgatgggagaacccatgcaacttgccaccatagagccaggcccgcggcggttggcgcctggtgggtattaaagacgagtcgggaaagaagagcaggtaagagggtggggagactggcccagtgggttggggtgtgcacctcggccacgtggaaaagcgagaatgcagaggccggacgcttatggacgatgcatatgtggggccggatagaattgtggcaggcggcgctggggctgatgctcctcacccggattatcctctctaatcctcagccctgtgaagtgggcactgccctgaacattttgtaaataagggacccgaggctcagagaggtgaagtaactttccagacagcccagctcgtcagcggccagcatttgaagtcacactccagagcctgtttttaacataatagccgctgtgaccgcataaccaacgtgtgtgttgaagtgatcaaataaccatggagtgtctttgatgtccaggacttttgagaaataccgaaaaatatgaggcaaggcccctgccttcaaagagcttgcaagtttttgggggagacttaggcacaaattaaccaacatctgttgagcacttgctgcttgccaggaccctgcccttcccctcgtgtcttcctcccttccaggactcaccccctcacttaccctccccctcacttaccctccccctcaattct

SEQ ID NO: 55554 - DNA, 1128 bp, Homo sapiens
aaagaaaaggaagtaaaaattaaaattaacttcccacaggcctggctaaagtatgggttattgatggctgatgttagaaatgtttgatgtaattttgattaacaaacaaaatgtcgttgtcaaaaaatggtatacatctttgtgttagaaagctaacatcatgtacatttttgttcatatatttagacattaaactaattttttttttgagatggagtttcactctggttgccaaggctggagtgcaaaggtgcgatcttggctcactgcaacctctgcctcccaggttcaagagattctcctgcctcagcctcccgagtcctgggattacaggcacacaccaccacgcctggctaatttttggatttatttagtagaaacgcggtttcaccatgttggccaggctggttctccaactcctgaccttaagtgacgcacctgcctcggcctcccaaagtgctgggatcacaggtgtgaaccaccacgcttggcctgttcaaccagttatttattgagctcctaccatgaggctgattctgtgctatccctggatataaaatggaaattgaaacagacctaaaccctgaccttggagttcagtctagtatataatagtctctacgaaattatacatataagtcaggaatcgtatcttattcatcagtacaatgaatatagtaggttttctttgaatatttgtagactaaatgaatggattttaccagacgttaccttgccataaactaagaaatagttactattactccagacatatatgtacttatggaggtttgagaaataatgtggactaagaagcccttatatagcctcacccaactttagcatgctccttccagagccaacccatcattcaaataatccaaaattctgtctaatatctggttatgaacagattcctgagacaaaacaaaatgtggccacctattaataaagcaaacagtcttggtgttcagacactgctgccgtttagttcagaacagattattgtcattattataattttgtttattaaaaagaaaactcttggcagccgagcgcggtggctcacgcctgtaatcccagcactttgggaggccaaggctggtggctcacgaggtcaggagatcg

SEQ ID NO: 55555 - DNA, 1047 bp, Homo sapiens
taagagagtagattgtcctctgggctgatataaatggggaagacagtactgtatgtgaccttgtgttctgacatgattctggcatctgtgcagaatctttttggtagcatgtgctttgtcactttctagcaagcagggagactaggcaggcacctagggcctgagagtcaaccagtccacacgtttccaaaccatgagggtaggagaaaggggtcccaatattctcagcatttgggtagttactactccgagatgggttttaaagccagttaataaaaaggcaccatgccaccggaagagatatgtgagcttggatctcaaagggtatgtactctgaagctgaaatcataaaccagagcatctgatgtgtgtctcatacacaatgagggaggaaggactgctgacggaaatgtcacacgcagctgcttttagcacttggctctcactgatgaagcttccctctctgccactacacaccaccctcttcctacatgagagacctttagggctctttagttctcatcctgaaagctgtgggacagattataaattgatatcttttatatcagtatagctcatgcttggttgatgtgcctgatgggctataggagtgattgactcagctactattttggtgaggaaagagagtcttccttagaaagagaattgtgtgccttgccctaaaaaggttaggaatgcggcctatggtcctaattaagtgccctgttaaacagtgtcccttgaacaagtcactttcttcttctgcaacttctccagctatataattaagcatgtaatcctgtgtgacttcatagtagggttgtgaggacaggctattcccaccgtctggagttgtcttcccctcacttttccattgccaaataaatcgtccttatcttttggagttaagttgaaacatcaatttcttgagattgtttcagatcctacttttctactgcccaaaacccgtagttccccagtctgtcactttatagcacctggcacttccctttttgcaaccaatgtcacgcttattgtaatagttgt

SEQ ID NO: 55556 - DNA, 1093 bp, Homo sapiens
ttctggagaattgtatgaagacgagggttaagattcttggggccaaggagtctgtgatttcctcaactggggaggaaatggggcgggcatatttaatggtaaggactcacgggtcctgggcaccagcattgactttggatggttggtggggcggggggtgggttgagcacggaacagtgctttctgcttatcttgagctgcatgatttggtgtgtacctcagacttagtggtcctcaggcacgtgattttataatcacaatcgccaaagacctatgaactgtctttagtccttagttcgcatgttggctgattttgtgctgcagttttgatacttaacagggttgaaaagttcattatgatgaatcaggagatcctgtaattcagaatatctttgtaagtagcattcttgatctaatttaaacttcactgtaaagaggaggagtattttttgcagaaccatttgatgctttgttttcagcgcatcttcttgtggcaaagaacccaaaaatcagttctgcttatttatgtaggtaaagcaggtacaacggttgaatgaattctggagtttccactgttgagttttcactttgacaggtctttattagacagtggaacttggagggctccttagtctgagtcagcctggtggtattaggaacaacagcaggtattaaatgctgcaattatggggcttcttaaccactaacatacagttatttctcgtcactaactgagcagcacgtttattaactgacagatttctgatggagtcgttaagaaagagtcatcaatgggccaggcgcggtggctcacgcctgtaatcccagcactttgggaggccgaggcgggccgatcacgaggtcaagagatcgagaccatcctggccaacatggtgaaaccccgtctctactaaaaatacaaaaaaattagctgggtgtggtggtgtgcgcctgtagtcccagctactcgggaggctgaggcaggagaatcgcttgaacccgggaggtggaggttgcagtgagctgagatcacgccactgcactccagcctgaaaacagagcgagactccgtctggggggagggagggtcggg

SEQ ID NO: 55557 - DNA, 1248 bp, Homo sapiens
tataatttacttaatcatttttctgctagatttaaaaatgtttttctttattctttaaagttacacattttgtagtaaacatctttgcgtataaatctttgaatttctttttttttaagttatttttaatcttttttaatgggtcaccgctgctcaccccctccagctattgcagctgccctgaacttctttcttaggatagcttgcctaagctggaattatcgagaaaagattgaggcttttttcaggattttgttctgaaacattaacttctaatcctcccatgagtatataaaattactcattttattatacccccattggtctaattcagtagaaattagggaataaaattgcctaacttttcattttttttttttttaatgttttcctgttagagacaccctcatttattagacccctggaggataagacagtaacacgaggtgaaactgcggtgttacagtgcatagctggagggagtcctgcccctcgtctcaactggactaaagatgatgggcctttgctggtgacagaacgacatttctttgctgcagccaatcagcttctcatcattgtagatgccgggctagaagatgctgggaaatatacctgcattatgtctaacacccttgggacagaacgtggccacatttacctaaatgtcatttcatcccccaattgtgactcttcccagagtagcattgggcatgaagatgatggctggaccacagttggcattgtcatcattgttgtggtctgctgtgttgttggcacttctttgatctgggtcattgttatttaccacatgagaaggaaaaatgaagactatagtatcacaaacacaggtaagtagtacccacatgacacctatggcttgtacttcagtcaagaatgtagtataggattaattgtacaatataaaaaactgagagctggtcatagtagcacatgcctgtactcccagctactcaggaggatgaggtgggaggactgcttgagcccaggagttcaaggcccacctgggcaacatagcaagacctcatcttccccctcaaaaaactgaagagctgtgatacattacctgatatgtgatagaagggagtttttgttgttaaaatgttcaacttctttgatataacagaacctctttgaggaataggttcataacagaacctctttgaggaaagaattttgtttatttgagatagggtgttactgtaatgcccaggtcagagtgtatcggta

SEQ ID NO: 55558 - DNA, 1017 bp, Homo sapiens
agggcacatgaaactcttcaggatgaaatctgggcagagacttattaattaattttgcatttactacttcatgtcccacattagatcatttactcctgccagaaccatccctgcaagtatctgagttaggctcacctttttttttttttttttttttttgagatacagagtctcgctctgtcgcccaggctggagtgcagtggcacgatctcggctcactgcaacctccgctttccgggttcaagcgagtctcctgcctcagcctcctgagtagctgggattacaggtgccaaccaccatgcttggctaattttttgtattttttttagtggagacagggtttcaccatgttggccaggctggtctcaaactcctgacctcaggtgatccacccacctcagcctcccaaagtgttgggattacaggcatgagccactgcacccagcctctattgttcttaagagatcaaagacttctaaagaggtacaggtcagaggaaagcactattactgaagttaatctcttatttttacattaagtgttcatgaaagaaatgcatcaacagtaaatccacttttactgttggatgtcttagaagagttaatacaaaaagggtttaagaaggaccagaaatgtagtcccatcttttttgtaactttggggatgccttcatttttaatctggtccgtaagtaaggaaatcagcaaatgagagtgcttcggcccattggcgattttttatgtggggtatcctagcttcttcttactcgaagtctggtctgttgactatcagcatcaccgttacctaagagcttgttagaaatgcagagtaatgaccccagagcagatctagcaaatcagagtctacattttaacaagatcctcaagttatttgtgtgcatattaattaaaacttgagaaaccctgctctagcttacttttcacatggattttatttttatttctgggtatttgtttttataatgtttggctagctttttctaaaatgtaccctatg

SEQ ID NO: 55559 - DNA, 1050 bp, Homo sapiens
gcagagggaagatacggggcaaatgtgcttcctgatgcttccatggggatgtgccctggtgtgcatctgcttgtcaggaagagtcacattgctgcttaacatgctggattgccctagtcttcagaatggtcctgagaaaacatcactacttcgatgttctactttgctttccaaggagcaaaaataactttggagccttctgggaagtgtgcctgggattcttcagtggtttcaggcagatagttgagactggggctttgatattcaaggtctttggcaagaatcccaggcttgaccaactggtaccaggtcaaagatttttgtattcttgtgaatttttttttttgtccctattgcccagggatgtcattgtaaatatatgtgcatttataaataatttttgtattcattgaccatatgtgttggctgcaatgtaaatatttttgatatgccaaaattatatgtaatatccagttataatattgacaagtagcttctcagatcacagattttaaataactcaatttagtgagatctaaaaattttatttaaagtataaaaactgtggctcacacctgtaatcccagcattttgagaggctaaggtgggaggattgcttgaggccaggaatttgagaccaggctgggcaacatggtgagaccctgtgtctgcaaaaaaataaattaaaaaaataggtggacattgtggcatgctgctgtagtcctagctacttgggaggctgaggtgggagggtcacttgagcccgggaaatcaaggctgcagtgagctgtgtgaagccactgcatcccagcctgggtgacagagtgaggccctggctcaaaagtaaaataaataaataaaaagttttaaaaacttacttgttaagaagtgtatctatagaggcagctacttagtgattgtatacacataaacacagtcttggtgtaattaaccgccttcttcatgcctagaggttcatacttctggtcatttgccatctgtttaaaagtgctaggtgatactccctttctaacataaaaagcttgttct

SEQ ID NO: 55560 - DNA, 1016 bp, Homo sapiens
ctggcctcgaactcctgacctcaggtgatccacccgcctcggcctcctagagtgctgggattacaggcgtgagccaccgagcccggccggtccttattttatacaagtgattaagccaaaaattttcttgaatttctgataccaaagagctttaggtaaataacttcacactctaatgcaatgtaattctttctttgtgctttcagatttccttacacttcctgtccagttctctcttctaaatccaatattactcactagataatttcagccacttaaataaaaatatctatttttaagtcctggttcaagggttccaaactcacataatttctcaactttttgccagaaagttgagcatttattcatacttattttcaatcctaagtgttctcccatgggcagcagcacttcttgagctgtttagtactgccacacctttttatgtctttactatgtcagcctctgatcattttcactttgaacttcctaaagatcacaatttcctatcccttcaatctgcgatccctcttcttcctttcttactagattatggtgtagtttgtactagactgactcattaagaccttgtacgcttcctgagtctgcttattactggctttgtaatcaagggtgagtctttttacttctctaggctagattttctcatttatgaaatgaggacatttttctagatgctgtaaagccctttccagctgtaacattctatgaatctgtaattccctcgaggagctaaggaggattatgctactttaataaaaagctgctttggtgacatttgttcgagtagaacaagagtgatgctgctcattctgacttgagccagatgtatttcctttatagcaggagtaatggtctaagaaatactcattaggagaaaaaaattctgcttctaaacagtattagtaaacaaagaatcttgactcagttgaaaaaccacccattgctctctagagcagaatgtctgaatgctggttttatagcacactagaata

SEQ ID NO: 55561 - DNA, 1034 bp, Homo sapiens
ttttccttaatgtgctctgctgagtatacggtgcatcaaaatataatgggctggttaattgttacctgggctaggtagcagtccatcccttgatggcaaaatgctagaaaattctggataaaaatttaatatgttatctccttctcatttctttctcagcagctcgctttggaaatattaatatatctttaatagtccttgagcttaatggggcttgatggtttgtggtgcagtttacatatgtctgtgtattgtggatatgtatacacacagactcacatgctcctaaggtcataattaagattttctttctatagcgtattccatcgtattcattttaagtgtatgggtttatgtggtgaggttttctttttattgttgttaattttttaaaactttggcagactttaaacagctttttctgtatagttttgagaatttgtaaatttttttcttaactctaacttttacagccatgtgtgaaaggcagaggaaagacttttggggctgtaattcagctagtcaggcactgtctgtaatatgcaaaaggctatatagacagcatttactagtctagctgccaaatcttagttcaaatcccatgagttagtgaatagtgagaacatctgcatcatttctttgtgttttgttttgattcgttagggcatagatgagaatataacttatttttagaaattttaaagttgatatattgacatggaagctggtgtattctaaattattgtgatcttttttagaagactgaagagatggctatttcataacattagtctaatctacctgttatacatttttctcaacctctatattatatttaacaataattcaagatttagagcattagtaatattaactgtgttgaataaacatcctatgcccccgtatgtagttgacattattagagtaatacagttttgccctcttgacagccacagacactgttctattttaaagatttagccaaaataaagggaataacgtattaatggccacagaacattttgtagtcatta

SEQ ID NO: 55562 - DNA, 1081 bp, Homo sapiens
tagcacagtgaaagagtaaaatttaaccatttttgtaagatgtaatactaatcggaaatgttctcatattgtcttctgacaaagtccatggcagaaggatgagctgggttgtagaacatggcttttgtagcactgattcttcctagccttcttttcacttaggtgctaagggtcgccctcccaaagccagtactatcagccaggtgacttaacatctttctggcagctactgtctttagctttgattttttttccctttttttgttgttataatctttaatagagaattgaaagttactctttaaaatatggtttctaatctgaagcttttcctgaatcaattaggtagtttcttattgttttagtgtagtacttagtagtcagtactttgcccgcttatagaagaatctttggtttcacctattgcttggctcgattagttacttgtttcttaattatgaccctgttgtttatttttctgcaaagagaaaagttgtcatttgagtttgaactttgtcttttcccagtagtaaagttgaactttggacctctggtgaaattgttttgtgatatactactatgactaggtttagtttctttgattttactacagagtatatattcttaaaccatttctattctgattaatatacaagtagtgaattttgttctgaaattccccagactctaattgtgcagagttttatgcttcttcatacacctttaagctcatatttcagcagtttgctttcagtaagtttcagtaaattatgtgtattttattccagagattaagtatcggtacaataaatacatgaaatcattgtctactgccatatgcacacattacattcaactaccctaagcaagtagtgtatccagggatggaaatcataggaaacaatgttatagtttgtttaaataaaaaccaagttgaaacagttcctgggtaatgttaaaggtaggtaaaagtcttcactgctgactctttgggacatccaatttgtaagggagttttgttaaaatgggctaattcctagaaatacacttcctgttggtgaagaaacactactggatgctt

SEQ ID NO: 55563 - DNA, 1070 bp, Homo sapiens
gacctagagattattttagaaacaatagaaaaagaagcaagccaagcccctttgctagggaaagtagcattacattttgataaaccttgaagttgaaaatttcctatttcaaattttggtagtttttttttcttttttccctaaagctcttaataactcaggggttcaggttttggattctgttcattgacaccttcaattcatatgagtaatgggcttacaccttagcaattgcaagctgatttgcttgcatgatatttgatgacttttattatatcattaacatctttgtacttaaaaaatattttctctccatcattctctaagagtactatatccaaatatctcagtatgtatatatgtatatacgtgtgtgtatatatatattatatgcatatatgtatatgtatatacacacacacatacttttgttaacttttcttgtatatcattttctagtatatcattttgggtactttattgatcctgccctcacccccagacttttataatttagtttgtaaaactttattttcctaggttgaggcattttaataattctttaatttcttgctatcttactggtacaaacaaatacttaacatttggccatttgatttttagatgattttaaattttattcagtttattgctaaaactgattttcatgtaacataactctgtgttcctgggacgtatacattatttttcctctgagatcctggcacatactttataaaaccttttgttttgagagacaaatttttgtgattttttttctgctaatttatgtaaactggcgacaaaacaaatcttctaaattcattcaagtgtctgacttatgaagtcagtgcctaatcttctcaagtgatagtttcatacagagtctttactatgtaacccctaagtgctttgtaatttttggggggacttagtgttttgggagtatgttgaaagagaatcttgtttttatggattacttcagtattatttaccaatttcaaaatctgtgaatgtcagggttgtgtgtgtgtgtgtgtgtgtgtgtgtgtgtgatttgacaaaagata

SEQ ID NO: 55564 - DNA, 2076 bp, Homo sapiens
gagtgaatgccctgaatttaaaactattgtctaaagtaagagtttcagaaacttagaagctggtgttatgagacatgtttgtagggaaagaggcaaatccattcattgctcttctagctaattttgctaacaaaatatcttgctaatattttgtttttgaagaacaactattattcagaatgttttccaagaaaagatgcatattttatttaatacagaaaaaataagaagtcctattactggcacgcattcattccctcagcaaatacttagtggtgcacccaccaagtgccagcatggagctagcactggcgatataaacatgagtcagaaattgtgtgtcttcaagaagctggcagtttagtgggagcttaatgactcattggtaaggaatacctgtagtaagggttttgcctttttcacttttctgccagtgtttaaaactctttaggtaggtcttagtatgaattttggtgaaaatgagactaactggctgcatagtgtgctattcgaaaaagtagtggagctgcattttagaaaggatttgggttctcaagtcatcacaaaaagagggaaatcaaatataagcaaaactgtcttttcaaaaagcccttaaattgtgcataaaatactatattgtactgtttgtaggatgagtccaaatgccacttttccacccatgttggaaccaattgcagttttttggtcgaataccagaagaagtaatttgcttgcattaaaaagatatgttttacaaaaaaacttttaattctaagaaattatcctcatctaggtatgtacagtgaatttatggaaattaaatgtgtacatgaagtgaaagaatgatttcttttctttttttctttttaatatcttggtaggatccacgccatctgcccttgttttctgacttgagtggttgaggaatgaattgtgaataattttgaacttgtttgggttttgaaagatgacagattttggttgagtggaattaggatctttccagtagtaggtaagaagcagaggaggagaaaaacacagggcaaaaacgttccatacagaaaggtttacagtgtggtccatctcaataattttgtgtgtgtttgtgtacaagggcacaaaatccacattatagaataattggaaattattttgtacaagggcacaaaatccacattatagaataattggaaaatagagggaagatcatattaattgtttaaatgtataggtagttccattatgaatagtctcctgtaagttttttttaaatgtgttatctcctcgaaataatgctctaaggtgcttaatgctatttctgccttcagcctcattccactcataatgttatactatgaatatttttatttaacccttaatgtaccattagttctgttctttatggttaatagccctatttttgttgttttggaagtctagccagttttatgggaaaacacaatttgctagcctaggaaaaagggaattgaaaaatatattttcatcttaatcccgccttcccttttgttacagccacagccgactggcttccagtgagaagggtggcatcattatatctccattcttccctgaaccctagcaatttatcctgatgcagccactcagctgcattgcagtggtttccaggagcaacccacttacctgcagcccccacccatttcagtcatcccaacatggccaggggaacatagattacattttgaggaccataatttgacttatgacatatctaaatacctgagaaaggacacgctgtccttataggtgattaggtacttgttttattaacacatactgagagatattgttttagagactctgtatgggttatgaagggttaaacttttttgccataatttgtttggagtttagggtttggttttaaaaaatatcatgcagtggtaattggaaaaaattttgtttcaaatttattaataattaagatcttttctatttggaggcttccctttttattgtcttgggtatacaatgtgaacggtaaccgatctacttaattaaaactttctggcattttagcctctttgcttttgctgg

SEQ ID NO: 55565 - DNA, 1056 bp, Homo sapiens
ccatcagtgtgcatgaatgtggttagaggcagtggtatccccgaacctgcagcacaggaaagaattttaatcattatatgccatggattttcagggcattttaagcctttataatggtgtaacttatgattaagatttacacagtcaaaattgttagctggtataatagctgaatagttaagtatttattttggttagttactttagctttagctttgaaaaatcatttttcctatcggagattcttcacaatgctttcagtaaaatgtttctgaatagttcctgctatatggtagactgctaacactgtttcttgctctctctgtggggctgatgctacaagtctgatttagagtcagctgtgcttttatttttttccttgagtgactaggggatgcattgggggaagataaattttagggcaagaggacactcagggttgtgggagatgaactgtcaaggatacctttggctcactgtcctcaagcttgttcggctgcagtgatggcataactgagaagagggattgtgctcttgctgggtgcgggacaagaagatgtctcaggccacgtaaagctggccacagcagaggacaaggtattccctgtgaggcaaaactgaagaaaggggattgaggtggcagttctggggaaactatgtttgttaggtagactaatgggaatgatggagtcttgcttgggctctttgtaggtcagtggaagaacagcatgaatgtggacatgaaaaaatctttctgcaatccatttaccacatactcctttgcaatatcagtcagggttcagtgcaggaaacagaaggggatataatgcagggaattaattgcttagggaatcttttgaaagggctggagggctgggctctagactgagcctctgagaatgatttccaggacaccttgaaacagtccacagtgggagctgccacctctgcttgagtcaggaaagtggcaatcaggaggttgctactgaaacagtggcaagaaaatgctactgtagctgtgatccaggtgatcagggcagccactgctgttaacat

SEQ ID NO: 55566 - DNA, 1090 bp, Homo sapiens
agttgcataataatttaataaaaacaaagataaatactcaaaacaaattatttcctaattatttgcccacattttacaattatctatgcttttgaatttctttatatctactatatctgtatggtagaaacactatatagtggtttgctactgtgcatatcttcccagctcccttttcactgttatcacagttgactatggtggtagttgttggcatttcctgaacatatcacactgattgtgggggcggggagggagaatcaaagttggagaggtcatgagaaaccatgtacaaactaaaattatgggagaagaaactatgagtgaaacgatgagaaaaacctaatgcatgatgtagaactgagtggtgttaatagcagagcactggagggaagggccacaaaactcttcaccccaaggtctagaatcattctagaatcatcctacaagcctagttttcatgagattcagccctattttatttcttgctcttggaattatatgaaattacgaatttctgtgtgttgccagctgtaatagaataccctggaattttatttacttttaattttgtttatttatttatgcttatgtgccatcttctcatgaaaaagaggcagtatgttaaaagtttgagttcagattttctgatgtagataaataagctaaagaaggcagggtgaagtgtgatatatgagaatttccagagcagggtattcgtaacttgtaagtatttagtccaagttccctctcccaacacattttacactagaataagattgaaaggccagatgtggtggctcacgcctgaaatcactttgggaggccaaggcaagtggattgcttgagcccaggagttcaagaccagcctgggctacatggcggaaccccatctctacaaaaaaatacaataaaaggtaactgggcatggtggtgtgtgcctgtattcccagctacttgggaggctaaagtgggaggatcacttgaacccaggcaggtcgaggctgcagtgagccatgcttgtacctgcatactgcctgggcaacagagtgaaactgtctcaaaaaaaaaaaaaaaaaaaaaaaaaaaa

SEQ ID NO: 55567 - DNA, 1022 bp, Homo sapiens
aactcctcactaccctgtttctgtcctctagacagccagatggatcttgtgtaaaagtagaagtaatcttggctatagaacaagaactgttgatatttccattttaaaaagttgaatcagtcttaagtttgagttggtgagtaaaacaaaaccaaaaccaaacctgggataagctaccaataagttaccaaagtatttaaaaacttgacagatgtaaaacattaatatataatttattcttagcaacttaatctgtttattgagtggcagtgtttcagtaataaagctgagctatttggatacactgaccttaatctagtggaaaacaggaggcttttaaattggcacatacacaaatcatcttaggatccataaaatgccttattgttaaattactgtttttaagtcttatattttctctgactacttctgatagtattagtaggcatctcttactgtattttttttttcagaaggcaaatttaggccgtttttataaggtgaatataggtagattttcatatgtattctggtatattgggaattactgccaatgattacttcccagataatccattctaactatcgagtatctagaaatgatatgttttaagtcacgatgattattaaaaaactgctgaattaaataagctacacattttgctggaaattaaacaaaacttactcgcttctttgaaggaaattgatttattccttgatttcttctctgaatcttgaatacaaattaattttttggttttttttttttctataaaagtgaacttggagaccagtatagcacaatataaagcaaggaaagttaaaatcaattaagaatgctttgtttaaaaagagagaagacagaaaatgtacaatttgtttgtgaaagaattccatagaaataacttatttatttatttattttattatacgttaagttctggggtgcatgtgcacaatgtgcaggtttgatatataggtataaatgtgccatgttggtttgttgcacccatcaactcgta

SEQ ID NO: 55568 - DNA, 1048 bp, Homo sapiens
atgacacatattaattatgtaattaatgacacatattaattatgtaattaatgacacatattaattatgtaattaatgacacatattattatgtaattaatgacacatattaattatgtaattaatgacacatattattatgtgtaattaatgacacatattaattatgtaattaattacacatattaattatgtaattaattacacatattaattatgtaattaattatgtaattaattatgtaattaattatatatcaatcatatattaattatatattaatttatattatattaatatattaataatatatattaattattaattaattaataattaataattaataatatatattaattatatatgatttatatattaattatatataatttataaatatattaattatatataattaataagggaatatgtgattaatctggcactgatgtgtaagagacactagaagagttaaagattagcgtggaaaccattaaaggaagagtcaaatttcccaggataggtagaactgatgcctgggatgaggaagagatatcaggtatcaaagttaacaaatcttgagatacagataatgacagaataagggagattatgaaggagagctggttttaaggaggaatatgatttagattttaaataggtttggttgcaatgatgatataaatatggacttcagattagaacctgagcattaagacttatttctcaaattcagaatggaatgcttagagttctattcaaataaaaacgacaaagttgcatatttattaagaaagtatttgttgctgggagagtggttataaataaagtactataaatagtaagggtgatattagcatatactttgtttctaatataatattaagtaactattgaatcacctttgactaattgtcattgaattagcaattagtaattgattttttaaaaaacttttattttaaaatttcatttattttctttttttcacttctccattgttcttttagaccttttttaaagtgtcagatttattgagtataa

SEQ ID NO: 55569 - DNA, 1047 bp, Homo sapiens
taccaagttttatcagtttttctttctttataatattttttatatcctcatccattcatttttattttcatattcacttccttgtctgggctttttcgacctaagacctggggtccttggtttcagtcttttgtttttgttttttatcttgtatactactgctatttcagttttgtgtaaatttttctcttattcagaaagctcagtgggatctgtgttgtttaccacagaaaatgtaaacttatgtgtctagcattcaagacctttatcatttatttaaaaggttttagtgtctgataacttcaaatgcactgtgatgggtgatttgttaggctgtgtagtttgtccccaacccacttttcctgttatctttttctacttccctacttgaaattttccacagtgtctaatttggttgcttacttttctctgaacatgctttttgctttccagccattacttgtgctatttcactaatctggtatcttcttcttttccatttctttctgagtcttacccaaatcaagtcccaccttcaacatctttgaccattctattccatagagcactcccttttgacctcgtttaggggatttaactatttatgctattcatttgtaatactgccttgtagtcttcttctttctctttttttaatttataaatatgccatcttcttacacaagatggaaagcacatggagtttgaggaccatttcttacatgtgcttgaatctcctgctgtctttaacatagggcttgtgcctagtggtcctcaataaatatatatttgattagagtatttagacacctgtttgcacttatgtatagaaaattaatgagagaatatgatagtgaatcattttatatctgataaaattccaaaatataatgactagtacactaaactttagcatctatgaacagaagtgttgtagaacaactttaaagattttaaagtgaattttacaggaacaatatatattacagtacatttatcaaacacttatttttttgctacatcattgttttcctggaagaaattaat

SEQ ID NO: 55570 - DNA, 1210 bp, Homo sapiens
ttggcagtgttgaatagaggatgaacaacctcttcccagaattgttgtagataggatctataaacattggtgggtctacacgagccttagacccttgccaaccctgagatcaaatgattctctatgcatagctcagtgctattataatttggatatggaacaatccctgccttaaggaattcaacttttactccattagttgctgtattgctttattgccccctttcaatacaacagtaaacataaggcctaaaagaaagactgaaaacaagggctgtagatttaggaacctactgcttagacaatcaaacctacttttgtttgatgaagttcttttgggttaaatatattttcacttgttttgaatgactcattcttccattcaggtgaaaaatactcagactttttaacaatttgaatggatggcattcctaaaaagttatgtggaaaggagtttgaatatttaatcttacacttttccaaataggagaaaaaaaattttttggaatttaacaggcctatgtgaaggctttaggtgaggaacatagcgtccgttcatctgtgttgaatatttcatggttttgattataaccaaccaatatgaaccaatttcagtagttttagttgagagatctagttagtagttcactttcaggtagactcaaaaagcttttctgtatctcagggaatacaagtcaaatgtctgtacatggggggagtggcttttataagctggtagtcagtgaatattgcattgggagagctgaaaaagtttatgtactttcagacatctcataatgtattatgtagcaaatttgttttctccatacgtttttaatgaccttatagattaaaactttttttttttgagagggctaactgtatttttttcttgaaaggtatttttgctgaaacagagtgaaattgaacatattttctaaccagtctggcatagtgcagcatcatggtatttaccttttttccctgaggctgttgtgcctcatgttttctatttaagtatgacttactaatgatacacaaaaaatttccatggtttctgtagcttcttccttatacttcaagcctgtcccacatggtaaatatgcttaagggtcctcttagataaatccaatgtcaagttaaaaattttgtgctattcatttgacagtgaaaaagagatagtcccatttgaggatatgaccagagtata

SEQ ID NO: 55571 - DNA, 1033 bp, Homo sapiens
ttaataacatgttttattgagccctacctgtgaaaatattaacatgtaatcaataggaaattattaatgagatattttacatgttttggtactatgtctttgaaattgggcataaatttaacatgtgtggcacgtctcaagttagactctaaattttcaccagaaatacttgatctgtatttaggtttcatacaatcacagttgaataagtaggttcatatgcctaaatttgtccaaatcatacttcagagttttccagtaactgaatcacttatcagttcttgaatttaaattaattaaaaatttaaacattacaaattcagttccttaattacactagctacattttaggtgctcagcactcacatgtgtcttgtggctcttatattggacagtgcagctctattctattctattgtcagtctttactgtagaacatacttttgtaattactgtcactttatcataaatcagagtggtagtataagtcctccaactttgtttttggctattgcctcagctattgctaatcatttaaattttcatataaattttggaatcaccttgtcaatgtccactagcattttttcatcacagtttactactgtttacattgttagctgcatacgtgacaacaagaaatccaaagtgatattgagctattgttaccagtggagggtgcccaggctcttggcattttgaacaaagaattggacaaaatgcacaaagcaatggaagaatgaagcaacgaaagcatgtagttattgaaatgaaagtacactccacagggtgggagtgggctccaggaggtggctcaggagcccctgttacagaattttctggagtttaaataccctctagaggtttcccattggtaacttggtttacactctatgtaaatgaagtagtggcccacaatcagtctgattgcttgtgaaggtgaccaatcagaggctgaagtgaagttacatagttacaccctatgcaaacgtgtgattggttgcggaaagtgaccagtcagaggctgaagtga

SEQ ID NO: 55572 - DNA, 1050 bp, Homo sapiens
tgctttttagcaaggccttgttttttcattttggccccaaaccattttttatccatgagccttttaatgttatattcttgcaaaatttttatctttagtcatcacttttgatttttatagttacatatttagttgttatgcaatatgtatgttttacataccaagtatgtttaagttaatatactattttccttagtagttaactcttttcttggttattcacttttgtcccccgttagcagtatgtcttacgtattttaagattcagagttgaaattctaaattccttttactcacgggaaattagattttagtgttttgcacaatgccaaatacatagtggacacttaataagcgttcgtttgtagtaatagcctctttggttttctatttcatagaatttcaccaaagatgattatttttgactgacttttaaatggctacatgaattcttgaccctcagcctaagtaaattttttcattgtggatcacaatacctactttctcttttccttcttcattttactcttaaaaatattaatgtgcaaatttggaagtgtcagtttcacaattgctaacctacttgaagtgttttgaaaaatgaaattaaggaaaatttagagaagtggtttattaccttaaaataattaatagcaagattcttcttaatatgttatgtcatagtcacatcatttatttatttactgattcattcttggttcagccagtcatccatttaataaatgtgtttcagtccttatcatatgtgcaaggtgctagtattatgaagaggaattcaacacagctgatatgtggagggatgtctttaatttatatttaaatctctgtgtgagatttgaaatattacaaaagactagagtataaatcaggtggaaaaagggacagcaaagaactgcaaggaacttaaccttttctagcatccagcttgaccattctataaaatatatttagcaaataatattctgatattttgatttgaaagcatgaggctgtagctctttcataaatgaaagatttttaaaggtactt

SEQ ID NO: 55573 - DNA, 1052 bp, Homo sapiens
ggcttccctttggcatatccaaattgccagcatcactattcttgagctttggggccattattaaataaaatgaggattacttgaacacaggcactgtgataccgtgacagtttatctgataagagagcaagctaataagtaactaatgagtgaggagcatatacagcatggacatgccagacaaagggataattcacatcctgggtgggatagagtggaacagcacgagattgctactctgagcagtgtgcaagttaaaatttatgcattatttctagaattttccatttaatatttttggaccaatattgacttcaggataacaaactggtaagcgaaatcatggataagcagggactactgtatttccagatttcttttccctctgtgcctttgcacatactgtttcctctactgagagcatatttctgctattgcccttccctttcttatcacctggcaagctctttttagcctgctcagaggttatttcctgaagccagtttattacacttcctccttttctgtattcctcctatagcatctgatgtatgcctttaagatgactatactgtagtgttttatcacctcccttgactttgagctccgtgagaacataaatggattatttcacctctcttcatgatttggacagaacactcaattgttagactggaaaggagaaaggaaactaaagtttgagtgtctcttatgtgccagggaatgtgcttaattgtgttgttttagacacaatggaataaattcaattgccacaataaattttgtaagaacatactatcataattagtatatatttttattacatattatctccatcttatagttcagaaaactgaaattaattaatttccccagttattaaatactagagccaggactcgaaccaaggcctgttttgactctacggtctccggttatttcattttactgtgctgtttctttactactagtgtaattgatgatatgatcttgtgtaatgtaaagaacatggacttggacatcatacagacctggatttgagttctagttta

SEQ ID NO: 55574 - DNA, 1775 bp, Homo sapiens
cactttttgcaaactgtggctatgacagtcctgaacaagaagggtttcctgtttaagctgcaataacttttctgactatggatcatcgttccttctgtggcagatttttacagttcctctaatgcatttgggaggactgtctcaaagtaagctgcagttttcctgacaactcctcgctctctctcctactaagaactgtagcccttttctgctgtttttcgaaccttctgctaccatatccaccacttccaccaccagatccataaccaccaccatagggactgcccgagcttcttccaccagaactgtcccctttcacgggtccataatttgattgctgttgtccactataatttccaaaatcattatagttcccaccaccaccatagttaccaccgccaaaatttcctccttcattgtaaccatcatatcctccaccacctccaccatatccaccaccttggtttccatatcctggtccaccaccaccatagccccctctactactataaccaggaccacaccatagttgccaccatcacctccaaatccattatatccaccatcacctcctccataactacctctgctgccaccacctccaccaccatagctcctccaccacctccaaagtttcctccgcgacccataaaattgccagatccacctccacgacctctctgtgatccagcagactgcatctcttgtttagaaagggcctttttcacttcacaattatgcccattaatagtgtggtatttctgaacaacaattttatcaactgtatcatgctcatcaaaagttacaaaagcaaatcctctttttcccactctgcctgtcttccgtaacttctatggtttcaattttgccatacttttcaaagaagtctctcaaattatattcttctgtatcttctttaataccaccaacaaaaattttcttcactgttagatgggcaccaggctttacagaatcctctctagaaacagctgtctttggttccactacacgcccatcaaccttgtgtggtcaagcacacattgctgcatccacctcttcaacacaagaataagtcacaaaaccaaagcccctggaacgttttgtttgggggtctctcattaccacacaatctgtgagtgtgccccatttctcaaaatgttctcttaaactatcatctgtagtttcaaagctcagaccaccaataaacagttttctcaacttctctggttcctttggatcatggccctccattttgagaccagactcgcctcttccaactcgagttcaatatcgatatactgaaaaattttttaatcagcaaactgaatgttgataataaactcaatctattgggaaaaaaaaatgcacttgcagataatttatccagaatctccaggatctactctgttctggatggatgtcgtctccaacggtctggaaattttaacccccaaatgttaaaatgatgaaaaaatatagatccagccccaaatcttctaagtgaattcatttgttttttcttaatattacatgatttaaggattgaagcctctctctctgtcacacacacacacacacacacacacacaccataaaagtaatgcaacacttataaaggatttatttgctgcctcaaagtaagactaaacgaggaaattcaccactcatgcattatctgctattccactgtgacgtcattctcatcaattacgatcagcaacttcttatctattttgcttagactaggcatctatgtcctcattaactttttacta

SEQ ID NO: 55575 - DNA, 1050 bp, Homo sapiens
ctggagattctggataaattatctgcaagtgcatttttttttcccaatagattgagtttattatcaacattcagtttgctgattaaaaaatttttcagtatatcgatattgaactcgagttggaagaggcgagtctggtctcaaaatggagggccatgatccaaaggaaccagagaagttgagaaaactgtttattggtggtctgagctttgaaactacagatgatagtttaagagaacattttgagaaatggggcacactcacagattgtgtggtaatgagagacccccaaacaaaacgttccaggggctttggttttgtgacttattcttgtgttgaagaggtggatgcagcaatgtgtgcttgaccacacaaggttgatgggcgtgtagtggaaccaaagacagctgtttctagagaggattctgtaaagcctggtgcccatctaacagtgaagaaaatttttgttggtggtattaaagaagatacagaagaatataatttgagagacttctttgaaaagtatggcaaaattgaaaccatagaagttacggaagacaggcagagtgggaaaaagaggatttgcttttgtaacttttgatgagcatgatacagttgataaaattgttgttcagaaataccacactattaatgggcataattgtgaagtgaaaaaggccctttctaaacaagagatgcagtctgctggatcacagagaggtcgtggaggtggatctggcaattttatgggtcgcggaggaaactttggaggtggtggaggagctatggtggtggaggtggtggcagcagaggtagttatggaggaggtgatggtggatataatggatttggaggtgatggtggcaactatggtgtggtcctggttatagtagtagagggggctatggtggtggtggaccaggatatggaaaccaaggtggtggatatggtggaggtggtggaggatatgatggttacaatgaaggaggaaattttggcggtggtaactatggtggtggtgggaactataatgattttggaaattatagt

SEQ ID NO: 55576 - DNA, 1033 bp, Homo sapiens
gtacattcctgaggtcttttatctgttgtagctttgtctttttctttttcttttcattacatcaagtatattgccctgtaaattgtggtagtggtaccaggaatgaaaaataaaggaatttttaacttttcaaaagaaaaatttttcagtatatctgcataaatgaaattggtccatcatgtgtattagaggaagctatccttactccgtttgttatcaggattatgttagcttgaagaatggactgataaactttctataaggcttattacaggctttaacctgtaaaattgatctcatcgtaaacagctttgagagtatacagatagttgactatttttcttctctggtttcttcagatactcttcatcatcttggatttgttttaataatttatatatgttaaagaaaataatcaaaactgtgcagatttataaatctttaaaattgtacacaatattatatattttaaaactccctacatatgcagttttatcacccttctcatttatggtacaccataagactcactttttgatgccaagtgttctcgaaaatgtcctaaggaagatcattgctggaacaatgttatttttgagacttttgttccttataaggaaatagacatcaattaaggagggaattttttttttggaggtggaaatgggtagtatgatcaagcaactatatgtatatttccctggggaacacggcattaagaagagaaaataatcccaactattaacaatttcatctgtgcagtggtttttattctgcaacattgtcttttctatttttgtacatgttttctagaaaaggtaaacatgtagtagaaataaatgtgatgttaattgctatggcagtgtgtctgtacacattacttttttctcctgtctacccaccttccattggcaatcacccaactggttaggtaaatgagggtggatggataataaacgtttcttcacaattacttccttagctctcaaaagggattctgaagcattccattataagtgctgcttacagacat

SEQ ID NO: 55577 - DNA, 1052 bp, Homo sapiens
aataccacatgttctcacgtacaagtgggagctaaatgatgagaacacgtggacacgggaacaacacacgctggggactatcggaggatgaagggtgggaagagggagagaatcaggagaaataactgtgtactaggcttaatacttgggttactaaataatctgtacaacaaacccctatgctacaagtgtactatataacaaacctgcatgtgtacccttgaacttaaattttttaaaagtttattaaggtgaaaatggttattgaaaaatcttaatctctgaattagtaacagttcccacatgctaaatgatgtatcccaatatctctttatttaaaatataaaactaggcagaaactgaaattattttctagtaggagagtcttttaaaaggtagcattcataagtgttgtttacatattatgcatgggtcactgacaatcaatgtgtctgtaaacaactctgttgtagttagggctcttttcccttttgaattttgattgctcagccaagggttctttgttgatagctggtttgagtacttttatatactatacttaattcagattaatgagctttgttaatactgatttgaactagctagattttatttgtttacttgtttttgttatttttaagaacgaccaattccagatctatgctaatttaaatatgtcctcaaaaagggggcacatatttaaaaaaacaaaccaaaacatacatttatgttggaaaaatcttcttagttcattgttagtaccctaatttttgtaggttttcataggaattaactctttcaaagcaccttttagactatgttgtcggcagctagatgctccatttacttcaagaaatgcaacaaaattgaaaccagtttaactgctaagtgattcgaagtaatgcaaagtacatggactgctaaatcatagaggatctaatttttttttaaaacccatttgttaggctctcatataaatataacacttaaaacaataagcacatatactgttatataattcaggaagatttttagcttgtagacttccaaag

SEQ ID NO: 55578 - DNA, 1060 bp, Homo sapiens
tatgaagaaaaagcattttttcaacggataataagggacagagcagggaagggaaaaggagaggaggtttaactattttggataaggtagtgaggaaaagttttctttcagaaggtgaatttgacaaaagagctgaatgaaatgaagaaccagcccaactgtatatctgggagaagaacctgtcagtcagatagaacaagtaagaagaccttgaggccttgacttattctagaaacttgaagaccagagtgactaaagcatagggacatagagtgtgaaaagatgagttccaaaaggtaggtagggcctgatcttgtagggcgttgtcacccttgtaaggagacaggattttattctggttgtgatgggaagctgtggagggttatgagcactggaagattatgacattggaggctgtgctaatttggatttaagaaagctcactctgattactctgtagaaaattgattatagggtataagaggagaagcaagaaagactattgctctggagtaggcaagagatgatggtgaccctattaattagtagaagtagtgagaaaggtgtcagatttcagatacattttgaaggttaagggaggggtgcttgaagatcatgagagaatagactgatatattttagttgagtccactttggaatcacacaaaactatttttaattttgaatatactttagtgcccccagcattaattatgcagaacgttttaggctgtttaaaagcaaagcagataaattaaaaggaggttagtggttaaaacttctctttcctataaatctcaaagcaatcacaagacccctccaaacctcatatccctttttttttttttgctaatggttgtagatcacaccagtgttctacatttcatattctctcagaacttgctttgaccctcaatgtcgttctgttgtaatgataatgaaagttaaggtaacaaaaaccacttattgtttatcatgtgcaaagtattggtttaagtgcttttgctatattaaatccttttatcctcaaacaaccctattgtaacaaaaaccaagttca

SEQ ID NO: 55579 - DNA, 1029 bp, Homo sapiens
aaggggaaagagaagcagaggtgaactctgtgaagtgattgaaaatagaaatcttaagggtaggcacctctcttttcaagtttccgtacagagattttaattcctttggtcaaaaggctgcaattcaagttgtttttgcaggcctggctcatttttccactgttttcctcatgggctcaaaggtctgttgaagtggtaaataaacgtgctttgaagctatcacaactcaccttgtgtagttgaacttgcttaggggcagttatcacagttcctagtaagccaagcttgtttctgacagctatggaggatgtgagaaagaacagaattggatagagaaccatttgggaaatgggagagatgtgagtgctgatatgctttcccctccatcgctaataaacttctagtgctattccttgttcttttaaatgtacctatagacattttgctctatgcaggaagtattccctaatgaaagaatggagtcagagcaaaaggaaacatctaagctttattgatctgtgcttatcttacattgctgctctctgctgagaaattgattgatttttttaaaaaaaaaacttcaggagcctttgttggatgttgccattgctgttgcaaaataggaaaacagttatgcataaattatctggagaaaatattttccttgatttttttttctttctaaaaatgtgtgggaagaaattatacaaagtgagtaaatggtggtattatttagaaaccattctattttcacttaggcaaccctaacattaagcaagaggatctttgtggagaatttactgttaatattgtttgcatatttacccaaacagcttgatataagggtttgtttttttgttgttgttgttcttaaattaccattttgagatctagaaatttttcccagcccaaataacaacaaaatcgtttactcattttaaaactttattgtttaaaaaaaccccactaacaaccctaaaatgaatgactccgtagttatttttaccttctttttatgaattccctcag

SEQ ID NO: 55580 - DNA, 1508 bp, Homo sapiens
agtgaagtagacaaatctcctgtgaggaattccaaataatttatgtaactacctgcccccaaggtgtgggacataactccccactccttaggtatgagctacccatagtgacttccttccaaagagcacaatcagtataggagagggaaaaataatgctccagtggagaaatctgatgaatactaccttagccaggtatttaaagttaacttcagcagtgataaatcatattgatagtgtgtgtatccttaacatgaagtaataagaatggcactttaccttactcgtcttcctctcaaaaacacataaccccagtctcatcgtgagaaaaacatgagacaaactacaattgaaggatattctacagaatacctgtttactactcctcaaaattttcaaggtcatcaaaaacaaggaaagtctaagaaactgtcacagataagggaagcctaaggaaatatgacaagtaaatgtaatgtggtattctggatgcgatcctggaaaaggggaaaaaaaactttaggtaaaaaattaggaaatttgaataaaatataaactttagtcaataatgtatcaatattggttcattaattgtgaaaaatataccatagtaatataatatattgataatagggggaattggtgtagtatatgggaactctatactatctttacgatttttctgtaaatctaaaacttttctaaaataaaagttttatttattttttttaaaaaggcctcaaaacattgccatatgtctctagggagcaaaatttcacctagttgagaaaatcaccattatagttaataccatagagaaaaaaagtatatttcatttttgtttctgttgagtccctagtggagaaataacattaatggaaatgcctaggatacctagtaggcacaaaggtgcaaagtacatatttacttaccttttctaatctctctccccttcccccttaaaattttagtgtccttgagggttttatatttttgtttttcttctcattctggtagctgtcttggattacctcatttgtgcctgtagcttcacatatcatccatatgttgatactaccaattcaaaatctttaggctgatcttagcttctaagtctagcttcagagtaagcatctatctatacttttatgtcccataacatgtcaaattcactagatttgagtcacaaaacctgatatctcctgcattctctgtcttgttccaccaactgaatatgtgggagtcatcctagattccctctaccttaaggcctgaattattgtaccctctttctctcactatgtcttccacatctatgggtttaaaacagaaatttgatcctcctaataccctttctcttaatcttataatggttcctcattgcatgtaagaaacttttttctccactgtcatgtacttcaatatctctaaaattgaccccttcctgttttgagcccctgaatctattttactggtttctgtggtaatacaaataacacaccactgac

SEQ ID NO: 55581 - DNA, 1159 bp, Homo sapiens
agaatttattatttaggccagaagccaaagtataaaacttggtgccaaatggaaagtttagaaaactttcagcattcaatacaacttcatttaaattaggttggtcttcagaggatattgaggtgagtaaaatgggcagctagatgaaagaaaatcattcatctattgaggaaactgcagagaagtcactttgctaacacagggaagatgttgctgattattttctgttttggatctgacttaaggaaaaaagataaaagattcattcttaattggcagaatagcaaagaatgagttaagtctttctataaattatttgtcttaagtacctattgctagaattagttaatattgtatttactaaggaattctatattttttcaactattatgaaaattttcaagcatacagaaaattagaaagaacaggacaatgaatacccatataaccaccacttagattccatacccacctatctataagtatgtgtgtgtatgcgtacatgtctgtgtttagtgaaaccatttcaaagtaaattgcaaattttatgacactttaatcctaaaatatttagcatgtattccatattatacctcacaacaccactatcacatctaagaaaattgacagtaatatcttaatattagctactatccagtttatagtcaaattttcccagttatcacaaaaatattttttatggcttttttttcccttcctaaacaggatccaactgaagttgacatattgcctttaggtgttatacctctttagtctcttttgtttgaaaatcttcacctcccccaaccttttttttttttttttgaaaggaggagactttttaagagagcagaatgttctaaattctaaatttgtctgattgcttcttcatggtatcatttgtcttgttcatctatcctttgtaattcctataaactggaatgtaaaccaagttgattctattcagattaaatgttttggcaaaaatacttcatagatgacactgtaaacttcatattgtattgcatcaaatggctatcagattagcaataataagtttgatcttttctgtgtaataaaatacttttctcctttgagattagcaggaaattggtgggaataatttcatactaaatggcttagcatttattgatgactg

SEQ ID NO: 55582 - DNA, 1050 bp, Homo sapiens
ttaatgacaattactgctgaaagtcaaacttccaaagaattcatgttaaatgttttccccctcaaaacatgcacaatttaaggtaaactatgtaatgtctagatttgtctcagcattatggggaagaacctatgctattttctatctaggaaaaaacaatcaattatctacctcattaatttaccttaggtgaatgagcatcttaattacttccttaggagctaaggaatttgattagaaaatatgattttagaaaaatcatgagtattttactctctaatcatatatatatttctctaacgttagcataatgattaatagaatgtcaaaagtagtaggaaccacaaactgttaatgtggctagacctgttgagtgctttcccatattatttggcggcctagtgggaactgcatgacaaattgagaagatactcaattgttttcattcttttctggaacatttatttttactgcaaaaattacagattctcaagagaaagttaaagtatttcttgctttcctgagagtaagccaatactgaattatcctgctaatgtctctgtttgttcaataaattgtcagataaaataatagaatgctcagaaaaacttttaaaaattacccttacataaaaagcctacatttttatatgatctggttagttcttagcttaacctttacctacatacttcctcattttaccaaaatagttcattatgttacacattagaacaaaattatttcagttagttttatcctcatttacccccaccttttatgccaattagtcttacatgacagcatcaatgcatttaaattcacaaagtatgtcctaattcagaacccatgtaaggcaatccctgtaggaatgaataatctacttacatacagtcaacttcctggccttaaacaaatagtattaagatattagataatatatgtgaagagcacttgagaaattagttctttcccctatttctgctctctcttctcgtaagatgagtgctttgagcgctttggcctccttttggccaatggtagatatttcct

SEQ ID NO: 55583 - DNA, 1049 bp, Homo sapiens
ttttttttttttttttttttgaggcagagtctctgtcacccaggctggagtgtagtggcgcaatctcagctcattggaacctctgcctcctagattcaagtgattttcctgcctcagtctcccgagtaactgggattcacaggcatgtgctaccatacctggctaatttttgtgtttttagtagagatgggttttgccgtgttggccaagctgatctgaaactcctgacctcaaatgattcacccatctcgacctcccaaagtgctgggattacaagtgtgagccaccatgcccacccctatggtagatatttcaaaacttctttgtgaaaaacagggcagagacatacactaggtcaaattgctctgactctcactgcaacattagtaatttcagctgctattttattcacttcaggaaacttctatggaactcccaagcctccagcagaacccagcccttttcagccagatccagttgatcaagtcctctttgataatgagtttgatgcagaatctcaaagaaaacgaacgacatctgtcagcaagatggaaagaatggatagctctcttcctgaagaggaagaagatgaggacaaggaagctattaatggcagtggaaacgcaggtttgtaaatagatgaacaacttctaactgatcttctagattgattttactattacgttgaattaaaagcactaaaattttttacaaagcatatggagagcaagtgatgggattttaatttttttgtaaaggttgtatgtggagcaaagtgtatttctgtagaccatcctataagctaaagtgagttgtcccaatttggataaatcaatgataaactatcattagtaataaaatatatgccattaccctgctgtttaaaatatttgagatttgcctctgatgttgcaatgtgggagtcttgttggcctatgtcttactttacaggatgtaaacaatatatggatgttttagaatgtagacttcagcctaaacaaagtaaatagggcttgaaagtatgctgataaaaattatctaaaaggttg

SEQ ID NO: 55584 - DNA, 1089 bp, Homo sapiens
aaacttaaaaatttctgcatagcaaagcaaacaatcaacagagtgaaaaagcaatatatagaataggagaaaatatttataaaccatatatattataaagggttaatatgtagaatatagttaaatatttgctgctagataaagctgtttggtttggtataaccagtatggttgatctgtattactgctgctgttgaaaaatgcaactgtaagaaaataatgttcatataggtctatagactttagttcttatgttttgggaatatcccctatggatatttcttttcattggaaaattttgggtaaaattttagcaaattgcctacatctgctgatttagcaataaaattttggatcatgggaacctaagttaagcttttctcaagtggcagtttttagttgggtttagcaaggtattttcgtgttgttgttgttcttattgttgtttcctaacaatctatgtggctcctaggcccctgagttctcatcctttgcattttctaaaatttttttttaagcaaaaaacttttaagtttggggagattatttctctaatagcatgagtaatatagactttctagagataatctcacttttttctacagaaataagctattattcagcatattaaaaactgttttggccaggcacggtggctcacgcctgtaatcccagcactttgggaggccgaggcaggcggattatgaggtcaggagatcgagaccatcctggctaacatggtgaaactctgtctctactaaaaatgcaaaaacttagctgggcacggtggcgggcgcctgtagtcccagctactcgggaggctgaggcaggaaaatggtgtgaacctgagaggtggagcttgcagtgagccgagatcgggccactgcactccagcctctgtgacagagtgagactctgtctcaaaaacaaacaaacaaacaaaaaagtgtttctatcacattctaccagctagtattatacctggcagtggctgcagagctctgcaagtagctcagcggttacaaaagatatagaagatgtgagtaattccctgaaaccttattggcttcatttcctaagagtggtcaa

SEQ ID NO: 55585 - DNA, 1174 bp, Homo sapiens
ttattgtgaacatggtatttgtcttctagagcatgtcccttttactggcttccattctttttcctggtccctaattgtttcagttcagttttctgccttttcttgttttcttttgtagaaagcatttattctcatagctttatcagtttactatagcctgccccattatcaaaatctctagtattgtcctttgttctgaattatatttctgtttcctcttgcttttgagtcttggttttgatttccctactaatacttcaaataagcttatttaaaactaaattgacatctttctcctaatacaacccgtccctctttctgtcatatacgtaccattctcataatcatctatgccaaaatctttgcaattatgtttgcctgttcctctcttcttgctctacttcctgatttagttttcacgtcctgttgctttttcttttttctctttttgccaatatattattatgcaaaagtttcaacatataggaaaatgaaaagaatcatacagtgaacatacatatgcccaccactaggatattacaattaacattttgctacatttgcttcttcacatgattattcatttattctttctctatctgtgatttttcttttatattatatattcctttccattctcctaatcactacacacttggattattcttggtctttcttcctccagttatttctctctctttaatacatcttttatgccagtggttttcaaaatgatcatactcaaactatctactggtacccagtagaaaatattagaactaatttttcataatgttgttactgaaagaaaaagaaacaaactaagcttcactactattttacatacagattggtaatggcattcttactgattccgtatgtcggattatcacatactctaaccagagtgccttgagggaggaatggatgagacacctttgctcttttttcaaggacactgtgaaattttacagttgatttgtgcccagttaagtggatttatagactagttatatagtttttaaactaacctcacataaaatggaaatgtcactttaaaagatttctacaaaaacactactgattgaagatgatacaaataggcaaacccagactaatagcaagaaaatggaagaaccgatactgtttgtgtatcatatatgaccatatataa

SEQ ID NO: 55586 - DNA, 1079 bp, Homo sapiens
tgttgccccaacataattattaatagtatccccttttattctcaaaagtggacagtacattttatgatcatcctaagtatatttttcttaaaatagaatgatcaaaattgcattcagtattctgggaatgtttgaaactctttaatatgggctactctcccacttacaaaactgggtacacctttttaacattgcctatacttatcttcgggggagcctacaatttagaacattgagtctatttgttttatgctcagccagccttttccactttcctctctacactttgtctccccacgtaatagccccacggaagactattttcaggatgaactatgtgtgattcatattagtattctctgcagtgctttgcacagagtagatgctgaaaagagaagaataatattttaagtgtaggttttataggttaagatattgtttacattctgctgaacatttaagatcttctagaaagaccttacagtttctaaaacatgcccttttcttcccagtcttctgatattctgaacacagctgtgtattcaaatacagtgtaaggacacagcttgaacagcttggtttaattgatgtacattttatcttctattcaaataaaatagtgttttggttaggtagttgtcttgaaaatacaacattaggaattcgttttaccctcaacccatcccatttctcttatgatgaaagaaagattaaatttttgctaaaggcagcttacaaatatattgaatgttgatatttcagagcttagagaatgattaaaaaaattatcaactgaatagagctccaccatgagaaaataattgtaattcttacatttaaacaagaaaaatcctatttggggaagaggaaagaaagataaattcatgggatttagaaccaaccagctgcttgatatgcccaaaatagttttgtcttttgaaatagctttttaggggaatactttggcttcatacacaggaaaagatggttaggttaggtctttcctgtatcaaaaataaacaaacaaattttctcttggccctaaccctccccatagtttttatactatcttttccaca

SEQ ID NO: 55587 - DNA, 1027 bp, Homo sapiens
ggtatactaacaatgataatataaattatcagggttttttttttaatgattcacttgagcttgaagtcaaaattctttgctactgaaataagtaggattttagacatttatacatacattttagagaggagttagaaaagggagaaggtctgtgttagaaatctatcttttcagcagttaatagaggtttccaaaattcaaatttagttgctaaattgtagttatttttgcccctctagcaaaaaaattaacttatttgttgattttaatatttttaacatgattatgtttttccaggcgatgttattgtagacatcaatggcaactgtgtcctcggtcacactcatgcagatgttgtccagatgtttcaattggtacctgtcaatcagtatgtaaacctcactttatgtcgtggttatccacttcctgatgacagtgaagatcctgttgtggacattgttgctgctacccctgtcatcaatggacagtcattaaccaagggagagacttgcatgaatcctcaggattttaagccaggagcaatggttctggagcagaatggaaaatcgggacacactttgactggtgatggtctcaatggaccatcagatgcaagtgagcagagagtatccatggcatcgtcaggcagctcccagcctgaactagtgactatccctttgattaagggccctaaagggtttgggtttgcaattgctgacagccctactggacagaaggtgaaaatgatactggatagtcagtggtgtcaaggccttcagaaaggagatataattaaggaaatataccatcaaaatgtgcagaatttaacacatctccaagtggtagaggtgctaaagcagtttccagtaggtgctgatgtaccattgcttatcttaagaggaggtaagtaaaagcacaacatagaaaaagtttcagtgttcaagcgtttatatctactgattgtctttccttacagtttagaatgtgttttcccagcagacttaactagtaattagtgtgcattttc

SEQ ID NO: 55588 - DNA, 1052 bp, Homo sapiens
acagtatgtagaaaatcttgcctgatgacattgaacagacttttaatagctactctgcagatttatattttctgagtttagtgttttgtttcattgtaatgatagggataatggttgtgctttttgagttatcgaacaactttgtattttctattttctttgtacacagccctgaggatctataagggattacataatacaatgtggttatttgaagtgccattttggagaatgggcactttctcagataatacctttctaaaatataactgttttcatagttgaactgcaaaaatctgttggtttgcacaatgctaagttaggaattccttaactcttcagctaaactttacactgtggaccaaactgtactttgttatcttatcagatatatattggggctattattcccctgggagcagctgagaaagatggtcggctccgcgcagctgatgaactaatgtgcattgatggaattcctgttaaagggaaatcacacaaacaagtcttggacctcatgacaactgctgctcgaaatggccatgtgttactaactgtcagacggaagatcttctatggaggtgtgtgaacttgttcctgctctgaaaagttaaaaaagaaacaaagatactagtctacttcctgtgtagttttgcaggttattttattacattcagtagtatctaagataacccatttggtgtgatccagggcctcactgtggaaggctatgcaaacacaaaaggattcagaaataatactactataaaaaaataaattttgggcttctatattaagattattttcatatattgatgcattttgcaaatgtattataggtgggagtattgatttaaatccggttttgttttgttttgttgagttgaggtagagtctcactctgtcacccaggctagagtgcagtggtatgagctcagctcactgcaacctccacctcttgggttcaagcgattctcctgcctcagcctcctgagtagctgggattacaggcacacaccaccacacggctaatttttgtatttttagtagag

SEQ ID NO: 55589 - DNA, 1121 bp, Homo sapiens
ctgcttatgtcttttaatagctgtctgatcttgggcaaattactttccctccaagagctccagtttcttccacaaaatgaggatgatagagacactccctgtctcatgaatgtgaggattaaaggagacagggtatgtgaagcccttagccaaggccttcagtaaatgttagctgctgttgcttgttgtaacttctgctgccattgttatcatcatcattatttagaaaattgtcaccgtctcttaacttttcttttaaaaaaaaacttttaaaagttcatcaatacttaataatgagataggaaagaaagcccaattaaaatgtaagattgaggcagcagctaacatgtggcaggagatgagtatttgcagctcattaattatcaggctgaatggtaaattaggctcaggttgttgatgaattttatgtaaagtacttgagattttcagtcatggtgtaaaaccagaattgataatttcactgaaatgctagttaataatctcataaaatgttgaggcctgagagtattcttgttagaattttatttttcacatatagacagaaaaagggtcctggggaaagctccaatgaggagttttcacttacagagactgaacacttgctgcaaactgtatgacagagaaggtttggttcagaaaggagttagcacaggtggaaaggcaggaaacctgtctcagaatagatcagtattttctttttcttttttttttttttgagacagtcttactctgttgcccaggctggagtggagtggtgtgatctcggttcactgcaacctctgcctcccaggttcaagtgattctcgtgcctcagcctcccgattagctgggattacaggcatgtgccaacacacctggctaattttttttgtatttttagcagagacggggttttgccatgttggccaggctggtctcaaactcccaacctcaggcaatccacccaccttggcctcccaaagtgctgggattacagacatgagccaccgtgcccagccagatcattctttatggacctcatctcaggtattttctgatgacgtatgtctcaagaagagttcctagtagcatctgtggtaccagttatggaattctgagtt

SEQ ID NO: 55590 - DNA, 1088 bp, Homo sapiens
gagtatttatgcatgtgggcaaaagtgagaagtatgaaaatagttccgtttggatgcgatgatgacgtgtggtacttttctgttatgtttttaaataattttctttgatgttatgttgaattttaaatgacgttgattataaatctaacactagcagaaatcttaaataattgaaaaacctggggttttttttcccatagttattcctcataaaattggccgagtcatagaaggaagtccggctgaccgctgtggaaaactgaaagttggagatcatatctctgcagtgaatgggcagtccattgttgaactgtctcatgataacattgttcagctgatcaaagatgctggtgtcaccgtcacactaacggtcattgctgaagaaggtaaggagccagtagacgcgcctgccccaagctgatctgagaggcacaaagcctgtgtgaggcagtggcctcctccagcactgccagaatcactgcggggatataactgtgtatgcacgctggagtcttattcttccccttttcaatttaatgaacttaaaaaacaacttattataaagttgtcagcagctcaagaaaaataatccagctagtgagtgtggaccgtttatttatgtgctagagaagcaagcacccagaagtgaaagagactggtagtacttttcagatcttattttcttaaaataatgtcttaagtcttcgcttaagtgagagaaaatcctttaaacagttcaaagaaagtcactgttgatatcaagtcttttatgtcaggcccatgccacagtgtgcctttccttggggacagggctttgttctgggcagccgctttgtaaacagggtaaaggagtgcgtgggaatggctagtaagtggggcataaaacacatactggcagccgtggagtctcccaaacatgtttaatgtcttgccttgctgtaaagctgccttttgatcattaagaatttctaattaggaaccatctttagccagtccatattctttgtgaattacaacataaccactatgtaatgctctcatttttcctgattttgcaaaactaacaaggagaagccaaaaacagaatt

SEQ ID NO: 55591 - DNA, 1057 bp, Homo sapiens
aatgtagtccaatattgatgctttcttatggctttttattttaatttggctggataagttgtttcaaataactgttaaagatattacttacaattgaatgtttgaaataagaaagtactttaagcaatagagttcatctcctgctgtgttatccaacctcgatgtatacttacagcatctcaggtcaccctttttatttcagttatttaattatgaaaccataaagaagcatgtggaaatagtgtttattgctctttgaagaaaaaccaccaactatttctggatattttggctgtacctactactaaagtcattagtctttaatacataatacatatttgaaaagtaaacatattatatagattatgtgagggacttaatcatgaaaccagtttcacagtccaagtaccaactcttctggtagcaggtgcacaagcttgggtgtttaaaaacaacctgtgtagggtatgcccagcaaatgaggacaaatgtgtagacagtacttactggatcttatttaacttttagctacattaactaactttcttatttaaaaacaagaaagggagactaaacatctgcttaacttgtacacattttcagaattctttttaaaagtctagttaaagatgtttcttagaagttggagactgttaacaacttccataaaatagatccaggtttttcagttccctgaagcagcattcagtagcatctatataaataaaggcaccttctgagaataaaactattttatggagtgtgtgaacacacttgttctgtcacctgggttcatcttgttgtgaagcacattaggtccaggtccttccctctgggagtctgactgtgaaactctttaacccaacaactcaattagcccctgtagataagacatgcttcccagagtgagatttttgaaatccccttttcatccagaactatatttacccacctattgtaactattcaaatagagcaaaattaggaggcttgataaatactaagaatttagtaccacagaaattatttattattttccctgtagtccacaattagtg

SEQ ID NO: 55592 - DNA, 1023 bp, Homo sapiens
ttgcagtgagccaagatcgtgccactgcactccagcctgggtggcagagtgagaccccatctcaaggggaaaaaaaagaaaaagatttatttttgagatgggggtctcactgtgtcatccaggctggactcaaactcctgggcacaagtgatcctcccagctcagcctcctgagtagtttggactacaggtgtctactaccatgcctggctttataattcttaaggctacttgcctagcaatgttgaaaaaatatccaacttagttgatatattaagttaattcagctagctaaaagcaaagattatagattccatgtaataatgacatgctttaaacaagtcatattcccgataaactctaatagaaccagaaaagagccacccgaataaataaatgttattgtttcaaagcacaaatagtttttaggccttggagcatgccatgatgatgtaaaaacttgctctgatgtattcctcataccagactgaaatgtcacattttgtaacaagtttatttatatcaatgttccttagctccactgtggactaagcttcaacttaaatacagctttctggaagtcattagtgagactgtttgttttatacagtttaatctgaatactccttgccttataaatccttactctttgaatggtggacatattaaacataaaataattctttgtctacatgtttaaaagcatttggttttacttctacatgattacatttatttctcttttaaatcttgctattaaaaagggaagtaacaaggtattctcatgtagaataaaaagccaagtgcctttctggatccaagacttctgaaataagagttgttcctgttcaaaagctgcctggtccaagactgatgtaactaaagacaatatcataggatcttagccttctaatctcactagggagacaatgtaataatatctcaaagcttttctccctgttgtgaccagtaagaaaatatgttcactaaaacaacaaaacgattttactgcctgtttgtttct

SEQ ID NO: 55593 - DNA, 1050 bp, Homo sapiens
taccagaaaaataaagtgagttaacctgttttaaatacattaattaatgttttacttctcagaacccagtaagagatagatgctaggctgtgtagattcaaaatgctgacctgatggttttgggttaataactactgtgaaaaaatttccaattttgttacccaggttctgatgattgctgatgtctgtcatattttatatatgtgtgtatgtgtgtgtgtgtgtgtgtgtgtgtgtgtgtgtgtgtgtatatatatatataaaactacaaatgacatattgctcaaatccacctaaaaaaatcttagttagtagaaaagtaggtgagaacacgttatggattttttgaaggtagctctttgaatattaaggaaagacagccttaagcattcatctatacccaagacaaaacacagcaagaagtcactgagtagctatgagaaaacatgtatctcatttcaattctttgatgttttttgtaggagctggacacaccatttagactctatggactgacaatgaatcccttaatctacaatatcacaagagtagttatcctttctgctgtctcaggtgttataagtgatcttctaggatttaatataagagtaagtatcaccaccactctgtagcatcctagtcttaaaaattactatgtacagaaatctgtgttcttcacacgtgtgtgtgtgtgtgtgtgtgtgtgtgtgtgtgtgtttctagcatgcaaataactcttgaggtaaagaaataggcattttgattggtggtccacaggcttttcagcttcagttttctcattttacacaaatataacagacagtgctcttgaatggaacaaaaaaaatcaagtttgaatttcatatcagtttaatagcctgagctgggtaatggtcttactctgatcctggggaatgtacagatgtagaatgaatgaaaaccagtacatgaactgcattgtattatttttgatcctggaagttttaaatgttttttctctatgatgttctatggttgctattgccagacttgatacattttcttctttta

SEQ ID NO: 55594 - DNA, 1070 bp, Homo sapiens
cagtttgctgctctgtagttgcttatccctaataaaatggatgtaatatctcctcctgctctgtgagaattaagatctaatggattgaaaagactttgtatactatggagagatttttattggtggtaatggagcatgcttttaatctcatattctatgtcaagtattagatctttagagtacttgtcatttagcatgtataataagcttcttgaattcttctgtattagacatagaatacattattcagtgtttggaagatacttggttttcagtatgtgaatagacactaagattgagaaatatctcttgtaaatacagagtagtataaagtttttttaattttgtttttaatttcaagtttttccataaactttgaataaaaacatttatcattcgtttctgttttttttttgtcttagaatcgtaatggagaattcttcctacaaggcaaaatataaggaattagtaaagtaaaaggagctatcttcttctgttccataaatgtttaatgaggatgttagattatctagggggatagtgagatgaataagatagaggttttgaactcaaggtgcttacgtgctaattatgttatgttgcaagtaatattaaaatttttcattgttttgatatttaaattgcttcatcattaatttttcatcactaaatagtttttctttgccagagggagactgatcaggaatgggggctagagcacatgacatatgttctctgtagcgatagctattggaatttcaaaatttattttacttgaaaacatgacctttgaaatatgccagattttatgcagtatatatatttttttccaagaaatttaccttaatttctattccttcccttagattaatttatatcttaagatggaaaaaaagccaaataagaaagaacagcttactctagtaaacaatgtattaaagctgtccaccaagttgttgaaagtaagtcataggctatgatacacttttactatcatttgagttaaatcagtcttttctctaagaaaacattaaatggcagatgataccttgggttgggaggggtcctgg

SEQ ID NO: 55595 - DNA, 1039 bp, Homo sapiens
gatatgcagaagaagtgtgatttattttattttattttttgagaccgggtgttgttctattgcccaggttggagtgtagtggtgtgatcacggctcactccagccttgacctcctgaggatcaagcagtccttccagctcagcctccccagtagctgggactacaggcctgcgccaccacacccgactaattttttgtatttttgtagaggtgaggtcttactttgttgcccagtcttgtctcgaactccagggctcaagttatccgcccgtctttcctcccaaagtgctgggattacagggcgtgagccaccatgcccagccccagaaatgtgattttgaatggaaatttaatttgagaataagccagaatcatgtataaacatttgagtttgtgaagtagtggatccataaatgccaaccattctttgggggtctccaaagaatattccttgcaaatgttgagtgtaccacattgtgaagaagtatgttactatgtaatgtgctttggaaacaacagggtaacgagctattaatgaaaattttcactgcccatcttactgaacactgattagaacttcattctttttaatatttttgtattctgggaatatcgttggcaattatatgaatacacagacacatacatacatttcactgtgattttttttaaatctcttctagagatttttatttgcaaaactcttcagccatattacttctgccaggaaagctaggaaatatgaaatacctcatttcagacttaagaaggtggagaatattaaaatatggttatcactgcgttcctatctaaaggtgagttttatttgattaacaatagagtatgtgcaagaatatgctcactgaagctcctggcagcagttactcagtagacagtgtagttctgggtgtcaggcagattatagcagcagctgacagacttgctggacagcaagttggatgtcatctctctgcaaagctggtaggggtaggtaaagaagagcttagaaagggaaaagaaaatctaaatttcctagggg

SEQ ID NO: 55596 - DNA, 1066 bp, Homo sapiens
aaagcatttaacatattttcctattgcttgttggtttgatttttggcaggtaaagaaaaccactacaaggtggtgtcatattgtgcgggattcagatagtctggctgaatcagaatttgaatcagcagccttcagccaggtaaagtatccctttgagaaatcaaggtatatttttgagggtaataactttatccattcctttttttattggttgccctaaagtagcatttacattaatatttgccagcccttccctgtctccaattacccatctccttatctagcagcttttaatgactacacacctagaaagaatattttcctacattgaccctaagcttaaaagtatcacagatgatgcccagcaggaggttacttaatccctaaataatgagattattaaatattcacttggcatatgaagtttatttttaaacatcataaattggattgatgctgatgaagacagatttttgagaaaggagttctgaaagatgggagtagtaaatctcatcatgagagctaaagggcatattatattatttggaaaattgtaactcagaggtgagcagagtagatggtggtggtgtggttttttcttttattttgattaataaggcaattgtggtcatggaataactttcatatttatgttggtacttttctttgactgattatcctttaacgttttggagctgaatcctgttcacgagtaggtctgtagtcaagttcacaatatttagagttggggtcactttgtgtgtgtcaaaaagctcagctaagccaattgagtgggtcatcttggtgtgcttacaggaatcactcccctcccagaacaccttagttgatcagttccataacatggcagtagcttcttagagggagtactgcttgctagagacatcagagtttaacatttaaatattaaaatctattattggctggacatggtggctcatgcctgtaatctcagcactttgagaggttgaggttgttggatagcttgagaccaggagtcggagaccagcctgggcaacaaaatgagaccacatctttacaaaaaaaa

SEQ ID NO: 55597 - DNA, 1050 bp, Homo sapiens
gaggactctggagcctgactacctgggttcaatccccatctttgctgtttgctttctgtgtagccttggaaaatactcttcctttgagcaacacagcacttcaaaatgtgttttatatacagcatctagttgtttttgtggtggaaacccttttgaaatatctaaattatcatgctgctagaaaggtaaatccttttaacacagtattcttcacttgccgagggatctagggcttcagtttttcacttggctaatgtgcatctggatgggcattgtaggaaactatttatttgtgtacttttttaaatgatggatttttatagaaacaatttgtatagtttttagaattaattttaaagaagagctctaatgttttacatcttaaaacctcttcttttcagttatagcaattgtcttatatttgatgatgcctattgtgaacataagtgaagtacttggacccttgtgccttatgctactcatgggaactgtccactgtcaaattgtgtctactcagataacaagaccatcaggaaacaatggaaatcgaagaagaaggtaagatgagaaattacactgtagttgtatattttctgggagagttattgtagagatttataaaacctttgattaatttaaaatctccctcttttgtgtttttcattattttttggcttagaaaatgaatgcattactttgcacttttctccttgatgctgagaaaaccttgttacaaacttttagttccagtttgggatttttgtcattcagtacagttgtttaaaaggaaaatttctatactatattattctttataaaatttatcatatattggcttcaaagaaaacattctctttgaaattcagtcttaatcaaaatttggtgaaaattcactgtaaacaaggatcttggtacatttggttagcgctaccaaaattttaccttttttcaaagatgtgtaataagaattgatttctaagtggtctaaactttttttttttctttttgagacagagtttcgctcttgttgcccaggctggagtgcaatgg

SEQ ID NO: 55598 - DNA, 5288 bp, Homo sapiens
aatttgattattgttatgacacattttgtttctactgttttcctttgctaattatttcacttgactaaattattacatattttaaagtctcacgtaacttttttctttcttcagtgcgtacagtgggtagatgaagctaaactaaaccaaatgaggcgggaaggcattcgttatgctagaattcagctttgcgacaatgatatctacttcatccctagaaatgtcattcatcagttcaaaacagtttcggcggtgtgcagcttagcctggcatataaggcttaaacagtaccaccctgttgtggaagccactcaaaacacagaaagcaattctaacatggactgtggtttaactggaaagcgagaattagaagttgactcccaatgtgtgaggataaaaactgaatctgaagaagcatgcacagagattcagctgttaacaactgcttcatcatctttcccacctgcatcagaacttaatctacagcaagatcagaagactcagcctattccagttttaaaagtggaaagtagactggactctgaccagcaacacaatctgcaagaacattcaaccacttctgtgtgatatgtacatattcaaacacattttttaacttttttaaattttgatgtgaagttatagttttataactggcttaagttaagttttattggagaaatcttgcctataattctataaagagaaatgacattccacaaatgtcaagcatatcttttttacacagattatgcaaagttaagagttgtatcttatcccgttagtacagtatgtaatagtgggtctgctgctactttctgttttaaggtgtgaggtaacaattcaatctcttcttcaaatcaaaatgagaattctctggaataacagattcttgtttggtaaattattcacttcccttaattttatcttgccttgtctcttgccatatttgctgtttttatggataaataagatttatggtttagtacttgtgtctttatggcacaggttcaatttctacagtgaaaatggcataggttgcaggaaagaatttctgcatctggtacatgggcaagtaagttatttagttctaaccacaaataacaagtagtttccaaggaaatttcagtggctctctggtttcttaacaaaagagaaagcacagcactttctgatccaaactgtcttttttttgtatctgttatttaaagcccagtggatatttcaattaaaaaaaaaatctaaagatgaatagtccttggtcattcattatccatggctcattaatctcttctagaatatatgctaactgttgaagatattttgggtaaaagagataatgttgacatgatactctattgttctgcttcctggcatcctcacattttgtggggataattttgcttcctaaactgatcacaactattaaacttagagaataataatagtctttctgatgaggctgccatattttgagcatcaatcttatgataaactattcttgtcacttggcatcaacctcttcatgataaatatctactactgagacacttcaattcacagttttaactggtgaatacctgggtttatttactattactctgtgttgctattttctaagaaagaatacagcactagacttcatcctagagtttcaggtaggctaatgcttagtgcctgagtatttaaattttcttttcaaacaggcacagttcacattgctagtatggtcctaactttctgttattttagaatgttaacatgattcacattatactttctcttagttaataatacagtaggccttttgtttattaatggaagagtactccccacacctaagaccagattcttatatctccctggttacagtgcaatttggagattttttttttttcctggatggtaagatttgaaatatttacattaacataggcaaaaaaaaaaaaaaatacaagatgctgctttattatgtctgtcaccatgaaaacttagctgcatcttttgaaatatcaaatatgaattttctctaaaatattctgaaataggttaaatcttatataaatattactttgtgcaatattgttgtgtagttaaatgcatattagcaaagtatagaggtcactgtgtaaaccgatagaaaagtaaccatcagcaaatactgcagtgattagttagaatctgtattattccttatatatatgtatatgtatgtattctctgttacaaaggatgaagacaaatagggatacatttcaatgtaaaccatttatgaattggaagtgatgttggctttagttatctttgtaaataaggtaattagaatggtatgaaaggtaatgtgattattgcaggggtgtttttaaatcttgggtataaattctagggtaaattccagtttatccagactagtttttaacgggacctgcctttgagggtgttttttgttattttgttggggaggggtttaatcacaaagtgtgtgggtttgggttatttcttgtttttatttttctgtccagaagagctttaccaggctgtgcaaagtaaaattcttctcaggcaacatttgcttttaaaaataatcatgaagagaaggctgttaaagcaaaaattttttttttttaattttttcttgtcttccaagatccgatttccccatctcccacttgccatccagcagatgccatctgtcatccaagctggtcattgctaataaacaaggagactgtctcctgacagccagcactgtgtattatcactcaggaaccagcggatctgcaaagacctacaatcaaaagcaaatccccattttccttttataaaacattctaccctcacctccaatataaacacattaaaagagtacaataaaaatgtttaaaatcatgtactaataaattcattgtatgttagaattgcaatagaatgaagagaaacatttagctagtaacgtgatctgaaaactgaatgtcctatgtgagtattagattttaatagcatgctttaaagactgatgagtataaaagcagaagttttgcgttttttactgctttcaaagctgtatcctagtttagtgatacaaatgattgcaatttttctaaatcattaaattatttggtttggtggagtgaggcatggagcaatctggcgtcttctgatttgttaaagtagtgatggcagtgaagttgtaactgaaatttaagctgatcttcctttttggtatattatccgttgtgccagctcttgagattacttgcacaatgtggctataagttttaatattttgtggagcagagggatggtttttaaatgtgcttatggaaaggacccaataaatgaatattcctaacttagtaaagtagaataatttcatggtattcattaaaaagcataaaagtcttcctcttgccccagaagtaattctctataccaagatatgctaggagtaggatgatgattcaaagtggtaacccaaattcataaagcaataataataaaaacctatatagtatgttctctcctccaaagttttaactctaaaaattggttcctaggtttaattgtacctttaatttgcttattcagtacttagaatttgtttaactggtacttttattattttttagtgaaagacttttgaaaagtgccctttccccttaagagacagttggaataccagttgactaatattacaagctcttgtagggggaaaaaggagcttattaaagttgtttactaaactttaggaaaagatgtcttgcatcagtcttactaggcataaaagtcacacttaatgactggaaaaaacttgcttattgcctttccctatataaatattaattgtctagaatgaaagctaatataggaacaagactcccaaatccatgaaaacgcttagtgaatatattcttaatcattaataaattagcccattatattttcatctgtatttgccataaaaaatttatttgcatttatgcctttaggataattttgtatctttctaatctgttttatcattgctacaggtttttaaaaaagaacctttcactagctagcacatgccagaggttcacatctgttttgtttttcaaacaggtcgtagctgtatttattggccatgcaagtagaggaaatgcacagtacaaatgtttttctttagcacgtaagggacctatccttgtcttgaaagtttgttgctttaaaagcaagtatctctccataaatattatggccttccattttcttcatacattttttaggatccacttgtgcatgtagttgagaccactgtctcttaaaatatagcacttttcaattctctctaaagaaatacttatgtactactatcacatgttgtaaattttcatgtaatagtgttttctgtgagtaaactccattttgattggcagctaagactttttttcctgtggcttttatttatctaagaggtctttgcatatagatgaaatgtatatttgcctggcggactatttgcgttgtgtggccttagtttgtttattgacattaacgagtgttttaaaaaggtttttaatgaatagtcttaaatctaaatttgtgtgaataatccttttaacacagtgcttttttgtagctgtctaagtgtgttaaattgttaagctatttctttgtaaaataggacaatggaatgcatagtttttttttttcctgtaaagtatttttttaataaaaaaagtctgatttgtcctttactggtgtttcatcacaaaatgcatagcatatgtgagttctaaatacctggaacctgtttttagaggacgaatccctcacctactgtatcccctactacttcaaaaaaaatttttagaaaatcttatgacttctttcctaaagatgtctggggaaaattccatccatattgagatgcaattagtttgggggaagaagaaaaaatacacttgacatttgttgtagttaatgcctcttaattgcttaaattggtgtgtatctacttaaaagaggacagtcttaaatttttattctggtgatgtggattttcttgaaagtgcattgagtattaatgaagatggcgtatagacttttatgtcattgatgtattaatgtgacacaacaaaatggatttctttcctcatcagtttttgtgtgaagttatctttaattgaggtacctgtcctaagcactgatagcctttggttctgtctaggaaaggaaaagaaagggacttcacattttttgagtaactgccatgggccaggcagtttatatgagggtttctcatttaa

SEQ ID NO: 55599 - DNA, 1074 bp, Homo sapiens
taaagccaacatcacttccaattcataaatggtttacattgaaatgtatccctatttgtcttcatcctttgtaacagagaatacatacatatacatatatataaggaataatacagattctaactaatcactgcagtatttgctgatggttacttttctatcggtttacacagtgacctctatactttgctaatatgcatttaactacacaacaatattgcacaaagtaatatttatataagatttaacctatttcagaatattttagagaaaattcatatttgatatttcaaaagatgcagctaagttttcatggtgacagacataataaagcagcatcttgtatttttttttttttttgcctatgttaatgtaaatatttcaaatcttaccatccaggaaaaaaaaaaaatctccaaattgcactgtaaccagggagatataagaatctggtcttaggtgtggggagtactcttccattaataaacaaaaggcctactgtattattaactaagagaaagtataatgtgaatcatgttaacattctaaaataacagaaagttaggaccatactagcaatgtgaactgtgcctgtttgaaaagaaaatttaaatactcaggcactaagcattagcctacctgaaactctaggatgaagtctagtgctgtattctttcttagaaaatagcaacacagagtaatagtaaataaacccaggtattcaccagttaaaactgtgaattgaagtgtctcagtagtagatatttatcatgaagaggttgatgccaagtgacaagaatagtttatcataagattgatgctcaaaatatggcagcctcatcagaaagactattattattctctaagtttaatagttgtgatcagtttaggaagcaaaattatccccacaaaatgtgaggatgccaggaagcagaacaatagagtatcatgtcaacattatctcttttacccaaaatatcttcaacagttagcatatattctagaagagattaatgagccatggataatgaatgaccaaggactattcatctttagattttttttttaattgaa

SEQ ID NO: 55600 - DNA, 1007 bp, Homo sapiens
ttttggcttttgtgaataatgctggtgtgaacatgggtgtataaatatctcttcatgtccctgcattcaattattttggctatacacccaggagtgaagttgctggattatatggtagttctatttgtaatgttttgagaaactaccagactgttgtccacagtggctaaaccattttatattctgttggggcccagttttaacaaagctcaggacatggagatacaaagtggcgagaggactgcaaatgcaactagtttagaataaaactattctttttagccatttttgttttaattttacaacagcaaatctgatttttatggctttttaagctttagtttttttcaaattaaaaaaaaattgtatacctagtccttagaaactatgcatctatttctctgctggtagaagcatttccaagaacaaaagaactgaaatttgtcatcatttttcattgtgagatgtttgtctctgaaacttaattttgttaatcttaggagtgaccaacctcgcataaccaaagatgtgatttgttttcatgctgaggattttactgatgttgtacaaagacttcagttagatcttcatgaacctccagtttcccaggtaataacttatgttttatcaccatttgcgatattagaagtaaatatctatacccattttattttgaattttatcttacagtctgatatgtgggatagtgagtttaattttattactgttaaagactggggtgggggtggtgctgaaaatcatttaaacagagcttccctagcagaatgcttgaaatcctttcaatctttgggataccaggtgggcctgggatggttagaggtcccaggcggctcagttatggccatgagctgtctcacttgttaaccccattgcactgtgtcccctcaactgcaaaaggctgaaagacacactaaaagaaaagaaaacatgttgcctttatgtgtggtaaagaatattgatacttagctgtactttgaaatacttaa

SEQ ID NO: 55601 - DNA, 1129 bp, Homo sapiens
tctagtgttacctgacttttagttataagaaagtgggtctaagtgcagcctgattaatgcttaattatagctatatttccatccagagttttgttaactgtgtgagggcagcctcactagtagcatattttgagagttggaaataagatgaatgagggtaaagaagccttaaactttgacttttattttctgttgctagaacagaagcactacatttgagcctaatctaagatatattttcagctttattatggcacacagggagaggaaggtaattacattaagcattataatatagtgtgttaaatgctaatgatcataatcattgaacccttctcagtcctcatcttatttaaatctggtattttagcagacttttttgccttactgctattaattaatttttttttggtctctttcttccttgcttaccctttgtttaacaaccaaatcaactctagatcaatgaatgaaataaaaaatctccagtacctacctcggaccagtgaaccccgcgaagttctctttgaagataggactagagctcatgctgatcatgtcggtcaggggtttgactggcagagtacggctgctgttggagttttgaaagctgtacaatttggtgaatggtgagttaattgaactcaactgcaaggttggttaatattgtataagacaatgtggactctatttaaaaggtttaggaccagttttttaaattgtggtaaaatacacataaagtttgccatcttaaccatttttaaatgtacatttggtagagttaagcatctttacattgttacgaaacagagctccagaaccttttcatcttgcgaggctgtaactctatactcactgaacaacaattcctcttttactctcacccccaggctctggtaaccatcattctactttgtttctatgaatttgactactttacatatttcatatagatggaatcatatagtgtttatctttttgtgactggcttatttctcttagcattgtcctcaggattcatccgtgttgtagcaagggtcagaatctccttccctttttaggctgaataataattcattgtatgtatataccacatgttgttaatcagtttatccatcagtggacactt

SEQ ID NO: 55602 - DNA, 1001 bp, Homo sapiens
accacaatttaaaaaactggtcctaaaccttttaaatagagtccacattgtcttatacaatattaaccaaccttgcagttgagttcaattaactcaccattcaccaaattgtacagctttcaaaactccaacagcagccgtactctgccagtcaaacccctgaccgacatgatcagcatgagctctagtcctatcttcaaagagaacttcgcggggttcactggtccgaggtaggtactggagattttttatttcattcattgatctagagttgatttggttgttaaacaaagggtaagcaaggaagaaagagaccaaaaaaaaattaattaatagcagtaaggcaaaaaagtctgctaaaataccagatttaaataagatgaggactgagaagggttcaatgattatgatcattagcatttaacacactatattataatgcttaatgtaattaccttcctctccctgtgtgccataataaagctgaaaatatatcttagattaggctcaaatgtagtgcttctgttctagcaacagaaaataaaagtcaaagtttaaggcttctttaccctcattcatcttatttccaactctcaaaatatgctactagtgaggctgccctcacacagttaacaaaactctggatggaaatatagctataattaagcattaatcaggctgcacttagacccactttcttataactaaaagtcaggtaacactagatactgaccatttgcatccctgttgttcctacagatagaatttcttggaagtgggaaaacctttttgtgaaaaaaaaaatatatatatatatactttttttaaaaaagaattctagtgttagcatcataaggcttttgtttaagatagaatctctgatgttaagaatggcttaagcagatcctgaattctggcaaaacagctgctgccaaccaatttaaagacccccacagaaaaacctaatcagcatgataatagtttattcatccctttgtcca

SEQ ID NO: 55603 - DNA, 2103 bp, Homo sapiens
tttcacaatatgtcttgagtctttcattcttattttttaattatactttttgttgtttagtagtcaccttaaattgaaagattcatgtctcctttcctttctgataatttttcttacttaattggtttggtaatttcttcttcattttctcttatttctttctgaaactactattggttgaataatagagctcctggtttgatggtcctcatatttcctattatctttttgcttttgattcggagacatttactggacttttgtcttctaacctttctttggtgttttaaaattttagcattgttcattttggtttttctctgtcaggctgctatcttcagaagctggtgattctcggttgacccattcatatgttaaaataaagcattgggtctattgtgagttctatttatattttggtgagtcttgtcaacaggtagacaattgtcagttgtcaacttagagtgaacaggcatagaaatggacactaaatgatgtgcccaaatttcagaggattatgttctatttttgtggcaatttccatgtgtttagagaatgtgcagtttttctggctgaaagtttatcaggatgtttttggctataagcaacaaaaattttggttcaaacttgtttataaaataaaatgtctgtcttgtatatcgagaagtccagagaggttggttctaggcaccatatggtcagtgtgtcagtgctgttatcaagggaccagattctttccttttctctgttctaacattctcttggcttaggctatttacttacactagctccctttatagttgctagatggctgaggcagttctagacatcacatcttgatttggctatatctaatagaagaagatagtatcttttcttgtacttctttcttaggagctaggaaacttcccagaagtctcttcagcatatttcctttcatactattagacagaatcagttcatgtctattcctaaatcagtcactgtcaggggaaatgagcttaccataatttaccagtactcatcagaaattaactctggagcttgtgaatgaggtcacatacagggcagaatgagatgcctaataaaaattagggttctgtcagggaattaaaggggaggaatggatgctgggtgggtagccatagtctactccatgtggggctaaatgtctgtctacatttctacctgcagggatgacttgtttatttgcagaatttcactttaattccccttttctcagcctcacttcatttctgttcatcattattatgcctggcttctttttggactcaggcttttccaaggtctgttgggcaggtctgctgcctttttggctgctgatcccttcttgtgtattctatgcctgtggctttctctgcacagttttattagtctcaggtactaggatcattttccatcttgcaaaagtttgttgatattgctcattcattaattcatttcctttgttgcttcttattcactatcatctttagattattatatttagaaattcttgagcacataaaaaagcagaaaacaatataataaactgctgtgtgtttaatatacaatcaacagctgtcaactcatggctaattctgtttcatctgtactctaatccattctcccatctaatccccacttcccctattattggtttgaagacttttactttcattttaatgtagaaggagataacatggatgcctggtttgcaatcttgaatcagaactctagtttaactataatagggtcattgcctgatgcacatggcaagtcagtacaccaaaacagcagactgcaacagagaaagtttaattgtagggccactaaaggaggagatgggaggaaatctcaaatctgtctccctgaggagtttgggggtgagggtttttaaaggttttggaatgggctgatgtgtggagatgtttattggtccgagagtacaaagtgaagtcatggacaaagggatgaataaactattatcatgctgattaggtttttctgtgggggtctttaaattggttggcagcagctgttttgccagaattcaggatctgcttaagccattcttaacatcagagattctatcttaaacaa

SEQ ID NO: 55604 - DNA, 1039 bp, Homo sapiens
gctatgcttctatcatcacatcgccttctcaaatatctctttgcctcagtctttaaaagacacgtgttattacatttaagcccacctggataatccaggagactctccccatctcaggatccttaatttattcacatctgcagagtccattttgccataaggtaacattcacagattctggggattaggttctaggggttaggttctttggaagccgtttttcaacctatcacatacttctggctcatcatgtccaaaacagtgaaacctgatcctcctccagaagagagagtagttgctctttcaggttccaaagtacagaacctggtagtcatctttcatacttctttctcttatctatcatatccaatctttgtccacatcttgacaattttatctcctgtataattttcagatctctttgtttttcttttaaaaagaagtccctatttaaaatcaagttattagcttagcctaacatttcttatttggcatattatagaatactcctagctgatctctttactttttgtgcccctctgagaaaactaaacaaacaaaaaaccaaaggcaaattgggtaactttccttcttttcagatcctttagtggctttccagaatccttgatgtgatcttctaggctctccataatccagctacagctgatttttccagtctcatctttatttttctcttttgctttctgtgtttattatcattagctttcttttagatcttggaaagggcaatgcttaagagattttgtttccctctgaacttgttcttcagatttgagctcaatgttacttcaaggaatactttattccccggatcaggatcccatgttctttttcatagtgtcatacatcttacattctgaagatcaaagtttataattaaatgtttatttagattagtgtctgcctctccttactagactgtaagcttcaagtggccaggaataggtctggtttgctatacctgtgttgagtacagtggcataaaatatatgtttatgtgctatgtagtgacgtttca

SEQ ID NO: 55605 - DNA, 1824 bp, Homo sapiens
ttcacaaggcacaaggttaggaagatcgctggctaattttttcctttctgtgttttaaaaagtcagcttgaataggcttcttcctgaaacgtgagttctgtggaataatccacacccgctctcaacccccatacacagggttttccacatagtgcttttttagcttggtgttctcctgagttattaacagatttataattgtcctttgtagaagctctatgtattggggacacagttgagcttacttaattcagaaattcatacaggataactgtgaagttgagtttctaatttaaacactacatatgtattgacagcagtatatatattcaaagataattgtttaacattttatagatattataaagagaataaattttatgcaaaactattattttttttaataggcatatttctctttgatgccacatccttctcccctccccactttgccttctgattttaccaaagactgtgtttttcctgttggcgttatgtctcctgcttccatggcagctttagttttttctgttctttggtctcgtacttacctccctccagtcctcccaattctgtttgttcctccactgtgctccagtacataaactccggaaagctgtagaattcaacttgttctttgttttcagttgctatttccaggccagagtttcccaaacttgccagatcctaagaataatttggggttgctagttcaaatatacattagactctcaggttcctcttctggaaattttggttcatgaggtctggagtgaggcatgaaataagtaccttgaccgacttgattcctatgatcaggcaagtttaagaaacactgttttaaaccatataccatctaccattactctagttcctttcatttgacctgtagatagcatctttttagaatttcagagcatcataaactaagagataatcttatctgacctctacaaagtgcaaattttaaaaaatcatgttttgattggccatcactggggactttgtctcttcatgacattttataatgcttcccattgggttgtcaacattgcctgggaagcctacttcttttctttgtttagcttgtttacctgttcttcataaatactatttaaactttatctgtatacatcttttcctcattctctcctgttacagtagagaagatattctatctcctcctcaaaggctaatttgtcaggctaatttgtctacttgtgttatgaataccatcccttagcctgctaaggtttttaaaaaactgttgtcaaatatacacaaaatttaccattttaaccattttaaagtgtataattctgtggcattgggtatatatattgttctattaccactaccgtttccagaactttttcctcataccaaacagaaactctatacccattaggttaggatctttgatgtcagttacccgctactacccctccaacctttcccttctccattcccactccccacgtaactaaaagtataaaatatattaagcgaatttctgcttcgtgtctttcccccgctttttttttctctaaataaacttttcctttctccctagaagtaaatctttattctgaatttgtggcttatcatgtcgttttatcttttaacattttactaataccaaatgaacataaaaacaatacttgtacctttgtattttaaaactacagtgtattgtgtgtatcattctgcaggttatttttgttcaacattgtttttgaagattattttgatacatctaactctacattaattttaaccattatatttggtattttgttgggcagctgtatcactgtttttgaa

SEQ ID NO: 55606 - DNA, 1080 bp, Homo sapiens
tgatgagctcagtttgagatattttgagttgaaggtacctgtgggaatttacggttagaaataactgttaggaggctgggcatggtgtctcacatctgtaatcccagcagtttggaggctgaggtgaacagattgcttgagatcaggaattttgagaccagcctggtcaaagtggtgaaaccccatgtctactaaaaattcaaaaattagctgacatggtggcgggcgcctgtaatcccagctgcttgggatgctggcttgaacctgggaggtggagtttgcactgagccaagatcacgtcactcactccagcctgggcgacagagcaagtctcaataaagaaaaaaagaaaaaaaaaaaaagaactcttaggaattgaatgtatggatccaagtttgagagatgtgtctaggttggagatgcagaagttgaacccattaatgcaggagatgcggagatgcagaagatggaaccagcaatagcagtggaaaagagatgaaactaagggtggaatcttgtgatgcatccacaagtaagtatgatgaacatgggaaaagaccaaaaagaaaggcaggcagaagaaagactagaagttttctgcattttaagaatgaagtgtttattttatccatatgaaggatccagtaagtaaggatgggaaagtggtaggtttatcaattaggaattgaattggagacatgatcaagattagtgctttgcaaaccgtggacaggtaaatactattgtaaattatgccttttctttagaaccttgctactaaaagtttgctctatgtatgaatttggcaccaccagggagcttgctaggagtgtagactgggctcttacccagattttctgaatcagaatctgcatttttaaaaggtgattcatatgcacattaaactttgagaagctttagaactcagctcctctaagcaggagaaagtaaaatgtagattttgtgcaagaaaaatgaaaacttctgttatttttatatttttaaattattgtggtggctaaagctaggatccacatatagggttttcttttaacattctagaaaactcaaatgttctaa

SEQ ID NO: 55607 - DNA, 1906 bp, Homo sapiens
cctgtttatatgccaggtttttggagtttttatatctctttcagtaacttgttggcagtccatcccagaaatataccccatttatgtgacttggaagtgtcattaggaagaccgccatagcctctgctccttctgcctatacattgttgtaggtgaagacattttttgaagccttgcatgggcagctaggcttaagtcagcagggaaacgtctgcttcttaaccagtggttttaaccaaacatttttttcagtgaagttattttagggaataagaagttaataatgtgtcctagtttttttcttacttgcttttctcgtaagaattgaatataaatggtcagctataagtttctgcagtatatattataaattcaactttagtggagactttcactttttaaacttttatgattatatgttctgttttttcaggttgtctagtaatttgctgccattcttttcccttaatatatatatatttttttaggtaaatagattgttgccgtaataagactctcagctgcctgaattatagtggtttcaagccacttagatttatttgaaacctcctctaacttgaatctttttagtgagtcttaccatctttgcctccaatgaggggagtatccagtttagatttatgagcttcagaatttctctaattgaagttctctctgcagtagagagagcaggagcagccaatgtggagaggtcgcaagatggggctgcccaagatgttggaacaccatgtgcaataaagggcttcgtcttggattttggccttattaccacaaccaggtaccgaagtgctgacttttgtagtagattttcttttttcattttcattttttttttaagttttgccctttgaaggtcaaggaatcctatttttataaatattgcagatgagactgaaaacatttctcctaatatagtccataatccccataagttccctatttaacaaggaaagatattgctgagagcagaatcaacatgctctatcatttttttagtttagaaaaatgcagcaaattttctcttttgatagaccaacaagcatttctgagaaataagccagaaatttgggggaaaactgtcccagttttgtaagggtgtctttttaacattcatattagttaaagtggatcaaatttgtatgtcaacagacagtatccagtctaaatagttaataaaagaaaatatcttgaaatattccctgctgatttttgtcctccaattaattttttaaaatggagctgaaatttaaatgactgtaccaacaacttaccttgatacttactttgagatttaaaaaataaccactttttaagaacatttcagattatgattaaattagatattaaacgcttcaaccacataagaatattgaggactgttgaatgagtcctgtgctctggtggtcctggaacttaattttatttatgaattttcagtcattagagaagagtatggtgtggatatgggaggttggattagccgactaaactttgaagtttgcaactttagcagatgttgggatagaagttaacacagtagttcaaattgatttcgcacttcatggtttatagaaatgctttcacattcatatctgaatatttgaaacaacctagtgggtaggtaggtaagcaattttatctgtgtttcccatggaagaaactgaggctgggagatgttcattgtttgttatccaaggtcatatagctagtaagtagaagagtccagatgcaaacccaggccacctgaacaatgttcacatcattttaccatggagaagagattagtgcttttatttgtctaacactctggtcagtgaaattaaagtatctccgtgtgaaacagcatgcaaaaggctttgtttctaatatttttaacaaatccctt

SEQ ID NO: 55608 - DNA, 1031 bp, Homo sapiens
atttttatcatgttgatttatgagattacaatgtaagattcttttctttatacagtggttttctctttttttgttttttttgttgtttttttttgagatgggccatgttggactaattgaatggttttcatataagtgaattttgtgaaactcgtataagtgaaacccacagagacttgaccaagttagaaataccactggaaagttgatagtaatacagaaaatgtgttacaatcaacgcagttctttcttggtgctaatttcagtggcagatctaggtcacaattcattttctgcataccaaatacctcttccgaagcttaaaataacaagatctatttggagatattttcttttcttgttttcctgtgaaattgctaaaacattaatagaagagagtaattagatgactatttttaaattggtctaacctttatattgaatggcattaacatttagttgcttgggagaattgcctaaattactgatttgatattggggaaagtatttagatgaattttatttggtaagaagtatacttcttaccaaataaatgactattactaagtgtttaattctcaaatatctcaaatatttagttgtatatagaataaaagatgactttttctcttgccaggttaacagtattctgattaaatgtaaattttgctatcttattacagtttaattacaagtgatatttgcaaataaacggttttcattttattgttcttagaaggaaatattatttggcattagtaaagtctttgacttgcttttttaagtattttctttagaaggtttcgtaacccttgtagtagctaattgacttgaagtgattttatatggagtattggaactgtcatatatttacatattgtaccaagtaaattcttaactctaaaatttgttgaacttgtttttctagatgtaaaaataggattaattggaatatttgtcttaactccaaattacttcaattatgttagaaaaaacgattgtttggtgggtaaattctatgcagtaaatac

SEQ ID NO: 55609 - DNA, 1119 bp, Homo sapiens
ttactcttgaccagttgcctaactgctatcaccgagtgtaagtgttcctgagccagatgtttaatggaaattttctctcatgtcaaaaagcagggattttaagtccagaaacacttctttttgatgttagcaatggagaattattgggattataagggaattgaaataaacaatcttatttatcagaacaacaactgtagggactaatatttttccctgctcaccctgagagaggcaaaaacacctttaagggcacgaaaacttttgaaatggcactaagtaagatatttgttgaagtaatactccctttattccaagctacctcaggtccattaattgtaaccagataatcttagttgatcatctaatgggagtgttgcagggagatgtctgatagtggaggcggaaaggaagagagtgtagggtgcagtatgttagaagaatttgttttggagtcagataggtgagaagtttgaatcttggctgttgtgtactagctttgtgacctaatataaattacatatcttgtttcaggctgtttctttctccgtacttcattggtttgaggattaaaataaaataacatatatggtccctattagacatttggcaaatacgttttctttcctctttcagagatctttcttatgtgtttctcttgataatcaagatgataagagacttattgtgtgtcacatattgtgatgagggccttatagtcattgtctcatttaattcttaaaataactctgtgagatagactctagaattaataacttttttttttttctgagacggggttgcccaggctggagtgtagtgaagtgattatagctcactgtaacctcgaactcctgggctcaagcgatcctcccacctcagcctgtagctaagcctagctcactcctgcagctaggactacaggcatgcaccgccaagcccagctaactttttttttttttttttttttgtaaaaatggggtcctgctgtgttgctcaggctggtcttgaattcctggactctagcagtcttcctgcctcagtctcccaaagtgctgggattacaggcatgaggcactgtacctggcctattataacattttaagatgagaaaattta

SEQ ID NO: 55610 - DNA, 1026 bp, Homo sapiens
gcctcccacaagtgctgggattacaggcatgagccactgtgcctggcctaacaatggtttttacaatttaaaatagttggaacgaccttgtagcgcatggaaatcatacgaaatttaaactgtgtccagaaataaagctttattggaatatagctctgttcattcatatatattgtctatggtagtttttgcactacagtagcagaatacagtaattgagacagagaccataagacctgcaaagcctgctgttcggctctttagagaagtttgccacccttgagttcacttaagagacatgttccttcctgcacagcagttcaacagtatttaatctgaattcatgtggagactaattacaaattattacaatctcagacatttggagttgttcataaacagttgaaacaaaaatttaatctgtaaatgctagggtaaacttgttcatctttaaaacagaaagaagtgattttcagagagatgaagtgaaatgcttaaaattttttagttggtgatagagctgaatacagaactcaatttttttccctcatggcccagttgacctctctttctgctatgcacactggggttgattatttaacagagatatttaaatgctgtttttatttcttatagggaataagcttgagtgtaactaaactggaggttacctatgtgttttgaaatcttaatttttttctctccctcttattgctcataaaaacataggacaggccgggcgcggtggctcatgcctgtattcccagaccaaggtgggcaaatcacgaggtcgggagtttgacaccagcctagtcaacatggtgaaaccctgtctctacgaaaaatacaaaaaattagctgggctacttgggaggctgaggcaggagaatcacttgaacctggaaggcggaggttgcactgagctgagattgcgccacttgcattccagcctggtcgacagagtcagactccgtttcaaaaaaaaaaataggacaaacatacttccttaaaaatccatgaaaagaa

SEQ ID NO: 55611 - DNA, 1681 bp, Homo sapiens
agttgcatttgattctgtctagcacactttgtggatctgttaattccaatagccctcaagaatattttactagaaaatgtcagagtatccaattaaatgtggattctagaaaaattagattggccagaactgatgtcttcctgttcccaagtacctgtagcatttatttatattctttgtggaagaaatgtgatgcttttgattatgccgtatgtttgtactttatatattattttatataatttactagttgtttttcctcaggaatatttgaaatacttgtttcttagtactggaccagttaggttattacatgttaatgagacaatctttcaacctaaagttttgtgagtcttgcattctttccacgtattgagtcttaaggctaatcattttttttggtggtgctatttccgaatactgtagttcgttgcaaataattgctcaataagtatttattgaatagcattaaatttttattcatttggtggcatccaaatcttgggagtagaacttgtggcaagatgacaggactgccagttttcaccaccaatatgcaatgatcttgctctctttttatttttacttttattccctactttctcatttcttgtgtgtgtgtgtgtgtgtgtgtgtgtgtgttttaactgtacagaactagagggaattagtgatcctctggcttaaatttgtattgtagaaaaggaaactgaggcccaaagtagtaaagaggcctgttcaatcaaatcacagttaattcgcatgaagtgcaaaaaaattaaatattttttaaaaaggtgaatattggcataacaggcagtagaacccaggctcctgaatcctgcttcaagcttcatctccaggcttcatgatgttgctttctcttcctgctattcattttttccactcctttgtttaccttttccctgtgctttgacattacagtggctttatatcatcgaggatctctgacctggccccgttttatgggggatagtggcaataacatgtgtaataatttacaatctttctctgaagattgcacaggccccatgttctttaaaaaacacacttctgacctaatgctgactgatagaactttctcagatgatggaaattttctgtatttgtgctgaccaatatggtagccgtatgtggttcctgaacagacttgaaatgtggcatgattgaggaactgaaattttgattttatttaattctaattaatttataattagtcacatatggctagtggctaccacactggacaacaccactctaaatatctgtagtttgccaacatgtgaagaagagaagtgggttaagataagcccatttaaacattttaacttttggctgagagattgttggattatatacccaaactatattttgggtgaaaaagaattttttggtcaaatacatttgagaaaaactgtgtactgtagccttctacatatgtaacatgaattggcaaactggcattttaaaagttttgaaaaccctacagaaaataaactggtttaactttgtttaatccaggcttttgcacatagtttgactgatatcttttttgtcctctgaacatctttattgttacagtggtatgcaggaggcatgcctctggtattaatctgagtttaaatcatggctctaacacttactgtgtgagcctgaacaa

SEQ ID NO: 55612 - DNA, 1063 bp, Homo sapiens
cgggggcgcggcggaactacagctcccatgacgctttgcgcggcatagggtgctttacaatagaagctcggttggagaggcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaaggagaaacctcatgctggggtctccccgcggggagttaaacggcagcgccgatctagcagtggggggtctcaggagaagcgggggcggccgagccaggagccccctctcgctccccctcaccggcggcgtcgcagccgccaacatcctgggccgctgccgccaacgaatgcagccccaactgtcccaggccctgttgagcctcttctcctgccgcctccgccgccaccttcgctggcacccgccgggcccgctgtcgctgcccctctcccggccccaagcacctcggccctcttcaccttctcgcctctgacggtgagcgcggccgggcccaagcataagggccacaaggagcggcacaagcaccatcaccaccgcggccccgatggtgatcccagctcctgcggaaccgatctcaagcacaaggacaagcaggaaaacggcgagaggactggaggggtgcctctgatcaaagcccccaagagaggtgagagcaggcaaactgcccggcttgggttctaggtctctctcagttccgatatcccgcatctttaggactgaaagacgccaaacccctgcttaccttctgctgctgtacttctctaagctcactggggtggaccctggatttcagatcgttgacacggtttgatctaactacttgaggcttctcgctccgaggccgagctgtcagttgctaatccctttaccggtcccccggagcctctcagc

SEQ ID NO: 55613 - DNA, 1065 bp, Homo sapiens
gaaagtagagtatcttagcactaaacctcagactgttgcctgaatttgaagcatttgtgagcaagaaagaggttcgtcactggttatttcagccatttgtccaaaaataaaagtcacattgtgtacatttgggaatttggataaaaaacttagctcctacagattaagaacatctttcacacaagttttctgtctcttttaggacccttgattcctgaagagaacaaggagagggtacaagaactccctgattctggagccctcatgctagtccccaatcgccagcttactgctgattattttgagaaaacttggcttagccttaaagttgctcatcagcaagtgttgccttggcggggagaattccatcctgacaccctccagatggctcttcaagtagtgaacatccagaccatcgcaatgagtagggctgggtctcggccatggaaagcatacctcagtgctcaggatgatactggctgtctgttcttaacagaactgctattggagcctggaaactcagaaatgcagatctctgtgaaacaaaatgaagcaagaacggagacgctgaatagttttatttctgtattagaaactgtgattggaacaattgaagaaataaaatcataacagagtcttgttgcttgtctagagtaagatgaataactattacactttcttagtctttcctattagagctgccagtaagtccagataatatcagatacaaaggagagtggaaaatctagaaatcaggattcttaagtttttggccaaagaacattgattcattcctttcattcctattggcaattgaccccatttttcagtgatgatgttgtagaggttaatgttggtaaggagatgcgttgaggatgggatttggattatttcctaatcaattttaggaattgtgttagtaattaaagatggctgatgtgtggaaactgataggggtcatcatttgtgggggtcatcttttcttccctggattattatagtaaattcctaactgttctcatatttccaatcatgcttttaggccagattccaaagtccttaatg

SEQ ID NO: 55614 - DNA, 1046 bp, Homo sapiens
aatcggctactttggcctgtctcctccctgcagcgcgcgctttgagtgcccggctcggcctccgctcccgcgcggttgggagtgtccagcgccctccgcgatttgggctccagcgggcagggtgacttcctttttctgcccactctggtaacttattgctctgctgggctctttcccttagggtctctggccctgttcttgccccagcatgacttttatcgggacgccgttgtggaagcctcacgcaggagccctgcccccgtggagaagatcccactggtgactccaaccctaccaccatgaatggggtcctgatcccccatacgcccatcgcagtggacttctggagcctgcgccgggctggcaccgcacgtctcttcttcttgtctcacatgcactcggaccacaccgtgggcctgtctagcacctgggcccggcccctctactgctccccaattacagcccacctcttgcatcgtcacctacaggtatggggctggagtcggtctccgagagctggtccaggcatctgggttgggacttcaacctgtcattcttggagtcatagaatgggggccacgaaaactgatttggaagttgtttgaacccaaaaatgcatctttaacccagaataggaacgtgttttcgaagtgaccaacttgagatagttagccataagttgaggagatattttaatccagccaaggaaactattcctacctttataagtaagctaggccgatgtttcccaaacttgccttttttttttttttttttttttttttttgagacggagtctcgctctgttgcccaggctggagtgcagtggcgcaatctcggctcactgcagcctccgcctcccgggttcaagcgattctcctgtctcggcctcctgagtagctgagattacaggcgcacgccaccacgcccagctaattttttgtattttttgtggagacggggtttcaccatgttggccaggctgttctctaactcctgaccttaagtgatccgcccgcctcagcctccccaagtgctgggattac

SEQ ID NO: 55615 - DNA, 1002 bp, Homo sapiens
tcagcctcccaagtagctgggatgacaggcgcctgccaccacgcccagctaattttcgtatttactattagtagagacggggtttcaccatgttggccaggctggtctcgaactcctgacctcaggtgatccacctggctcggccccccaaagtgctgggattacaggtgtgagccactgcgcctggccgatttcccactctttaagggtccgaaccttgtgaagagtaattgaaaaataggagtaggatggagacattacaacaaagaaaccatgcagctatactgcctagttcagtgccaggctacataatagttttttcacagactagtaagcaaacgcctgtctattgttggaggtaggagaggcttgtcttctattcttttgtctctgaccttctgcccccatgtacatattcctccaggtgattttcgatacacaccatccatgctaaaggagccagccctgacactggggaaacagatccatactttatacctagacaacaccaattgcaatccagccctggttcttccttcccgacaagaagctgcccaccagattgtccagctcattcgaaaacacccacaacataacataaagattggtgagttgtttcctttcagtttcctgtcacctgtagatagtgaactagattctttaaggattctcacatctttcagatctttgtgcagttctcactttctcctacactgaccaccttatttaaaattgcaacctggctaggtgtggtggttcatgcctataatcccagcactttgggaggccaagatgggagggtcatttgagcccaggcgtttgagaccagcttgggcaacatggcaagaccctgtctctacaaaaaatttaaaaatcagttgggcacgatggtgcgtgcctgtggtcccagctacacaggggactgagacaggaggattgcctgggtccagtaggaggtcaaggttgcagtgagccatgtaagtgccattgcactccagcctg

SEQ ID NO: 55616 - DNA, 1008 bp, Homo sapiens
gatttagcctaacgttccctaactccatcacctgttagatacaatactgtatactttttttgtttttttttaagagacagggtctcactctgttgcccaggctggagggtagtggcatgatcacagctcactgcagcctggacctcccggactcaagtgatcctcccgcgtcagcttcctgtgtaccaggaactataggcgtgcaccaacatgcttatttgtttatttttgtagagacagggtcttgccaggttgcccaggttggtcttgaactcctgggctcaagcaatcctcctgcctcagcctcctaaaattgtaggcttacaggtgtgagccacagtgcccggcctgtacacatatctttaacgttgctcttaattgtggtttttctgggtctccttgtagatagtacttcttgaggactgacagttttctttattagttttcatggtgcctgaaacttgctagatgctctcttttgttgaactaaatgaatgagtggattctgtgtcattccctttcatatgtcttagctcaaatgccacctcttccttgatattctccctggatttctccatgaattgtatctatttttgttaaacattttgttgatttattaggattttccaatagcttaattttcttccttctcttactttccccaatacattgaacattatttaggactctacagcctgggaaaggaatcactgctggagcagctggccctggagtttcagacctgggtggtattgagtcctcggcgcctggagttggtacagctactgggcctggcagatgtgttcacagtggaggagaaggctggccgcatccatgcagtagaccatatggagatctgccattccaacatgctgcgttggaaccagacccaccctacgattgctatccttcccacaagccgaaaaatccacagctcccaccctgatatccacgtcatcccttactctgaccattcctcttactccgagcttcgtgcctttgtcgcag

SEQ ID NO: 55617 - DNA, 1044 bp, Homo sapiens
cctcctcacggcagccccagctcgcggctgagaaccagacacaccggcggtgagtggggacgggcaggaggggtcctcggcggggagcgacttcccctcagctccctgaggcggggccgggccggccgccggctctcctggagcgcccagcctgccgggggcgccttcctcaaagggcccctgcctgggaccgggcgccgcgtcttgcggcccggccgctcactgccgctgaggggattgccttcccaggaaggtggggaggctccgggctggttttcggggcaactccccctgcctcctgccacttctcgcctgggcgtgttgtccttaagtgacaggggaccgccttgcgtctcctcactcggccggttttttccccggctgtcgtggcaggttcccagtgtgtggcttgtgcgtgtgtacttcacagctccgcttatcaccatggttttgggttatttgtgctgtttgggaccaggaagccgtgcctggagaggacgacagtggggtgggtgtggaagcttttctgtcgtctccgctgatgttctgtagtcgttaggcttgtaattcgtaatgacggtggagactacgtgagaccagcccacctaatgtatatctgtacaagggagatctagaggtctggcccaaagggaaacttttgctgccaccactttcaaagctttcgttaaaaaaacaaaagggagggggaaggtggagaaacaaccaaaattctggtaaggcccacactgttcacaggtctgtggggaagagtcccctttttgtgcttagcaaccaagacgtggagttccgtctccaggagcgttggtctaacctccagtttgttgtggtgacgagctgtgagcaatggcctgtgtttatgctgggcgagctttctttcctacttggggaggggggttcaggatgggaggatgcgggtagggaagagggggggaaaacccccaagctccagtaagtcttttctttacttaatcactgattctgttgtaggtagactcatttagaggcagtcctagatgctctttc

SEQ ID NO: 55618 - DNA, 1057 bp, Homo sapiens
aaataaaggggggaagttgagagtacaatttggaggaaaccagttaagctgtttaagtatgggattgtgcagtaggggtggagaaaacttaggagagtagagagagatttaggtgttctgttgggaagaattttcttcccaaacttgtctcactttgtttttacagaagatgtactcttatcatctgtaaaaaatatgtatcagagtatgtgatagacaatatgtatacctgtgttcatgtcatctgaggataagtgctggagcaagaaatcaatatatagtacagtttttaggtcatttggctaaccagctgttaaattgtatgaaagaggcaaagataacattgagcaaaagcaacaggaatttattactggtgtgtcaggaaaaaggttactgaggggtaaggacaaatcaatggaaaatgattacctgggttgtcttatccaactgttccattcagggttataatatttggatccttttaataagattatttgcctatagtgcttatagtgtggagcacccagtaaataatgttaaatggatgtgaccatgccagggagtgggaaagttgttaatctgtttttgaaagccttggattctagctattatcttttagcaataagtacaagtaccaatgatcttttgcccatcattgctactttggtattaatgaactgggcaaatttgtcattatattgagatggttaagtccttggaaagtcagatttgaaatgtaaagacttcatttattgctggagtcaagaggcgcagcattttcaggaagtcaaaaataactttttatgccaggtacggtggctcatgcctgtaatctcaatatcgtgggaggccaaggcaggaggaggattgctttagagcaggagtttgacaccagcctgggtgacatagtaagacctcatctctgaaaaaaaaaaaaaaaaaaaaaaaaaattagccaactgtggcatgtgcctgtagaaattagccaagcgtcctggtgtgtgcctgtagtcctagctacttggatggctgaagcagaggattgcttgagcccagg

SEQ ID NO: 55619 - DNA, 1215 bp, Homo sapiens
tacacatatattttaataggtgcattttgtaaaggaggtacttggtttcagatttttcttttattatatttggtatttcagtgaagtaggtagaacaagatgatttgtaaattcagcctcacagttaaattgtactgaccttagcttttaatttgtacttttttttctcttcaaagtttatataaattatggaaactcttaaagtaaatctcaactgagttttagaaattgaaggcagaggatttgttctttccagctgactagtccagtgcaggtggtttctagttgtattcaggcacaaagaaatgtacttactgccttttgatgttctgtaacatcctttgtcatgtttccttcctttcttgttgtgtttattcttttatgattagtaatgttatactgtatggattggagtagagacttcccccatgactcaaggaccacacagataaaaaggagggaagacattaaaaaaaaaaaatcaaggatcgagcatttgaaaatactacagttgaatgtgagtggtagggagttgtatttaatagatatgagattggtaggcaggggtcaaataattcatccaacagataattgagtatgtatatattgtcagtctgtataaggctttggtgatagaagagcaagacagagatggtacatgtgccggagcttatactgtagctgggaatgtagcattaaataaatactttcaagttaacaggttgctgtgggaatgcatggtgggggcagggggtgatcgtagggagcgtttctgcatgtgacagaggtgtcagggcagttttcgcagcagaaagtcttcaacatatttagagggcctggaggtgagtggccttccaagaactaaagaaagaaaggcagtgtggctagagtgggggttaggggaggaatcaaagtggggagatgttggaaggcagcaagcagattttggagtgcattttaaggcaggttgagacaggttttttttttgagataggatctagctctgttgcccaggctagagtgcaatggagtaatcacaactcactgtagcctcaatgtcccagactcagatgattttcctgcttcagcctcctgagtagctgggaccacaggcatgtgccacttacacttggctttttttttttttttttcccggtagagatggagtctccccatgttgctctggctggtcttgaactcgtggactcaagtgat

SEQ ID NO: 55620 - DNA, 1048 bp, Homo sapiens
aatgaattatttggctgcttagctttctgtaatgtgtaattcatttgaataattttcagtgttaggttgctgatctttgtattttttatccttttaatttaagctgtcaattgattcattttggttttgttttttatagaaactaaggttttcaaatcttcaaagttacccttcgacaaagctttctttaaattcactgcaatatagttgttgactataattttaagtggagctaagtttgcctcttaaaaacaggagttcattctgtgtattactgagtaattactctgtatactgaagttcagtgcccagggcttgacagtgtttaggatttaacatgagtgttctgttgtgtcacagtaatacttgataatgagcctaaggcagatggaacagcagctcaggcattccttctttatcactagttttacccgcagtggtcctcttaagcttctttgatgttgctttgttgccatattagagtccattaagtcctcacccttctgtctttcaaaaaacctctgtgaaatctgtttggctggtgaagcattttgactccaaagctagtccttctcttacccacctttttagtttaccttgctttgtctttctgataatatgccagtattatcagctcacataaatttgccaacttgctgtgtccattggccctgggcatggctaaatgattcaggcagtggaaataatatactttactctctggctcactgtaaatgtgcacagactccaagcaaagctcctgtctttcgggcttgagttttagagacaaaggtttgccatgcttacaggctgaatgtttttccctactgaacaaactagccagcctttatttcaagctgaatcactttgttacttacggaaggaaaaggtctagagaaggaaaacgtatcttccatttatcctagacaaacaaataatctaatttcctctggcagtcaaaatatagtttcacctaagccactgatgcaggaagttaggttttatgtaacctctctaattggtaagtaagtaggtttgatgtctctga

SEQ ID NO: 55621 - DNA, 1189 bp, Homo sapiens
ttataagatacattatttttgtaccacttaaaaaaggaaaagcgctgccattaaactaaaatataccatcatttgtaagaatcttcttaatttcagaggtgctaacatgtaaaaagatgtgtatcttagaattgatgacatcataataatactttgataggattgttgtaaggattaagtgactcaacatttataaagaacttagaacagtgcatggcacatagtaggcaatatttatgtgtcatttattattattgctattagtgttacctattattttctttttgaacccacttattgcctaattagtcatagtttgacaattgcccttgtattccaccatgtcaaatataaatttacatagatgagtatgtacttttacttattgagaaacagtgtaatatataatatactcaattctggagccagattgcagggattcaaatcctagctctgccacttatttgactgtgactctaggccaataacttaatctttctttttctcagtttcttcttctgtaatggggataataattctattttagatgtgttcgtatatataaacgtctgagttatggattaccttagtcatctctttaaagttccctagcattttatttctcacttggactgttaatgaatatttctaaaaagcacactaagagttcaaagttttaaaataatggtaacataatactgttattatatctaacacctactagtatttaccatgtgccatgcactggtctaaaagctttcatatatttatttaagcttcacaacaactctatgtggtgggaactcttactgtctccattttatagatgaggaacctgaggcacagagagatcaagtaatatacctgcagctattaaatgatggaactaggattcagaccctgacaggctggctctagagagtgtgctgtcaacaccatgtctcttcagaaggcatttctttttcttttttttttttccagaaggcatttctgtcatgaagggttatttattgaccagggctttttttttttttttttggactgtcttgggtctcctaggctggagtgtagtggtgtgatcttggcttactgcaacctctacctcctgggttcaagcgattcttttgtctcaacctcctgagtagctgggattacaggcgcccaccaccacacctgactcatttttgta

SEQ ID NO: 55622 - DNA, 1046 bp, Homo sapiens
ataaaaaaaatctattatcccttatctgtgattgcaaaattcagaaagctctcataaatgaaaatttttctttaagtttggtataaattcatttaattggcaagacctgacttgaaccattgttaagctatttgaagtctttatttagccaacttagtatgactgttccatgttttgttgcagaaatattaatgtgtttgattatagtgcactgccctgaactccactgggattattatataatgtgtactttgtgttctgcattacctttctgaaattcaaaatattctgaattccaaaacacatctggccctgagcttcagatgatggattgtataccaaagattttttttccatttcattgaataaatgttcctttagctaatactaaaacaggacttagtcatgtagttaattttcccaaataatgtttttttttttttaatctgatattttttgtttttgctagagctcctgaaattattcttgggttaccattttgtgaagctattgatatgtggtcactgggctgtgtgatagctgagctgttcctgggatggcctctttatcctggtgcttcagaatatgatcaggtaaaagtgtttatttgaatggaaatagaatgcaaatagttacttgtgaattagattctggagaaagagaagtactaagtactactgaagtatttagataatagggaaagagtagtccaattgctactaaagaactttttaaagaatagtataattttctcttcctgcttcttaggctaaagtatgtttgcaattctataataaaaaaaagaattttattttatattaaggttgatactttgctagatctgtaatgatttattagagacttaactttcattaacttatgtgctttgtgagttaggaaagtagagtaaagatgaggaactggaattttaaaagagaacttctacttactcggagctattataatttacttttacgcatgacacactgaagtactttcttcagactgaaacacttcaggtcccagaagctgtgacatactgggtc

SEQ ID NO: 55623 - DNA, 1332 bp, Homo sapiens
ttttttttagtagagacggggttttgccatgttggccaggctgggtctcaaactcctgacctcaggtgatccacctgccttggcttcccaaaatgctgggattacaggcatgagccaccgcgcccagcccccaaatttttaatgacaagaaattgtttagctttcttctaccactcaatttagatgaagattttaattaaacagcataaaaagagcttcctcctctgaaaatgattagattttcataaaaagaatttccccaggtttctcttttgattacatatatacacacacacatagtttggagggaaagcagctatgtagtgtcagtgccaaaggttaagtgaagaagtataattctgaattttctttggaaggtgaatatgtctacagacctggagggaacagacatgttggcagagaaggcagaccgaagagaatacattgatctgttaaagaaaatgctcacaattgatgcagataagagaattacccctctaaaaactcttaaccatcagtttgtgacaatgactcaccttttggattttccacatagcaatcagtgagtatggaatattctggggcttttgccatgtggttctttgttgagttaccgccttatcaatggcactatcaaatgagcccgccactttggtgcttataaatctggctcagcagtgcttttctttctcattgaaacatcataagataaaaattagatgtgtatttttcttccctatgattatacaaattcttgatttattttatctgaaagtgattgggaaaaaaagctttgatccatgttcatcttgagttatttgctgtctgtttaaatctcagcattcatttaatgaatctttaatctccttttcagtgttaagtcttgttttcagaacatggagatctgcaagcggagggttcacatgtatgatacagtgagtcagatcaagagtcccttcactacacatgttgccccaaatacaagcacaaatctaaccatgagcttcagcaatcagctcaatacagtgcacaatcaggtattcaataaataattttggaaactcaagcttaagtgggatagaaactagtaagaatacagggcaaggtaaagaaccaatttttgttttggtggtcttgttgcttcttagaaattctccacttgacaaaagttgatggaaaacagggtagactgataatacttaccaggcacaggctaactaaagttaaatataaaggcctaatccatgccctcatatgttcagcatcgtcaaataaatggggtctgactattatgctacttactgctgttagttttactgactttagccaaat

SEQ ID NO: 55624 - DNA, 1111 bp, Homo sapiens
acttttgagttcctttaacaaaacaaaatgtaaactaatgaagttagaggggaaaagtgggataaccctttttagtataattaggtaagctttgaaatttttcctatctaggaagtataaataacctgaggagttattagagcatacttaaaattttccaaatgaaaaaggagttttaaaattaaggtgatgatgatgatgcctgatatgtattactatatgccagataatgttccaagtgcttttacatgtattaatttatcttcactaacaattctaggaggtagggtaatgtcattatccccaatttatagatgagaattttgagcatggttccttcatatgcccaaagtcctataactaattattgcagaaccatgatttgaacccaggcaggggaattcatagcttctgtattttgaggtattatccttattgcccttcagttgccagccatcactagttgctcatttctgtgcaacaatggtcttattccaggttgcccacttttcttggactatctgttcttttacaagatgactatacttacaggaggatagatcctcatcagttaggcaatttattctttccatacttacctgattctttatttaaaggactatgttcaataaaacaaaataataacaaaaaatgaaactataatccctcttaggtcaggaaccggggagaaccttccaacagtgttgccttttgttaattctttttttccacttttgggctcagcctaaagtacaatagcaatctaatacattagagtcacatttgtaggtcagtactataaatactactttccatactgtcctggttggccaaaatagataacacattttgcttagtggtaactattattctgtaattttgtcacctttcgctttatcaccctgggggctatagatgagcttctgaagtgaacatttcctcctaaattttaccaatttgtaggaggctattattatacaataccaatgtcttgtagttaggcatgtatccatgtcctactataggcaaaaattttgtgtggcttagccttcttattggataacattgcctacggaagcatggctggcaactttttaatcttgatatatga

SEQ ID NO: 55625 - DNA, 1912 bp, Homo sapiens
atcaaacatctttccattaacctaacctgaggggaagtctcccttttcttaacttccaagacttctatgaatgaaacttctttgtcttaagtgtctaggattaaaacctgaacagtggattatttgaacagagaagctgaaaacaaaataatcttaaaacagtactcccagaccttgcaaaactatttaactgtgatgctgttttcaatagctggactacaagcaacaacaaagcattctggattccctgtgaggatggataatgctgtaccgattgtaccccaggcaccagctgctcagccactacagattcagtcaggagttctcacgcaggtaaaagctagagcaatgtggatactcagtattgctaaacactattgagattcagatattttgtcctagaaaatggtatttcctttgactataagatctttcttggtcatgattcagtggacttaaaatgaaacatctctatggaacaatatactaattcctaacactattgcaactctgccattgtcttccttagacttgcagggaaaaaatatccagacattcttgagaaatggtcttctgagtaagtttactctaattttgcggggtgaagcgtttttttttgttgttgtttgttttttaaatgttggagctcatataaagataagtatatatgtagcattttgattctaaaatataagcttccacttttgcaccctttgtgtcccttttgctcactcttttagaatttcatcacagttgagaggctggatcacatcaggatgcctcttcacatattacattccttcattccgtgtgtttaaccagattgtagaaagctttaaaactttatacttgctatggaacattcgactaagatgatagagaaaattgtaaagtatttaaatagcaacaaacagtatattttatattttatatataaatgtttgtggcctatgacacataggaaattctcaaatccaaaaactctattttgtgaacaggaggaagaattcttaataaatgtctctgtttcatagaactgatcccctgaatctagcccaaggaggattcctatacttctttgttttaggccattggcatttgactttgtgggccaatgccatacaaagttgaagggggaaagttgtgtttggtatatgcattttagatgctatcaaattactgttcattgtcagtaataacttggggggaatgagaacccttctgaatccagatatcctgcctccgtgtttgtttcactcacctgcctaatctacgtttcagggaagctgtacaccactaatggtagcaactctccaccctcaagtagccaccatcacaccgcagtatgcggtgccctttactctgagctgcgcagccggccggccggcgctggttgaacagactgccgctgtactggtaattcccctcacttgattgtgttactaacggagtttctttggtttctttcttttttgttttttcctgtttgtttttgttctgtttttttctggtttatttttcaaaaaaattttttagcttagtctttgcagagggcatggaagcatgtgccatcttgtggctgtgttcttgctacatcttttaatgtctcattgttttcctccccaacatttgctgtagcactgtctgactgatggttatgtggctctgtaaggagccagatcccttgattcttctttgccagcctagtgtgataaaagctctcgatgtagcctcagaagagcttcaacactgttacttgttttctgccttttaccctctgatccttgagaatgaaggaaatggcctttaatttggctcagctacaggtacccggatggccaaaattgagctcgttggcaagatagctttctcctttttttgctgttttaaggttctaaaacttttctgcatg

SEQ ID NO: 55626 - DNA, 1011 bp, Homo sapiens
gttttcattttaaaagtctttgtcacttccagattaattttcttgtaagcagaaaacctgagtgtgagggagtcagatatatttccaacttgattgatccaagccaatggttttaactcactcatctgtagtttcgaggttggaatgttagttgacacttctcctttgctgcttctcttaagtttgcactagccatttgctaagctttgcatatttttgttcttcctctgtcaaaacagttcgtcgcttggaacgccagatttctgcctcacattggaatgttatttcttgctttgtattaaactacatgctttgtcttgtgcaggtgttggcttatggaaagacgcatggtgtgacttaacatacttcttttattttttgttttgttttattttgttttaaattctgcttatggtagcagacgtgtttgcagtttctctgctttgaaggcttcttgtttggaaccagtatttgtaacaagtagatctgttacttgcagaaatatttttaaaacagtgtgttgatggccttgcaatttgaaattcaagaaacagaaccatatgtacccaagcattgtaggtaattgtactgcagaattcaagtttaaaaaggaaacttccaaatccgttcccattttttttttcaaaaaatgccagaatttctgtgaggaagaagtacagaaaacatttgttgctcagtttattgcaagtgacatggcttttttaaaactagaaatcatgtattttcttgtagtgattagtttttatgtggaaatattcctgcaaatgatacataaaaacatattttaggtaactattagaaacaaagtatgatgctttctgcttctaaaacatcttactttttgccttattttgaaattccattatgtggctataaatgatgaagttagctttttcttgctggcataagattttttccccaaaaggattaggcctttggtcatccacatctggctccattttccaaatactacccttttaaaaaagggaa

SEQ ID NO: 55627 - DNA, 1049 bp, Homo sapiens
caacagtgtacaattgttcccttttttccatatccttggcagtgtttattattgcttgtcttttggatataagccattttaactggggtgagataatatctcattgcagttttgatctgcatttctctaatgatcagagatgttgagcaccttttcatatgcctgtttgtcatttgtaagtcatcttttggaaaatgtctattcaattcttttgcccattttttgatcgtattattagatttttttccatagagttgtttgagctgcttacgtattctggttattaatcccttatcagatggtaggtgctcaactttaaaaaaataaaatgcagctgcattttggctaattgcttttgatgtctgtttggtcctgattcttcagtggttttggaattcactcttctctttctttctgttggtacaggaatgcccactctcatggcaaccagtacagcactatcatgcagcagccatccttgctgactaaccatgtgacattggccactgctcagcctctgaatgttggtgttgcccatgttgtcagacaacaacaatccagttccctcccttcgaagaagaataagcagtcagctccagtctcttccaagtgagtctgtgttacagctgatagttaaaactgtgccagtttgagagatatgttgccttgcatttggaatattgtatagacatataatatagatatgaagcagcaagtagctgccaaattgaggaagagcaaatcatttcatctgggcatgtacaccaggtgtgtcctggttttatgatggtcctttgtctctgctgccactttgaatctagggcattttatgatgtttttattttactttacagagtgaaatttaatcctgggataaagggcttataaaagtaaaatgtcttttgtattttggtgttcttgtccctggaaactcttgccagcatggtgcttattttcactggaacttatatagttaaatgtatttgcttaatgattatgtaaaaaggaatcaatgagtaaattggaaagcagtctggggaaaagataca

SEQ ID NO: 55628 - DNA, 4479 bp, Homo sapiens
tctactcataactattaagcctggtgcttttttaggtctcctgagcaataagactaagccagtcgcttcagtgagtgggcagtcatctggatgctgtatcacccccacagggtatcgagctcaacgcggggggaccagtgcagcacaaccactcaatcttagccaggtaagtgctatgggctactgccttctgtttgggccctgcactgttgttactttctggagaaccctgcttctggctggatgctgaataaagccaaatgaagccccttttgtgtcaaacaattttgtgttctatggcttacgtcgtaccgcatatgctgtgtctcttcattcactctgtaagtgtgttcaggatgtacattctaggttttccatcagacctccctaagtctaccctggaaggttagagaaacgtctgggatttagaaagagcctggggtgctttaaccatgtctgtgataggcatatgctttgagaccagattctctttatcccccaggccataagtaagctgatccttacattgtttacttgagtcaagagattgtgaaaagctcattggccaccaaattcaactggttctaggtcctacttgttgctggagtctgcgatttgggacttccccactctccgaacacccccagccccaacctacccttctgcttctctcattactttattctatttgtgttcactcttagaagctaaaattcgagtgcttgtatgatgtccaccagtagtgagaaagtgtcagtatgagggtatgtgagagagagcacatgcaagtgaaaatgtaagtttgagttagtgcatgtattttagtttccacatttcaagaggggtatgaagaacttagaggacgaaaacaaaagaaagcaatggtaagaaataaaggctaggaaaaattcaaatttactgacgccagaatagggtgagttgagtcaccagttattaacttgcaggagtggggaaccctatgatctcttgattctccctcttcctgtcatacttacaagcaaaatgctgttacctgagccagattaggatctatcttgctaagaggcagaaggaggggtggctgatttctgacagcattcaatgccagtgtgggagattatgtgctatacccattcgaaaacagtacaagtcagaacctgagctcttaacttggcctttggtgccctgagctggagtgacctcaggattcctcacttcttccttctttcttccagaaccagcagtcatcggcggctccaacctcacaggagagaagcagcaacccagccccccgcaggcagcaggcgtttgtggcccctctctcccaagccccctacaccttccagcatggcagcccgctacactcgacagggcacccacaccttgccccggcccctgctcacctgccaagccaggctcatctgtatacgtatgctgccccgacttctgctgctgcactgggctcaaccagctccattgctcatcttttctccccacagggttcctcaaggcatgctgcagcctataccactcaccctagcactttggtgcaccaggtccctgtcagtgttgggcccagcctcctcacttctgccagcgtggcccctgctcagtaccaacaccagtttgccacccaatcctacattgggtcttcccgaggctcaacaatttacactggatacccgctgagtcctaccaagatcagccagtattcctacttatagttggtgagcatgagggaggaggaatcatggctaccttctcctggccctgcgttcttaatattgggctatggagagatcctcctttaccctcttgaaatttcttagccagcaacttgttctgcaggggcccactgaagcagaaggtttttctctgggggaacctgtctcagtgttgactgcattgttgtagtcttcccaaagtttgccctatttttaaattcattatttttgtgacagtaattttggtacttggaagagttcagatgcccatcttctgcagttaccaaggaagagagattgttctgaagttaccctctgaaaaatattttgtctctctgacttgatttctataaatgcttttaaaaacaagtgaagcccctctttatttcattttgtgttattgtgattgctggtcaggaaaaatgctgatagaaggagttgaaatctgatgacaaaaaaagaaaaattactttttgtttgtttataaactcagacttgcctattttattttaaaagcggcttacacaatctcccttttgtttattggacatttaaacttacagagtttcagttttgttttaatgtcatattatacttaatgggcaattgttatttttgcaaaactggttacgtattactctgtgttactattgagattctctcaattgctcctgtgtttgttataaagtagtgtttaaaaggcagctcaccatttgctggtaacttaatgtgagagaatccatatctgcgtgaaaacaccaagtattctttttaaatgaagcaccatgaattcttttttaaattattttttaaaagtctttctctctctgattcagcttaaatttttttatcgaaaaagccattaaggtggttattattacatggtggtggtggttttattatatgcaaaatctctgtctattatgagatactggcattgatgagctttgcctaaagattagtatgaattttcagtaatacacctctgttttgctcatctctcccttctgttttatgtgatttgtttggggagaaagctaaaaaaacctgaaaccagataagaacatttcttgtgtatagcttttatacttcaaagtagcttcctttgtatgccagcagcaaattgaatgctctcttattaagacttatataataagtgcatgtaggaattgcaaaaaatattttaaaaatttattactgaatttaaaaatattttagaagttttgtaatggtggtgttttaatattttacataattaaatatgtacatattgattagaaaaatataacaagcaatttttcctgctaacccaaaatgttatttgtaatcaaatgtgtagtgattacacttgaattgtgtacttagtgtgtatgtgatcctccagtgttatcccggagatggattgatgtctccattgtatttaaaccaaaatgaactgatacttgttggaatgtatgtgaactaattgcaattatattagagcatattactgtagtgctgaatgagcaggggcattgcctgcaaggagaggagacccttggaattgttttgcacaggtgtgtctggtgaggagtttttcagtgtgtgtctcttccttccctttcttcctccttcccttattgtagtgccttatatgataatgtagtggttaatagagtttacagtgagcttgccttaggatggaccagcaagcccccgtggaccctaagttgttcaccgggatttatcagaacaggattagtagctgtattgtgtaatgcattgttctcagtttccctgccaacattgaaaaataaaaacagcagcttttctcctttaccaccacctctacccctttccattttggattctcggctgagttctcacagaagcattttccccatgtggctctctcactgtgcgttgctaccttgcttctgtgagaattcaggaagcaggtgagaggagtcaagccaatattaaatatgcattcttttaaagtatgtgcaatcacttttagaatgaatttttttttccttttcccatgtggcagtccttcctgcacatagttgacattcctagtaaaatatttgcttgttgaaaaaaacatgttaacagatgtgtttataccaaagagcctgttgtattgcttaccatgtccccatactatgaggagaagttttgtggtgccgctggtgacaaggaactcacagaaaggtttcttagctggtgaagaatatagagaaggaaccaaagcctgttgagtcattgaggcttttgaggtttcttttttaacagcttgtatagtcttggggcccttcaagctgtgaaattgtccttgtactctcagctcctgcatggatctgggtcaagtagaaggtactggggatggggacattcctgcccataaaggatttggggaaagaagattaatcctaaaatacaggtgtgttccatctgaattgaaaatgatatatttgagatataattttaggactggttctgtgtagatagagatggtgtcaaggaggtgcaggatggagatgggagatttcatggagcctggtcagccagctctgtaccaggttgaacaccgaggagctgtcaaagtatttggagtttcttcattgtaaggagtaagggcttccaagatggggcaggtagtccgtacagcctaccaggaacatgttgtgttttctttattttttaaaatcattatattgagttgtgttttcagcactatattggtcaagatagccaagcagtttgtataatt

SEQ ID NO: 55629 - DNA, 1099 bp, Homo sapiens
caggttgagatccgtagcattttagtgtccgagaggataattgctaagggagcagagacctcttcacaccttcatgcgcttagacctgcctagaggctcagatggctcagtggcactgctcacagagaacacaggctggaggacatggagtcggggtaggggcctaggtgaatctcagctaggctctttgcacatttagcacctctgcacatctggtttccttttctgcaggagtggaaggggatattgaagcctggctgagtttgctctttttttcccattcctgactcccgagttgggcctctccctgcctgggagttgtaaccctgcagcctccctcctgatcccccatcccttcaggaacggctggcccagtgccaggaccagagtagtcggcatgctgctgagctgcgggacttcaagaacaagatgctgccactgctggaggtggcagagaaggagcgggaggcactcagaactgaggccgacaccatctccgggagagtggatcgtctggagcgggaggtagactatctggagacccagaacccagctctgccctgtgtagagtttgatgagaaggtgactggaggccctgggaccaaaggcaagggaagaaggaatgagaagtacgatatggtgacaggtaaataatctgaaagcaggcccctaactcttctcagaaccgatattcttccttccttgcttcttactctttttttcgctttgtcccagtccattgtggctctgtcttctggaatctgttttagggaaacctctgtaatgccaggtctattaaggagaggttctggggatccaggccgctgtggtacccgctctttctcaattctccctaagattggaggcaaccactgggcaaatgctcactattctccagatcacccaccctgggggagttcctgctggaggcatctaattcttgcctctatttccttttcctgtgcttttctcatcagactgtggctacacaatctctcaagtgagatcaatgaagattctgaagcgatttggtggcccagctggtctatggaccaaggatccactggggcaaacagagaagatctacgtgttagatggg

SEQ ID NO: 55630 - DNA, 1216 bp, Homo sapiens
taagttaatttggatatatttgtcatatcaaactacaaagtgtacaaagttaagtttagcccttttctagaaagtgatctttaaaattaaaaatgctcctcttttaaattcaccaaatttatgtgtgggaaggcaccaaaatgattttgtaagtgccactgcaatattccctttcaagtgtggcctaaatttcaatcttaaggatggaatgcatgtctgctccttgttctgaaaaatgtaggcatctactacattttaaaacacagtgaaacatatacataagcctataaaaaaagatttgtgcaatttgaaagcctgttaattttttatgtagacatacctacacacgaaagggttaaattcacagccttactagttccttgcttccagtatttcaattggtctcctcccctcattattattattactactagtactattatttttgcacatagttaactgcccttcaatatgattcttaaaaagtgctgtttctgtggtatcgtattctctaaataatcatatttaattttttaaaacaaggttgcagtttctaattgtttcgttcctgtgtttttgctggtgtgtaataaaagcaagttttttcttttcatggttatttaatacattagctgcctgtaaataattcttgttataatgctctggaatgtgttgtagaagttgtattagattagttttaaacccttgtttgaaagccacattgttttggttatttctattaaattagaaaattgaaaaagttttcaaatgaatttctttttttcttcttctgtgagttgaaacttaatcatagttttaaatcattttaaaaatttacactgtgtgccaggcaccaaagatacagtagtgaacaagaagatatagtcgttgccttcacagactttagactctgtgttagagtaatcaatgttatgatagggattaacagaatataattgtaatgcgtaggaaaggatctaacccaaactttgttgccaggaaagcaatttctttcactcataaaaggacagtggacaaggaaaagagagagtgaaaagagaatacaacatgtagaagactgagtgagagagaacatgtatgtattccaggaactgaaaagttaattaactgaaagttaatctgaaacagtgtaagttggagtggtaaaatactacactcaaaaattgagcagagtcctcttcaagcagagagtctt

SEQ ID NO: 55631 - DNA, 1023 bp, Homo sapiens
cttttaaaaaaattgtagataatgagtcataaatagattctgccaactgaggggagaaacattttaagtaaatatttttcagtatttggggccttaaaaaataattgtgtttccttaaaattacatgttagatagagtttttaggtttttttggttttaagattggttaaagcaatttaaaagccacttttttgtcaacatttaatagcctccacttctgttaagataatgtatactgctgaggaattactattaatagctatcaacataccaccattaaattaaggtattcactttagattttttattaaagcttttttcttgcacactgatcgttgtgtttctaagctgattttttcagctctaatatacctatggttaaaaagtataaaaacttaaattgatatttagatatatgttttcctattagtttatgttttaaaaagacaaaattgtatctgtcagtccctgaaggcagtttgtttttatactctctcacatttgtatttgttttttaaatggcagtattttagaagatttggagaaaagtccacataataatgttttcttaaaagcttttaaagtttttgctgtacttcaatttacttcttccatcagaaaactaagaacaaagtgttgctcagtctgttccgctgacctaaatttgtgttttcagcacttggctcagccaattcactgagtgaaggaattgctttatgaggcaaagcatgtgaaagttctaaagtatggttagattgtaggtcgtgctctatatggaaacatcaaaccattactacagagaaatgataaggcattggatccactattgaaattattatttttggatcaacaagttggtactttctgacttctgtatcttaacataagggaattttaggtaatgctaagtcagttgtctcattttttgtgataagttttggaatttttagttaattgaaataaataatgcttttaaatagaagtaaaaggtttataagtgtgcaaattgtagatttatcaatt

SEQ ID NO: 55632 - DNA, 3052 bp, Homo sapiens
agtatggcacagagtatattagtaaaatctcactagtttgaagttatatttagtcccaaattctgtcttatttttcagtgcagttaaattattttcaaataaatatgctttcatgaactatagttgataagaagacccatgtttcctgcctcagtaataaatagtttatgattaacatattgctatacagatagaatttttattaagtggtttgttgaaagtttgtcagttttttaaagcaacgtttcttgtataatatgcttcacaaatatttttctcttggatagattgatgtgttcagaccaattcctattcagattgaccttgataattcaaaataagacaattactgaggtttcacagtagctttagtaacagggctttgtaaagaaaatggttccatgttctgtagaattttagaaaagcactttatctggttatagcaatttgttctccctagtatggctgacttttcgtcgccaatcctatgcagtctcataactttagaaaggattataatttcccttttttttttttgactctggtatcctttttagatgatgaaagttgttcaagtttatgcagacacacaagagattaatttgaaggtaagcttttcagaccatgcaaacttggtgaaggaatatgcattaccaataggtgaatattcctatcttttgcttgcaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgtttaaaaaaaaaaaaacgaaaaaaaaaaaaaaaacacaaaaaacccagaaaacttttaagtgttgctggaatatcctgcctacagtgggcacctccttgaagaagctgatagcttttacacagtattagattgaaataatggacagaaacacattcttgtcaagaaagggggagagaagtctgtttgcaagtttcaaagcaaaaagcaaaagtgaaatgatttgaggatttctgttctaatggagatgattctctgattgttagaaatggcaaatattgatgattgtgtgctattgattggtgcaggatacttggtatacgagtaaatacttgagactcgtgtcacttgataaattttctttttggactaggtcgcacagttattaaaacaacttttaaccctcccccttcacacacatacatatcaggttgttttctagttaaaaacccaagtagctcagattctactttaatgtcagtgcagatttgcattgaatcatgccattatgttttttctcatttttatgctgttgggtcttagtttttaaattgatataaagaactcagcaatggttttattttctactcatacttagggtttaggaaacactaccactagttatcatttaatcaacttcaatggtctactgaaacaaaaatggtaacttttcattagtggattatttagagttatagtagttgtttccagaaaacacttcctcacaattgtacttcccaatcaaatcatgtgatcatacagttattcccatgaaaggcagaatgtttgtttcaaaattaatctagttttctgtacatttaaatttgagaaggtgacaactggctcttttccagtcttccttcatgtcagttttctgatagaccactattggcaaacagtatctgtcaactaccaaatgtgtaaaattttctgtatttcactttgtcttatttgtaaatagtgaactaaaacttttggcagatcagcaacatttgctgagcctgttttttaagctaatgtgtattcttactaatgttcctatcaagaatggatttgtaatatatgctgtctatttctaatgttcacattcatattttgaggttctatcttattttaatagagaacagacttctcaaaaaatcttcagaagcagcttattattgaaatatcgaaatattgaaataaacccggtggggttagattactcatctgtccaccaagtgggacatttgcatggactgggggcttaaaggacttagaagagacctgtaagtaaatcctgaaaatgagccaatccccacttgaatggttactggagtaaacccacctttaccaccccaattacagcacccgaggccgataaaccaacttggctctggttcatttttcttttcttcatttgtgatgctcagattcaaaatgtgtgttctacactgttacaggcttctcttttgtttgattaaagattttagtcctacttttgtatggacacattagaatattcagagaccaaaatagaagaatttgctgttagatatttttcagaagtcagcagatttgtggcaaatcatttatttgcctttttaaaaattcatttaagcagttcagagagtagactactcagaaaattatttcacgtaattgtctaagaggtcaatattttttaatgcatattgaatcaaataaagtgctctaaagaaattattatacaaattcctttgggttgtttttcttttcttaacaaggggtgggggtaaacaggaatatgattcaggctttctggttgtgtatttaaagagtattgattttattattactattgatttactttattcctggcttccttttcacttttctttcaatttttaaaaaataatttaagccgttgaaaatataccaaactgttgaaacattttactcaaattttaaattcctaaaaatgttttttaataagagggagaaaattatttaaaaatacttatgcctatgccaatttccctcttttttcacaaaatccatgatttcagtttgtaagtagacatatatctaagggcacatttttggaaagtgaggaatagcagcagtataacttcattttgtcaggcctttgagttctaatattttgtattg

SEQ ID NO: 55633 - DNA, 1826 bp, Homo sapiens
aatgttttctttttatggactattaaagtagcttcttggccgggcatggtggctcatgcctgtaatcccatcattttgggaggcctggcaggcagatcacttgagttcaggagttcaagaccagcctggccaacatggtgaaaccccctctctactgaaaatataaaaattagccgggcgtggtagtgcatgcctgtaatcccaactgctagggaggctgaggcaggataattgccaggggatggaggtggcaatgagccacagttggcgccactgcaccactgcactccagcctgggcgacagagcaagactccatctcaaaaatcaattagtcaatcagtcaataaaatagcttctctaactttacttttatcccaagggtagaaatttttcgccagagttggggtcagaattccctagcgtgaacactaaatggttaataaagttagtaaatttttcttatgttcttagtcttacttcctctgttactaagtcaagacttcgtgatgtaaatgatattccctgttatgttttccaaaagacatcatattctaattgtaacattaatatattttgtaaatttttttctttaaaaaaaaaagaaaaactcctaaggagtcataaaattctggtaagtcaaatgttgcctcaaggctactggttggttacccttgctaattgctttctttccaaatcttattattaaaagtaggactttggggacttggactaaccatgaagattggcacatatgccacataagatttggttttcatgaagatgtaaagtacatacgtctatactcaaaatttgcaagcagctggctctataataatttttttccctaaaattaatatgctatgcattttcaaattaaacagtttggcatttttggagaattcttatttgccattatgtgcttattttagataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaagtatgttaacttccaacctatagagtcttgatttgttagtttttgtttgtttccttgttttatttttctgctgactttaattttattaaaatttttttttctgctaaagtcctgtcaaaagtaacatctgattgtattaacagctccagtgaagaaaatttattgtgtataatttggagtatatacttaaatataataaattaagaatattatcaaatatccttttctaaatgagttgaggattggcataagtatggaaagtactgtcagtagttacgtatattttgtggaatatgattataaacagcttacgttttgggtactattaggaaagttatctgtacccatgtccttgcattttattattgacaacatgaatgtagaaccttaaaataacaaactaatctctggtgacccatcttgaatagtagcccagagtatataatactaagttttcttatttcagcagtgtgactttgattaattttggttatgttttttggtttggggagttttttgttttttgttttgttttgttttgtttttttttttttttttgagggtaagtttgagttagccatgccttgagaagaaatgtattatatacctgtttcagggaaattgtttttattagggataaaatcgattctattattgttatggaagagtttcattgtaggagaagaaaatggaatttaatgagaatccacaaaatcttttaaaagattaatactaaagtctct

SEQ ID NO: 55634 - DNA, 1052 bp, Homo sapiens
tgtgtgttctaggttttgaccacgaaaaaagaactgatttacttgtggcattttaatacatgccaaaacagtacaagatacctgagaaactctgcaacctgtgctcttcttcttcataaataactgagtccacataatggtgatactgggatctgagagaattggtcttaggccttatgctgcaagtactgctcatcactactaagagacccccttttaatgcggaggtgccatttttataatgcattccagaaagtaatcaattgatgcgtgactaggaaaatttagaggagtttttaatcacatgacttcacctgacgagatttcacaactataaaacctcccttttttcaaaaaattattaagaaaataaaccaggccccagtccagggaagtagcttctctagagcaggctttcttataattacgtggactaattgcctatttccctgtctagtggggactggatatgcacattttgtagagatattggaaagccagaagttgaatatgattgtgataatttgcaacatagtaagaaggggaaaactgcgcaggggttaagccccgtggaccaaagggtaagtgtcaaataagttgatttgtcactgggattcagtagttgtctgcctatatatacacctttttttttcctgtgtagcatacacaaaacctgataacatttaatttttaatcctgtcatctgatggtatattgatgatttctgaagtctttttttcctctaaccctgaactacagacccttctatccagattcctcaaacttaacatgtcccaactaaaatcttaatttctaatcctctccctccaagcacaaaaccaagcaaataacgacataaaaaactgtattcctcccccagtattccccttaattgaatgataccaccattcatttctgttgctcaggttagaaacctattagaaatgaaataataataactataatatgattttcttaccttacatcataatttctcatctggactattgtagtgatctcttaactgctctccccgcttctgctcttgacct

SEQ ID NO: 55635 - DNA, 1050 bp, Homo sapiens
aggttggtgaacaatttcttttatgttgttgcagccttcctacaatatagtagaatgataggtgagcagaagaatattatagaatgcttctaaaatgctatgcaaaagattctgggtgtgaaaaggggtgtgccataattagctctctcaaggaaaagtataaccctatgctcacttcccaatcaatagcttaacagtttaattaatttacttattatttgagtgagacattatcagaggagcagaccccttaaaatcatatgttagcgtgcctgaataattttggggttattgtcatttctttatggcactattgtgatctataaaataaatttgttacgtcagtatatctatatgcatattcacataactgttaaatacacatatggcatacaataaagattaaatgattcttcaagaatttgtcatcgttttgttttagttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaaggtaccagtgaaataattgatttttggtgttgattttcataagctaaaaataaataacagaagaatgttcagggcagatggccttctaaccagtgcacagtatttctataaaacagggagcctgttattcttttggtattagcttccagagaaactaacaataaaatatctaagatctaagtagtacattaatgttaaagagtagatttcatctcctggcctttagtttatattcagtataaggaaaatagataaaact

SEQ ID NO: 55636 - DNA, 1076 bp, Homo sapiens
catgcttcagacctggaatcagccactttcccaggaagttctggtagtgttagcaggaaagcaggaaaatagtgtttgaggataatattctagtactaatagcactcattgctactgaattgttcattgtttcttaggccttttcagtggacagagctaagaaataggagtgtgtgtgtgtgcgtgtgtgtgtgtgaagaaagtgcttcaaaccataaaatgtgtttttagggtcttctgaaagttgctgcataattttaaagagttttaagctaggctttataccacattccccttaactacattatgaggtatccttatcttctgtaaagttaattgtctattgtcttcactttagtgaacattacttttcatataattgtttttatttataccatatagtcaaacgtatgtgatctttatttgttgtttcttattagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatggtaagctcccactggagtctgacagggacttaaggacatcacttcattgattctttcagctctgagtatattaagactaagtagtgggtctagaaacatttatttttgaaatttcatgcctggcacaagccagatatctctttttctaactcaacttttttgtctaagagtcagctgtaattaatcagaaaagacttaattgtattaagtactcatttgaaattatctttgaatttgtatttagtcaatattcttcccatgatgctaaatcagattgtatcttgtcctgaaattattatttcagtagtcacattgaatctcaggccacaaaagatctttgggattctcctggacctgtgagctcagcattaagattgctgacatgaaagaaatttattgatcagagttttgtgataggaagtttgtcttttggcttacgtattactaatcattctggagttccttgagtggaacat

SEQ ID NO: 55637 - DNA, 1064 bp, Homo sapiens
gattgaagcaactccaaacaggttaacagtctagaagtgttattgaatgtatttttctaacgtaaattaaatgttatttttttcttactgaaacacaccacctacttctttctagaggaagaacaattcacatgtaaatatggattttccatgagatgcaacattaacatatttttaaatcacataatttttaaggtttaataagaattatttcaggacttctgaaaataattaatgggaacctaagtagaatattttatcaaataacttgttgagggatggcagataacgttttcttggtctgttttgttgactggatagtggtgccctgaggaggattctgaggtgatgtctggacacagctgagagaaactggttgatgtctgctaatggttacacatgcgtccctgactttgtgactaggtctgatttccaataattttttagctgggttataataatcttgagttctgtgaccggtaggtagaattccaaatattcttatatgcattgatattcattttgacttactactttttaggtttatccaattctcacacacctgtgagacccccaagtacttctagtactggcagtcgaggcaggtgagtatattgataattatttttttcctttttgttaagaaaaatagcaaatatgtataataaaagtagaatattacagtgaacccctttatacttaacactcagctttaacagtgatcaaataatggccaatcttgtttcttctatacttctgccaattcctttctggtctgaattattttgaaacaaatctcagtcatttcactcgtgactgtttcagtatatatcacttaatgaaaggaactttaaaaatttataaccacagaaccatgatcacacctaaaaaaatttaacaactcattctttaatatcagtagagatccagttaatgtttagtgttcccaatttttgcaacaaatgcctttgaaaaaaaaaccagatgatttctttgaatcagatgcaaataagctctatacattgccatcagtttatttgtttacatcactatcagttaatttg

SEQ ID NO: 55638 - DNA, 1564 bp, Homo sapiens
caaatcttcctgttgacttgagttgcagctagggattcacctgtagtcacagctttgcaagtgcatccttggccaacagctatgaccacagggtaacacaactgctattgtcctttgattatccctccaactaacctactgcctactcctaccttcagcccttcatgtctctggcatgggttttgttttgtttgtaatcccagtactttgggagactaaggtgtgcagattgcttgagctcaggagttggagaccaatctgggcaatgtagcaaaatcccatctctataaaaaaaaaacacaaaaattagccaggcgttgtggcgcatgcctgtagtcctagctattcaggaggctgaaatggagggcatggcttgagcctgggaggtggaggttgcagtgagtcaagatgatgccactgctcttcagtctggacagcagagccagaccctgtctcaaaaataaataaaagaagaatatgaccatttcttttatgaaatagtataagatttaaggtaatattcatacttaaataattttttttactctttcttacacattttgtcatttaatcatcggagttctgcaatataggtggcatgttttaaggataggaaactgacgttcaggttgagaaccagcccagaatcatagttatgggtcttctggctttatcgtactgcctctaagtaagggaagggctcatatgtactgttaactgtgcccttttttttttgtagtaaggggccttgtgtgtcaagctaagggctttctgtgggctataagaatttttcagagtttcagagctgggtactaacataattacatttctatttaagtgaatgattgtggacactgaaatggagggatactggggacaagaatactgataaataggtcctgcagcaattttgagaaacagcagaagtgtcagagcatgtcagctattttcataatagaacatataggatttgttttgctctgagcacctagttgtttgctgaataatacagttttatctaaataaactttatactgtgtgggccctcagtggaccctaaggaagcaataataaggctcagcttgatattggataatctgttagtttattaataaactgagtataagcagtgacataaaattaataacttctctgctttaatcaaagcaaatttgtctttatcttctttctcttcagttggaagatgctggctcaagtagtttagataatctactaagtagatacatctcaggcagtcacctacccccacagcctacaagcaccatgaatccttctccaggtccctctgccctttctccgggatcatcaggtaaagcaaacgggtattaccttattttttaacaccttaaaaaaacagtgtcagtatctgtcttagtcagaattctccagaaaaacagaataagtaggaggtctacttgaagagagaaagggagattgagagagatttattttaaggaattggctcatgtgattgtgggtgttggcagggaggtgaggcaggctggagacccaggtaagagtattgttacagtcttgagacaaa

SEQ ID NO: 55639 - DNA, 4212 bp, Homo sapiens
cattttgtcttatatatttaagagagattttaacttcattctcatgccataccaggaggtggcactggtgacacaaaatttttttggcctttaaagtatattaagattacataaatttatttctaaagttagctccttatgctataaataccatatattagattaatctaataggaagacactatttttaacagacatgttgatagaaaagtgacattaactaacattcatttctatatgtggaatatcctttttagcttagagaactgacttttagtcccacttttgttagtggcttttcctctgatgataggcttgctaaataatcatggagcttattcacttagcccatttttaaaggaagtataggtattgtgcccatttgcattagaaatgtggggttgattttttttcatatggaattctacagcgaagctcttgttctgtttcagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactggtgagacacatactgtttttatttttctttaatggactttattaagatatatattcagtgaattgcacctgtttaaagtatacattttaattttggcaaatgtaaccaccaccacatcaagatacagaaaacttccaccaccccccaaagtttcctcattccactaggcagccactaatctgatttctgtcattttttagaatttcatataagtggaattatatagtatgtactcttttgaagatacctagtatcttaatgcactttattacccaaaatggcagaaattcaagtatgtatatttgatttgattgctaatttaaatgttgatgctgcctaatctgaggctgacactgtgggaatatatgtgcttttttttcttaatgtctttatcttatgatttcccaattgatatttaattttgagactaatgtggatttttttccctttaagattactttccagttgcgtcatattttgaaagcacggtgtgatcctgtccctgctgctaatggagcaatacgtttccattgtgatcccaccttctgggcaaagaatgtagtcaatttaggtgagaaataatgagttttatgaatataacttggaacactgaattagaaggagaaaatacttaaagcaaatttagataaaatttttaactttataaaactaatgttttacattttatgtaaaaatatgttgttattcattggaaactcactttagctgtggttttgtgtggctgttattacatcttaagaaagttgagcgtctactctgtatattgttttttaatgtgtgctgtttctagtcccccgaccctccatcttttaaatttatattgactgtttcatatagaaatcttagcaaatgattcattgtctggaataatttcatagatttttagttgtttaattaagccaaattgtgcattagcaacagacttttaggatgctaatgtgtccagtagttaggtcctgaggaatgtttgaaagataagagtagctcttttcacatggaagagaaatggattttccttttgttacagcgtagtatggacctaaagaccatagatgaaagttacagagagctcagttaaaacacatgcacacaaacttcctagcaattagagagctatttacagattgagtaaactcactttcagaacagttaagtcctaaacagtgggaattgtaaaagcagaggctggttgccctttttttttaaaaaaaaaaaaaaagtaatctttgcatataataaaaaaaaattatattcaaatttagctatagccttagttctgacatcagccagctgtttttgtgtgacgtagtagctaagaatggtttttacattttcaactggttgtaaaagcaaacaaaaaccaaggactgtgagacagatcttatgtggcctgccaagcatgaaatatttactctatagcccattacagggaaagcctgtcaacctgtgccttaaatcacatcttcctaaaatttggcttctatccctagaaggcaatggctccataaaaagcaaggaaaaccatcacgtctaaggatataagttgtttaaagcattcagtatttccacagaagacgattttgtgacattgtaatgctctgccttgcatattttggcaattcaaaggcagatggaatcagtattggcaatcttgagtatccttgagtaagtcttgtcatgggagaattgatttagattgattagataggcctcttctaatagataatctcttttactgtcttaattttctgtatgtctaagtaaaaaagaataaggacagagagtatatttttctgaataaccaaacgtcatttattcagctttggaatgtattaagtttctgatcatcatcatcatctttaaactgactccattccctgctgtactgttggagctttgaggtgctgatagttgtcagaggaaagaggaaaacatggtgattactcaacaaagtagatgatttagttgattatatgcaaattctcattttttaaatttttcaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacaggtaagtatcgtgttactacattattgatagaaattatgaagccctcaacactacactttttcctatataattaagttacacatttcaaagttactagcaagactgagcagagttcaaaagtcagagtttaaatatttgctatggttatgatggtgatgtaagggagctgtgaagaaaggcagtaagtaaattgtcttgggaaacaaaattaattcactaatactctgaaaggatgtaagttctcatcctttcacatcaaatcttttttgttttccacgtataattttgtggaccaaaggaccagactgtttctgcctaggatctgatatgttccttaggcatttgttcagatctttcctatacctgtgtgtcttttgctctctccactgccatcccaatcaaaactattactccaggatgggatacgttaatgttgatacgctttaaacacacatatagagaaaaagagggggaacaggtaagagagagagagagagacaagggaaattagggagtgatatacaaactagtcattaccagtcctctggggattggggctagcgataagaattatttatactttttactttatacccttttatcttgactgaattatttttatgattacattttataattgagataaatttattttaaaattattacataaattgcaatttctactttttgtagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaagtatgcctagagttacatttgtaagaatcctacaattttaaaattaaaagacgtcattttcttaatcactttttgggagcaggtcattgatgtgtttgagaatttgattaatgctgtatatcctcttgtcccagaaaaataaacatacacatgagattttgtatttaattttaagagcttttaaaaaatgctttaagtgcatcatatactgtgggttaagaaaccctgatgtagttaacccattcaatttgcagaagtgaaaaaaatctaatgagctggtgattttacccacaatcacaaaaagcaatgataaaatagcaagaacattagtttcctgaaaatgctgctctgctcttttaatgtggctttttgatcctaatatataaaaagggctttgagagtaacagagctaactatatgtattattattattatttttttttaccttttctctac

SEQ ID NO: 55640 - DNA, 1199 bp, Homo sapiens
gagtaattttgaagggagtgtatcagaacccatgtttgaagtggctaagttataaatgaaaataaatgcttctatgtttaactattatcctttcaaaagataattattgcttgtgacattgtccttttgcacattgttcttggaaaacgtcaaggttaaacagaaccaatgtgccacatttgacactatccagaagtcactggtgtttgtgcatcacattcatgtcatagttacttaagtagattgccatccagcttaataaactgtcctttatgagcataatttaaaattactaaatattagtttcattatttgtctatgtacataacttgtttggaccaaattggtcaggtctgctgaaacatgagttgtacattttgacaaagttttcattttaattactcggttaagtgcccagttggatgaatttctgtaacagttgatgattcagagacctaggataagttgataacctaatgatgcatttctcttattcaggataaaagaagtaaatgagactaacaaacgagtagaacaggaaattaaagtggccattttcacccttatcaatgaaattaataagaaaggaaaatctctcttacaacagctagaggtatggttcaaagccaaaataaaacaaaaactgcttctcttgctctttagctgtttttaatgtttattgaaaactattttagatggattggggggtatggaaataaaggaaaacgtaaaataaggtttttaaaatttacttttggaagagaccttttctagttagttactttgcggcccaatttaataacactgactttagctgtataccttaggaaatagtgatgtcctcttagaaatcaaataattgttactaagactgggtatggtgactcacacctgtaatcccaacactttgggagcccaaggcagacagatcgcttgagccccgggatccagcccagcccaggcaacatggcgaaacctgcctctacaaaaaatacaaaaattagccagggtggtggcatgcaccagtagtcacagctactcaggaaactgaggtgggaggatcgactgagcccgggaggtcaaggctgcaatgagctgtgattgtgtcctgcactccagcctgggcaacagagtgagaccctgtctccaaaatgaaaaacagaaaaagaaaaaagaaatgttactaaaatgtgatgtac

SEQ ID NO: 55641 - DNA, 1880 bp, Homo sapiens
tcatagtattattacttttgtgattttagtgcccatatagacaattacacagtaattgtgaactcatttccaatgatttgtttcttgactgtgccttagctaggcatttagttttcaggttgtaccatggaccttgccataactgacacataacctctcaaatctgctgatctcactgataaagtcagttccagcttgtttgtttggctgtaccaaccagtactgtaccctgatctctgatatgagttactgtcttagagttttagctggtctttcccttctattcccttctttgggtcttttatatttctgtttgatgattttcctagaatgtaaatgtgattattacattctggttagaattcttcagaggttttccattacttagagaattaaatgcacaaatagtgtgctatacttggcccttcacagtttgcctctggattttatcagttattgtctcatattctgacttttgtatatttttctttggccatattgaagtatttatgtgtggattttatcagttgttgtctcatattctgacttttgtatatttttatttggccatattgaagtatttacatgtctcaaacatgcctctgtacctagcataagatgctgttcttctctgctgtgcttttcttggtattgaggccgatttaggcagtggtttcttgtaaattatatatacgtgaattatatctcttgtcacagtatggtatcattttgtatttgtgactatttgttagtagtacaaacaataatggattctttagtccatgtaaaaaggacatagaaaaaaactaaataatatttgttgacttaataacttaaaaacctaataaataatttacaaaaaggaaataaaagtagcaaagaaaactattattctagcttcctagtagccaaagaaatgttattagagtctatatttgcactattatgattagaaaattttaacatatagcattcatgctgacaaagtaaaactggtgttgatgtgatgttttttattgatttaacccttgtggaaagtttgacagtacatggcatccagaactgaaaaattattttaagtgtaattataaagacaagataaagaataaaagtcagatgtaaatttgcatgttcattattattataattgcatttaaaaatgcatagttaggccacatgcagtggcccactcctgtaatcctagcactttgagaggccaaggcaggaggattgcttgagaccaagagtttgagaccagcctgggtaacatagaccttgtctttattaaaaaataagtaaataagtacatgtataattaaaagattaaggaactatatattacagtggtagcagtaattttgtgatgttggaactatgggtgatttcccttccttttatagtattttctataatgtggttacgctttatgatttaaaatgtatacaacttatgccaatatttgaatttttaaaaagatgtaatcctgaatcaacactctaatataagagcactcaaccattatctgagtaatttttttctttcataatggcctttcagggtcagagttggagggagatgggtgattgccagttaaaagttgctgttgagataaggtatgagtggccagcatagagttgatcacttaattaaggtttcaagattgactcatttagctgttctttatttccaaaatcttaatcataaatgttttgttttaaatgtagttttgttttggttttaaggtatcagtttttggaagaagcttttcaaaatcagaagggtgcaattgagaatctactggcgaaacttcttgagaagaagaattatgttcattttgcagctactcaggtgcagaataggtaagtttgttgccttaaaac

SEQ ID NO: 55642 - DNA, 1002 bp, Homo sapiens
catgccactgcactccagcctgggtgacagattgagactttgtctccaaaaacaaaacaaaacaaaacaacaggattgttaaaagaaagtcgggagatgaagggcaaaggttttcaatctagtattctctttttttgagacggaattttgctcttgttgcccaggctggagtgcgatggtgcggtcttggctcactgcaacctctgcccctgccgggtgcaagcgattctcctgcctcagcctcccaagtagctggggttacaggcgtgagccaccatgcccagccttgatctagaattctgtagctaaagtataaatcaatgtgagaataaaatgtagacatgtttcatcatgcaagtattgagaagctttgcctcttatgtacctctttttggaaagccattagagaatgtgattcaccaaaataagttagtaaaccaagaaagtaaaaggtaagggaatgcctaaaatgacagccatggggtaagataatttagaatgaggaatgaaaactgaggatcctgtgaagaaggtctccaggaaaaaaatggaaccatgtctattaaatttgttatattgggtcatttgaaaaataatgctgacaagtttggcatgtggtagttcatgagaaacattagcgattgcagcatggggcaagatggaataaatttggagagaatatattttggagaaatgtatttatttctcctgaaatgaatagtcacttttaagaccacactctcttactcttcaatcctcgtttgaggtggagatagggttgactcgctgaaactagaatttcttttccattgacagttttacaagaggaagacccaaactgcatccttcattaccaccaccatttgcagcctctccatcattatcagccttgtatctactagactaatattgttacattttttatctgtatttttctgttacccaagagagtgccacaagtgccacactcccagacgtcccctcatctgtcacactttaatt

SEQ ID NO: 55643 - DNA, 1029 bp, Homo sapiens
tatatttttctttctctgttgagtatcacaggatgcttctactctggttatttctaaggattttttcaccatttaggcatgccgttagacctttgctggatttatcatacagctcctgttggtcacatgtcatcactgcttttttcccctaattccccaaactttttatcaccattgcgtttaaattagtcctgccttggtcttcagtttctgatagtatcatgacatcatcagtatactatattattacatgtggggacccgaatcaactctaaatttctcctaatcaaattatgacagtaagctggtgagtggaaataaccctgtggtgatagagtaagtgcaaattgggatctctcccactcaaaggcaaattgtggttggctctttttgaggatggaggtaaaataaaaaaagaaattcacaagattagtccctgagtactgttttcctttggcctgctatatattttatatgttttttgtactgttgagaccatattaggaactgctgatgctatggcggaactacttcaggctttcatagttcactgttagtctccatgagccatctgcttttttcataggccacacaggattattgtacaaagaattcattggcaccagcactccgttgtctaattcttcattaaaatggtaatttctttttgtccaacaggtaatttcatcaggcagtaccttacactgtccaaaattaacaacttctgagggcctgggtggttctggtggttcctaattagcatttctcatcaacattgacctcaaggtgaacttacgtgctttctgttttcaatattagacaggtgtacttttcagtcaaacatactgtctatcccaatagtacattcaggtaatgaagacgtaaccacctcacataaaggcagctgagacattctagttttaatctaaatgtttaccttaatcccattagctgtcacctttcaatttaaccttaacacctgttaggacttcaacaagatttagaattatggtgccttgggcctccctg

SEQ ID NO: 55644 - DNA, 2244 bp, Homo sapiens
tataaagtgcatcactctactccctgcgtccattgttattataattgccttccactcttctgtagtcttaccttcctcttcctccccctgataaggtcacttgatcacgtttaggacccgctggacaaaccatctccagagccttaatcgcatctgtaaagtcccttttaccatgtaaattaatattcatagtttccgaagatcaggatctggatttcttttggggcaattattcagctaaccacatattataatgaggaagcacttcttgggaggcatcataatgcttgttttttcttttcctaaatagagtatcacttttacccaaatggaataactcgctgggttattttactgagctcttgatgctcatttctttggtcttctctgtgatgaattaatgtttctatatggacatcatgcacaatttctttattcctgaagaatattttaaaatgttgttattttatgttgtagttggtgtaatacggtgcccagtatgccgccaagaatgcagacagatagaccttgtggataattattttgtgaaagacacatctgaagctcctagcagttctgatgaaaaatcagaacaggtatgcttctcaatttttctttatattcctatcttgatatcaaactgtaagttataagaaaaacatgtttggatagttaagtcatttagggtggttctgctatggattcctgtttcaaatagaaagttaaagatagctttcttatatactctcaaacttagttaaatgagactaaagctattacttaaaatgtcaaatttgggccaggcatggtggctcacgcctgttgtcgcagcacttagggaggctgaggtgtgaggattgcttgagccccggagttcgagaccagcttgggcaacatagtgagactccatctctacaaaaaataaaagtactagccgggcgtggtggcatgcgcctttagtcccagctacttgggaggctgaggttggaggattgcttgagcccaggaagttgaggctgtagtgagccgtgattgcactactgctgtccagcctgggtgacagagcgagagcctgtctcaaaaaaaaaaaaaaaaaaagtcaaatctgcacagacttcgtgttctcagccttagatttttacctacatgaatgatctgtaaggaaaaggattttgttgaagataaatggataacaaaataattttattctgtgtacagtgaaatagtatattgaagaacaagtttttttttttttttagatctagattttatgtatttaatttagattagtgcttatttcttcttttaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcaggtaagatagatgcattgtaatcattacaatgattacagttaacctccttcttttgcccctatagaattttctacttattctttataaactttggatagcaacatcaataggaatttagaaaactagacaaaaattttatgtttggttaaaaaatatttgttttattttgctacagagtctgttggagcatctggtcaacgccctgttttctgccctgtacacaaacaagaacagttgaaacttttctgtgaaacatgtgatagattgacatgtagagactgtcagctattggaacacaaagaacataggtacagaaatcataattgcttaccaggaaatactataaaaagtgcttgtaaagtcattcttcttcttaaagcaaatattgattatatgtttgtgtcttaatcttttaaatctgtattttacatattttaatttcttgagcaatatatgttttggtaaattatttaaagatttccacatttaaatctaattgtcttatgaatgtttgttaaaatgtatcattttgtaggtttgggtttacaagaatggagttatattatgcatttgtttgctactcctgtgattcaaataagctttttcttggtgtcctatagtatttttggctgtaatctacaaaagcagtattcttttaaacatcaaatcacaaatacactgatttcatgttacatataaaatttgtagaaaagctagggatttatgaacaactaagcagagttactgaccctctaatacatacctttgtattttagccttgtaccctcag

SEQ ID NO: 55645 - DNA, 1062 bp, Homo sapiens
catggctgcagctcgaatgggctaggcacagacaggaagtcagacaaatcagccctagcccccagcagcagcgctgctcctgctgttacctctcacaccactgcactctctagccccttattaatgtgtgcacatagggtgggaatagagatgaataagagataggtgcatggtggagagaggaactagacttaggcatggttatacttctccagtttgaggtttctggcacgacttgacaatctttttccatccagcttctttttcctattctttggataattcattccagtctttcaacacttaactcacaggactctcttatcatttggactgggctctgacttaagtaattagaggctgtaggtataaattctctcaactcccctctctatctgaaaatatatctgtaatttttcattattttctaagggaaaggagagtggtgttgatgaccaaagctttggtgtgactgcttgagaatattggaaagagaagctagggctaaatgaaaagattgttaggtcatgctaagagtcagctgactttaagcgcattatgtaattttaaaagtaaattggtacagtggtaacaagttaatcataaatggttaatggaaaagtagttgatccttgtttgacttgtgtttgtttcagttacacagacaggtatgtatttgtgtcctggcctttgatgtaaagtgtacttcctgtggtttgcagttgaaaatgtttgaaagctgtctcctaaatttgagagctctgtttcttctgcttgacttgtaaatattggtgtaacaagggttattgtccttgataatattcttcctcagcagtcataactacatttcacatttgagttatttacatgctggtagctccctccacacccttcagctccagaaatatgctagttaaacaccatctatccaaaacttactcattacatttctggctaaaacactttttcctcattttgagtagttatgtaattatctatgcattacccacaccaggaacttgggaatcatctagaatttctaatttgtttcctcattgtaac

SEQ ID NO: 55646 - DNA, 1262 bp, Homo sapiens
gtggtgagttaattaaaattttcccaattaaatgagaattttattcttctcattggtagacctgtattacaaaaaaaattactcaattattatattttgaatttgtagataaaaattgtggaaatttttctttcattatgtaaatacctacatactatccttgatacttttttcctaaacaacctaagttatttactatgccttgtgatgccacatcccatgttttcatttgatgggacatgttaggtgttggttatgaatcagatttcaggcagtgttgtgtgtacagcctgacctgttgtccacaatagatttggaagaatgagaatttacagggttctacttctaacatcacaaatgactgccagaatgaattccacaaatgaattttggaccagtctggcctgtcatccatgtgtggtttattaatagaatgctaaaattcaaattacacaactcatttcttttcccatcactgagggttggcttaaatactatccctcacaaagtaaatacttaagcaaaaagctaatgtcagtcaaaagatccccatcagttttttgtctgccgtagggcagatatgagggtaaggtattgagaatcatttcactgtattactgtgcttatgaatctgaagtattgaaagtaataagagcactgcatttcagctgtccttcgtatattacattttctgctttgtgttgaacattaccttcatttgttgtgaggcatataaaagggatgtatgtaatgaaccttggacccactgaatctcgctggagaggtaagagattatattaaagaacagtataatacattttataataaattagtaataaatttgatttcagtaaaccagatatttgttgaaatatggttcaaaagaattagtcatagctgaaatttactatttctgctcttaatgttggtttggaggtgattccctctttttcatttgtgtattatatgattttagtccttatgcttttggctgtaatctaggctgctcttgacatccatccaattttctcttctctgttttccttcctcaatttatgttgaatgctttcaaagtagattatctgaattaataatggcaggaaagaactagctgtggataagtttatttgaatctgtctagacttctgttccttgtctgtaaaataacatattttgttatgttttatcttacgttaaagataaaactttttcgtgttatcttatttgcctataaaaatcctctcagagggaagactcattct

SEQ ID NO: 55647 - DNA, 1027 bp, Homo sapiens
agatcataagatagtaggtggcagatttatacatttatagttcttcattttggagtacccataacagttcagaaaaagcctccctttagtaaaatgtaaaaatgaagaaagtacttattaactgaagttaaacttctaaaaataggtcactatagatctactgatttttttcatgtttatgacagtctatctaagccaacttcagagattgggctcaggatggtagataaattaacctctgtctcttctttggccacaaattgcacatctatccctagccatttgactcaaggggaagtgggaaaaagaacaaggatggataaacataaatataccatttttagaaaaatatttaaagcctatgccccagtgatgagtaaatagcatgcactatatggtactaatgagtacatttgaatgcttatatgctatttatgttccttttgtgaattatttgtccatgtgttttatgtttttctttagattgcttacattttttgttttgatttacaagaattcttgacaaattctgtatactgatcctttgttgatgatgtaggttgaagatttattctgagcctatggcttggtgtggtagccagcctctaagatggccccttgttccttttctcctgttattcacaccgttgtatggttgctgtccagttgctcaaggctggtctccgtgaccaagagaatataatagaattaatagtgactttattaaaaagtcattaaagccatatatacagttttttccttgctctttgaatcccttgttctgggtgaaaaacagctgtcattctgtgaaagatactctagtagtcctttaaagaggccatatggagaaaaattgaggtcttctgcaaagacccagcaccaacttgccagctatgtgaaagagccgcttttgaggtagattctctatcctaatcaagctttcagatgactgcagtccttcctggctgacatcttgactgcagccttcttagaggcactaagccagaactgcctgccaagtccctcc

SEQ ID NO: 55648 - DNA, 1232 bp, Homo sapiens
tggaggtgagtcctcagtacaatggttgtggcacaatagaggaaaggtcagggaaatttcacaggaaaggaaatccatgaacaggtttcttgaagaatgagtacctcactgggttggagggtattcagggcacaggacacccttctacatccctggaactaaagactgtgtagggtgattggtggaaattagattggattgatgggctgaaaagataaaggtttcacagtctcttaaactcttgggatccaggtgtaaggacttcagaatattttgggatttttcttttttctggcaaggtctgttatgtgagacttttatcagggtctgagttaactctatcaaacacgttaatgtttctacattgaaacacgtgaatgtcacgctaatgggatagacgataaataacctcccagcattcacagtgggttctgttgcaaaccaatgaaaaaaattaaaatttcaaagcttttgaatttcgggactgtaggtaagcgattgtggagctgcactaaagggcttggaattcatcctgtagagtgtatcctcgacattgtggactgaaggatgttcctggagggctttcatatcaagaggataaaaggatcagatttctgatccagaaagatcacttagggcacttgagggatgagggaaggcaaggctggagacaaggagaccagttaggagaatcctggcggttatctaggaaagaaatcaacatttggaatgggtagtaaaggaatgatatatcaggtattacagaatgaagcattttggtttgggggaacggtagggtttggaaatctactttgccatctcctacttacgacttgggcagatgaccttttcttagcttcagttttctcatttgtgaaatgggaaaaaagtatataacctcatagggttattgagagaatgaagtaagataaaatgtgtaaagtgattagtacgtggtagttactaatgaaatggtagctagtatattaatagtagtaactaatagtggctatgggaatggagggatggggggagtgtattgagattggtgtgagggagacaaacgtagaattccacattttttgtttggtggatggcaatgctattaatacatattcagacactgaagcagggctggggtgagggtgagggctggggtgtagggaggataaaatgttttcagattgggatgttttgggtttctagcattattggtacatgtaggtaagaat

SEQ ID NO: 55649 - DNA, 1095 bp, Homo sapiens
gagtgtagtggcgctatctcggctcactgcagcctccgcctcctgccgggttcaagccattctcctgcctcagcctcctgagtagctcggattacaggcgcacgccattacacccggctaatttttatatttttagtagagacggggtttcaccatattggccaggctgcccacgaactcctgacctgacctcaagtgatctgcccgcctcggcctcccaaagtgctgggattacaggcgtgagccactgcgcttggcctgaaagcttctactaccattgttgtaagggcatttgtcacccagctcaacccaggacacttaaagtgggacctcagaaggacgcagtattggttatatccgtggctctccaaactgacatacataagaatcagctgaagggacttttccccctccgtcggctctctccctcacttcctgattcaggtctggggactggccctggcatctctgctttgaaaaactcctccgttgattctgatacgtagcaactcctgagaatcaccttaagatgccaaaaatagctgttaaagagtttcttcctcactcggtcttttcagcctatttctgatagatcctcagttcaaaaacaaaaagcaaaaaaaaaacaaaaaaaaaaaccaaaaccaaacaaacaataagccccgctttagtgctccacggccacccaaaggaacgcggctggtctacgcacagcagagacccaggaggtcccggcgatcgagcggcgcggcaggtgaaacttccgcggagacgcccgggacacgctcgcagggaccggaaccgtcccggctaccacccttccgtatgcaccaccgctgtgtcggagttcataaccaaccccagccaaaggctacccagcgtcaacggcctctggctttaaaaaaaaaatctcccttcgggttaaagagccgcggcactgacgcaaggaactggcttcgagggtccgggaccgctccgcgcccgcgaaccgagttcccgcctccctcgggaggacgtccgtgcgtacgtgcgcgtgccgcaaccgccctccttcaaacgcgcgacgcgagggcgggggcgccgcgtgcgcgcgcg

SEQ ID NO: 55650 - DNA, 1467 bp, Homo sapiens
ttttccacaattgtgccttgatttttttttaatggaaagttgaaagtgaaggttaggccaggcatggtagctcatgcctgtaatcccagcacattaggagaccgaggtgggtggatcacctggggtcaggagtttgagaccagcctggccaacgtggtgaaaccccatctctactaaaaatacaaaaaagtagccagctgtggtggcgtgtgcctgtaatccagctactcgggaggctgagtcaggagaatcccttgaacccgggaggcggaggttgcagtgagctgaggttgcgccattgttctccagcctgggcaacaagagcgagactccgtctcaaaaaaaaaaaaaaagtgaaggttagtgttatagctctgggtgaacatgtgtatacatttaaaataaaatcttctaagagaagttttacattgagtaatttttttcttttcttcccccccattctagttgggtatccctggtcagtaagaattatgagattgaacggactattgttcagctagaaaatgaaatctatcaaattaagcagcaacatggagaggcaaacaaagaaaacatccggcaagacttctgaaaagacaatttagcaggtagaagaaaagttgggctttcacaaaaggcatctgaacttttaatgaactttgaaggacaacagcatcttcccaaaaccattgatgtttaagtgtttagaaatcatagaaggtgtaggctgctgtggtaattctatttgtatatctcaacagaattaaaatgtctagcttggtggtatttttatagccataaaagaaaatctttaggctttcaaaataaggatgactttagaataatattgtgtcatagaattaattttcagccatgtggaccatattttgtatccaaggatccttatttaaagctttcaacatgtacaggaagttggaaatttttggtttatgactttgtctaataaagagatagttctaaacacattcttgatcaccaaacaacttcagaaagacagtgactgtacagttatcattatcatcatcatcgtcatcatcataggtaacagttatatcaagcttaatatgtgctgaacattgttctgaacactttaggtagatgaactagatgtatgtgaataaaaattatttggtcctcacaaaaacctcaggaggcggttactgtttttctcatatgtggacatgtaacagacaccagttaaataacataacttgccagagttttatagctgaaagtgtcagcttttttatagaaagttgtcagtcaggttttgaacccaatagtccagctccagagttaatgttcttacttctctacttgtaaggaattaaattgtgtaaaagattcctgcccaattcagaaaaaatatttgcaacatatcaaaaggtagtgttgctaggtgtggtggctcacgtctgtaatcccagtgctttgagaggctgaggc

SEQ ID NO: 55651 - DNA, 1032 bp, Homo sapiens
gaagttaaggtaaattgttttttcctattacagaatgaagtttaagtgaacctttaataaatagaaaataggaggaaaaagaaagcaaagagactgcagccagatgaaagtaaacaattgatccactctctttgttcaacatctgacactgggtttgccctacctaagtagaggagaaataggcctgaggtctgaaaacatctctgccacttgcagcttgcaagtctgcaaacatagaaaggcacttttagagtgggaaaagttgcagaataacacatataatctgatttttaaaaccaatttctacacacacatataggaaagcctggaaggacacccagcaaaaactcaacaggagttatcaggaaaaaggagacatgcatgagaggggggacttgagacttgtaatctgtgtgtgcttgtgtgtgtgtgtgtgtgtgatttctcacaatgagcatgttttatgaaacttgtaatcaaaaaataattagaagaaaggtaatttctacagttagcctataactgtacataatattgttctcatgggattaagatattctcttgtgttatagagttttctgttgatttaggtcttacattaaaatgtaattgggttgtataaataattttttacagaaaacatattcaagatttaaactggcagagaaagaacatgcaactcacagctggatctaaattgagagaaatggagtcaaagtgagtatctataattccatcatcttttaaattgtttagccctttctaaggtcgattcaataatatgattcaaatagcattcaaatgggatgccacaggtaacaaagaaatgctattttctgaattcacccttccccgtctctgcctctttataaggtgttaaagagaactataaacgagaattgaaccattggcgaaggatcctttgctaaattgaaccattgctaaaggattctggtcttagaataccctgtttttagtctagtatttttggccttgaatagaactctacctttattctccttttaaacggaa

SEQ ID NO: 55652 - DNA, 2078 bp, Homo sapiens
acagggcattacatggcaaggtaggggcacacaagagaaagacaaactggcttttataacatacccactctggtgataacttattaacccatgaatggattgagccttcataacccaatcacctcttaaagaccccacctcttaatactattacattggggattaagtttctgtatgaatttcagaggggacaaacattcaaaccatagcactgtcgaactgattctgatatgcttctggaattaagaaccactggtttaggattaatccttttctctgtgggctccttaatacatgccacttttcctgaatgtgaagtgagtgagtgagtgtgtgtgtgtgtgcttcagattctagagagcatttaactcagagaagaattagggaaaggtaaacaattcattataatgggtagtgtagcttaaatctgttctttggtgattgttaatttttagttgtcaacatgatcttagaaatcttttttctgatttacacatcagactgacataatgagaaatgaatttgaaagactggctgctcgacaaccaattgaattgctcagtatgaaacggtaagaatattaaaatggaaattaaaatttagtttgtagtaactcagtaatgagctgagatttgtgaagaatgtatttgctggctaatattggcagtgttggccgggtgtggtggctcacacctgtaattccagcactttgggaggccgaggctggtggattgcttgaatccaggagtttgagaccagcctgggcaacatggcaaaaccccatctctaccaaaaataattaataataataataataataataataaacgtacctgggtgtggtggcacgcacccgtggacccagctacttggaaagctgaggtaggtggatcgcttgacaccccccaggagatggaggttgcagcaagccgagattgtgccactgcactccagcgttggggacagagggagacccagtcttgaaaaaaaaactatatatatatatatatagagagagagagagagagagagagaggcagtgttgaaggactgactgggtagtatgaagagagaatagaaggagtcatatcgcttctcatttttttctctaccggcgcatgggtatgttagtggatgggtgggtgtgagtattttacaaaaatggtagcaaacttttttgtctactgctttttccccttaatatattactgacatcttaatattattaaatattcttcagtaacatttaatagctaatgtaacaatcttttatgtgaatgtaatgttgcttatttaaccagttcacattgaagtgaacataatggtgctaaatcatatttgtaaattgattgttagcatatatcggtttcttattattgcaaggtttacatccttagtcttctgtagtttttatactatatggagactcatgggacattctactgagaagagatgtaaaggcttggcagtatagatggttttattttattttgttgtttaatttcagatatgagcttccagccccctcctctggtcaaaaaaatgacattactgcatggcaagaatgtgtaaacaattctatggcccagttagagcatcaagcagttagaattgagaatctggaactaatgtcacagcatggatgtaatgcctggaaagtatacaatgagtaagaacctttttcttcatcttctgttttttttgttttttctcttttctttccatctcacccaaagttttagtacattttaaaagtatgggaggtgctgggtgcagtggctcatgccagtaatcccagccctttgggaggcagaggtgggtggattgcttgaggtcaggagttcgagaccagcctggccaacatggtgaaaccccatttctacaaaaaaaaaaaatacaaaaaattagctgggcatggtaacgtgtgcctgtaatcccagctactctggaggctgaggcatgacaattgcttcagcctgggaggcagaggttgtagtgagccaagattttgccactgcactccagcctaggcgacagaatgagactctatctcaaaaaaaaaaaaaaaaaaagaaaag

SEQ ID NO: 55653 - DNA, 1365 bp, Homo sapiens
gtggaaggatcgcttgggcccggggggttgaggctgcagtgagctatgatcacgccactgcactccaacctgggcagcagaacaaagaccctgtgtctacaataaaaaaggaaaaaagtctcgcacagaggaagagaagattaaggggagaaggtgggagtaagcagaggtgggaaaccagtttatctctccccgccaaatgctgcagccagttccctccaaaagtgttaaggggctccctttccagatatcaatgttttggaggaaacgaaaagccccaacttcaaatcgccgccattcgcaggcaaaaaaaggggcagtaagcagaggacaggaaattgaggcctttcgctgacgcagacaagccaagacgttacgtcacgtccgcccaaaacaaaccagcccggcaatttctagataccgggcggacccgccttcaaaattagcaactgagcatgcactaacgtcaatacggagggaacgtgattacatcagtgtcaggcgccggcgtaattaaatataactgagtttacgcagacgcagaaaacgcaggcaaacctgaggtcctcagaatggcgggcacaggtttggtggctggagaggttgtggtggatgcgctgccgtattttgatcaaggttatgaagcccctggtgtgcgggaagcggtgagtgcggggtgtctttgtagctgactcactgctagctggctcggtactgaaagaaacatgttacaatttgccacttctaccctggtccctattctctttcttaggctgcagcgctggtggaggaggaaactcgcagataccgacctactaagaactacctgagctacctgacagccccggattattctgcctttgaagtaagtatgtcttgagcctaggtgtgaacgagaattcctgtgaacctttattttggattgagagctttaaattccagttttaaccattgcctgcatagctactacttacctactgtataggtgtcagtctattgaaaacaactagatagataagtcttctccgaggttcttattctaagatccataggaagactttctggggctccacaactcacttaatgcaaaaatttgtggctaccattctttgagataggatccatgcgtaaattctcaaagggaccctctcctgccaagattcactctacagcaagtgatctagggttttttaatatgtataagcctaattacctaagctctttagaaccactggagagtggcatattaaagtctagttatttaccaaatgtatgtgatacgactgaaaggacaaaccatatccaagtgtatactacttttttctcagccttctccttttttctgtaatctatccgatgttttta

SEQ ID NO: 55654 - DNA, 2198 bp, Homo sapiens
ggcctcatcacaaaagctttataatcagatcagcaatatagccttaaataggctgaccataaaccatgatgctagtttcaaagtgttttggagaaaaagcagcatttttctcaaaatttgggatccctcatcagagtggtctgtggggccatttcccagagatgaacttccctgatataagtttatttatttcatgatatgtttgcatatcatcattattaatcatttctaggacacattccttggagaatcttataaaaaccatggtcctttttcccagaaaaatgtatttacagcatataaataaattttgcacataattttaggctgctcatataccccatgaagtctatctttggtactccagattaaaaacacttggtttagagggacttctgaggcaaaagaggatttcttacaagtctctaattttctacttcatacagaaacacatttatgatttttcagtaatagttaattagtatgatacaagagaacaggggtgtggctagcctaaaataatgaataacctatatgctacgatatttatattttgtctttgaaatatatgccccctaattaggccctgtccttcactagctgacagaccatggacaaattaggccttaggctgttatttcatctttatacaatggggttagattagatcagtggttcccagctctgactacattttataatttccagagaacttaaaaaaaattttcccctgggctccaggaaatctctggggagaagccaggtgattttaacctatagtcaaggttgaaaaccactggattacatgatgtctgagttcttttctgccgctacaattaactagacatatggggtttggggttcatttttgtttttgttttgggggttaaacacatcaactgagtttgagatgtcagcttaactcttgggctgttctgaatgactgacctgttaatcccttacctcaaataatgtacaataaataaaaatgaattgagcattcactgtacttttctttccctttaggaagcaaaatgaaatttctgcaaaagaaatgaaatctctgattgtctccatcctgaatatacaacagaaagtgccaaagaaaatatttttctaagggtcaggatcccatgaagtattctacaaaattcttgaaattttaaaaggttaaagagcgagtcaggctgttagaggaggattctcctgttgctgctgtagtaatcactggagaattgttgggaatggtctggcaccatgccatctttactctgtctccattttttttttatagcagccttttctatgtgattcttgggctcattctctgttttgtgctttgtctgtgaaagtagttgtgtttcacaaggaaaagccttgttgttgttacatttaaaaaatagctcaaagatgagaataatgagagaaatgctgagtttaaggtagtagagagacatgatggaaatggagaacactagccttatacacataattctcatcactgaactatcatggcccctttaaacccatgggctgtttgacctgggctaaggaatagactcatcacatatctccattgttttgccttatattatatctaggggaatctcacttaggaggaagccctacttgtaatattataaggtactgttattaagtaccttataaaattagacatcttgcaactcctcctccaaattatgtggcatttgagtagtttgcttgtgcctcacatgtcaacattaaactttgtggaggctggatgcagtggctcacacctgtaatctccaccactttgggaggctaaggcaggagtttgagggtgggagtttgagactagcctgggcaacatagcaagatcccatctctacaaaaacattttaaaaataagtaaataaatttaaactttgtgaaattatagctaatatgaaaatgtcctttcaagggcatgggagccacctttattttttagtgtccaccatgtgccatgcactgtggtatatgtatgcatatcatctcaaccaatccttaaatcaaccttatgagatagatatttgcatctccattttactaataaactgaggctgggtgctatggctcacgtctgtaatcccagcactatgggagtccaaggcgagtggatcatttgaggtcaggagttcgagaccagcctggcaacatggtgaaactctgtctct

SEQ ID NO: 55655 - DNA, 1062 bp, Homo sapiens
tggggagaaacagacacacataaagttttagaaattgtataatagaaatttgtacaaggtacagtgggagcaaaaatgaagtgaccatttattctgaatattgaagtggaaaggaagagttcataaagcctcctcagagcagccctccgcatataacctgtatgtaggagtgtgagctctgaaacacagggtgaaaagaagagtgtttcccaggacattttcagaatcaattagctcatcatgtttgaaacactatttgtggatgatcttcataatataacagaagacttgtagatgagagagatctggtggaaaagtgccagaaaattttacaaagtatatatttttttaatatagttaaaatatacaccataaacatgaaagattcttcatgtagggaaggagacttcagactgactctttagccaaaatatatacagtcacttgtggaattttggagaaataactagggcatatttgagacttaatccctcaaatctcaaacaaagaaaaatctccatttttttttcttcttaaggtatctgatgaggatgaaattctaccaccaaaacttcaagctgccctgatgcagattttggaagaacgaaatgaaatcttgactcaggagcagaatttttcacaaggtatgagacaagtgagccaaggacttaaggttaagggttaaggtagtaaatatttactgaatgcccagcactatgttaaaggatataccaaagtagcattagattgcctgtgcgctgaaaatcctataatcagcttccttgcttatcctcagtatgccaggtcctcttctatttcaggacctttgcacttgctcagttacatttatagaatgctattcccgcagatatccacatgactcctgccctttcttcctgtaggtccatgctcacatcatcttctcactgaggcccttcctgactgtcctatattaaattgtacccattcctctagtgctccttatcctcttccctttgctttaattttattcaaggctcttagcactatctcatattctacagcataagttccgtgagaaca

SEQ ID NO: 55656 - DNA, 1835 bp, Homo sapiens
ttaagagttacctccctggggctggagatgaggtaagttagctcattttgaaaagatttgatagcactaaaaagcaggacttacactagtaggcagtttccagagcccaaggggatagatttcccttttccataaactgtaaagaatatgttttatttccataaagcactggagaaatatccagttgatctgtgacatagttcttcctagacccaggacccagagattttctaccatacatagactgagtccctttgtaatgacaatttcatgtgataaatgaagactgtatatactattgtcagaaggaatacaggatcttgatttacagcacaaaaataagctgttgggtcctggcattagtataggaagcttcacagaccccgtgtagcagacctttcttgaatttaacttatataagaataacaggatccatagcgttggcactagggattgttttccaacattagctcacctgattcaacttcttgcatttcagtccattgaactctgccgaccactagattcccgattggaacatgttgattttaaatgtctctttaagtgcctgagtgtgtgtcatctcatccgggtctgtgcctctctccttttggagcgtagggtaatctttgttgccaacagcctaaggtaagaaataagtgaaatatgttacttcacactggtgttttatttgttccaaattttaaaattggggcatttttttttattttactattatactttaagttctagggtacatgtgcacaacgtgcaggttcattacatatgtatacatgtgccatgttggtgtgctgcacccattaactcgtcatttacattaggtatttctcctaatgctagccctccccccatccccccaccccacgacaggccccggtgtgtgatgttccctaccctgtgtccaagtgttctcattgttcaattcccacctatgagtgagaacaaaaatttgggcatatttttgaaatgtaggatcagtctctcagttatctagtggtatatagtggcatggataattttaaatggtaaatcatcaaaaagccacttgcgttaggctataccaatgacttttgtgggttgtaataaatttcccttttaaatgcattttgcttaccctattgtcaaaagttggtaatacttttctaagtacactaatttttcgcatgagaaattgtggaaatgagctggattaagattgaacattttcagtaaagtaagtttaaattttaagtaaaatgttaaaaaattaatgactgtttgcatagtttttaatctatgatcactaaccagcatcaatttttaattctttaacataataactgaaatgtcctccttatgttactctatatatgacaccatttgttttctcctctggctagcaccctgtcaaaatgtggccatgctgtggtagctacactgtatccgttcacctggcagcatacctatatcccagtcctgccagcatctatgattgacatcgtgtgctcacctacaccattccttattggaatcctgtcttgctccttaccacagctccaggacctacccattgaagaggtgagatagaagaatggaacctaatattggagcattgagaagtaaaaataagtgatcttaagagtggtggaattgttattaatttagttattactattttatgctatttataatatttctattaaattattataatattgctgtttataatacttctagtattaagatgggaaaattcgatagtacacataaatccaaagctgtatcttatttacagtagtaaccttgggctcattcttgtgttattctgaagggta

SEQ ID NO: 55657 - DNA, 1563 bp, Homo sapiens
tcaaggctgcagtgagatctgtttgcaccactgcactccagcctgggcaacagagtgagactgtcttaaaaaataaaaataaaatttaaatgaaaataacccgattaatacctagagtggatgaataagaaaacaaaaggaaccaacatcaacagcttatctcatacctattctctcactccagtacaaggcaagatattcttaaggcctgggcattccttaggaggagtgtaacttgcaatgaatgtaatattatgcctcctcttagatcacttgaaaacctggactctagttttcaattgttttttccatggagaatgccgtaagtggttgtttggatcctaactagatcacaaaatgactactgttggactctagttttcaattgtttgttccatggagaatgccataagtaattgtttggatcctaaactaactattggctcttttttcagtgaaacattctcctttgtcttgactggtgaagatggaagccggtggtttggttactgtaagaagctcttggtaagtatcagatttgtgttacagacagggttggtcaaggaataattgagtcagagtaggaacttcagaaacactatctctagatgagtttgagggatgctcaatgatctgtgtattaaggaagctgtattagctttaaacagcaagaggaaggtgggggttaaccatggagtgttctagaagagaaggggtatggatttattttatttgtttataatagaggaagtaactgatgacatagtggctgaatctcagtctggatatatttgaaatagagtacaatgagctactcgaaggagctctgagttactcaccaaccatattagggcttttttcttgcttgggtggcttcactaaacctagaataaaacatgctatcatttttagcacttttcacatctttcagtgttcactaaagatgagagccttggttactgctccgtactaaagagtagtaaaagataattaatagtccaaattagtattaataaaaatgtatgcggcttgatttttttgttgttgttgtttttatcttttagccagtaggcaaaggaaagcgactccctgaggtatactgcatggttagtcgcctaggctgcttcaatcttttttcaaaggtgagtggagaatgagctgtatgaaaaatggtgtcctttttgagctcttaatattaagtggcatagagtttaacatgttacttcagaaaggttccctattagtaaactaggaaccacgtgcctgaaggcttaaacttacatctctaatccatttgctcttgctatatcatcttcattttggtttgctagaactttcagcttaagggagaacatagtccaaagcttatcttgtctcgtgtctttcttagaccaaattgcaggatatcattgtcactgtcaccttctttgcccctcccttagtgagatgaaaaggggcttctcctttaaaaataagttgatttatgttagtaacttttcttcagggtataatgatacctcccaagagatatgatgcttatttaacttttattgattgcagaag

SEQ ID NO: 55658 - DNA, 1144 bp, Homo sapiens
cgactaggtttttgttctcagtacattgaagaatggatttttatcttataccccacggttcataaaaatactgggttcccatttagtgtgtgaatcctgaattaagattttacctcttgataggaaacttttcactaatctctcttacagtagatgctgagatatccacagataccatttctaagtaaaaacaggattcttttttcttagtaactctgttctcagtgcatcctcagtgatttccagaattgactttttaatttagttaagcagtacaaaaccatgctgaggcttatcagcaactactcaggcttatcagagaccttttttcctgagacaaggctgagttttttatttctattccccacttacatagtataatttaagtcacctatggtgttatctttttcaggatgatcatggctataagcagtccaaagacatggaagagagacttaaagttattccaaaattttgttttcctgattcaaaggactggatgccaacctcagaactcaagaggtaaatgggctaatttatctgatttctattcattagacctgcaaaaataaatcagagtatttgagaaatgggtacagccattagtgaagctatgtgaatactgtggcaagtcaaggatgtggtaggaggaaaggaagaagcagaactagaacatttcctatgtggggcttaaaaaaataaaaacgtggaataatttcagtgtcaaaaggaaaacaaatttgagagtctcttcagtttgccagttctacaaaaaaaaaaaaaagttctattttacatacaatcagaaatgctcccaagtggacagaaaatgaaaaaagacttggattttgagactcaacctagaaacagagataaaacagagcagtgtcttcatctttatcttctttcttcttcaaattaacagaataatccacagcccagcttttatgttcctctgtggaacctgtacaaagggaggctccagtttgggaagtgtagtatattaagaaaggaagttattaaaggatttcttccaggtatctagaggaaattactacttttaattaataaactatcataatctctgaattctgcttgtaaatattaatagatgcctgctttgttcaaaactataattattgat

SEQ ID NO: 55659 - DNA, 1466 bp, Homo sapiens
ccctggcctgggctggtggtgccacttgtgggtgactacttggggattgctcaactgctgtgggttggaatggtggcccccatgggaaggggagatgcctggcttaacttcccaacccctagtcgaaacacagagtctcaattctgcagctacccagagaggaaacccagcaccttgtgggccacttgtgtaccggattgcagactgcagcacctgggtgtctgggagagtctacagtcatcccccaggatcctcatgtctgagggagtgtgacattaaatagcaaataaaaactccattacagaggccacagaagaaaaaagatgttttatatttaatttgttctgctttttgaacaaggggctccacattttcattttgcattatgctatctgaattatgtagttttccttagtaaggagtgatccctttaatagggacatttagtcactctcctgcttattacttggacgacttctttcatttcagttatctgcttggccactttaggactgttgggtttataaccctgagttacatgtttcactaaaaaagctggtgaagtacaactgtactggaatctaagagacatttcctgcatggattctcattttcaaaaagtcctcaaaaatatccctgcagtaaataatcagtaagtttaatttcttataaaatttctcaatgtagcctgaaagtacaatgtcacagcactgttaagtgacccagaatggctacatagtttgtttttttttaagaaattaaaggagctgtgcacagtggcacataattgtaatcccagctagttggccagctgagacacgaggatcactggagcacaggagtttgaggccagcctgggcaacatggcaagacctccttctcaacaacaacaaaaaagaaattaaaagggagatcattgttattagttatctgaaggcaatatggtaattagacttaagggcttgtttttatagaggacaggtcatactaatttctaaatgtctggtttactgaaatttagactgtcatataagtacagtaccagatttatgcaaaaggatcttctatgctaaaattttacaagaagttccaaaccagcaattaggtagcaaagattctatgctaaaggaaatgattatatatggggtggattctcaaaatagtatcttttatgttttctttttttgagacaggtttctctctgtcacccaggctcgagtacaaggcgcaatcatgcctcactgcagcctcgtcctcccaggctcaagaaatcctctcacttctcagcctcctgagtagctgggactacaggcatgtgccaccacacccagctaacttttctattttttgtagagatggggtttcaccatgttgcccaggctggtctccaactcctgggctcaagtgatgcgcccaccttgggctcccaaagtgctgggattacaggccagtgcatctggccgtat

SEQ ID NO: 55660 - DNA, 2170 bp, Homo sapiens
tgtctgattttttatagccactcaagtgtaattatttaagtaactttgatatctctgacattgaaaaaggaaatatctatttgttatttataggcatttatattccagattattgtgctgtttactttctagtagaatatagaatgcaccatgcatttctgactctctttgtccaagcacttcatggtgccttcatccttcatctaacgatgatgctttctagttatcacagcaagttatctacttcctatttaagtgactgtcatactaagccatggaaaaagtagaagacatgcattatcaaagctgagtacagggcagttccagttcctaatctgacaccctaattttatgattaatagtcttgtgctccctccactggcctgaattgctttaggtgtttgattctgtagcctgactgaaggtgaaatttaataatcatcaggttcagcctagatgtgtgaagatgactaatttagggctgttactactgagaaacaggacctaaaattttcttgacttgaactcagccctttgaggtaagtaaagctttgactagagcactgaatgtactggataattccggggagccattccaggatgcattttttaaaaatgctcttaatattttgatctatagtataacttcttttgggacagaatgcattgtatcaaaaagaaaggaaagacaattagaggttgagtctatcagtggctcggaattatacataagcaaatcactgggacgtgtagactattttttctgcaagtccacagtttccttcagtggggaccaccccagattgctcaaaatttagagataaatgagaatagaggatagatgctatccagttttaattggtattgctatgactgtttaaatagtatgcttccataattttattcttttaagaaagtcagctaatggatgtcttcttccacttaatttttttctcttgtgtgtagcaccatttactgatacaagtatatattcattgttagtaatatgtggcaaggagagaagggaactggacagtttcttcaatgtgaggaaaatttttattttaatttatcaaactccccctttctgtacttaggactgaattattttatcagatctctgccccctgccccgtgccacctggcaccctgtgatttcatggcattcccagcagtagcatctgttgtcagtctagcgctttttcgtgacattttccatgtgtcctggtttgatgccatgaaagatgggatagcatagattatttgttgggacatacataagtattggttgggacatggaatgtcagtcccactgctggccagaagtggagtgaggcccctgcacacttgtgagggtctgcacttcttccccctagtatgtcacagccttaacaggtatgtctatgtggcagatgctggttattcaacattcattcagcagtgactgtgtgaagattaatcctatgtgggtcatgacctctggatgctgaaaggaaggtagggctacagagaaaaaaacatttctccatgatttcattacagatcgccataaacgcttagcacaactgcaaccgtcttccaagaggaatcctcactaccagaccttggagcgggatcttattgaattacaggagcagcagctgtttgaactttttgtggtggtgtctctacagaagaaaccatcaggaataagctatattccccaggtcatacaacaattccctggcaaggtaggcacaaggaggccaagaggcattcaggaatgttcctgtgtctctgtgtacatgtatttcctgtcctcttggtttttgttatctcaacaagtttttaccaatactgttcttgtggtaggatctggtggctttgaaaacatcttatgttaggtatgagctgcaacccagcaaaacaaagcaaaacaaaacaagctcattttcctagttagttttttaaatttttggctctgccatttaataatctttaacaagttacaaaaccttagttttctcatccttaaggaggggaataataaatgtgacagaatagggtagtggtttagagcatggactctgtgtgaaagctctgcatttcccacttactagttccgtgactttaagcagttacttttctttttctttcttttttttttttagatggagtcttgctctgttgc

SEQ ID NO: 55661 - DNA, 1051 bp, Homo sapiens
gaggcaccatagaagaggtaggctgacttggtaatatctctctcctagttctcatgttttcctgttattctaaatttatagtctggttggtgtttagattcttgtttagccctgttggtgtttgcctttgatactctatttggaatatacaaacaactatgtggatatagaaatagaatccactctgaactagactcttaaaactggtctgaaatgcaattagtttctagaattagggatgagaggggagccgaggagtgaagtagggtatgggaagaagatgtagtagaggagtttcctctttgagctttttactctcttttggtaactatcccaacttgatacaaccaagtggtttggagaaaggctcagcagctttattattccttactccaagtccccaggtttgtgggtttacattgttctcatcctcatgtacttcctactgttggacaatacaaatggaaactccttctctcttttcaggtgaaaccagtgggaacgaaagtgatgccgagtatctgccaaagagtgagtgagtcaatggggctgctcccgttgttgtgatgatcatgggttaggtggagtggcacctacctttgtgactaagcatgttttttcccacatgaagttccattttgtagatgatttccttattttcagagcctgttgaggtttggagaattaaacagtcagaattaaacactgtcagatgtttgacagcatttaaagtctcccatagtggagtgaggcaaaacagtatggttcttatgatggaatattcttaggggagcggcagagagctgcatgtccagacatatatgcagtagtttcctggcagccaaaacagagtgtgtgaatcatcctctgagcagtaaatatctgattttttttttttttttttgagacggagtctccctctgtcactcaggctggagtgcagtggcgcaagctcggctcactgcaacctctgcctcccgggttcaggcaattctcctgcctcagcctcctgagtagctgggattataggcatgtgccaccacgccaagct

SEQ ID NO: 55662 - DNA, 1232 bp, Homo sapiens
gaaacctgagaaacttctttacaaatggtgagaaagaaattatgttatcttcatttgaaatgattttaaattaaatataggataaatacatttctggaatagctttgactttgtatgataatacaggcattaactagatgatgctggccaggtgcagtggctcacacctgtaatcccagaactttgggaggctgaggtgggaggattgcttgagcccaggagtttgagactagcctgggcaacctggcaaaaccccatctctaccaaaaaaaagaaaaaattagccggatgtggtgacacgtgcctgtagtcccagctgctcaaggggctgaggtggggggatcacttgagctcaggagatcaaggctgcaatgagccatgatcgtgccactgcattccagcctgggcgacagagcaagaccccatctcaaacaaacaaacaagcaacaacagcaaaactaggtgatcttaccagtacatcttctcctgttttagctccctccaaaacctcagttccttcaccggaagactatggaagtaaagaactcacaggcttatttgcggtcaaagcttacaaaagatacaactttgccggtcactttaacggaatggaagcttttccgagctggtgaagttgcaaacacgaaaaggaaaaatcttccaagggtaaagactccagtgctttcattctttgactcttacttcagcatttccatgaatgagaataagtaaactttagaccgaaatgaataataggttagaactgacctactgggattagaagacttagaaggcagcgttatgttttaaatttttgctcatgctagagaagtgcatgaatggcttttgccagagtttcgttgtggatttttaaattgatttagatggggacttcacttcagttaccttagctctcattaaaatcgtctgcctatttcaaggaagcaccagaatcttatataaaagggcgttctctcaggatggcttcagtgttgttctaattcactcattcatatgattgccaaagtgagttcagttttgtgcttgagtttacagattttcagtaatgaaaaagtatatgccatttatttggggcaaaaatttccaaagaaaaaaacaaatctattacttgggaatggaaattatcagcaatcataataaataaatgacttctccctcaagggagaaaaggcagtaagtctgtacatcatctctactagaagcattgcaac

SEQ ID NO: 55663 - DNA, 1777 bp, Homo sapiens
tggtgtgcacctgtagtcccagctatatgggatgctgaggcagaagaaacgcttgaacctgggaggctgagcttgcagtgagctgagatcgtgacactgcacttcagcctggctgacagagcaagactcagtctcaaaaaaaaaaaaaaagaaaaaaagaaaattaatctataggagctgggtgtggtggctcagtcccagcactttgggtggctggggcaggaggatcacttgaggccaggagttcaagaccagccaaacactagacagggcaacatagtgagaccctgtctctataaaaaaaaagaaaaaagaaaaaattagccaggtgtagtgatgtgttcctgtcgtcctacctacttgcgagtattacttgagcccaaaagctcaggctacagtgagccatgatcacttcactgcactccagcctgggcagcagaatgagaccctgcctctaaaataacataaaataaaaattaaattcaaaaaaatctgtagggaagcagtaacattcttccacttcatttagggcatgctggcctcagccccacttttccttacaaagtgagcttaataaaggaacccaatgaagaacatgaatgtgattggctacaagcatccaattttctcatggtgttcgtaaggcacagcctacttcattattcttagatctctgataaaacacctttgtaattttgcacactagttctgtacttatttatttctgtctcccataccaatttaaagaagattagaattttctgtaatcctagcactttgggaggccgaggcaggcagatcacctgaagtcaggagttcaagaccagcctggcggtcatggtgaaacctcatctctactaaaacacaaaaaagagctgagcatggtggcacgcgcctctaatcccaggtgcaacatccctacagcaatgtagaatcgcttgaacctgggaggcagaggtttcagtgagccaagactgtgccactgaactctagcctatgcaacagactgagattctgtctcaaaaaataataataaaacaaacaatcaaacaaataaataaataaaaattttaaaaaataaagattagagttttgaaagatataactttaaaatatatctccttttttaaggaaatcctttgaatttgaggatattcagcactttcgaaatcggaactcacagacgattcgtgaagaacttggaagaaattctgggtcagcactttattacacacagtctgaggacaatatctatgaagatatcatatgtaggtgttgacaactttgcagttaaatttagtgattatatatttggtgaagcccttaattgtaggatggtattttcttctataatcaagcatatattgctctaggtttttctctttagcatggaaacgtttggtgtataaattattttattctctaatgaattttacaactaatgtgatagactgctcagcttataagtacatgtttataatatattattttgagaattcttttagctctgttgaacccataagcttaaattgctgttgatctggaaacccacatccctacagcaatgtagaataagaaagctgaacatagttagctttttctttcttttgccagctgtggttatctttgcatttaattatgttcatgtaaacatttttttaaattattttttaagatcccaccaaagaaaatccatatgaagatattccagtgcagcctttacctatgtggagatccccttcagcatggaagctaccacccgctaaaagtgctttta

SEQ ID NO: 55664 - DNA, 1056 bp, Homo sapiens
aggttgcagtgagccaagatcaccaccactgcactccagacttagtgacagagcgagactctgtctcaaaaaaaaaaaaaaaaaagaattaatttattacaaaaatattgtatactgctatgtataatctcttctaaaacctcattctacctaactttaggaaattaaatatggcagaacattaaagctgacaatctgaaaaataccacaaataatgttttgttagtattattatctcaccatcttaggagtgcctttatgtagttgaattacttaatagattacaggtatgtttttacatatgcaatgtatatgaattatgtagggataggtgggcaatgttttagtggagttttaaattaggaaattataaaatgtgttaacatatttttgtgtcattttaacaggattattcaagatcaggttgtagccattttcaacaaggatcactgatcaaaattttctttttacaaagagatttacaagttaaacatgaagggaaaatactggaatcatttggattctgacaggataaagaatacaatatttcacatttacttgtaatggaacctttgtaagattcatcacttgtcattcacccagttgggaacatggatgttggtttttctcgtactactgttcagacactgtcaagaagccactgcaaaaacatcaaacaaaaaatttctcaatgggaaggaagggctaatggtatatctaatccagaaaagtggtgtccaaaggactttggagtgagatataactgtcaccaagagatccgtcttaagaaaaatcctatagctgagagaaagagcaaaaacttggatgtaaccagccgtgaaaatgtgggtctagatataaatgaaaataccaaaagccatgatcaaagtgagaatgaaaataagaaacatgaatatgacgatacacacttctttaaaaatgaatcagaatccaactgggtatgttctcgggtcaaagaaattgaaagctgtaaagaagatgtcttagatccagagacttcattacctccaggaaacttctatacctcacaaatac

SEQ ID NO: 55665 - DNA, 1119 bp, Homo sapiens
tctagggttaatttcatcctgctggtaaatcatgacctcttgtttctcttctgaattacctgggcattcaatgaggttgctcctctgttgttggactttgaaggtttcccagagctagtgaaccctgggttagcttaaaaatctcccatagtttttctttctccactagttgtttgttgtctagcctcatgtagtattatcctatgcattagcaacttagtattcaaccaaagattcaaggggactctatgtagatttctggagctttttctctatgttgctctcttttctgatactgtgccctgaaaattccatttgcctcagtctccatattccaatcttgttatcctcaactcggtaaggttgccatgtctgtttgggttctccctcctgaccctactttctggagtttccagggagaaagctgggccatcataggacctgcctcattttcctctcttctttcagggatcacaatcttaagctgtctgttatccagtatctgaaagcacttattttatatatttttccagttttatagttattgatgtgggaaaggcaagcctagttcagctactccatcatggccagaagtgaagtttccctggtccctttcataaattttcttttcttttcttttctttttttttttgaacgaatctcgctctgtcgccagactggaatgaagtggcgcgatctcggctcactgaagcctctacctcccgggttcaagcgattctcctgcctcagcctcctgagtagtagctgggatgacaggcgtatgccaccatgcccagctaatttttagtagagatggggtttcactgtgttggccaggatggtctcaatctcttgacctcatgatccgcccgcctcagcctcccaaagtgctgggattacaggcgtgagccaccacgcccagccagttttctttttaattaaggtaaaattcactatttttacagtgtaccccttcattattttgtaaatcaggttttagaatgttccaaattcttccaagttatttttccagatgcttatatctaatcaaataaaatattttaaaagatttggagtgagaaacttgccctatccaagacttgaattggtaaaatagaa

SEQ ID NO: 55666 - DNA, 1072 bp, Homo sapiens
tacctccccttcagtcttatccctgactttcctctttttctaagtgtctccagcaagaatgagtgttaagagtcttgaggtcatggcaaagacatacacaggtatttgctataaggcaaattcagaattgtaaaagtataacaatatgcaaataggtgtaatagaagcacacaaaaggagtgattaactctggggaaagggctaaggaagctttcacggaaaaactttcaactgatcttgaaagtacatggtgtattcagagagaaatttatagtacctgtcatttattgagcagttactgtattccagtcactgtcttaaacattttatttactttatctgatatttaatcctcacaaccttataaaataaatatctgtatctgttgtgccaaaggatgctaagacatgtatttgttacttaacctcttggtgcctcattgccttatctgtaaaatgagattaacagtagtatctacctcatggggttgttacaagaattaggtgagttaatatggttaaagttagtagagctatgcctggctcatattaagtgctcagtaagtattatctgtaaacattgtgatcattctacagataagaaaacaagcttagaagggttaattggactaatgatttacaaccaagaaccaaatctatgttagtgtttgaattctaactcgaacattctaactttggactgctaatagttccagattatttggcattattggaaaatatgtagctggtgagtaaggcaagtggcaagagtcagagcttgaattagagggtgaaagaccttatatgtcatattaaggagtatagactttatcttatctcttgcacaccatgaaatatttacctgcttaattttattagctgggcgcggtggctcacacctgtaatcctagcactttgggaggccgaggcggacggatcacttgagaccaggagtttgagaccagccggcccaacagggtgaaacccgtctctaccaaaaatacaaaaattagctgggcgtggtggcatatgcctgtaatcccagctacttgggaggctaaggtaggagaacc

SEQ ID NO: 55667 - DNA, 1295 bp, Homo sapiens
aagagtgagactctgtctcaaaaaaaaaaaaggataattatgtgaaaagagacattttatttaattatatggacagttaataacattgcattaatataattaaattctaaaagcttaatgttattaaagttagttttacgtgccattttccacactgtggcattttgtagaacttctgctgaaatttctcatttgactgttgtgcctgagtggtctttaaaatttagctacatgtcagctctttttatccaccaggtgggagtcagataccagtccctgtgtctctgtacttccctaagtctggggatatgcctcaagcactttgagtggttgtcttgaggtttcagtccctgtcttgaggtaggcaagaggtatatccctctttccctgtaggaggcagggaaacacaccacctagtttccttaaagaagtcctctctgttgtcccttgtaatcctcacaatttaataaattgtaattcttctcttatacagccttaagggtagtgaactaatgtcagcagagccaatttttggcaacctcactttctaagccttgcacttttcttagaatatgggggtattcgactcctattgttttggttttggcctttgaggccctgctgaaactcggagaacacaggaaaagttgcatttgacatcctgttgcattagtttatattattgttatgtctaccaactaacaagtagtataatatacagtggtttagtgcacaaactttggagtaaagtagaactaggtttgtgttagtttgggtaattaaccagttcagcttcagcttccccattcacaaaataataaaactttctactattgcaggtaatagtaactatctgttagggttgttgtaagaattaaatgaaggccaggcgcggtgactcacgcctgtaatcccagcactttgggaggccaaggcgggtggatcacctgaggtcaggagtttgagaccagcctggccaacatggtgaaaccatgcctctactaaaaatacaaaaattagctgcgcatggtggagggcacctgtaatctcagctactcgggaggctgaggcaggagaattgctggaacctgggaagcagagtttgcagtgagccaagatggcgccattgcattctagccctggtgacaacagtgagactgtctcaaaaaaaaaaagagttaaaagtagtaatgaaagtagatacatagcatggtgcctggcaaatgtaaacacttaataagtaataattatttaaaatatatgctatacaggtcaggcgtagtggctcacatctg

SEQ ID NO: 55668 - DNA, 1132 bp, Homo sapiens
ctttccggtcccattggaggcccatgctctctctccttctttaggtctttgctttatacccttgtttcttttcttctctcctctttagcgactccttcccactggtgtttgaacaagattaaacttgtataagaaacaagtttagaaagatttcctggacttcacgttcctgtccagctccactctattgtctattcgtctatttggataaactccttgaatggattgtctacagttgatatttgcattcttttttctcatccaattctcaattcacttattttccttcagcctccatgccactgaacctgctcttgtccaagtcctaatgaccaacagacactgcagtttttatcttacttgaccttttgacaatgtatctgtcaattgttgaccactctttccttcttgatagagtctcttcctttggcttccatgattccacacattgatagtacttctaccatcttttgtctactttcgtgacttaaactgccatctgtgatacatgaggacttacctaaaatgtctgagaactgacttacgcttgattaccaatgttttggagtttataaagctcaattctaacagaacatgatgatgtataaaaataatcttaaaaaataaaatatgatggtacagtaataaagtaaaaataaatatggtacgataagaaacaaacaaacaaacaaaagaaaaaaatgagtttgaaaagttgacatggaaaccacagtgagatgctactacataccagaatggctaaaattaaaaagactaacaattccagtatgactgaggagtgactgcaacctcatatattgctggtgagagtgtaaattagtacagcctctttggaaaactctggcagtgtccacttaagttaaacatatgcctacttggccaggtgcggtggctcaggcctgtaatcccagcactttgggaggccaaggtgggcagatcacctgaggtcaggagttcgagaccagcctggccaacatggggaaaccccatccctactaaaatacaaaagttagccaggtgtggtggcatgcacctgtagtcccagctactcaggaggctgaggcaggagaattgcttgaacccaggaggtggaggttgcagtgagccaaga

SEQ ID NO: 55669 - DNA, 2182 bp, Homo sapiens
gacccgagtgatacccgggagactagcttggccacaggagacaacgttgaggtacagacaggtaagagtcggggtgattcggcgcggggttttaagccgcaggggcttcggactctcggggctgtcggcatcacccttctgggcgtcgggtgcggggctgtggcgccgcggcgtagtcctcggacggtgcgagccgagctggcggaggtggtgtctccgcgccccgctgtctcggcacctcctccgtccggaggagcaaccggttgttgggcccagctttgggacgtcctctcgtggccgcacgggttgtggcggagcctggctgaagacctcctcgctacctcaggggcttggggacccctaggctgggcgccgctctctgctggggaagagggagggagcgcccggcagcctggggaaacgcgggctttctccaaaattagccagtgagcttgaacttcgacatgctgggacgatgcacttccaaacaatattttgctttttttggtgttttgattcttaacagcatctaatacgcacaataccgaaagttgtcaagtagaattttaatttaaaagtctgacagtggaacacctaagagcttttgagtaactagagctgtatagcagctgatgattagattatgagtcaaaaggctcaagtctagggccagaacccgcggaaccagatgtgatacctcggccaaattaacttcctgggcctctctttccgtaactgtgaaactggcaagttcatgcctatgggtattctcagggtcaaatcagatgagtgacagtattctacaaatgtcagatatttgaacgtgcgtgtggagcgtgtatattctgtgaagcaactactacttgcctggtacatagtaggcactttacaaacgtttaccctaaagctagtgattcttctgcagtgttttagataaagtgatagatccttgcttactgtgtaaataagttgtttaaacttttcccacaaagtgacccccattgtttgagtgtgtcctatttttaaatgattgatgaaattttctagaatagcacagtggtgttatctatacactgttgctgaatcatttaccgcgaagtctgtagcaatcaaataatctacttctttgtcttagctaaatagttgtagtttaagatacctgctaaagtaagctgggaatattgttccaaatcaagactttaatttgtttttgtgaattgacgggctgcttataggaagatttaaatcttccaaaatattgttaatatatagccatattttttcatacagcctttattatagacgtttttgttctttactatggatatgtgtgcgagggattttagcggggagatgggaaataaaaaagaaaatggcagttttgtaacctgtaggcttttgctggggatacttgtaggcctgttctgagtttgccaggcagaaaccaggaaatgtagtaattatgtgtcttggtctttcattagttggggtgtgtgtgtgtgtgtgtgtgtgtgtgtgtgtgttgaatgtggcagtacgttttttaaatgcagcaataaaggaagaatatttatttttcttaatgacaataagcagttttctaaagctggaaattatattacttttaaatggtctgtagtgagtcttaagttataggcaagaattttagaccactggataccaagatcaaattaaatgaagtagtagagggaaagttactagtgaatgtaatttttgtgtgtgttgctttagaagttttacttaaacatgtttcagcaattcagtggaggatgggtcttttgaagctactttaaaacatgagttttaaacgtactccatgtataaatttttctgtgatttacaatttcttgatcttggaggtctgaaaccttacattcacattgttttttgagggcctactacacaataggcacaagattatatttatgtaagagcagtatgtaattcctgtcatctaggagattccattctaccaagtgggctaaaataagtactgaaaaaacaaaagctgtttttaaagcggatggtaacaataacaacatcagctatcattcattggtacctagtctgtgccaggcagtattctaaattctttacatgtattagcttacttaatcctcacaacagcaccatgagggatgttattatgattatctcatta

SEQ ID NO: 55670 - DNA, 1005 bp, Homo sapiens
atgttgatattggtaaatttcctattgagactgaacgtatttccatccaggcaatcaacactttatttgcttccttacccccatatcctctgctgcctctttttggaaactttgtatttagcaagaattaagattatgatttgggactgttttgctgaatcctttggatggcttacttccttccagagtgttcacttttctactgaattttcttgtgaatcactccatacccagaacctgcgattccaatagcagttctatttccccagggaacgaggcatgaatacgtttctgttccgacctcactgtggagaagctggagccctcacccatctcatgacagcattcatgatagcagatgatatctctcatggcctaaatttaaaaaaggtgagttggaagctctcttcttaacttttacattggagctagaggaatcttttttcccttaaccaaccatactgtcacaagtcattatcgacactgcaatcataatcaagtagagcataaaagattttttagtttagtgcagttcattctacagaaagaagtaaagggacttgctcaagattaccttgctagttgctgtcagataaaagttaacgcagatctcctgacttctagcttagaatcctgacaagggataattcagagatggcctggctttccttaagctagtttttgccagatttcttgttatagcatgcttcaagatgtttttttgtgagagtcagaactttcttgtagagagagagagaaaaaataatgtttcaaggcaaagtcttttgcctgagacagaccatctaacgtaggccattatagatcaaataaacaatctggtttgactcaatgtttctgaaaattaatgtatcctaagtacatttattctaaatagcatttacattgaaaaactcctaaattctccttactaagagacttgaagaacaagtgataattttgttgaaagctgaagcttaaggcagaccatgagattgtagtgtttct

SEQ ID NO: 55671 - DNA, 1652 bp, Homo sapiens
ctgcactccagcctgggtgacaagagagacttgtctccaaaaaaaaagttacacctaggtgtgaattttggcacaaaggagtgacaaacttatagttaaaagctgaataacttcagtgtggtataaaacgtggtttttaggctatgtttgtgattgctgaaaagaattctagtttacctcaaaatccttctctttccccaaattaagtgcctggccagctgtcataaattacatattccttttggtttttttaaaggttacatgttcaagagtgaaaataagatgttctgtctgaaggctaccatgccggatctgtaaatgaacctgttaaatgctgtatttgctccaacggcttactatagaatgttacttaatacaatatcatacttattacaatttttactataggagtgtaataggtaaaattaatctctattttagtgggcccatgtttagtctttcaccatcctttaaactgctgtgaatttttttgtcatgacttgaaagcaaggatagagaaacactttagagatatgtggggtttttttaccattccagagcttgtgagcataatcatatttgctttatatttatagtcatgaactcctaagttggcagctacaaccaagaaccaaaaaatggtgcgttctgcttcttgtaattcatctctgctaataaattataagaagcaaggaaaattagggaaaatattttatttggatggtttctataaacaagggactataattcttgtacattatttttcatctttgctgtttctttgagcagtctaatgtgccacacaattatctaaggtatttgttttctataagaattgttttaaaagtattcttgttaccagagtagttgtattatatttcaaaacgtaagatgatttttaaaagcctgagtactgacctaagatggaattgtatgaactctgctctggagggaggggaggatgtccgtggaagttgtaagacttttatttttttgtgccatcaaatataggtaaaaataattgtgcaattctgctgtttaaacaggaactattggcctccttggccctaaatggaagggccgatattttaagttgattattttattgtaaattaatccaacctagttctttttaatttggttgaatgttttttcttgttaaatgatgtttaaaaaataaaaactggaagttcttggcttagtcataattcttatattcactgaagtgcctttatagaatgctaatattaatttcaaacttttggatgtgacatttggaagtgttggaatatctgagttcctcatttcatcataacatcaaatatatcaaagcctgctttaaagtattaccttggggatgattcatagctatttgtcagatttgcatacattaagatgccattggagctcttttgtctcgtttttgcattactgcacaatctagccatcttggtataggtggaggagcattgatgctaggggctggagaacttgaggcccgatataattttactacgccggcccagtttcttcaattgcaaaatagaagagttgaattaggatatatcagatttcccaaccttaaggagactttaaaaagaataatatcaaacctaggcattttcaactaacactggaatactaattttgga

SEQ ID NO: 55672 - DNA, 3364 bp, Homo sapiens
tatattttttggggggggttgggggggatggagtctcactctgtcgcccaggctagagtgtagtggcgtgatcttggctcactgcaatcttcgcctcccaggttcaagcgattctcctgcctcagcttcccgagtagctgggactataggcgcctgccaccacacctggctaatttttgtatttttagtagagatggggtttcaccatattggccaggctggtcttcaactcctgaccttgtgatctgcccacctcaacctcccaaagtgctgggaatacaggcatgagccactgcacccagcctaatctttgtatttttttgtagagaccgggttttgccatgttgcccaggctaatctcaaactcctgggttcaagcagtctgccctcctcagcctcccaaagtgctgagattgcaggcatgagccactgtacccagcctaatcttgtttttcttatgttctgataatatattcccgtttttagggagcagattaagcgagtaaaagactcggatgatgtacctatggtgctagtgggaaacaagtgtgatttgccaacaaggacagttgatacaaaacaagcccacgaactggccaagagttacgggattccattcattgaaacctcagccaagaccagacaggtatggtacagctttcagcatttgtgcaagagtttgcatcagttgattaactctggtagagatgtgatccatattcatattctttgttgttatgcatttttttcatttttatttttttattttttatttttttttaggcagagtctcactctatcttctaagctggagtgcagtggtgtgatctcagctcactgcagcctctgtctcttgggttcaagtgattctcctgcctcagcctcccaagtagctgggactacgggcacatcatcatgcccggctaatttttgtacttttagtagagacagggttttaccatgttgcccaggctggtctcgaactcctggcctcaagcaatcctcccacctgggcctcccagagtgctgggattacaggtgtgagccaccacgcccagcctgttgttaggcatttttagtagtgttctttttcttaacgcttgtttaaacccaaaatgaacttactaatattctgttatggcatgtttactcctgcattaacatccacaaatatttcttgggaagatccttgactaaaaatatttataaacattagttatttctctgtcaacaccagcccgtttatggcttaagcctcctgaatggagtctttagtttaatgtagttttgttccgtgtttctcacattacccttttcctttgcatgaatgtttatttggcaaaatgtgccatttttatatcagcctgttcttgtgattcaataggaatgtgaaatttagtgttctcttccttaaatcaccatattttattttatcagctattcgtttagtaattggaatcttatgtccacataaagagatacaaatgcaagagagcttataatttggattgtgtccgttgagctagctctctcattttttttcattttttccttttatagggtgttgaagatgctttttacacactggtaagagaaatacgccagtaccgaatgaaaaaactcaacagcagtgatgatgggactcagggttgtatgggattgccatgtgtggtgatgtaacaaggtgagcatatggtttcttggcataattacaaatcttagtatatagtattgggcaatttggaggagtgctggtgttattgtctatatgttttttgagtttctgcctatcctcttctgcacattttccatatgacaccctttctgaaagtactgaggtctaaagtgtttaaaacatttgattattccacaggtatctttatatttttggtaacattagaaattataagacattatttatgaaatgtaggcataccctattcctggcaatgaccaggaatttgaaggatcactactttgaaactagttaataaggacatggtttctgttctttttttacagatacttttaaagttttgtcagaaaagagccactttcaaggtaggacaagtttggaaatgtattctcattcctgttaattttgtatatttgtttttcttatactctgaatgtgtcacttatacaaattctgtttctatttcagctgcactgacaccctggtcctgacttccctggaggagaagtattcctgttgctgtcttcagtctcacagagaagctcctgctacttccccagctctcagtagtttagtacaataatctctatttgagaagttctcagaataactacctcctcacttggctgtctgaccagagaatgcacctcttgttactccctgttatttttctgccctgggttcttccacagcacaaacacacctctgccaccccaggtttttcatctgaaaagcagttcatgtctgaaacagagaaccaaaccgcaaacgtgaaattctattgaaaacagtgtcttgagctctaaagtagcaactgctggtgattttttttttctttttactgttgaacttagaactatgctaatttttggagaaatgtcataaattactgttttgccaagaatatagttattattgctgtttggtttgtttataatgttatcggctctattctctaaactggcatctgctctagattcataaatacaaaaatgaatactgaattttgagtctatcctagtcttcacaactttgacgtaattaaatccaactttcacagtgaagtgcctttttcctagaagtggtttgtagacttcctttataatatttcagtggaatagatgtctcaaaaatccttatgcatgaaatgaatgtctgagatacgtctgtgacttatctaccattgaaggaaagctatatctatttgagagcagatgccattttgtacatgtatgaaattggttttccagaggcctgttttggggctttcccaggagaaagatgaaactgaaagcacatgaataatttcacttaataatttttacctaatctccacttttttcataggttactacctatacaatgtatgtaatttgtttcccctagcttactgataaacctaatattcaatgaacttccatttgtattcaaatttgtgtcataccagaaagctctacatttgcagatgttcaaatattgtaaaactttggtgcattgttatttaatagctgtgatcagtgattttcaaacctcaaatatagtatattaacaaattacattttcactgtatatcatggtatcttaatgatgtatataattgccttcaatccccttctcaccccaccctctacagcttcccccacagcaataggggcttgattatttcag

SEQ ID NO: 55673 - DNA, 1033 bp, Homo sapiens
gtatttgtatatttagtcataaacacaaatgatgtatatagggccaggttataattggtggaggtatgtttagatttctttaagtaaaataaacagcacaaataaaacagtccagttcatagcttagtgaaatacactgggtacttaatctgtagcctcctggctgcagtagagttgtcatttgagttactgtgttttcttaatcttttccaggaacacagtgaccatatttcttttctgcaggcatatagaatttggtgggttttcttttatgtagggtgatattggatactttttgtttgtgattatatattagcaatttgagggacaaaccagataggcagaaatgggcttgaatagttagatgcttatttaaccttggcaatagcattgcattccctgtggtttttaataaaaattgaacttccctccctccctgcccccttaccctccacacccccaggattcttacagaaaacaagtggttatagatggtgaaacctgtttgttggacatactggatacagctggacaagaagagtacagtgccatgagagaccaatacatgaggacaggcgaaggcttcctctgtgtatttgccatcaataatagcaagtcatttgcggatattaacctctacaggtactaggagcattattttctctgaaaggatgatctttgtgttctgaatctttatggggaaatgaggttaccacactagggaagatagagctttttaattatgggaagagttggttttaggttgtttgacattgagaatctagggtaattactgaaagttaatactggaatttattttacataatatactgttactataaagtttgataatacataagtgaagcttgctactgggaatgacttggaaccagagttgttgtaattagagatcacgaaggaatttcagagaggaaaacatctccaagaaacatctttcagtatgtaatggaaaagataggccaggcacagtggctcacacctggaatgtcagtgctttgggaggccaaggcgg

SEQ ID NO: 55674 - DNA, 2213 bp, Homo sapiens
aaatatagactgttatcttgttggccctatgaaattctgcacttttcattatatactctaccttcattaattacttctggcaagatgttctgccttagcactcagttgcattcttttcctttttcttcctgttcattatgctttaattctgaggaccatatgagggtagaatatattatcttttaaaaattacaaaaatttgtataggcaaaccatttcttaaagttgatggccaaattttaaaatgttatttttcatatcatttataatcttgtcacaatccacttaaagaagtttggttatatttcagtgaaaattttcttccagagtaggttttttttcgtgggttggggggtaactttactacaattagtaagtatggtgcagaatttcatgcaaatgaggagtgccagcagtgtgataatttaaacatatttaaacaaaaacaaaaaaaatgaatgcacaaacttgctgctgcttagatcactgcagcttctaggacccggtttcttttactgatttaaaaacaaaacaaaaaaaaataaaaaagttgtgcctgaaatgaatcttgtttttttttataagtagccgcctggttactgtgtcctgtaaaatacagacacttgacccttggtgtagcttctgttcaactttatatcacgggaatggatgggtctgatttcttggccctcttcttgaattggccatatacagggtccctggccagtggactgaaggctttgtctaagatgacaagggtcagctcaggggatgtgggggagggcggttttatcttcccccttgtcgtttgaggttttgatctctgggtaaagaggccgtttatctttgtaaacacgaaacatttttgctttctccagttttctgttaatggcgaaagaatggaagcgaataaagttttactgatttttgagacactagcacctagcgctttcattattgaaacgtcccgtgtgggaggggcgggtctgggtgcggcctgccgcatgactcgtggttcggaggcccacgtggccggggcggggactcaggcgcctggggcgccgactgattacgtagcgggcggggccggaagtgccgctccttggtgggggctgttcatggcggttccggggtctccaacatttttcccggctgtggtcctaaatctgtccaaagcagaggcagtggagcttgaggtaagtttatctcatgcatagtgttcggctttgggctgtggaatgttcaggcgtttcactgatgccagaaatggagcagaatctatcagctggagacaaaggccttgggcgggggtccttccatttggtgcctacgtggggagatctttggagacagaagggagaatgggaaggagttgcggcctggaggcttcctgctagagctgagaagccttcggggagtaataggaagggggatttccattgcttaggctgagggcggggcccaaggactgttgaaaaatagctaaggatgggggttgctagaaaactactccagaagtgtgaggccgatattaatccggtgtttttgcgttctctagtcactttaagaaccaaatggaaggtcacactagggttttcatttccattgattatagaaagctttaaagtactgtagatgtggctcgccaattaaccctgattactggtttccaacaggttcttgctggtgtgaaatgactgagtacaaactggtggtggttggagcaggtggtgttgggaaaagcgcactgacaatccagctaatccagaaccactttgtagatgaatatgatcccaccatagaggtgaggcccagtggtagcccgctgacctgatcctgtctctcacttgtcggatcatctttacccatattctgtattaaaggaataagaggagagaaagtaaaaagttattttgggtatacattcagttatgcaataagcttaacgtgtttatagagaacagttcatttttattagctgctgaagtttctaaaacctgtccagtttttaacagttctgtaaactattgcaaactcagtgttgagttcattcatgagtttcttcatatataacagctctattacatgagaaacacaggccatagtagcgagactgtctgattgtatgggagataataggatggagataaaggattcagagatgagtgttcttcaatatttatttattagctagttgaagcagctgagaccag

SEQ ID NO: 55675 - DNA, 3506 bp, Homo sapiens
gcctgtagtcccagcgactcaggagctgaggtgggaggatcacccgagcccaggaaatcaaggctgcagtgagccgttgatcgccactgcactccagcctgggtagcagagcgagaccctgtctcaacaataacaatgacaaaaattcttcacttaccctgtaatcatcaagaggatggttagaagcttctgcttcccacctgtttttctcatgttttccactattgttgactgagtacatttgcctggatgctgaaaattgttaggcagctgaattctttggcatagtttttatctgtagcctgcaccgggctccaggcaacttcatactgtagggcagggctcagcatatatggtggccttttcttgtgatcacagccacaaccatttgtttacatattgtttttcgttgctttctcactacaacagcagagttggttagacaggatgacttgcaaacctaaaataatactctccggccctttaggaaaatggtttttggtctctgatctggaaaaaggaacctatgtgagggagccagaattcgaacaaaaaaaaaggaggtggggtgtcaaatttatctaaattgtttttgcctgtgcccgcctagttgtttactggctcattgagtatgggacaaaagtatttttggttggctcatattgtgaacttgggaagaagatagtcctgtgaatattggcaacccatagtgcttaaaatttaggcaatgggattgtaaatgacagtattttttgttttaatttataaatgcagtttaaaattgttcatcagctaataaagtactgatgggagctgtgacattctcatttggttccatggtagtatttaacatttaggatttcatttaagctttaaggtgaaacttctgagtactgaaaatgtaaatatattttaagtaacataacacatttttagcagttatataaacttcctagggtcatcagcagaggactgttgtgaaatactagcttttagactttgtacctgttttacaggcgatatgaaaggtgaggtctatccatttggcatcgttgggatggccaacaaaggggattgcctgcagaaaggggagagcgtcaagttccaattgtgtgtcctgggccaaaatgcacaaactatggcttacaacatcacacccctgcgcagggccacagtggaatgtgtgaaagatcaggtaagtgccagcatctctgtatctgaatttgatccttctatgagttggtaaccaaaaccttcaaatattttcagccaaggggaaatcatcaacattcattcgtttttttatttctacttcaccttttttcagtcatttgaggtagcttaataaaaacagaaaactacacaaaaagtgactatattagcaatgagaaagtaagattggtattagtaactaatattatgcaatggggaaaataagttaggggtgagatttccagaatagaaggactatatggttttgtacacttttgcttagagcttcttttgcatatcacacaaacacagaaaccacgttcaaaagtacttaaaaaataagcttagggcaaacaaacttagtcttactcctgagatctcagggaaatctgagtcctcagaatgtttttcatcagtacagagaataataacattttgtatggctgctactataacccagcttaattctagaggggatccaaacaatatatatgttgaagtaacagcttcctgatgagtttgcttaattcaaaaagcttagttcataatatacgaaggaacaaggcaagttttatttgtttggttcaagtttgtgatatagtgaatggcactttcagagatacatttcttccctgacaggttttgccacaggcagctggactggagtatcaacattaataccatgttttatacatccttttagataggggcaggcattgtgcttcattcagagtgaggtgtggcatgccctctcttttttacctacttttttttttcagtttggcttcattaactatgaagtaggagatagcaagaagctctttttccatgtgaaagaagttcaggatggcattgagctacaggcaggagatgaggtggagttctcagtgattcttaatcagcgcactggcaagtgcagcgcctgtaatgtttggcgagtctggtgagttttgttgttgtggtttgattagtaactaccctggagtgtctcaactttatagtctctgttttgtcacatcacttttctgtgccttgtcttctgccacttattatttcttgatacttcctacttctagttgaatacaaaaagattgtttagtacatgttttttaaaatttttgccaaattcttcttcttccattaagtcatttctaggttatatgctacttaaaattctaatagtttagccatgctgattcataatgccgctttgcttccccagagacagtctcacagtctgattcggttacccaggcgctatcacgactcactgcagactcaaccccctgggcctaagcaattctcccacgtcagcttccccagtagctgggactacaagcatgcgccaccacatgcagccaattttattttttgtagagacatggtcccactgttttgcccaggctgatctcgaacttctgggctcaagtgttcctcctgccctgtcctctcaaagcgctgggattacaggtgttagctaccacatctgctaccttgtttttttatgcatctgtggaactggtcactcttgattgcattcaagtctagggtctgcaaatgattccttccattcctattaagttgggaccttgagttggggataataatacataaacaaacttgtctgtcctgtctttctagctaggtatatgaggcaagagtcccatcataaaaagtgagtcatttgggcagttaggtggaaaacacactcctttgcaagtgcttgctgtctgcccaccaagtgtggtttcttctcatcttttgacttaattacagtgagggccccaaggctgttgcagctcctcgacctgatcggttggtcaatcgcttgaagaatatcactctggatgatgccagtgctcctcgcctaatggttcttcgtcagccaaggggaccagataactcaatggtatgagggcatacaaggcttgggggaggccaactgatagaccaacataaaatatgtggtcctatttaaacaataggtcaggaaacttaatgaagcagggagacttccatattgcttataactagttaggactttctacacattggttcagccccctaacctaatggttgcttacagtaagaagcacatttcttttcttgatgctttgaagacagtttaggtaatgaatgggtcaggagtgcttactgtggattttctcctctaggaaagaattagtactgcataagatgattaaaaataatgcttttgtagtttcatttcggaatagtgaatgtactatgattgttgtgcgctcaaatcattaactgcagggttttttttttct

SEQ ID NO: 55676 - DNA, 1044 bp, Homo sapiens
acaaagagaataaagtccttgcatcatctaagagtcagcgaacataaagtgctgaatagcaggtcatttgggagaaggaaatgaaccttgataacctattcctttaccacatgggattcttagaatttctgttctacataaaaccactgttctcccacctctaaatatgaatttttaaacaaatgccatgacatcacacccctaaaaaggccatgggagtatggactactaactttaactcataatatgatatcaaattgcccttccatctcctaacgtgctgcttttacttccttttccatccccacttcccagtccactcattcttcagcactggctgtgggatatagtccaaagcaagggttttatttaggcatctctaagcctggtgggatatagtccaaagcaagggttttgtttaggcatctctaagcccgggactagacagattacattttcccacttggtaagaactagctcttttattcaggaacacaactgtaacttatactaagactttgaagttgggcagacctagatctggacaccgttctagcatataatcttggacaaataacttaaatctttgctagctcagtttcttcatctttaaaatggtaataccttcagccttagatggttctataaagtatgaatcagtatgtgcatcataaatggtaattattgatattgcatgaggtcagaccagcttcctctaatcactcttcccatgacttgatctctttggattatctcctcaaagttttttggttcctgtatttaaaattaaaagtcagctggggtcgagagtaggggctcacacctgtaatcccagcactttgggaagccaaggcaggcagatcacctgaaggtcaggagttcgagaccagcctggccaacatggcgaaaccctgtctctcctaaaaatacaaaaattagccaggtatcatggtgggtgcctataatcccagctacttcagaggctgaggcaggagaatcacttgaacctgggaggcggaagttgcagtgagctgaatcatgcca

SEQ ID NO: 55677 - DNA, 1035 bp, Homo sapiens
taaaatactgtatatgatgtttagaaagacaacaatacatgtaataaagatgaatcaggacagtatgtaagtattgtgatttacattttagagaccaggaaaggcttcttaaaaaatgacatatggtcacctggaaaaagtaagagatcaaggcatgttttatttatgaatacttattaattccttaaacaattttatttaaacaattctatttaggaaaagcaggcattttggtagtttagaagtatttaaagtccagcagctgttctaaaaatagaacttggcttcaggttccctaccccatttcaatagcagccagccaacctaccctgttaacatttgtgctgttattttttgcttacttgtctttctatgtagtagagatgaaataaaattgaaagatgtacctgcctttgttttgtagtgaatggcattactgaggaagctgatcccaccatttactctggcaaagtaattcgccccctgaggagtgttgatccaacacagactgagtaccaaggaatgattgagattgtggaggagggtaaggatcatcactatcaggctgtttgaaatttgccataacttcagatgagcacctataaagttttaaaatatggtgcttattgcagttgtttttaggtttaaaactgaattaaggaaaagtgacctctctcatgcttgctttttatttttataccccttgaaaatgaggtcagtctgggtttaaatagtgaaaacgtgactgctttgtgagcacatgactgatacatgagcaactatgagttatattgagatagacttaacaacaaactctgataaccaaagcttttactgttgagtgtatgataatcaaatattcagttccttcattagtatttaaatcagtaagcattcagttctgtatttttgcttcctgtaaaagtttactgtttttttcccccctacactacacatatgtacataatctgtttcttaatagctagagttctatgaggatcctatttctcgtttctagctcaggcttcctttcat

SEQ ID NO: 55678 - DNA, 6092 bp, Homo sapiens
catgttttaagaaggtttaacaatttgttgtgttgggccacattcagagctgtcctaggccatggtttggacaagcttgcaattaaaccagagtcaaaaaggttttgttttggcagaacttcacaaattgttttttaagagtttgtgtctgggagtggcataaaccaaccagattttttcccaaacatgttttatgaactcattttctcagacataatttgcatttagttacgtttgggatcatatcatctacactataactcagtgttgccagtggaactgggtacattgaatgaaaatttaagtttcttgagttttttttaatcctttgcctttgaagaactggttgtatttgacacagtgtatttaactttaaaagtttgtaagtctgaatgtgtgatttttttttttttttttacattttcaaaggcaagatctgttttgctttacggtatggaaaatataacttggctactgtcaggacttggcaaggattaaatgtcaaaatattgtttaggtcatatttaaaacttacagaatcacttctgcagtgagcagatatgtagtatgtaatacaatagcagattgataatttgtgttcattgtttcattaaacatgagtatctaccatgttccaggtactcttgatacagtaagccttacaaagctgataatttagtaagaaggaaaaaaaaaaaagagaaaagattgcatatattttattcttcagatgtaaattttaactctttcctgggcctaaactcatgcaatttttgaggtagagactggagaagtgcctttgtctactttggaattatggtctgtaaattagtgaagtttctggagattatattgtcattagacttgggcttttatgaaatacattgtgttcacgtgtttacgttcacatgtggtaattttttctagtgcatatttgccaggaagtagcaattggagagtcttagaaaattgctcaggttaagttactttgttgaaagcaatgagtttgtacttaagtgagaacagttcaaatgtggatacagtatttgtgtcacatcagagaaaattcctgatgaatttaacttgatggtggttgtaaagttgaatgttgccttcttgacaagtttcacagccagtgaaaatattatttgggtttcagggtgtgattgctgccatgagagatggttttggtttcatcaagtgtgtggatcgtgatgttcgtatgttcttccacttcagtgaaattctggatgggaaccagctccatattgcagatgaagtagagtttactgtggttcctgtgagttgtttctgagaaaagttgggaggtgtttcttgatgctttctttttcaattgaaagttaattttgttttatcatttttaggatatgctctctgctcaaagaaatcatgctattaggattaaaaaacttcccaagggcacggtttcatttcattcccattcagatcaccgttttctgggcacggtagaaaaagaagccactttttccaatcctaaaaccactagcccaaataaaggcaaagagaaggtaggttttgcataatccaaatgatttttgtagctgtttatttctcttctgctttaacagcacatagtaatagagtacatataatcagcggaagtttgtctctttcagaatttctgtcatattaacagtgaactaaacaaagtaaggtttcttaaccttgggattattgacattttgggatgaatgattctttactgtgggggatgggatgtttagcagcatttctggcctctacccactggaagttagtattctgaccccttttccctgcctcccattgtgacagccaaaaatgtgtccagacattgccaaatgtcccctgggaggcaaactcattccaagtagagaactagttatataaaatgatagtactgtcttccaggcaatttaaaactttcaaagttgggtgtatcctcagttcacacatttaaatttcatttattgaaaaatccactaaataggaaatagaaagatgtctgagatgaattctcctttcaagttaataacaaattgagagttttatagaaacaagtaattcatatagaatataaaatattgctattgaaggtcagcgatagtgctctggtgaaaattaactggtagggtatgtgatggttttactaacagatggagacaggaaagagcattcttcacagagtaaaagtatagatgagaaaaattcagggtttctttaggaagcaatgagtaactagtccgacaggaatttttttttttttttttttggttttgtgtgtgggtttttgttggtgagggaggttaggagaaataaggatgaaaaatcaggatccagctagactgggagggtgttgattgctgctctaaagaatttagaccttattgtcaggtgcggtggctcacacctgtaaacccagcactttgggaggctgaggcgggcggatcacgaggtcaggagattgagaccatcctggctaacatggtgaaaccccatctctactaaaaatacaaaaaaattagccgggcatagtagtgggcacctgtaatcccagctactcgggaggctgaggcaggagaatggcgtgaacccaggaggcagagcttttagtgagctgagatggcgccattgcactccatcctgggcgactgagtgagactccgtctccaaaaaaaaaatttagaccttgttctgtacttcaaggaaaagatttcttttggataatgacatcaggtatgtgctttgggagagtaatggcagcaatatgaagcctagatgggatggagaaagacaaaagatgaaaaggattactatgaaattacttggatagttaaggtagtccttgaactaggcacacagatagtgactatagacaagtgaaggtacatgagagatactggaaagtcatgttataatttaataattgctattagccagaaagagcaaggctagtatcttgcttatcacttactgtagcttgggaaattatttcacctctgagcttcagtttttaaatttcaaaaatgattgtgtaatagtttaaaaagccctcgaagtacctagctcataataggaatttcgcatgtgacagatgatactgttaacaaaaataaaaatacacttcagttgggcttatttttaataacttttaattcttggaatgctctgcttcccaaatgtgtctggcaaaactggcttgatgaagagagcctttgtgtgagactttccctgccattttttgtttttttttctttcttagtccaacagtaccctagtaaatcctctgtcatcatgcttcttacagtatataacatttacctgttaatgaatctgtctctgctgcactggactccctcagggcagggattctcctatctctatttaatatatttgatgtatagtatattgtcagctgttgatgttgaagttggtgagttaagagcaaaaggtgaacagtaagcttttgagtttggttgtggaaaagttgatgacattggagtcagacctgagttcactgacattgttcttaaccaaactcaaatcctctggattattttgcgctgggttttgtaaccttggtaaggtttacttaattcctcagatttccccaatttgtaaaatgagggaaaagagaaactatggagatgattttgtacaagattaatttgataatacataatacctggtaatgttgtaagtgttcaataaattattatatagcagttatggaaggaatgtgattggtagaagaggaaaatgaattggttttgaatatatcgtagtttgtaatgaggactggagtttaggaaggaagtcagggctagagtagggacatgggcattatcttcatagaaatgttgaaaccataaaatcagtataatttatgtagttgctgtacactgtcattacttaacggtgtgattcaatacgacacacctgaactttcttagacttttatttttttagtcaagtgcagtagtgagaaggggggaaagaggagaacaaggaagttcgatctgtaactgactgaacaatcgagataacccactaccttcagaccagcccttagattttttaagagttaatcattcttacacgtacgatgactgaaatgttgtttctccttgaagtctggtattaaaaaaaattgttgaaatactagtatgtcataatttttaatcatctactttatgtcaagtacttgaactgtgctagatcatacaccaaattatcctgcattgttaagtatattgattgacattatatattaaatactgtgcaaggtgctgtgtgctactaaaagaggatacttcagcagcttctttaggaaatactaaagcttcttgcccttatagaatttccacttccttggaagtaacatgcccagtttaatttctgattggctatgaggagcgcaggtgtattaaacattttcagtaagcttttttctcctcaatagcaaaaattagattcttaagattgaaagaccaattaaaaattacagcagactgagctaggcttaaggcaagactaccttttattcatatgaataatcttttagaaaatgctggaataagacatttttacagctgtaccaatcctttggcacaagaatatgtaagaactatagttgtttttattggtttttgttcttgagattgttttcattctgtttttgactgtatctctttaggaggctgaggatggcattattgcttatgatgactgtggggtgaaactgactattgcttttcaagccaaggatgtggaaggatctacttctcctcaaataggagataaggcaagataattctgctcattcgagagagggttaagagttgtcatcttaatcataaatcctgcaggatgggttcttcaaattttatcaagttttgctgaaatatattttgtgtttaagagaaatacatgaatatcttgtatttgaaagcagcttattaaaagtgtctgtcaagctctttgttaatcaaagccttgttaatctagctgtttaaacgttagataaaacatgcttaataaaatcgttattggtaagaaagttaaaacagttactactgaaacattatcaaagtaaaagcacaccaaagattttacgttgttgttcattttttctcatacttaatatgtttggtttttggatagccctctagagaaattcagaatctataaggaatacagactgaaagataaaagtttgatcctttgtgaaaagtgggatgagacataaatgttttggtgaaaatcaatttcattgaagtaataacaaaggatatttggaatgaaaagcatgcgctgggggagttataggtcttgttttctgagttaaggagattggtgtggaagtgatatggtgttaatgagcatccttaattttcacaggttgaatttagtattagtgacaaacagaggcctggacagcaggttgcaacttgtgtgcgacttttaggtcgtaattctaactccaagaggctcttgggttatgtggcaactctgaaggataattttggatttattgaaacagccaatcatgataaggaaatctttttccattacaggtaaggcgtgactttcaggaactttacagctaacttaccatccattctttggtgttggaataaaaaacatttagtattgattgattatacttgttgaggttcagatttcatattggtagaattatggcaagatataaactgaagttaatcactgatcttactatatacagagcctgtggccaaaagaaatagaaaggcctgtgccaccttattttttgtgttggtaccatagagttggccatttggtgtataatgtagtgtaagagtaaggggtctgactgggtgtggtggctcatgcctataatcccagcactttgggggctgaggcaggtggatcccttgagcccaggagttcgaggccagcctgagcaacacggtgaaactccatctccacaaaaattaccaaaattagcctgacatggtggtgcatacctgtagtctcaccaactcaggaggctgatgtgggaggaccacttgatcctgggaggcagaggt

SEQ ID NO: 55679 - DNA, 2265 bp, Homo sapiens
atatttcactgttaacctcaaaagtagtctcttaaaattccttggttgctaatacattatcttctttaaaattggctgtttaattgataatattaggttgtaccaaattatattattgtgactacagtataattttacaaaaattactggttttaagttgtaatcataaatttgtacagagtggtaataatgttcttggttttttattttgcttcaggaggcatttggctttattgaaagaggtgatgttgtaaaagagatattctttcactatagtgaatttaagggtgacttagaaaccttacagcctggcgatgatgtggaattcacaatcaaggacagaaatgtaagacagtcagttaacttgatctttggccttttaagatcagagttggtttatgtttttaagaaacacttaaaattatgtgattcttccttcctctgtccccccaccacctccaaccccttctgatttagggtaaagaagttgcaacagatgtcagactattgcctcaaggaacagtcatttttgaagatatcagcattgaacattttgaaggaactgtaaccaaagttatcccaaaagtacccagtaaaaaccaggtaaataatctttttcaggagagtcctatttcgcctcagtagtaatagaataatatggtgtggtatactgagattttatcttattcagttaatataatgtggtagtggaacaactaaggacctcttgttacgtatatttaaactaaaagagaaaccagatttatatattcataaatatggtgtttttttttttttttttctttttttgtgacagagtctcgctctgtcgccaggctggagtgcagtggcgcgatctcggctcactgcaacctccgcctcccgggtttaagcgattctcctgcctcagcctcccaagtagctgggactacaagggcatgccaccacacccagctaatttttgtattcttagtaaagacggggtttcaccctgttggcaaggatggtctcgatctcttgaccttgcgatctgtccaccttggcctcccaaagtgctgggattacaagtatgagccacctcgcccagccaaatatgtatttttttttactgggtgatgaaaaaaggccaaagaagaaaatgctaattaaattggaaagcacctgattggattagactgcagttcaggtgtacatttgttccctcctctgcccctgccctacccctccagtttgtggggaaggtgaggacacaagtggtgtcattcctggaaaaattccttaaataaaatcttttggtaccagagtgctgggtcttaattgcattgttgtaattttatggttgactcgtgtgaccatagaccatgaagctttcacattggacttatgttgtcaacaccttttttcgcttcagggaactaagttaaaaataacatgggtttactatgtgttcttcttgtttgacttagaactaggaaggatgagaaatctccagctaaaatcgtttttccttctcatcagaatgacccattgccaggacgcatcaaagttgactttgtgatccctaaagaacttccctttggagacaaagatacgaaatccaaggtgaccctgctggaaggtgaccatgttaggtttaatatttcaacagaccgacgtgacaaattagagcgagcaaccaatatagaagttctgtcaaatacatttcagttcactaatgaagcccgagaaatggtaagtgttggatattactggatatgtatctaatatgcgaaagccaatgttatattcaagtttatactactaaattaaaatttttcttaagttaaatgaccctaatgggcatttaccttgttaaggtgattaagaatcatacacatttgagtcagtctgggttatctctggcagttatcttggaaatatatgtgaaaaaattttttgaatggaaatctggacaggattactaagatatttttagagtcagtgattctcaggcccttaatatgaagagtaagaaaattcaagttcatcattgtagaaagtagattttcccaaactatttcctaagacatttaattagtggtttctgtttttaggaaacacaattcttcctccagtgtggtccagggaagccaaaagattgaacacccatgatctagacactagatcacacataaaatacactaacagcaatgatagctgatgagcttttttaaaaaaaaaatcataggcacggtggctcacacctgtaatcccagcactttggga

SEQ ID NO: 55680 - DNA, 3016 bp, Homo sapiens
ccagcttgggtgacagggagactctgtctcaaaaaaaaaaaaaaaaaaaaaaaaaaaaagtttttacatgtgaagtgtttggcttactaaaggactgaaattatgaggcctctgtgcatttttaaaaaacgtttgagaaaagagtcagtataatagctaacaagatgcatgctataggaacattgttttggttaatcctcatggcagtcctgttaggaattattctccttttacataagagaaaactgaggtacagaggagtttaaaaaaaaaactcgccaaaggttatgattgttaagtcatctcatttgtagtatgtgtaaatgccataaaaactaagattaagacatggctatcttagcataagatggtggttctgaaacatttgtgtgtatcagaattagtggaaggcttgttaaaacacagattgctatacttgatccccagagtttgtctttggctaggactagagttaggcccagtatttcttttaagctcccaggtgatgttaatgctgctggtccagggaccacactttgaaaaccactggtctaaggcaattcaaatgctatgttaagtatagcttggaagcaatatatcgtttcgcaaaaatcagttcaacaaacataacacattatttatttttagatgatgttgaatttgaagtatcatcggaccgacggactgggaaacccattgctgttaaactggtgaagataaaacaagaaatcctccctgaagaacgaatgaatggacaagttagtgactttgatgctttgtgtttttttagggccctgcatttgcatatctttcacattagaaaaggaagattctccccatctcctcagtttgcacgaaagagagctatagtatataaagattactattttaaaattaatcaaaagcactggcatttcttgacctgaaataaaaatatggtcaagactcaattgggtttttacatataaccctgagtcaatgcttacagtcaatttacatactgtaagtttgaaacttggcagcatgacatcctcttgtggatcatattaaaatgcatccctgtatatagtatagaggatattaaaattcagtttatattgcacagtgctgctcctgaaatgattagcaatggaaatttttttttttttgactggtaggttgtgtgcgctgttcctcacaacttagagagtaaatctccagctgccccgggtcagagtccaacagggagtgtatgctacgaacgtaatggggtaaacttgtgtatttttcttaaacctttgcctgatccaccatgtgatctataagcgtactttaaaattcaaaatagaaaacgtaagctgcaattgttaaaatcagttttaaatttggtttctaagaggcttcaaatgcagcataatcaaaaaatttaaaaagaaaaattccataggacttccaagtgtcttagtttgcccaagtatgaccttagttagaacattaaggtaaaatgttccttttaatcacttttttgggggttgtgggggggatctttttctggtttcttttaagcactaacaccagctttttttgtttggaatgccttatataaaattgtttttttgaaatgtaactatagtctctgggcaaatgcttccacgtgtgtaagctttttgaagttggattgctgctcagctgtggactcgcagaagtcatcagcaccatggaggggaagtgtgtgtttatatgaataaagtgacttgtcataaagcatttaattttaagaaatttggcttaaaatgccagtataagaggtttttaagtaagtaaatcacagtatacagtgaatatgcatcctgccaaaatagtaataatgatttattaattcacaggaagtgttttatctgacttacacccctgaagatgtcgaagggaacgttcagctggaaactggagataaaataaactttgtaattgataacaataaacagtaagttctttttttttaaattttctcacctaagcggtttttttttcccccctccattaagaaatttgaatagagttaaaaacctaacttgtaagtctggatagttttcatgaactttcaattcatcaactaatgctttgaggtctatgaatattgtattacagccatgatgcagggtctcagaggaagatgataattaaaacattgttaggcattttaaggacttgttctagagatcagtgaaggtttttcaaaaaatagtgctttgaggtaagttttgagggaggggtatagtcactatagagaggtgagaaaaaagcattatgattagaagtatcatgacatgttgggggaaaatggccaaaagtttggtcgaactgaccagaaggtaaagtttgagcattcttctatgtaggaatctgcgttgtttaaaacaaggaagtgtgattggtttagatctttggaggtggtggaagtggtagacttttgaaaggtggggatgctgttgaccagaggcagtgatgtgagagttaacgtgaaagatgaccgcctgatatggatagactaagaggatggggtggaggagtcaagtcatattgagaagatagaatcatcaatcttaattgatttgataaaggtggggttggaattaaagggagtcccaaatactgtttttctggcctggcctactgggcagatgatggtaccataaactgggctaaggagacataaggagaatgttcaaggtgggaaaagaatcatacttatcttggcaatttttgagtgtgagatgtttgtgatatatctgggtagagatatcaaatctacagttgcgtgtataggtctgagacttagacctattaagtctaaggtctatttcctgcctataggggaagtatatagagctgtagaattcatcagcatacacagttaaggaaaatgtagttaagaaagcccagggagaatattatttttatcttggcataggagagatgagagatgcaagaggagaaggaaattaaaatagaaagttggagaaagtgctagtaatgt

SEQ ID NO: 55681 - DNA, 2677 bp, Homo sapiens
tcaatagaaatctaatttatatttcgctaaacccaagctaaaaatatatattgactgtgaaatgtgcattaaattgttattgatcatagttatcaacattatgctatgttataacagctgtttgagatggagaacgtttttactgtgtcatcagatcctcatccctctcctgcagcccctccttcactttctttacccttatcttcatcttctacctcatctgggactaaaaaacaaaagaggaccccaacttatcagagatctgtaagtcaggaaagcagtcatctcagcttaccttgctttgtgttaagagcatgacctaggattgccactcattctggttgaaatatcttgccgactcaccttctaacttcccgaatcatttttttcaccttcactcttgaaagataacttcagtagattagggtcttactgcccaaagtatatctaagaatcagaagcattattatcaccttggatcttaataaagatggaaaatttcaaatccccatacctactgagtctgattttatattttaacttctcatttgagaagccctggtttacagccagaccttcttggtttgaatcttctactatttgactttggcaagtcatttaacttctctgtgtctgttttctcattggtaaaatgaggcgaatacaatactttcttgtgggcttttgtgaaagttaaatgagttaatatatgttaaacacagaacagtggctagtgtagaagaattaggacgtaaccacctacaggtgtggtggctttgatttacgtgatttgaccatcacacatatcgttgactcaaactttggtttatctttctagaatttgttactcttttttcctagtgaaaatatatcctttttattaataatgcccaacattccacttaaatggaaatacttataaatcagattttcagtgaaagggtctaaaacataattgtaatgatttagaaatgtcattactgtggtaaattatagacctaggctttgctaaggatttcgtcctgttttgtgcttcacttatagtttttgttgttttactcaaagaagggaaatggaacatccaatgtgatagtattttatgacctaggcagattccattatattgcttttaaatagctcctatttcactaaagaatgggaacgaagtgatagttacagatttcatcagtatgtaaaaagtgaagggtttcttttaggtaaagatttctttaaatgtacctgtgaaatgattcagcatttttaaaatggaaatgcttttgctgtcttggagttttgttgtttcagaagttttctactgcactattttggatagtctttcattaaaggacctaagcatgaattactctgaaattttctagtttaagtattgcatagaaagttcattttattgtgttaatctctactaacttgaaatatgccttccaaatgcatgacttactaaacagtattaaggtattggctgaagtttcaaaatagcgttaccaaatctcttaagagtctttggtagtttgtggtcgctgtctcttaatattaattacctttgttctgaaattgttgttttagtaattttcacttcatgtaaaggcagcatttgctaatgtagttgctataccttaatattaaaccccagaaattctatttttgtctgataagtggaaattctaccataatttggggcaattccccaatataataagttgtttcctctgaaatgttttattagctaaattaatgctgcagtaataaagtctataatcttcccttcattttacttttttttgcgtttttatatggaagatttagtgacttattaaccagacttaatatgctatggagataatgtacagatatgtatatattctttttctttttaaaacagatgagctttgatccaaaccttctccacaacaatggacataatgggtaccctaatggtacttcagcagcactgcgtgaaactggggttattgaaaaactgttaacctcttacggatttattcagtgttcagaacgtcaagctagacttttcttccactgttcacagtataatggcaacctgcaagacttaaaagtaggaggtaatctgtcagttctcctttgtaaaaatgtaatcacaaaatttgtcttgcatatcaatttgttcatgagtgtttttcaaaaagttttatgtaaattaaaacattttggacttttagttgtactgtttagtgaagaatatctgtataaaccagcagaatccttgaaagattatatttgcatatatttacaataaatgcttggaagatttcattgtttttccccataatgatgactgtttacccgtaagattttaagccagtacgaatattgaacttttgtaatgttacttatgattattctgtcaggtactattttgggtagtacctgaaaaaagtaatccttagagtgtcacctcttagaagctgggcgcggtggcttacgcctgtaatcccagcactttgggaggccgaggcgggcagatcacgaggtcaggagatagagaccatcctggctaacacggtgaaaccccgtctctactaaaaatacaaaaaattagctgggcgtggtggcaggcacctgtagtcccagctactcgggaggctgaagcaggagaatggtgtgaacctgggaggcggag

SEQ ID NO: 55682 - DNA, 1020 bp, Homo sapiens
cctaccaccacctttgttagcatctttaattttttataaacaaggttctgttaaattatctacttccatttgtcctatactttcatgtaattgtttttgtgataacttccattttgcttgttttttgatggtgctgattaagaaatatttgcaatgccattaaaatatagtttagccaaattattaggaattctttgaaaagtattaacatgtcacatgtcacatcaacttatctaaagttgtttgagtggtgtgtttccctttggaaaaataaaataaaggcttcctccaaatggataaaggctagggaaagagagctctagtcagcaaagattctgggagaaggggaaggctttttcaactcttttggtatgtgtctagggatgagacggagactcgaacagtagagcccagattccaacattcttgttggggaacaacttagagtcttaaaatgctagctttgatgctttctaattctggttcagtctccctttgggtgagaaaaagaggatttctatctcctacctgcagtgatgtgtggcaggattggagacttgagaatggggatattttgcagctttaaggcatatatatttcagatcatatcattgtgttcttgtttaatagtaatcagaactatagtctaaacatgaggccaagtgcagtggctcacgcctgtaatcccatcactttgggaggccagggcgcagtgcaggggccggatcacttgaggtcaggagttccgagaacagcctggtcaacatggtgaaaccccgtctctactaaaaatacaaaatttggctgggtttggtggcgcacacctgtagtcccagctacttgggagactgaggcagagggatcacttgaacccaggaggcagaggttgcagtgagccaatatcgtaccactgcactccaggctgggtgacagcgagactccatctcaaaaataaattaattcagcctgggtgacagagcaagactgtgtctcaaaaataaattaattaattaaataaac

SEQ ID NO: 55683 - DNA, 1007 bp, Homo sapiens
tgaattcctgaccttgtgatccacccgcctcggcctcccaaagtgctgggattacaggcatgagccaccgtgcctggcaagattagatattaaggctttcatttcattgacatgatttatagaaatagatttaacgaagtcctttttgtttagtgtaatctttgtattctgaatattagtttactacatgaacattttaatatataaatgcatccatagctgtctaaaaattacatgtttacatatgtacaaagaaaccacaattgggatgaagattattggcagtaaaacatggctgtggttgtacagttgtgaaatagttcagttaaagggggcacacagctaagaaaacagatttggtaatgcaatggaacccccagattttaaaggggggttttgtaaaatcagtaaaaatagtacgtaattaggaacaaatatatatagaagggtagaattagccataaaatggcaagaaagaataaggcttataaagcatttgtttgagatgtgaaaatagacctgaattgtttggtgaatgatttgatccaggttagtctaaaggtgacagacaagagaaaagcaaaactagaaaattcctgtcgcgctcctagttttttctgctgaatgcaataattttcatacttgaaacatagcaaagcaagagaaaactgaggccccagatgagtgagaaaataacaggattacttggcggttgctagggtgctagttgctaggtgtgtgatagtagtcaaatagagacctatgacaggaactgtaaatgtcctgatttttcagtcagatgtgggaactattgagcttacttttcatccctagcaaaaaccccagagccagtgaataaataacttggcagactagctcatgatagcataatggtcaatatggagaaatgttggatggatagcagttagtaagagactgattttagagaagtctccaggtgtatgctgccagatgctatcctcgccctgcttttttcagagacctaa

SEQ ID NO: 55684 - DNA, 2964 bp, Homo sapiens
tctcttctatagacatttctcatctatttactgcagcagtgcaaatgagatttctgtttgcttactaagtcatctcctttaggatttcaagacttaataccactttcatcaaaaactaaggcactgtttcctgttacatcacgttgaaatgcttcataatcgggctccgctacacctgtcacactacatatcctatttcacttcagcccagctctctgttctagccaggctagcctgttgattttcctctgaaacaacaagccacacatgttgccacaggcattcatgcagaagacttcacttgatgctgggcttagaaaatcatagaatgcatggtcgctgctctgaagaaagaatttagtggcatattctcgcttgacttatgtgctgtttcatgcctagaatactcagctattttctttctcctagaattctgcctgattttccaggttcacttcaaattccacttatttaaaagccttggttgctttgatggacatgcagttgtggataaacaataaataatatttctagatagtctgtgacataatagatacctagatactaattgagcaaaataatttttggcatttttgtcctatactctgttttttttttccatgtttacatcttgtcttttcagcaagattgtctatgctctcatggcagggacttcttttatgttttccacagagctagatccttataaaatacttgcactaaattaaacattatgccatgtaactgagcttatttgggggaagaggtcaataaagactatggaataatttgaggtcttgggtatgagataccaaaggaggtagttgctagtacttgagagattgctccaaataacatcagatgagcatgcttccaagtttcctgcattacttgcatgacccatgattctaagttaatgaaatgagtttgtccctcttctcacccactgtccctgattattttatgtatgttatacttaatgtcttcattttttacctttagtatgaagtgtaacagaacagactttaccacctgaaactgctgcttcaagttcagatcaggcaaggaacaaacctcgtaacaactaacaagaccaaagaagagtacacttaagttgaagacacaacacttgatctgaaacaagaagtttgtgcctactcaacagctttgaaagagcacttcccaacgctgctagtagtctttgttttcttcagtgctgtactgtgagattgcccggtacagcagcagttgtattctttattagcttggtagatcattttctctcgctcttttttttaatactagcaactttcatcctttgaaacgtgtgctgaaaaagaagaatcagcaaatactactgaaagtgcaatatttgagtatcactgcgaggtaggtttgtaatttcctattaagaatcagttccataattctagatttcctgattatttggtcaaatataaaatctttatttgttcttttctaaaggtattcagaagacagtttttctattctcaactagtatgaaatatcaacactatctcttgttagataaggacagtatttatggtcaaacatttttcataccagattatattaatacatgctgatctctcgacttgctggtctcttagagaagctccgtctgtactatttagaagttaggatttcaaataagaatgtgcattgcagtctttctatgagggtctgtgaaactttggtgatatttgctactgacgtctgtttctttctctctactgtcttcaatgttagcttcttgaggaaagaaccttactttatatccatgcctacatttgcagtgcatatttgtgaacggtatacagtgcacatttgtaaatggttgacatgcctactgtattgttaggcattgctagtgctgaaatataacgaatgaataagatactaatggacttaatgatttagaacaatttgttacacaatatcacaatataggctaaaagatactaataaaatattaagaatataactgaagctgttcccttggaggtaaggaggagggtaaagaaagcctacagaaaagggatatttgaaggtgagtagtaccttgttaagaggtagaagagacattggtagaggtatagaggtaacagaattagcagattcagggctacgtgaaagcacatggtatatattaagttgttcattatgaacagagtagagaatataattttgcgggagagttatgaaagggaagtttgctggaggcttggcccaatgcatttgtctttattccgtaggagagccatcagatgtctataagcaagggcttaagggtttttcccccaaaagtaagatagctttattgcttcacattttaaagtaatattcagaagtgtacctttaaaagacaaatggtgacacttttgagggaaaggctgaggatgggaagacctgtcaaaagcagtggatcaagtataaggaagataaaagctaaggtgtaggtagagaaaaaggtaggtgctaggtgttctgatgatttagaagtgaggacttggggaccaattgaatctgaagataaatgtggagagaatggctttatcaaatccagttgtgcaaactagaaaccttcattgttcataggaatagggaagttagagtagtaacttactgatattaaaatatgttatggaaatctattgtgttcattagatagcaatctgaagttgaaggaaatacactagtatggaatattgaacagtggttaactttgagggtaggcttatgaagagcaattttcctttttaatctttagtttccagattttctaaagttagacataaaggaattcagaaaggagtcatcagtgtataggtaataaaaggaagaagcaccaatgaagagagcaaagacatagaagtcaggaaaaagcaccaacgataatttcaggaagtcaatggtaaacatttttttagatgctacagaggt

SEQ ID NO: 55685 - DNA, 1183 bp, Homo sapiens
ccttgctacaaagctgactctatactaatgaaattcctctaaaacagtagacgtaagaaagaatgcttgcactataagaagaaacgagtgtgaggtccttccggatttttgctgggaaaagataaatcattttttatgactcctgaatatgccatcagaattgttggccttcaaggtttaccccattattgtgggctaaaacgtattcaaacgctcgaagactagagacgcctaaagccacccgccacccctagtgtccaggaggagtcagtaaacaccgagattgcttcccgcagcacacccaagaaggaatgtaatgtaatgcagccaccatgttggttgtggttaagtgcagcaaactgcttggcgtcacttagccctgctgcgcaagcgtgttgagagtacgcttcactccgccccttctcgtgcacgcgcccggagcccgcaactctcgcgagagaagcgagatttattcctacgtaccgggccgtgctgcttatggcggcgctggagagggggcgctgagctgttggggtgagtacgacctcagggtccaactgggggtagcagaaacccaggggaagggctgagaataagaccaaggctaacgagaagccttctgagtcaaggtgggcactcgtagagctctaggtggggaagaatgcaccccgattccctgccctgggctttttcatacgtctcccgttcaactgcctgggcctcatgtcaggtcgcagagctgaaacgaggagttgaggccagccggctgcgcgtggtggtagtggtggtggtgactaaagtggggggagggagcgaaaatggaggctccgacagcagccaagatggaggcagagggtgcggggctcgggcgcggaggctgctgggatctgtagtctggctgcttccccatctgcggcttgtctggggaaacgggaactacatgtcccggcgggcggggcgagggggtggtggcgcggtcctttgtgtgaggttggaagagcctgagaccgagaagaggggcctactttgactctggaccctgtagtttcctggccgttacctgcttgggaatctgactaccagtaccagagcgcagtgcggcagtggcgccttctttgtgtatagactgagaccctgctccatctagatatcttaggggaagtgtttaaagacacctttcccc

SEQ ID NO: 55686 - DNA, 1483 bp, Homo sapiens
catgcttagtctgtctctatttgtccagtatcaagaggatgcatccgatatgaaggacatgtccaaatacaaacctcacattctgctgtcccaagagaacacacagattagagacttgcaacaggaaaacagaggttagtcaggccttttcatatctggtaatagtttaaagttattgcaaaattgccctaaacatttacaaaagtgtacatatatttccaggtcagtacttttagtaggagagtcctcctgatctggcccagtaacaataaagtttgttagattacccttttcaaggtcatctgactaatattgcagcagcttaccaaagaggtgctgtgtagagttggtattattgcatggtttatttttaagcatcctcagatgtgtaacaaaagagttcatagcctcatggacttaaaatttaatgtttaagtattaatataaacactgaaggtaagatttaaggttttgtttatgttcttgtttgtgcaaggtgaagcagcagaattttattctaagggtatatattcttaggcttgattagtacattattaatgattgtggtattaatagttgtttaccagaggggtttcacatatatcattctactgtattctcatatcttcatttttatctaccacaatgcagttaagaaataggctcagaagaagctaaatgatttacttatgagtattaaccaagcaagttacagaactgaactcaaacacatgtcttctgatgatacatccattgttgtttctgcaagactttgcttctctgcctagaaagttacctttcacatagactttaactgttcagttttgcggacttaaacattgatttacaactttagattcatattatctatatagtgttacaaaattccaactgttaagactttggatttgggaactgtctctcagacatcactgccaagttcttttattttttgacagagctatggatttccttggaggaacaccaggatgctttggaacttatcatgagcaaatatcggaaacagatgttacagttaatggttgctaaaaaagcggtggatgctgaaccagtcctgaaagctcaccagtctcactctgcagtaagaaactttgaataaattcgaaatgaaccaaattgaaatcttgagattgttttagattgtgtgcttgtttttttgctttgtgagatagggtctggctcttgtcgaccaggccgtggtgtaatggcacgatctcggctcactgcaacctctgcctcctgggctcaagccatcgtctcacctctgcctccggagcagctgggactacaggtgcacaccaccacgccctgttaatttttgtggggttgtttgtttgtttgtttgtttgtttgttttttggtagagatgacatttcgccatgttgcccaggctggtctgaaactcctgggctcaagcgatccacccacgttagccttccaaagtgctgggattataggcatg

SEQ ID NO: 55687 - DNA, 1916 bp, Homo sapiens
aatacctgttgtcttttatcttgcagatcctgctttacaaaaagttaatttcttgcccgtgcttgagcaggtcagttaagcatagtacatgtagatataatctgtttaggtaatgaactgcttatttgaagacgaaaaaagtctttagttattgcattactagtcttctgtatttaattgttattatttagaagctcttatcagaagtattttcttatagaaacatctatctttttaggttggtaattctgactgtcactatcaggaaggactaaaagactctgatttggaggtcagaagatttcccattcatattaaatttcttgtaattggaatataacttattacctatatgtatatttcttttgaagcttcaaaaggattattatttgattaacgttttaagatatatcctttaaaacctttttttctgcttctgtattttttgggttatgaaagttccatttatgtagaggcaatttaattttaaaccatgaaatcaagaagaggggaaacgagtactatacctgaaaagtatattatcaagagagtattttacaaaatcagcctttaattaatagacgaaattgactggttgactggtttattgtataaggaatttgtaggacatgctatatacttttgattttagttataaaaatatttcttatttatggcatatagtgtctttaaaatgaagagaaattccatagcctggtaaggtactgtatgtttgttgctgtgattatggtatcacagaatttaaaatatatagaacttatttatatatttttataagaaaaagttgtcaaccagcaaaaattgatgtgactaaaaatctctgatatttacaatataatgtggattttaaaaaggcaggaaatctatataaaaatcagacttgatgaaaattatatcttgtcttcacttttatttttcttgtcattatattttaaacttcatgtcctttagtgaatcttcaaactgtttgtataatcaaagtgtttcaagaccattgttaagatttatagatttcttataggatgatttattttagcttttaaccagccagattctgtcactaactaaaatatttttatggagccatttcattttattcagcaaggtataatttagtcaagtgaccaataactttaatgaagtagttaatattgccttagtagtttaaaagagttaatgtggctttcagtatgctattagtgcttaaattgaggagatatttggtctcaactattagtatatggatattttcagtaggcagctgtagtttggttatattagaattttggacaattaatttttgaaaacatattttaatagaattcagagggattgagcagagtgtattcaaaactgtataaggaggctgaaaagataaaaaaatggaaagtaagtacagaagctgaactgagacagaaagaaagtaagttgcaagaaaacagaaagataattgaagcacagcgaaaagccattcaggaactgcaagtatgacacaattttgcattgtaaacatagtatagtaaatctaatcataatactgttgaaagtagagtattagttgggataaattggattgatcttgtttttgtgatgaatattttaaggataatgctttttaaaagttacatcaatactggatacattttaactttaagaatgagcatagaggacaagttgtataacgcttaatgcaaatgattagggaaataataaatcactttatataaaaattgatttaatgattctaatttattataaagagtttcaatttttattcctattgatgttttatgtaaatatattctcttagattacaatagttgtaggtaacactttaaatttgaaactgtgtaactttattttttttatttatttttgtgagacatagtcttgct

SEQ ID NO: 55688 - DNA, 1050 bp, Homo sapiens
ttcaggttttctttccctgactctggttcccacagagttttctgcttatgggtttctgccctggtaagttgtaattctctctgtgtttgcctgtctctccaattttggggtagtagtttgccctgcgactttacttctcttaaggatctgagaagagttattaattttttagtttgttcagctttttacctgtcgttaggatggagcagtgacttctaagcttcttcacaacagactgaacccaaacagcttttgatgcaacttaaaaagacccagtaatgatttagataacccaatgttcatcattaacacagaattttaaatattttaatgttttctggaggcattttgagtattgtcttgttgacatcttattttaaaatttaatcttgaaatttttatattaacaatagatgaatatgaacgggaagaaaccaggcaagtttatatggatctaaataataacattgaggtgagtgttaatgaaatctgagtattttaaacataggaatttctgagcaaattagagcgattgctacaaagatatggacaactattcttactaaaaagattattatttatttgttgatatattattgtatcactaataaaattcctaaggttctgtactatgagcattaatgttatgtaggagctttttgatttacatgttagtgacatcacttaatttatcaaatatttactgccttttgtcagaaatcagcacattgtgacacataaccattaatttgaaaacatataaagtattattcatctgtgtctggcttctgtttacctttgttttctcatctcctgtcattgtccactttgcttttctgctgtagtcactcttttatgtttctcaaatttgccaagctctttctgatggtggttctttgaatttgtaccctttgcagaacttttatgtctaagatcttatgcacatttctaaacttcattctgcttttttgttattctccccttaatactttatctaaaatttctatttgattattccatatatatccatctcatttaacttttctcaag

SEQ ID NO: 55689 - DNA, 1065 bp, Homo sapiens
tttaccatcgggagataaattacttttcatattttagtgtgtatcttttccttttgcatgcagtgtttaaatattgttttaaacccactctttttattctatgttttatgaatatccaaattaataatcaataaaatttgtattacattttcagtggctacatggtataccatcccatatatgtgcctccataatttgtctacttttggatatttaggtagtttctaatgttttgctattataaaaaatgtaaatccttaaatatttatttttgagttcttgggagataacaatcttgaaaagtcaataaagcttgatggtgaccaatatttgtgtgtctatatttgcatattttcttctcattttggactattatctaacggaggaaaaagactaattgtcacaaataatacttagttttcttggtatatatcttctgctaagtactatctatttataactttctcttttagaattacagagtgaaaacttaaaacaatcaattgagaaacagcatcatttgactaaagaactagaagatattaaagtgtcattacaaagaagtgtggtatgatttaaaaactcattagtgtgtaataagtctcaccctatcaatcagtcaacaaatatttattaaatactaatacaatgtacaaggacctggagtttcaaatagttagagaagacacaatcctagtctgcaaaatgctatagtttagagacattgcataaaaacacatcaaaagtataattaaaatacaagaccctggacaggtgacaacagggtggtttaggtaataaattaatagttctaagaattgaaagaacagtatggctggtttggctaggaaggctccatggaggagctggaactataggtgggatttggagaacagtgaattgaaataagagtagtgggtgggcattccagggtaggaaggaggaataataggaaaatatgagggtgggaaaggggcagtgaatgtatagaagcagataagttcagcttttttggttaaggcctttggatcattgctcttgttttatactttatttcatttagag

SEQ ID NO: 55690 - DNA, 1040 bp, Homo sapiens
atttattagcataatgttgaactcatggaactgtagaaagaaaaacattgggctttattttttaggatggcaagaaagaaggctgtcagcaaagaaaacaagaacaggaggtagagaggaaacaggacatatgaatagtgcaaaatcaaagaggaaaaaatggggagaagttaatagtatcaaatagtacaaacctccacaatgatgaagacttaagaattgtatcacaaaatggttattggtgatccttaagatgacaattttattattatggtgataagcattagttttacttggagttcaaaatgaaatgtgtaggtaacaaataggaatttgttggaaaaacaaactaagaaatttgatagctgcttgaaagagcagaaaggtcagatattgttttataatcaaatagaatgtttagacgagataagggaaattaaagattcctctacatagaatctgtgtatattggtagcgtaagggcagagtctcagaggaggtgggaatgttgaatccaaagtacaatgctcagagttagcttgagaaaagagaatcacttcttttaagtttggagtgaagattaaaatgtcagatgtttagacagtgatgagttgaaggtaaatgtacattctgacctcatttcaaatatattttatatagatttattgcttattttgctttatgaactttgggttatttggcaatggcattaactttagagaaacattactattaatatttatcttttattagcttttcatagttagatttggactccctctatgctttacattgctctagttgcatttgtctctcctgatttttcccttttgcgtagtattatgcttgttccttctgtctcttttcctattcttttaatccagctttttaacacattttttttttgctcattttagaagagatgactaagcttacaaataacaaagaagtagaacttgaagaattgaaaaaagtcttggtaagtatagtctttcctattaatatatagcaattacttttcagaagaatattgaatccct

SEQ ID NO: 55691 - DNA, 1041 bp, Homo sapiens
taataaggtgttttgtagagagagcaaagctcactcagttatttttttcgatcatgattagaaatattaaggcccctaagattgttgattgctgaatctggagtgtgtctgtctctctgtttcactctttctctttcttattttcttcagcaagttaaaggaaaggcagagaaagtctaccattgtaaatttttgaagaaagacaacttatagtatcaaaaacatttgaattaaattcttatccaaaatttttgcctcatatacttgccaataataatggaggtttctgattgctaaggactcaaattgccttaaaattatttgtgaaaccctttattaataatgcatattttatttgatatgataatgtatggttttttatttttggataggcatatacagtgaagacaccaacaaaaccaaaactacagcaaagagaaaacttgaatatacccattgaagaaagtaaaaaaaagagaaaaatggcctttgaatttgatattaattcagatagttcagaaactactgatcttttggtaaaaattttacaaataatatttagtatttatttatattacttatttgtatactattttccttgatatacatgtataatatatttacatagtacctaccattgcaatactgatatacagtggagctctgctaaaatgcagatccttgtgcttttgcagcatttcagaaaaattagggttcaaataatttccctgtaaatttcagaaaacctggcactttgaaaatacttgatatagcacaatgggcatacgatatgattaatcattgtcttgttttctagaagaatgtcataaaggagttcttactatatttttaaaaagagagatggagtgaatattttactgtgccaaatctgttatttaggcgtcccctctattttgcatattatacatgctccttttacatcactggttgatatttatatcaaggtattggttgacaactataacatttccatcactctaaagaagttaatgtattaaggacagcatgtttaagcaggct

SEQ ID NO: 55692 - DNA, 1043 bp, Homo sapiens
ataaaaatctaggtcctttcttggccaattgatttattttgttactgttttctttgtttggtcttctttcttctctctataatcttctttctctttcctcctccctttgcccttctcccttctacatccttcctctttctactctttgttctcctcacatgtgatatgttgacaaaatgttaataatataatattaatgatggtaaacccaacatcatatttttttatttttcttcaagagcatggtttcagaagaagagacattgaaaacactgtataggaacaataatccaccagcttctcatctttgtgtcaaaacaccaaaaaaggtagcttttaaattttatttcagaaagcaaattttaaaagctgcacttaaaaaattaaacatgttatgatttttaaattttattttgtactcaggccccttcatctctaacaacccctggatctacactgaagtttggagctataagaaaaatgcgggaggaccgttgggctgtaattgctaaaatggatagaaaaaaaaaactaaaagaagctgaaaagttatttgtttaatttcagagaatcagtgtagttaaggagcctaataacgtgaaacttatagttaatattttgttcttatttgccagagccaaattttatctggaagttgagacttaaaaaatacttgcatgaatgatttgtgtttctttatatttttagcctaaatgttaactacatattgtctggaaacctgtcattgtattcagataattagatgattatatattgttgttactttttcttgtattcatgaaaactgtttttactaagttttcaaatttgtaaagttagcctttgaatgctaagaatgcattattgagggtcattctttattctttactattaaaatattttggatgcaaatacgtgcttcttattgattctgttaggtcctataaacagctcatcattataattttgagggaatattattcattgtaaagtcttgagagcattgtagaggagttttgtacttctgaggcagctttgacttt

SEQ ID NO: 55693 - DNA, 1051 bp, Homo sapiens
tagtaatttcttattggatgctcaacattgttaattttacattttaataagtgagttatattttgttgtatttttttaaaggaatactgaactttgttctggcagacattcatgttacttggttcactcaatccttttgaaagttcctttttatctttgttcaggaaggttcagagcagccttaactctagagttaatttatcctcacttttaaagcatgacttctctgaggactctacctaattatgtattataatacttctccactttggcttatggaagcacaaactatttttagacgtaagtaagctcgaggaattgttcagcctcctgattttcagtgatctttccttggcttcctagtttcaaccccatcatatacaaattggtcatcagttgaagactcaatgaaaacccctttcagatctccagattttctttctaggcagctccctcctcttcatttctctgtcctaaaaattctaggcatttcagactccctgaacttctatacgtttcttcacaattccttaagagtatagtctctttttggctccccctctctgtgctgtagcctagaaactgccttcaggtttctaggacaatcgtagggcttaatttatttgtttcttttctttcagtatcagccttgtggtgcctattatccaaagtttatgaataattggttcatatattttgccctgttttctaactgtttttagtagaagagaaattcttataccagtgaatccttgatgggtgaaagcagaaatatgtggggcttttgggagaagctgaatagtctgggcactgaccaatgaaaacaatggttagtagtgctggagtagagactgggaggcctcctcttgtgccaggcagggaagagcttttccctactcttgacttccttgaaatcaaaatgtgtttacctaaacacattttggtcctctccctattcctttactgactttacctatggggaggttcaccaaacctggttcatattttgggctagaatagctggcttagtgcctttctcctgccttctttt

SEQ ID NO: 55694 - DNA, 1017 bp, Homo sapiens
tatttcgctcccagaaaaaaaagatcaaagagctttcagaaactttgagaacttggctatttagaaaaagtgataatgggtcagtttctcagactgtagccattgaaaattagatgcagagaattcagagatttcttcttaatggaagtaataagctgtaagaattgagagatcacaatggagtgttaaaactgactgtgtctaagttgggtgtaagggtttcctgggtttttttatatacatgctctccccagaatacagtaaaccacagttttagaactaaacacatctgtaaaactaaatatagcatggaaaatccaatttgaataagtcatgctttcctagaatttaaaaataaaaaagtcttcctctggaaagagaagtcacacagacaatcatgtgccctataaaagtgagtgtttataggactaaaaaacttttaacaactttttaaggaaatatttttgttcttatacaaaaacatgtaaatattgctttattactttcattttctgaccctgctgtaaactactgcaaccctcacatcctcaaagggacttttatgtcaaactcttctgtttctccaaatataaggaaaaaagactaaagcaagagatctggcagttgaaaattgtgggaaagagaatttgtatgggcactgtatctatgaaatacctcataacttacgtttacatgttttcctaactttttgtatttttcttgtatagccacctagagaattcttcatagattaagaactacagttttcaccacttaacataagtaaaacaaagtccttcataatttaaccattagcatctttggccaaaccaaaataaagaaaagcatcttctcctagttgtgtgtgggcaacagaaacaagttaaggaaacaaaaatacttatatatacacagaacaaaaataatgttctttttatgcaaatcccctgtgaaaataaaattttcaatgtttttttggtcttaacgcttcattttaacttagtaaacccaaattta

SEQ ID NO: 55695 - DNA, 1049 bp, Homo sapiens
ggcttgggaactgtcagaaatctttctagtccatgaaaactgttctggttagtctgtccttccatcctcaaaagcatcttagaaactccagaaactataatcttctccatatgttgctgaattatcctaaaatacctatggaaaggcagtatttttttttatttctacaggttttgtggggaacaggtggtgtttggttacatgagtaagttctctagtggggatttctgagattttggtgcacccatcacccgagcagtgtacactgtacccaatgtgcagtcttttatccctcacctcactcctaccctttcccctgagtccccaaagtccattgtatcattcttatgagaaaggcagtgtttttcaaaggtgtggaagaggagattttccttgatgaaaggagaatgtttgaaacttcccacccagaagtccttcatttttccttgtatttcttcaggctatccgacatgttcagaccatgtatgaagaggcttacaatgattaccttaaagacaggggaaaaggcaatgggacactcatcaccttccactcaacagtgagtaacttcacttcttccttaaaatcacagcttctaaagattatgtgtgagccaggttctcaccaatcaccaggattaaaaataaaaataaattcagtaaagccaagtagcaccacctattttagcccttttgagggccacagtttgcattatgtgtggaaccctagaagggaaagatgtctatcacacagagttcacaagagagacagaagagcatgaacccaaaagacacatgccccaaagagacaaaagagcacaaacaaggttacagagaaaggagcccagataaatagcaggctttgtcagagggtagcattgtggtgtaacagaaacaagtgtgacctgtaagtcagaaaagctaatttctagctgcagctctaccattcaacagccttgtgaccttgagcaagttacttggcctccctgatacccacgcagctccctcatttgtagaatgaagggtcacaggagatggctacactccctt

SEQ ID NO: 55696 - DNA, 1028 bp, Homo sapiens
tagaacatgttcgttcatgtgagcccctaactgcatcctcctcagctgatcattcagcttgcagagctctgcttaataaagccagacagaaagctgtcatctgttcaggagaaaggcttcaaagggtgtttttaaaaaataaataaataaaacttctcccctggttcacatcaaccaaaaataaaaagaatgttcttttctaaatggtgcattatatcactagaatagaaaatgcactcaatttttcttttatctactgatcacttttaagagagtttttttttaaacttaaaagtttataggaacacactctcatgagtaaattaaatatttttttaaaaaaactttaaacctaaaatctaaatgagagatatatttgagacattttcaagtcttaatgaaacattctgcctgtgatacaaatctccattgtgattaaatgtgataccatttggtatcttgactgtgagtggaaaagtagtgttagagtgtaggaactttgtgaagtcagttcagtcaaaccagcagatgcaaggcagggtagaaaacttcataattacctgaaatgaaagaatataatggttggaagatacctttaacatcatcatgcagatggagaattaaggaacactggaggcaggagacttgtctacatactcacagtttcttagaggaggagttacctaggagttctaggtcacctgggggcaacaaagatgagtaggacactttgctgcctacagggagtttgtcctctagaagggaggataaaagaatacaacagccctaagagaatataaagggaaggctttaagagatagagaaggggcagggcgtggtggcttacgcctataatcccaacactttgggaggccgagggggcggatcacgagatcagagatcaagaccatcctggccaacatggtgaaaccccgcctctgcaaaaaatagaaaaattagccaggcgtggcggcgtgtgcctgtagtcccagctactcaggaggctgaggcaggagacttgtttgaac

SEQ ID NO: 55697 - DNA, 1045 bp, Homo sapiens
agatatataagaaattgtagctatcattagctatataattttcatttttcttttaaagatgacaccaatttctgcaaaaaaaacaagtggacaatcaacaaggagatatcaattggcttattttctgaatagatgtgagtgtaaaacaaacatccagggcccctactcaagtcctccagcccacattggctcttagatctcttcccagccagccctagatgtaatgaatgctaatttggtgtggcaggagtttaggactagaagagaacttagagataaccagtctgggtggtgagattgagcccaaatgggtgatgacttccccatgtcacagagcagcaaagacaagactctagggccctgactgctcctcttttcactccgacagatggtctctctggttgatatataatgacattgactcccgctattgccttttactacattgtgatatcacacagcacatagcacagccctgggtgcatagtaggtacctgatgaatggtttgcttaatccgctgatgtgccaagtgtatgcttgacaatctaagagacaggaagtcaaataagacagaataccttcgggaggcttcaagagactgacaaggaaagtcacagcaggggacaagggggtcttagaaatgggaaatttgtttaacttcctcgacagtacaatgagagtcagaagtcgaatcacgtaatgaacctcagcgagctcgttcttcgtactccctatgccagacaagtcccaatgctactacatatttaccaaatgtacatttatagcccttgacctctcccctaactctacatgtctatatcaactgcctattcaaattttccatgtgtatgtccaatataaggtatctcaaatatagctatctcagtatataggtatctcaaatttgacactttcaaacctaaactcttgattctgccttcaatcctgttcctccttcagtgttctccatctcagtaaatctcacctcctttcagctgggtgccaaaaagcttggcgtcatcctcgatccccctgttccctcac

SEQ ID NO: 55698 - DNA, 1053 bp, Homo sapiens
cagatctcttcaagaacttttcaagaaaagccaaaactttgagactgaaaagccaaaactctgaaatttcttcactttccacacatgggtacagaccaaacaaaatttgtctgcaggctttttaatcttcttatgtgaattaacacatggagcaattgcaagcagtatcaaaactggaactagtggaagtactaattctgtgaatatatgacctccaagagggacaggtctggatgtcaagaaggctttcagggaggctcctcggagggcagtgaggggctgtcccataggcaggtaggattttacaggagtcctggcacacagatagaactggatttaggtccaagttcacttctcattagctctgtgagcacattacttaacccctgtaagcctcagtttcttcatctgtaaaagggaatcatgatgccaactgatttttgagggcaattgtgaaggggaaaggagagagtgctggaaagttcttacctcagagtctggaatatagccaatgcccagtaagctgaggccccttcccgatgtggaccccctcattgacattgcagacaattgcttttcaaggattttgaattgctttttctgccccaggaaaagcacaggaggtctgggttatttttctcctctgctgccctcttcttgcttctccccgaggcctgtggctgcttgcccagttgccctttgtcagaatcccaccctttaaaagcctgacctgggccacagcagaaatcacaaccctactcagtaaggagaagtactccaggaggctgtatagacacgcacggcaaatatttaaggaattcttaggaataaaaaaaattcgtaaatctggatttttgcatgaggccatcacaggaacatgttttctcaattagcgtgcacattgcttggagtgaagtcaccgagtccacagcccatcagggctgactcgagctgagccacctgatcagacttcactttccatgacctaaatgtgattcaaccaacctgccactgcccctagctgctgaaacaaaatcatccctgaaatcccaa

SEQ ID NO: 55699 - DNA, 1095 bp, Homo sapiens
aagattcacagtggaattcacatcagagaaggtggccccccaggatgtgagttgaaaccagagtgtcctccttcactgccatcttctcaccacctgcagtggtaacacccagtcctgcatccatggcaccatgatggccctcatccgagaccagagacagcacagcctcagcaagccaagtttctggtgccatccaaaggacatcagtgacatagagcacaggaggaaggcttgtttgaggatagtaattgtttgacttcccacagattattttgtccaaaaccctaaggactccattgcaaaaaaatactgcgccaggaagagtagatagaggaagaaaagggaataagtgtggggtgagaaagggcatgccatggaagagaagggagcagagggaagaagagggctgaggggaaaggggaaaaagggactgggaattccgcagggtcagaggaccttgccaagaccaccatttgttcgaagcatgctctgcccctagatggtgctgtgtaattagcaagttcaggaaataacctcactcagcacagaatcccagctttccctgtggtgcgtttatgtatgggggcttgtttgcatcagtttcccacacagccccaaattaacttgtgcgtgctcctggcggctatcctgtgtccttttcttcccctccattctccgtgctctttttcatctgctgcgtgctgtgctaggtgctccttgtatcttacctcctgcatgctcacaagaagcctgtgagataggcagccttatctgcttcaaagatgaaaataatgagactcagatatgtaccgtgagaagctcaagctctctgaatcttaaattcaacagctggagcccaggtttgaatctggataagtgggacttgcaaagtccatgagcctgagagtgggaaatctggtgcctaactctccgtggccatccctgtgtgtctctgagcctggttgccatcatctttaccgtgctctagccaacgaccagcctgtcggccctctgacccctcagtcaatcaacagtcttgattcattgtgtgaagaccacgttgtgtacagagacttgcctgagccctgtgtcagt

SEQ ID NO: 55700 - DNA, 1050 bp, Homo sapiens
ctggagttgtcttaatgaatggccacaagttttcaatgaggacaaggaatgaagtcctctggcagagggggaagggaataaaacttgggttaccatgtgccagagactttacctttgcagtttcatttaatcctcacaagaaccctgggaagagagagtattaaatgacctcatttttatggggcagggttggataagctcagagaggcaaacatttgccccctgatgtcacagctaggaagcaccaagctggatctgcccacatctgcggggcctgggccacctgcctctgagacactccagcagcatttagcaaaaagtagctggaagttgggatggaatggggaatccagagttatgggttgcaaggcagagtgtaggagttgtgaagggttaattatgaatctagaagagagtgggaaatcggtgttctgggccagggaactggacatttgaatctgcagatcagcagaggctgggtgaggggctttcagggaggatctcagttcactcagggctggagatcttcgaagcacatcctaatgttgacgtctgcctgttatgaagcaggtgagaaaacagcaaagcccagggcagaaaggaagtgagactgaggtgttgaaagctgattgaaattgctagtgaaaatggtggagacagtaggcagaaaaaaagatgactcagcccttgaagtcttctaggaaagtagggtaagtccaggagcaaaacttagcatttaaaaaaggcctgctgtgttttcacatttaatctttacagctacctccccccacaaacccccaccataataggctgccttgcttcctttttatggattgggaagtctctgaggctccaaggagaaactgctttgcccaggtgtacagctagttagtaggcagcggactgagatgtgtgctccgttctgtctgactgcaggtgagccttgtggcaggaaggccggcacagagactctgctctgcttctttccaagcatttctctcattaaaaagacagaggaacaagcatttcggaacccgcaaagagagtgct

SEQ ID NO: 55701 - DNA, 1041 bp, Homo sapiens
aacatgtcagcgagcttgtgctggagtccaggtaaggctttcaaataaggatgagaaacagaaggagctcggggcaggtgctgctggacggggcctgtggtgacatggcagagcccagctcctgagacagtcacaaaccctctggccataagaattgaatcacacatttcagctggtgggtaaacttaccagatttagttatgaaataccagaaacagctgttttaaaataccaattttgtttagcactaccaattcccttgtcaataccaggcttccctcatccacaccacaatgacagaagtaggaatttgggattccctgggtgcttggggatgaacaaagcaggttggctttgcagtatcctttgtgggaaccatctctgggctcttttgtctacactcgagttctgactttcacgcttcggggcccattgctacgctctgctatttccttaggcctcttggggcctccagaaattgatattccaatgcccttgtagtaactttaagagactgtaacttccaattaaaacaacacgcagaatttttaatgcattcttggacccatatagaaagtacttggcaaatgttaatacaagctgagtcttttaatcaattattcaaaaaatgttcctggatatctactctgagaaaagctctgagagaggagatgaaccttagagatttgtaggtgcactccatgggttctttaaaaaacaccactaccacctacgggtggtggattctccaactgactgcagcatagggcacagcaactgtggggtgagaggcaccatccctagagagcacgggctgtggtgtactttgctggggcctaaaggatgttaagcagtagggttgccccccacaggcatgagagcaggccccaggcccagctaagggtattttgtccaaggagtgttcctgtgaaggctgccctgctcagaggtttgttgggaacttgaatggaagggtaggaggcgggttggggttggagggggaccatgctctttggtaattttagtcagagtccaactcag

SEQ ID NO: 55702 - DNA, 1048 bp, Homo sapiens
atttccctaaattcaaaatgatacttacattttgataaacccagagagttaattaacatggcataaatgtgctagctcattgttgtttttcagggaaagaactagagagagacacaagtcaccccggaataaagacggcagagggtcagaaaagtctgtcaccattcaacctcccactggagagcccctgttgggaaatgattctactcggacagaggaagttcaggtaaggatcaaaggtggtctgtaagcacactgccacttggccaagactcctgtctgtaaatgttttccttaggttctcttggatttttgtctttatttttctagcatgctaattagtttatctatgtcccatggtctcttgttggtctaaggacagcctgtcctgccctttggtagcgtggggattcttctgaagtatgattggttggcctgctttacatggtgtggaaaagtagccagcaaggttgacgacagggttgggaagggaaaagctgaagtctcccacgactcatttcaaaatggaacagtataagggggagaaggaaactcagaaaacctaagaagtttaaaaaacatggggcagcccagactgaccattactactagagctatgcaggaattgagaggccgcacgctcagatgcctggtagagaaacgtaagttaattaaggaggccctgggtcgaaaagagggggcaaaaatatattaacctagctttgggttaacagcaatctgtgcagtgcctcagtgtcagtgctgtagtgtggtgtgaaggagcctatggctaactggagaatgcatttcctctgtaaaggaaacagcagctccgcagctccagacacctactgttgctcaggaatgcagggattcattgtttgagaaaagctgcaaatcaggattttatgtggaatcctaactttacagtatttttgaaatactgatactttattaatttttttgaaccattgagtgggttcttctccaggttccaactgtctggcagcccacctgatttaaataaacatctgagctatacacagaa

SEQ ID NO: 55703 - DNA, 1090 bp, Homo sapiens
agatcacattatgttttctctgtttgaaaaggtaaatacctcatacattttgaaaatttcaatgaaaatcgtttgagttaagaagttctaatatttaaagagttaagctttcattttctggaagcctttgtgaatagggctgggtagatgcagcgggccctgcatgttcactgccctttgtagcttttacaaatgacctgtgtcatgtcatcctcactgtcttctccccaccaggatgacaactggggagagaccaccacggccatcacaggcacctcggagcacagcatatcccaagaggacattgccaggatcagcaaggacatggaggacagcgtggggctggattgcaaacgctacctgggcctcaccgtcgcctcttttcttggacttctagttttcctcacccctattgccttcatccttttacctccgatcctgtggagggatgagctggagccttgtggcacaatttgtgaggggctctttatctccatggcattcaaactcctcattctgctcatagggacctgggcactttttttccgcaagcggagagctgacatgccacgggtgtttgtgtttcgtgcccttttgttggtcctcatctttctctttgtggtttcctattggcttttttacggggtccgcattttggactctcgggaccggaattaccagggcattgtgcaatatgcagtctcccttgtggatgccctcctcttcatccattacctggccatcgtcctgctggagctcaggcagctgcagcccatgttcacgctgcaggtggtccgctccaccgatggcgagtcccgcttctacagcctgggacacctgaggtaagaggcaacatccaggaggcagaaaggatggctgatgtcttgctgggagacagctgctctgtagcacgtgaggggtggtgacagatgccaagagctaggaccagagtctgactcttttctggtttggggaggagatgcgagggtggggagggtgtccatgttcattgagtttctggacttctagatggtgcggggcagttgctggctctcacccaggttgagattttgctgggcttgttctcaaa

SEQ ID NO: 55704 - DNA, 1396 bp, Homo sapiens
gcagctattactgctgtgatcatgtagctggcagagcagccagaatcagcaagggcacaccttagtgggtatcagaacaatcggctttgtcatagatttggctgggctccaggaaggtggctcagcctgtatttggagtcaggccatgctgccaaaccatcttcatgttggtgtgtaccctcctccattcctctggcttggcttgtgctacgagaacgggatgatctagcgttcaaggttgctgccaccctaactgatccttggtggaaactggtgtccaagtcacatgtctgtgcaccaaaaatctggggtttagagtccttcacagatgcctgtagggctctgaagacaagtaggtcaccgctttgctgcatattcatctcagaaggctttcttttcccatgttttgcatcagggaatgaccagcagttttgtgttaaacatctgctgtgtgcagagccctggacacaccaggctggctgccttcagagctctatctcagcacctgtggcactcacagtcacttggaaagagaccagtgcaccgctgtctggtggacaggtgcagaaacaggcctgggggtataggtgataggaacacaggaggacagagaatttcagattgtggcagcaataaagccgagcaggagacagtctgtctcagaacaggttttgctgcagttaaagtggtagagaaaaatccggctgtggtctcagtggagatgagtgatatttggaactctgtatatgtaagtagccaagacactggccaggagtgaggtctatggtggttttgttttttggcccttagccctagttggtgtgaattccacctgtgtaggtgggaaagggcagggcatcttctcaccataggtcatgcagggtggtgggaccgacttacccccatgggctcccacatcgctcctccctgtacgactggttgagctgcacactgcatctgagtgggagtggagaggggacaaaccaaacagcccgaggaaagtatgcctgtggcgtgttcagaaagcatgattagcagcagccctcgcctcccaccacacagctctgctggtcagggcagagctggatgggagaagccagactgattgtgctgcatggctcccaggcttgctgcaaacctttcagtctgctcttaccatgaccaacaactgtccaggctttaaaaaactcaagtcagtcaccccagctccccagggagaactgaaaggtggcaagtgcccatctgccctggggagagcgttttgaggtggtccccagcctcatcctttcggcttctttttaggaccattggtgttcctcctctccctgcctttaataaggccccctttgtccctctcgtggagagcctgagttaggaggtggaaagaatggctggg

SEQ ID NO: 55705 - DNA, 1051 bp, Homo sapiens
ccttgggctaaatctggtctgaacccagcagtggctggaagagttactaggccagaaatacaacttctaaggccttttgtaaagtgtagaaacagacaggagggaagagggagcgggaatagacaaagcaagcctcggaaatcagaatagcaggtctccattagacccagcagaatcacaggctgttggctctccctttatgtaaagccttcaccgtggcagcaccctattgggcttaggtgccaagcgatggtgagttcttttttatgttttcaaagatgattttatcgaattgactgagctatttttgagagttgtctaaagaatgtctactctttagtttcttaaagaaaataggcttctcattagttcataaaaggtgcttgctgtggccctgcttgttggcaggaatgaagttttgggcttatttgaaaactttcaaaaatgtaaaaagttgttgcagaaagtaagataccataaatagattgagatacttcctaacctctgcccagtgccctaggagttatgaaaagcttttcataggtttggactcatttacccctccttgctgccctgtcagaggtcagagcaggtggggtagaggtgtcccctcttacagttgaggtccccaacccccagggtaagggacctgctcaaggtcacagggaatcagcaccttcctgtgcatcacaccgcttaccccaccgcactttctacagcgtcctggtgtctcacacagtcgctttgtcattttccatacacaccttgctcgtcacttttcttggccccgttctcacaataagttgctaacttttccaggatgttaccagagactaatgactgttgatatgactttatttgaggagaaacccagaagaatagaagagcctaaaaattggcattcaattatcttaatcatttttcagttttgaaacctctaaagggaaataagtgtgaatactggtgcacaggcactagtgtaattgactggttgaatgtgaaatggtagaacaacagagacagataaagaaaaccttaacaataaacaatt

SEQ ID NO: 55706 - DNA, 1528 bp, Homo sapiens
gttgtctgtaagatgtgccatgtaagatgtgccttttgccttctgccatgattgtgaggcctccccagccacatggaactgtgagtccattaaacctctttttctatataaattacccagtcttgggtatgtctttatcagcagcataaaaatggactaatacagatcttttaatcaaagatgtggtaacgaatcacagaaccacctgtgctttagaagaaatgatccttggattgcttttcaagcaatggaagtttatgattgtcacattgtcaattgtgattatattcaaggaagtgttatggactgaatgtttgtggtccccccaaattcatatgtggaagccctaacctccagtgtggcatatttggagatggagcccctaaggaagtaattgaggttaaatgtagtcatagtgtggggccctgatcccataggactggcatccttacaagaacagataccagagagcttgctctgtctctgcacacacccttagaaaaggctgtgtgaggccccagaaagaaggtggccatctgtaagcccagaagagagccctcaataggaaccaggttggctagaacgttgatcttggacccccaacctccagaactgtaagaaaataaatttctgttgtttaagctacctaggctgtagcattttgatacagcagcctgagctgagacaggaatattacatacactggagacttgtgaccccaaagacttttgacctgttgaatagagctcatcttgtcctctctccagctcatgcatgcatcctcccagcttgcaagggggccttgcttctctggattgcactttgattttctagttttaagtgacaaagggagagtcttctagggatgttaaagttactccagtaattccaggatatttccagctccttttgaaatcttatgtttgtaattctgggtcaagtaatgtccaagccagtgattacattactggtaggcatgtctctcatgctgggccacgccctccatcccatgttcacgatgagcaccaacggtctctgagagcccagagccagtggctgcaacgttgggaaaattcttaaatgaccatcagtggttttggctcatgttcctacgattgtgggttcatataccatctcatttttagaaatgtgtgtttttgtactcctgtaattactttttaataaagatattttgccagtccttagctccactccatagcaaagcaaaggacaagaacaagtaagggctgaaacatagagcgtggagggttttgctcaggccatgctttgctgtgggagaattttgaaggcgggagtggagctgccgtttgtggtttggtgctgtggtgcctgttaaaagtggctttaatgagagtgtaaggtgctgcacactgaagccctgtgtttattcagctgcctcctgccagcggctacagctgggatggcttccctcgcacggcgtctgcccacagccttgcgcccggagcccagaggactcacaggaaaaggagctggcaaaggtgaagct

SEQ ID NO: 55707 - DNA, 1031 bp, Homo sapiens
taaaaacaaagagtagcataactttgtggccccagtccctaaggaaaactgtgcagagtggacccatcttggctcatttcccatggcagtaccctcatggtgggcctctggaggaggttggtacaggcgcacctgggatcaagttggccgcttcaacatatatggccatataagctcgtggtggctatcgtttatgaattatttactttgaataaccactttaaaatgtgttatttcatcttcagcacagacctaaaccaggcaggctactcctctttaggaagcaggaaagtggtgggtgaactcccaagtctccagtatttttcctggtataaatgccaactagctttgaagtctcataatgtcatagaacttggaatcatcccaatggatatttaagctcatgagacttaacctgccttagggcgatgccgacctcagccagcacctggtatacttggatctcgcaggctgctgctggaggttccgagtagctgcctgtaccaggcctgccccagtcaattcattagcctttcagtaagacgttttatgccactgagtattttggagcccacttatcatggtaatcagggttttctgtgctgctcttcccatcctgcagatgaagagtatgaggtttggagaagtgactaatttgttcaaggtgaatgaatgagtgagagagcctggagtcatgttgtctggggccagagtctgcaccagttgcactgtgcgtgcctcctcccacagcctctgtgcagactcagacatgcacagagcatggggaggcagtggatggtctagatatgcagggcattaatttggtttgtatttttttcttcagaatttatctttaaaaaatatgtctttcagatttttgtgcattaacatttgaactacgttttgaggtgcttctttccaggtctgtttaagaaatgtagcccaagggcaagcccctcttctctgttgccatggcagtcatgtaacagttgtcaacaacactggaagtgctttcgtggttgattagacac

SEQ ID NO: 55708 - DNA, 1136 bp, Homo sapiens
gtgggctgtggacttggcttatttggagagctggcccatttggagagcatctgctgaggccccgtgctggaaggcggtgggccgggagccctgctggagacagaagccactgctctgggcagtgcatcacactcacagggtggagggtgagagacacagccaggaggctccgacccacccatcccctcacaggccccagctgaattaatgggattcccttgacccctccttgcagcctcgctgaacagaaaagcaaaacccagcaaccacaagatagttttgagttgaaaatggttctgagaacttctgatgattgctttttaatttttaaatttagatcagggtaatgcttttctgttggaatccaggggcctagagatgtttctttatcagtggaggaggggggatgaagtgagtttgaaccccagtgggtctgtgtgtataaactgagtcttacagccatgtggagggagcctcagaaagcccaggcactccagaaaaggcatgcacaggggtgggagctgagctaggcacacaccagggagtgtgtgtgtgtgtgtgtgtgtgtgtgtgtgtgtgtgtatgtgagagagagagagagagagatcagggagagggttgcaatgaatctctggatggggtaggaataaagaaacacttgcccctctctggagaatgccatggacagggggcaaggacggagttggagccacattgacttggagattgccaggtgagaccttcagggcaagcagactagacttctgcaggaagagctctcgtgacacacaaacctccacggaagtccgcctcctcaggaaggctgcaccctgtcccaggcagccagaagctcttctccgtggttactcagccccacgtgttccagcatgagaacatactcactgtcatggggttcatgctccaggtaccagctaaggtctatcttcatattcccagggcttagcagacacaggcactcaaatatggaatgacgagtgaacaactgagtaactgaatggtcagaattttcaaaatgcagatttgctgttaggagtcttaggtttacttccattatgcaaagttggtctcaccggatttcccctgatagtgttccccagcctcacatgactgtacat

SEQ ID NO: 55709 - DNA, 1051 bp, Homo sapiens
atggtatgtgccttgaaagggtgtccgtggtgctcacaggggcacagttgggtgactatttaagattcatggtacgtttggttcgacttcttctctgggcctacctttatggtacattcttgtttcagaacaatttctcttttttatgtaggcagacacatgtttagaggaatgttgatttaccatctacctgtgttggaagcctgttcattttgggattttatgattgaaaacagcagcggtgtgtgtttcctgccttctgccaggatcatcttatattggaagctgttaggaaagggttgcttttcaaaattggtgcacattacccacaaactcagaaagctacctaaatcattaagactagaaatctcagtagtccaggcatctggtgagatacctgcgggcacttcttactcgtggctaggagccggagttgagtgggtggcaggaggctggaggccaggctgggtaagtccaagctatgtttcagggtatcacatggttaagtgcaagaaacaggatgcggtgtcatttcttcctgggtatgttgggtgagggcaagaactttgcaaaccctaggagaggattatattttcaacaagtcaagtgatttatatacagtgtcagtttttgttggcaatatcctttcagttatttgtttgttcatttttttttggctatatgaggtgtgagctccctcacgaagcctgaaggattgataaatttcacctgtgatctaaaaacttaggaaagattcccactagtgaaaccaagtcaccagccaagtagatcatccgtaagaaagcctgaaatctgcctatgtttctgaaaagttaaggtggtcagtggtcaggggacaggacaggacttctgagtctgtattcattaacgggtcacgttgcacaccctcaagcattggtatttcctagaaaagttgtggctgccatgacattctagcatagcttgctttccattgtagactcagtgtctcatgtcctttgactttcttttttgtctgtctgtctgtctgtccttggtctccccatccctc

SEQ ID NO: 55710 - DNA, 1021 bp, Homo sapiens
ggaggtgatggaccctagggaggccgcccaggccattttcccctccatggccagggctctccagaagtacctgcgcatcacccggcagcagaactaccacagcatggagagcatcctgcagcacctggccttctgcatcaccaacggcatgacccccaaggtgcgctgctccgggcgggctctgccaccgtcatcctggcttgtcactgagcttggccagttgaattatagcgtgttactagaagtgataaaatcgaaaggcatctctaaaactcaagtaataagaattagtgattctcacttattttatgttatgttagtacaattgtttttttaaatgtgcctttcgaaggcctctggattctaacagaggagagaatttcgcttggaggacagtatggaatagtgattggagacagtatggaatagtgattaggggtgcattgtggactctggagctgaactgattcattctaacctggctcctccaccaactagatgcataaccttgggcagatggcaatagctctgtgcctcagtttcctaacctgttaattggttaggataatactaataactatctcatttgtatgttttgggaactgaaagagcaggatacacatatagtgcaacatataaacagaggtccttataaaaaacagctaccaaatgttacacgtgtaccacatgccaagctcatctactctctaccatgcgatttacatgccttgttgccatattcaatgtaattcttacacaacaaccctgtcagagagatattattattatcctcattgatacaacagcaaacaagtgtagaggaactgaaacagttaattcatgtgaagtgcttgaaacagtacctgtcatatgatgaggatggactaaatagctctatttattggtaaaaaatagaatggcgtgaacccaggaggcagagcttgcagtgagccaagatcgcaccactgcactccagcctgggcgacagagcgagactccgtccaaaaaaaaaaaaaaaaaa

SEQ ID NO: 55711 - DNA, 1092 bp, Homo sapiens
ggccaacatggtgaaaccccatctctactaaaaacacaaaaattagccaggtgtggtgacacatgcctctaatcccagctacttaggaggctgaggcaagagaatcacttgaacccgggaggcggagcttgcagtgagccgagattctgccacggcactccagcctgggcaacagagtgagactctatctcaacaaaacaaaatctgttcttgactctgtctgggacctgattgatatatcccagtatgtttctatctgtattactggctcatttcattcttccttcccctcatggctaaatcagtgtatttatttgatttaattcgcatgctgtcaaactcctagtatgtgctaggcacgttggaaattcaaattaaagaaacaaaacatacttcctgcccttcaagagagtgaagtgtagtgtggggagcagacatgcaagtcagcaatcactttgaaagtaaagggtcacacgagagtcagtgattacaggagcctgaaggaggacatgttaatctgcctgagaggttcaagagaagagccttaagaagatttgaagggcagggaagaatgagctgaatgacagtgtttagctggaggaacagcacatgtatcagaactccatcgagccaggtgccactggagcagagaactcaggagagggaagggggcatcaggcctgggcatcccctggactggccatgtgcacacttagcccaacatggaataaccattgcttgcttaccatgtcgggcattgctgtgagtgctttttgagagctaacactttcatccttacggcagccctgtgacttaggtagtgtcattgcgtccactaatagagagtgtaaatgacttgtgcagaatcactgccagtaaatggtagcgcatgcgttcttattcatgcaagtatatgcagcttgtatttcctgactgctcctttgggcccgacacagccctggccctgagaaacttttggttcaggaggaggaagacatggagaaacacatcaagtaggaccataccctaagaatggagtgatgcagccatgacggcttccagccagacactgacaccagccaccccattttc

SEQ ID NO: 55712 - DNA, 2306 bp, Homo sapiens
cttaaaacaggctgtttcttccctaatggcctttctcctctgcttccaggccttcctagaacggtacctcagtgcgggccccaccctgcaatatgacaaggaccgctggctctctacacagtggaggcttgtcagtgatgaggctgtgactaatggattacgggatggaattgtgttcgtccttaagtgcttggacttcagcctcgtagtcaatgtgaagaaaattccattcatcatactctctgaagagttcatagaccccaaatctcacaaatttgtccttcgcttacagtctgagacatccgtttaaaagttctatatttgtggctttattaaaaaaaaaagaaaaatatatagagagatatatatctatgccagaggggtgtcttttttaaaaattcttcttcattgctgactgaaactggcagatgattgaccagtatcctttgaccatctgcactttatttggaaggaagcaggggctgtccaccctgaaaaagagtgactgatgacatctgacttttgtcgatgggacttctcaagaagccattccttggagcttctgttacagctgtaaaccaaagtggagctggtgcttcttgggagcctcgccttacaactaattcctgcctttcgtccagtaccaagtcccccgttgcttctggtcagcccacttgtagacttccaggggacacatctttattctgtttcaggaaaccagtcacgacacgtccacatatgtatttgtgtatgttaatgtccagtatcacatcacccatgaaagtcgtgggcagttcaggagatacctgccttcatctttgttctttgttgccttaggttcttcagagaaagatcacaacaaaaaatgtacactgtcgtttacagctattaagtgatttgattttgtttttttcccaaagagaaaacctacctgccctgtttctgatcccacccctctgctggcttgaagcaggtaaccctttcccagccctgcagctgcccacctggcctccatgccatcctgcccccacctggctggcagccctggctctccatgtgtgccctccggctctgtgtgaagcctcaagtcagtcccagcattgtttccatagggaagtgtggggtgcccagcaggtaaagcacagggagagagggcagtgggaatgccacctttaggctgcagcaggagccccacactgcccagttttcctccccactgttctacaccaaccaggggagactaacactgtgactctgggattggcaggtgcaacttggagccacttaatttcctggggacgtaagttcttcccaagcttagagcaagctgccctgccaaaggagaccaaaccatgccaaccacgctggcaactgctgctgtccagtccctgtgttttctgaccaccgtcactgtgcaactcatcgcctctgccacttaggaccaggaaagaggctggttttgctcccactcttagttgctgataaagtggggagaaggaaaatggacactctacagagtttggggaagggagagtagggagcccatcttgtccagaaagattcatctgtggtctgtctgttaaacacagctgatttcagtgggctttcccctggccctgggggagcagacactgactgggttgtgggcagaggagccatcctggcggagccctgctgcaggggagctccttcaggagccccatccggacctcttgcactgggctgcctttgcctccatttgccttcctgtatctgcaacaaaccttttaaaagtgttcactcttgctttttccagtatttcggtaatcagccatcttgctgtagtacaggatgacattgtcgaatgctctttgtatgtgtgcacacccccttactcccttactgcttcatacactccacaagtggtacagtattttgtgtcattgtaaaaatcaaaattggctttggatctttgtaatacacctgtacctgaaaaagtaaacaacattcttcaattactagccttcagcttgaaaagacatgctggagaagaaggaagggggaacccataggtgtggcgtggagccaagatgtactattcaactatgtgtttctgtttataaaaaacacataccatggaaccatggtgcttttgttcttagtttttgccgttagatcccttcaaactggaagttccttacaatatctttctcaggaaatattttgggaaatggggtaagagatggcaagtgtgagacgggctgtgtcagaggttgctacgtcatggatacagtgcagttccaagtgccataagtgtatgtacatat

SEQ ID NO: 55713 - DNA, 1056 bp, Homo sapiens
cattcccagcagggtgaagaaaggtttaaattaaagaatttattttctctctcccccttcctctttctcccagtctttgcataggagaatgttagacattcagaaattactgtttctgttttaaattgagtattgatttttttatattgactttgtattgagttctttttgaaagaataacaaaataaaatgcaggatctttgtaaagcctttgcactttcaacctctttatagcttgagttacttttgcagtgggaacaatgtaaatgacatttaaaagatttaaggtttcagaaagctgcatcccacaattgaacacaatgcatttttatttcaattcttggaactggtaggctattctttttaaaagggggtaaacttcgccctaaggctggtagaatgtatgttcacattatagtagacaggatttcatttgccttatatgtttatagattttttataattttcatcctacgttattaaaattagagcattgagtgttaaagaacttaatgaggagtctatatctgagattgctctcttccctggtgatgttttaactggtagataatttgttcttaaatatgtacttttgaagataggacagtttttatagtccatgaactgaatgttaaaaagttctgtatgcattctcagagaggattttaaagctatatagttcatccatcctttgcattatcaaaatgttaagtcaaatctgtaatactttggctaaaattcataaagtaagccctagagaaaatacttgaccaccaaatttttgcccaactatcatcacctcccttcccccgcctctgttcttgccttttgacatctacatggaagacaagttctttacagcaaatggtaagaggcaggtgacctggtgtgtttgctgtgttgtagttcattgcctggggcttgggactccttttttaatggagagactagctgtgcaggtgtgtgttggatagggataaagtgctcacccctgccctctctacagtagttggtggtagatttctctctcattttgcctcataatcactttcgagt

SEQ ID NO: 55714 - DNA, 1044 bp, Homo sapiens
gtattaccagacggatagcacatttatatgtcagacatcttaacatctgtgttatctgtagcaggtgtgtagctcagcagatacgtgtcattgtgtatatagctgagtgtgtgagggtgtctgtgtttctgcagtcccctgtgtttgagagatgacttaataaccctgtgttttgagaggtcgctctaaaccagtgacttttccctcccctgctttattcctttccctcactgacactggcttctcccgctagagtaaatggctttagcacagcactgtcttctggggagcctgctgtcctgcaggcaagtccattaaactctttcttgctttaggactctgaaaacagcaagaaacaaacaaacaaaggtcaagctctaagaaaattactgctcaaacttcactaccctggaagccttactagatatttcttaaggtaacttaaaaattgggctttatttttaaaaagtgataggttacttacagtagcacagaaatgttagcatatttatttaaatagtcctgcagcagagaccctgcgattgtaaagtgatttaagtatttctgggtagtgtttgtgatttacggatttgttactgaaaaacaaaaaaatcactactgtgaatttactactatgtaaccttgtggtcgtatttcattataaataaaataagaattgctcttctgcccaccgttcttgattggtattcagtgcagtagcgaaatgagatagtttagacactgttgaaataactgcattgagctttaaccaagtgtatgctcagaaaattcagttttggatcacattttgacaaaacatgttttggtcaaagaaaggaaaggctactaacacatttatcaggtaatgtatgtcacagtccgtgttccacccagccttgttatccccacattctttcaagataggagtcatcttggtttttcgggtgaaaaacggaaggtcagagaggaaggggcttgtccaaggtctcatgtctggttaacagaatttcaaactagatgtttgattctaacccctcagtccac

SEQ ID NO: 55715 - DNA, 1034 bp, Homo sapiens
ctctgggacccctaagttatggcgtgattagccaaatttgatttccaacagtcatttatggccataactattgcatagagtgcaggatgccagcaaagatgagggtgggggcagatactggctcagtgatttaactcacattatagatgaccccttcctcaacagaaatgctactgagagaaccagagaggcctgggccaggcaggtcttatttgagaggagattatttgataattgctttggttagaaggactttacatttcctgatttcaagtccagcaccaatttagaaagttcagagatgaaaccacctgtctttacctgacagagtcataacggtttgtgtaaaaatgtggtcagggaccttttttgttctttctgattagttaatactgtacattgtaaccaggaggggcagttttgccaaccagcctctgctcatggtcaccatatgtgtatgacaaggcctgagtgagttcctgcataaactgggtagtgggctcttttgacacatttgcaagcatgtaaatgaatgaatgacactaccagcaaccatctgtacaggtccatttacttacattcataaggtttatgctatgaaacttcttctcattgtgatgtcagtaacagagttagtgtctctgatggaatagtgtacctgtcacccaagttattttgttcctttttgggtcctccagtataatccccccctcatcccaattaactgtaaaatgttttacacatcacattttttatactgtaaacttggaaaataaactgaaatatcaaattgtgtcttgtttcttttcttcatgtgattatttcaatctaaaaagttgcttactttttcagggacatttttcactctcgcataattttgagaccttcagaatttcaagacaacctgtcatatttctataaaaaccaagacaattgtgatggattgggaaagtagaattaccattgtaacaaaaactactagttgtcaatcattttacagtgaagaaaatgttttgaatagataactaaaaatg

SEQ ID NO: 55716 - DNA, 1096 bp, Homo sapiens
ctgttttaaaatgttttcacttgagcatgttttaaaagtaatgtattattattaattttaaagtagcttacaaaataaatgaatgtagagttccctaggtgattgaacacctatcaacaggggagaaagacattgctaactggcccccattcttttttattttttttttgagatggagttttgctcttgttgcccaggctggagtgcaatggcatggtcttggctcactgcaacctccgcctcctgggttcaagcgattctcttgcctcagcctcccaagtaactggtgttacaggcacccatgaccatgcctggctaatttttgtatttttagtagagatggggtttcaccatgttggccagctggtcttgaactcctgacctcaggtgatccacccatctcagcctcccaaagtgctgggattacaggcatgagccaccacgcctggcttggcccccattcttaagagattctatcttaattaagtatggctctaataatcctctgtgatcatccctttctgtccactgtttgcctgattgtatctgtccccacttgagttttatgatggtggagttgtatgagatgtatggactgagatctaagatttcctcgcattctgccagtgtacctcactagcctgtcccaccctcggttcaacaatgcctgaactctgaggagaagccccttactcgcatatgattttcttccttcccttctgcaggcctggtctcctgcctgtagagtagttgcctgcctgggattctaggccacaacggccccatcacccattgtgcagtgatggctcctggtgtgggttcccttttgtaaagagacctttttgtttgctgtttgactttgggggtaaatacaggagagtttacttgaagggaaagttccaaatcagtgattcaggaaaggctggccccataggcaagaaaatgtgcccatggaagagagccatggaaccacagattgggactggctcggagaccaggcgtggaacacactggcaagtttccttgagcaggacccctgccctcttctgaaaaggctgggctactatagatgctctcacaatctaagctgtgtagc

SEQ ID NO: 55717 - DNA, 1025 bp, Homo sapiens
attccctgactcccaatctcaatttttccctttttacccttgatcatcacactccatgcttttcctttgcaaccatttcacagttgcaagtgcacattaatttatatgattctttgtctagcaattgtccatgttgtagcctgtaagctctatgtccacgtctgtttttctcccatgctatctccagcacctagcgtaatacctgaacagattagatctcaaaaataaaaaataaaaacaaataaaagcggtagtttcttcagtaaatgaatgaatgaagagggaggctgtttagaaaaggggaggccagctagaacttggaggaggagtgtgtggataggcggagggggctgcaagggcatcccaggaggaagaaatggtataagaaaaggtttgcaggtgggaatgtgcaggggtgtgcaggagaacaggctgacctgcttgaacagtgggcttatttggggtgctgaaagaagtcctgtgttaaaatcacattagaaaaaaagtgtgaaggacttaactactaggactggaagctctgatttggggatcgtctgagtagaagagtaatatgactaagttgtgtttggcaagagtggatctgagtgcgtagagcagacagaaaggagagtggaaaggaaaggccaccagttgggaggctgatgtcctagtctgtgtgagagatgtctctgatctcagaccaagacagtgtcagtgggagaaaaagtgacacgtgcaggtggtgctacaagttgagaatcagtcagacctggtaagtcttccttggttttggagagaaaagggagagagatcaaagaagagggaggaggcaaaatagtttgagggtctcccatgaggaaacaaagtggaggacacacagtgatggcaggagggcatgacagaactggggaagcttctcagcatggattcagacccagagagttcacagtcacggcagtccagcccagacccggaggtgctgatctagggctcgggggagaggtcctgcgtgagaggtcaaggct

SEQ ID NO: 55718 - DNA, 1050 bp, Homo sapiens
tatttgtgaccttaaacatgtggacccataggtgcagttagaaaaagacaacctatttttatttatgttagaaggagtagagtatttttttcaagacatttatttttcagagtggtgatacttttactttggatactctgtgccaatttatttatagtcaagtgtttacactttttcctgtggaataattatgtctaactttttacgtgtttgttgagattatactgtggtctttctttctgctctaattatattgcacttgtataacaaatttcccacttctccctgtttctaaacatattttatatattaagatgtttgttcttgaaaggttcttttgttgtgagatcagcaacactagcacttcactattatagttttttaaaaagtgtattattcttatctgtagttatgtctgagaagtcctttacaagctgtttataaggagagtagcttctttgtgtgtgtgatgtttgtgcgtgtgatgaatttagcaaattaagttattttcctaaaaaaaaaagaaaaaaagaattcagaactactttcctctgtgacaccaaaaagaaaagtctataacctgaaaatgtttcatgttctctgctgtgaaactcttaaaacaaggagtgtattttagagacaagggaaaaaaaccacatctgctatccaaagattttagtctttttcagggtttttttgtgtctctgttgctttatataatgcaatattttgtagtgaaaatagatataatctggtttctatctgacgagtttttcatatctcatgaatggtgcgctgttttgcatataaataaaggtatcaaataaagtcctctcttttattttaagcacactgtctaaaaataatggacatgttagctgagcatgaaatatcttaatggactcaattccttagaaaggaactggtaagcacaacaaaatcttaacataaacatatttatgtagtgaaatatttgatgctcaaatttggacgtggatcagtcccataaatagatgccctacatatgatggtgacatagatcattctaca

SEQ ID NO: 55719 - DNA, 1039 bp, Homo sapiens
ctgtctgtgaaaaacaaatagtttggcactactatgataagaaaagcccagggaataagattctgaaaaatttgggagcacttgatatcaaaagaaggagatttagaattacatatagaaacaaatggaaaatcaaggctgttttgaggggtgctatcagagggtcattggagaggatgtagctttacaatatttatatcaggctgtgcattggcaggagttctgtagaagttggactgaaagctggaggtaatgacgtgggtggggcacagagcagctagggagctctgatgcggcttttgcttggggcagagtatgggaagatatgcaaacgctgaggccccaaatagtgcagtggcctttgtgggcagcacttacaggtgggcttggaaacacttgcctttggaacattgtttaaaagtaagtagtgctcccagaagggctgtaatttctttagattatctgatagcagactccgtgatgtttaccagcttcaaggagatcagaccattgtgaaattttttttttttttctgtagtaaaactagccccagccagcccaactgggaatttactgcctgagctgttttccaacataagttttgctggcaaaaccagacgtgagtgttccctcgactctaaagggacctgtttacactgactttatttttactgccagctttcaagttggaagagggaaattacgtttaaaggtcagcaggtgagcagaaggattcctgaccagccattcctgtgggtgtgtgcccgtgtgcactctgtgtacgtgtgtgtgcctgtgtatatgtgtgtgcctgtgtgtacgtgtgtgcctgtgtatatgtgtgtgcctgtgtgtacgtgtgtgcatgcttttctaaatgccaaccgttgtgctctgcgctggctgacaagacctgatcacttgtttgcgggcataatgatgggtgtcaggctggttgttgggcagtttcctatttgtttattgtaaagaaggtaaatcaatccgtgggattttctggcttggagagcaaggggtgttt

SEQ ID NO: 55720 - DNA, 1031 bp, Homo sapiens
caccgatggcaactggagttgtcatccgatggtggggagaggcgtgcagattttttttgaagggacgagccctgaaggaggataggcagacccaccagggcctcagggtacaagaaacccgaaaaaggactggaggctgcaggcaatacggtggtaggaatctctgccggtttccagcgtcgcggaagcaccaaagggcggtccctgaaggaaacgaggggtcttggggctggagagcggcgcggagcgtggtgggaatatcgtcacaacgccgctgtcctacatttctgtagcgaagacttgattacccctagctattacccgtgcaggagactgggccctggaccccaaatgagccaaagtctagttgagaaaaatttacacagaataacctcggagttcatggggtgaaagtgaccatgtcatgagaatacaaatgggagagaatccacttcgttgtctccagggtttagcacagtgcagacactgagtaggtctttgaaggccctgaggcttctgggtgtagacagagtgtcgggagcagagggaggctgcactccttggggactctaagggagttttaaaggaggtaattgaaaggcttggacctggtggggagaacaggcacaagtggaaatgcacaactcgcctcgcttttaaaagcatgcagcgtggagggctggtccaggtcaggtggcatcaaagagcggagtacagggcctctccattcccctgatggagtctgggttagtggcctgtgcttttaccacaccgtcaaacccttgatcatttctgtaaacatgcactttaaagctcattctttgtctctcctgccttaaaagaaaaagaaaaaagtttacttcctgagctaattttggggggtttagacatcacagatgtgtgccccaagcctaggaaggtgaagtgacttgctcaaggtcaaacggttggctagtgacagactaggcgtccctgattcttgaacagcctgtggcctcaagcctgaacatgcatttactctttaacattga

SEQ ID NO: 55721 - DNA, 1048 bp, Homo sapiens
gtgaaggactttgttcgcggttgatgatcatttttacgtttttgaagtcttgcaaaataaaatgggcttttcggccttctgtgatgagagggagcctgaacatttgtgctgtgctgacttcttctagctgccgagggctctctgccagccaacaggctagaagaagaaacccgagtgtcagatcagatgggctcacagtaatcagagtggctgggtttggacggcaaagcaccaggcaaaatgtttcccatccctgccagagctgtccaattctagattacactgaaagtacatgtccagtacatgataatgtgcagtagagagaactgtaaaacctactcactcattttaaaactctccatttatatattttgggggagggatgtggaacctagtcaggtctgaactttctcacgttgctatgaattgagtgtatgagaggaagtgtgtattctttggctggagtcatagagagactgttcttagcatatgactcacctcattagttgtgctgaaatctgttgtcaggaatccacaagaagttcttcatatttattttgtgtttcggatagcagattctgttacgaaagaagtacccttcaccctacactttctctttggtttggtttttatttgcatcctgagcaaagggatttttgatcaatagacctcattcctttgttcctttgtgactttacagtgaatctctttatctggttttagacctcacttactagttcctttgtgagttatgatgaaatatatctgcacgtgatctctttccagttttattcaaaccctatttagtaatgactattggctgtctcagtgatttgataagttgattcatgatagttcgtgctttgtccttgggacttgtattgtttgggagcctgataatcagtgtaagattttgtgactcagtgggccttgctgtgtagatcggtgagctgtgattgctctttctagtctgttaccatgtaggggcaggtccctaatgcactttggggttatcctcttgtgtgtttcttttatcttccacatgatg

SEQ ID NO: 55722 - DNA, 2012 bp, Homo sapiens
tgtagaagttagtaacttgcctaaggatacactgctggtaagtggtaaagcccaggattttaactcaaggctgtctgattgagaatgcggactcataagcacaatattgcactctaagttaataatgtaaagttagtttcattctttcagtagggaagatggaaggctgcagaatagggattttgatagcaaaaatctcctcattaaccccaaaaggaagtggcactggcagggccattctgaagcctaccggtagcttcagtattgttcttaatgctcttggatggagagaatgtatcttgagccaatgtattaatagtagattgctttgcttatgtagtaggcaatatatgggtatacattttcctgactattatcttaatgactattccaaattatgactaccttaaaaactaccaaaatcccctgctccagaattttcagtttcagatgaggttcataattcatggcctcacttttcccacattctcctacaggttggacgtgataagtatgagcctgcagctgtttcagaacaaggtgataaaaagggcaaaaagggcaaaaaagacagggacatggatgaactgaagaaagaagtttctatggtaagtactaggaggaatattgtattccatccttattaaaaatccatgatttttaatcccccaggcctcactgtattcttcaaagaactgctatatattaaaagagatcatagcagctgtacagatctcatctagtcgtagaggttaatgttgaacatatactttttaaaagctgttagagggtaggaaaagttattcagtcactctggcataaccagagataacagaaggaacttaggttgataccatgagtctttgcttttctctgtattatatcaaacattgggaaattcagcctctccaggcgatggaagcttccatagacttaacctgtctagaatcgacctggtcatcagagaaggcagataaggttttactagatccctgagagctgctgggtttctctgaagtgttatggcaaatagtaatgggccacggtcactcagctttagccattctccagtgaagagctgtcaatgataactgtgtggttgcaaagccacaaagcgatggtgaaaattgtaccaacttatgcactgaagaaaacatctgcactttgtttaataagcttaatgatagtaatgaataatgctattttttctgtcatttttttatactacactgtttaactattttctttgtttctgttttcccttaggatgatcataaacttagccttgatgaacttcatcgtaaatatggaacagacttgagccgggtatgttctagtttgaaagctgttgtacaaaatcctagttttccgtattatattttcccctgtattacatacaggtctaacctcaggggctctagtaagaaaatgacagacaccatctgcgtatctaccatgtgacatgcacagaatttgggcatttatatgctaccgtttcttttccctgaaactttttgaaagtagatgttattttcttttccctattttatagcagttgagagccagtaagtgggaacaccaggacttgcagttggcttcaaagccatgcttatgccttgaccttttgatgataaattttccctttatttttctacatttgttaaatagagttgaatctttcacctagttgaatcttcaacaattcccatttttgcacttttcccagctagcccattgcagtgtgttatggttatactatcatttgtttagttattctatcatttagttggaaattgttttgtacaaaaattaaagaaaccttttcataaaataggcgttatgtatccttgttatgtagaggattttgatattaaatgtgtaacaaatgttataaaagtaaatagtctagggatgtcttatttccagataatcactgaaatgtctgggaataacttgaatagcaagccaatatgtagcattttttcagtaaggcatcaagagacatgggtact

SEQ ID NO: 55723 - DNA, 4482 bp, Homo sapiens
cttaatttgcaaaactgaatggatttgtgaaaatagatacctttttggcagaaatgcaatttggcattaatcccttgatctaaaacttagaagaaaccaggctgaattcaaatttattgatggatcaatttaaagagttttaatctgggtgttatgagttccttgggcctattgtttgcctgaaccctgtggggactggctcatcagcagaattattcatggaggaatttgctaggttttaccttggctctctagcttgggacattttgtttcttccttaaatccttattgcaaccgtccagctaccaggtaggtatattgccttgtaagtgctggtacagtttgccttatttatattccactgcttctcagggattaacatctgctcgtgcagctgagatcctggcgcgagatggtcccaacgccctcactccccctcccactactcctgaatggatcaagttttgtcggcagctctttggggggttctcaatgttactgtggattggagcgattctttgtttcttggcttatagcatccaagctgctacagaagaggaacctcaaaacgataatgtgagttctgtaattcagcatatggatttgtagtacacatcagatatcttctccgtctttgtctcccacttcttctcaattaccactcattacttaatggttatgaactcattacttaatggttatgaacagctgttgccttcaaggctcatccattcttccttcgtttccatttcctctctctaccacccacgttgtagatgctcttacaagtgggatgcccacctgcatgtgctgctgtgagcaggcagctctgctcaggccccggccgccacccactggatggcagagcacagcgattcatgttggcacatccacctgtccagaaatgcttggtggccattcttcaaaatccacaagttggttgaaaaacaatctttgttttataaagcaggagaaactgatgcatctagaacctttccaaacgtccagttagtgatcaagtgttggtgtgcctgactccatttctgacccttcctgtgtggtctttagaaggataaataagaaaacatgagttctatatttctgaaatcttggtttctctattaaaaatctgttttttattcagtcaaaaaattaattgaatgtccctaattattgtgtagagccacgggccctaacttgtcttttcccttccagctgtacctgggtgtggtgctatcagccgttgtaatcataactggttgcttctcctactatcaagaagctaaaagttcaaagatcatggaatccttcaaaaacatggtccctcaggtaccagacgctttgtccttccccagtggatgacttgacagccccaagcatgtcagcctgtgaattagtgtgaagttaaggttttccaagtattacatgactcatcagagagatggatgtcttctaccccacccaaaaccaacctattttccttctatccaaaaagtggtagcctttcttttgaatgtaaactctgaatacaggcacaccatgtaacagcaatatctcttaaactggcgagcaagcttttgtaacttgtgtaaataaaaaagtgaataatatctttgttttgtattcaggtaattaggattatgactatttttattttcttgttttggacactaccttctctttgttggtatactaacggtgtaaattgtttcttttccaaagcaagcccttgtgattcgaaatggtgagaaaatgagcataaatgcggaggaagttgtggttggggatctggtggaagtaaaaggaggagaccgaattcctgctgacctcagaatcatatctgcaaatggctgcaaggtagctcttttattttaacaaacctcatagctagctctgctgttcgggcagcttgatttgaggggtacagtagcccatgataaggctggtgtattcacatgacatttttcttcttttcctcacatataggtggataactcctcgctcactggtgaatcagaaccccagactaggtctccagatttcacaaatgaaaaccccctggagacgaggaacattgccttcttttcaaccaattgtgttgaaggtaggccatttttgggcactttgagcatggcgtggtatttctcttgggcattaacaaaatcaaaaccataggcacaatctcttgttttattggctccatttctgagaacttgtgtcaagcacagagcagaggtgttttcctagctggcaggaaaccttgtggcagtttcccttccctccacctccaccctgcctcttctgtcaacaacaccagtctggcatgggtgttggagctgctgtcctgctactggagagaagtccctttgccaaacagcatgtacagccaaagagctggcccttaaaaagtgcttttatcaactctttttgtttttttagtcatcctatgtaattgtgtaaaatccgtggcttccttcaggttagatacaattaggtacagttctccctccccttctttttaaggcaccgcacgtggtattgttgtctacactggggatcgcactgtgatgggaagaattgccacacttgcttctgggctggaaggaggccagacccccattgctgcagaaattgaacattttatccacatcatcacgggtgtggctgtgttcctgggtgtgtctttcttcatcctttctctcatccttgagtacacctggcttgaggctgtcatcttcctcatcggtatcatcgtagccaatgtgccggaaggtttgctggccactgtcacggtaagaggcaggtgatggtcaccctgactcagatcagcttgcacgaatgttacactcttccgctatcctattctaaggtattgccaacttatgttttattctggatgtttgatatagttcttcttgagagccacatcacgtggtgaattttgacagtgagaaaacctcagcatttgtttatacgtaagataaccccaaagcatacattttgcttttaaattatcacgtggtcctgaacagtgcagtggagaaaggagaagaacttgggatcaagtagggggatagaatatggtagaatcctgttattatttttcttaatagattgcttttctggaaggaaggggaagcctcatgtatgggttccccttattatttcttcaaacttcagaagaaggttggagagatttaattttagacaaatttcttccacattaggatatagcaagaatctgtatagaattccagcctggttgagtgaagtaataatcttcctaatattttttaggtctgtctgacacttactgccaaacgcatggcaaggaaaaactgcttagtgaagaacttagaagctgtggagaccttggggtccacgtccaccatctgctctgataaaactggaactctgactcagaaccggatgacagtggcccacatgtggtttgacaatcaaatccatgaagctgatacgacagagaatcagagtggtaaggccagggttaccacacacctcagccacctgctgacttcgcttggttttttttcttttaagaaattgcatgaaatttcttttttttttttaagctcatggcagctttttctttcttttttgttttttttttttttatcatttagtgaagagtcaagggtatgggatattgattttttgcatgtcagtagaaactttaaattgccctacaaacgtgactgaagaatgcctaaaatgtgattggtttcattaattgggaaatgagatgtatcactgcagatttctatgggactttaataggagaactgagaacacagcctttgaagttaatgcattgttgttctgttgtgttttcttgcctccatcaggtgtctcttttgacaagacttcagctacctggcttgctctgtccagaattgcaggtctttgtaacagggcagtgtttcaggctaaccaggaaaacctacctattcttaaggtatgctcaagagttaactaatggagggatgtagacagcacatgagaactgccatttgagtgttaaaagtagcaaattacctttgtggtctgtgtgactgttcactgtagaacacctggagtggtctgtgcagtactttgctgtgtgtaacttacattgtgttgcctgtagatcctgatgtattataggaccccctgctccatataggttgattaaaaagggaagatgcagtaaaaatctgaccaaagtgggaggggaggagacggaagacagtctttattggtgaaaaacctaattcatctgcttttactactcttgagtttatatgttatcacctaacctagtggacagtgagagctgagggctgcagtgactccataatcgtatttgcatattaggatacagtagattccagtaactcctttaagccatttattttcctgaaatagctcagcttatcttatcttattggttcttagcttgtttactaatgatgtaaaaataag

SEQ ID NO: 55724 - DNA, 1049 bp, Homo sapiens
ggcagctgaggcagataattccatgatttgccaaatccaaataacttaatgtcatcatcagtgggcaagtctagaaccctaatatcctggtgctcaaaattagtgttatcaattcagtcttctccacattaaacaatttccaattcctttgaggcctggtgtgatggattctgtctttcaaatgctttttttctttcagtgactctatcgttcataaatgttaaataaaaccctcactctgttataaaaatatagactttaaaaattttccaaagtaaacactccagagaaaggtaggcgggctgaataggctgctgttgtccttcttactgcccagcgtcactgaaattttcaaaggctcctgtcctcctcgcaggtttctgccacctctttctgccagatgaacagtttcctgaagggttccagtttgacactgacgatgtgaatttccctatcgataatctgtgctttgttgggctcatctccatgattgaccctccacgggcggccgttcctgatgccgtgggcaaatgtcgaagtgctggaattaaggtagtgcccaggcgcctccttggcttcatctcttagtgccttgggacaccctactcagtgaatgttgccttttgaggtccagatggccagctgttctatctcacctggagtattaatttctcatctccaaagctttacttccacccagaaaagaccagatagtattaaaatatgatggtgtaaacacacgaggaattaaaaattttttggaaagcaattgtgtaaaaaagaaatgtaagcaaagtaaaaacagcaaaagacttgaagttttaaaatacttgcattattctaagttaatgtaccttatgcaatgaatggcatatcttctgtgttttcagttaactgtttgttaatgagtgtttggtgtcctctgtgtatctgtctttttttaagtagctgaatattactcaagtgcactaatatcctgttgctgggtatttggtttctgttttttactctcaggattttattttatttattttttgagacagagtctt

SEQ ID NO: 55725 - DNA, 1096 bp, Homo sapiens
aagtataatcactgcatcaaaaaataacaattttgaattcttgtcacatgttgcttttcctccaagttgtgccaatttgagaatgctagccagtagcatgtggtgtcttcacagtcccaccagcatcagatttttatcctttttttttttttttttttttgctggttttagtaattttcaagtatttttatgtaactctgtagaaggaaaaatagacattgtgtatgctagtgattgtataccaagataaaacctgagtattgcctttgtgtttcctttctgtggatatatatgtttatatttttggctaatcgatgtttattagttttatatttgcattcctttccttttgatagtctaagccgaatcatccttagtatttactcttgcctactggatataagactttaaggtcatttacttggcagttgcattcaacacattgtcttgtttattacaggtcatcatggtcacaggagaccatccaatcacagctaaagctattgccaaaggtgtgggcatcatctcagaaggcaatgagaccgtggaagacattgctgcccgcctcaacatcccagtcagccaggtgaaccccaggtaaggcaggaagctcaaatcacagtctgctgtgaacaagcaaatagtgatggtttaaaatcttcagcgtggttctataatggtttgcatctaggcttgctctgagtaggaaatgtacctgcactgccagaaagcaaccttgtcattcctaagaagggttttaagtaagagcaagtcataataattagcacttagatggtatttactgttctaagagcttgatatggtgacctattatttgcagagcagggaaggtaaggattcaagaggcttttgaagtacctcagaactggtgaaatcatgcagtaaattcagcagtctagcttctgatttcatgctgttaaccactgagctctactgcctagcacctagcatcttgacactttccaggtccacactaacaaaataaaataaggaagggacaattacttaggccattcaggcaaacacaggagacatttggcaatgaagtaaaacagataatagcaaattggttttg

SEQ ID NO: 55726 - DNA, 2658 bp, Homo sapiens
tggctcactgcaacctccacctcctgagttcaagtgattctcctgcctcagcctcccaagtagctgggattacaggccccaaccaccatgcccggctaatttttgaatttttagaccaccattttggcaagctggtctcgaactcctgacctcaagtgatccactcacctcagcctcccaaagtgctgggattacaggcatgagccacacacccagctaaaacttggttatatttcagcatgtctaataaagatagggaaaggaagaatacagacaggcctgccttagagatcatcatgagcctcaaatgagataaaatatatgaaaatgctctgtaacctgtaaagtactgaacacttaatagcttttatgtgctggggaaaattccttctttgttttgtttacaaagtgatctgcataagaatatcccctcttgaggtgatggacacatgctggtgatgtgatgcgtgactttttttttttttttgtcctaattctagggatgccaaggcctgcgtagtacacggcagtgatctaaaggacatgacctccgagcagctggatgacattttgaagtaccacactgagatagtgtttgccaggacctcccctcagcagaagctcatcattgtggaaggctgccaaagacaggtcagccagcacaaggatcaggctgctttgggcactattggctttagggattggagttccagtggaaacagagcaacggtgatggatggatgcatacctcgctgtattagactcagtataaataggccagtaggaagctcataggcatagagagggtgacttgttaatggtttagcagtgacagaagcactttaaagtccaggtgtccactgtgtcccagagcctgaccgctccgtggagtcatctgatatggggtcctagtatttgcaatagagatgtgagtggtcagactacagggcgtgcatacaggaatggcattttctggagtgccacccaccagagtcattactttgagtagctcttgttaatgctgggggctatgtttgttgtcacttctcagttctgttatttggtgtagggcctgtgtgaatacttgcctgtgacggttctcaggcttcataaatagtctcaataggaaaggagcagtgtctgtaatgagtgctcagtgggggcatgcatcgcactatttccatcgctaggaaaagtgattggtattaacccgttttcccttttctggggtagggtgctatcgtggctgtgactggtgacggtgtgaatgactctccagctttgaagaaagcagacattggggttgctatggggattgctggctcagatgtgtccaagcaagctgctgacatgattcttctggatgacaactttgcctcaattgtgactggagtagaggaaggtgagagctatttaaggtgtacaccaagatcttattcagatactgcccattagcatccatttctgtatacttcttggatatgttcagtttccagtgtgcttgtctcataagctaacagtaaaaaatcttggttttcataggtcgtctgatctttgataacttgaagaaatccattgcttataccttaaccagtaacattcccgagatcaccccgttcctgatatttattattgcaaacattccactaccactggggactgtcaccatcctctgcattgacttgggcactgacatggtgagtgtcacaacagtcacagatcgatagtagtgaggtgtgagctgtgtcttcattcactggcactatgctcccagcatccatgaggctggcgttgggaaaagaaattctcaggaccagtatccagtgtgtgtcccaatcccggcttcacagaatcagtattaccactcttcaaggcagcagttaacatttgtttatcagatgggaatctttatttttgtatacttcacctaaaagatttttaaatgggagggcaagaattttataacaaaaggttcacaatattagcttccttatttttagtaactaaattccttctccccaccccttcccaggttcctgccatctccctggcttatgagcaggctgagagtgacatcatgaagagacagcccagaaatcccaaaacagacaaacttgtgaatgagcggctgatcagcatggcctatgggcagattggtaagctgcagcctggagtgggaagctggcacatctaaggcatctgaggtgatggtgtccacctcaggttgaggttgatttcagagactgcaaatccaggcgactttcaggtctaggatgagccctaacggagtgagcctgtggagtttctctgaactctcttccatgtgagaatacatctgttgctgtttgcccagttaccttttgtggaaactggttttctatactgagcaccttggaactgggctcaactctgcctgagaaatgaggatgtccttcctcactgagccttgcggaacaggaggcatggttctaaggaattgtgtgtactgacgcacaggctgctttccctggagatacacacttatctgtcactcacttggatggagttaggcattggagaaagtatatgtgtttgagagtttggctggtaggtcaccaccaaagggtgatcctccatccacctcacactggacttctgcccccacagtgcagcatgact

SEQ ID NO: 55727 - DNA, 1335 bp, Homo sapiens
aacttggagcagcgtggttaaattggatgccagggggaggagggtcctgaaggtggggaggagagtcagaaagtgccacagtggctagaaaaatggcagcatgtaggaattttgaaagatggaaaagaagttatcatttgtcagagattaaaaagtagggaagtggatttcccctaaaggtcatacccttagaagcagctggtcaagtaacaggtgggcattttgagagcaaggcacatgtgtctttgtgtaggctccaaaaagtgactcaaaaagcagagggccctgagattggagtgtatgcctggggtcctccatcccatccctcatagcctgtgagtgaccaggcaattctttcctgtgcttttatcaaccagggggaaacactcctccatatgtgctctcccaggcctgctgcagtaatcagctgaaggctatacaggtacccttgtgtgtgaggttctagtaattgggttgttttcccaacttaggaatgatccaggccctgggaggcttctttacttactttgtgattctggctgagaacggcttcctcccaattcacctgttgggcctccgagtggactgggatgaccgctggatcaacgatgtggaagacagctacgggcagcagtgggtgagtgggcacctctgacctgaccagtgtcagagctcctcaagccccagaagactgaggccacactgccaccagccatgcaggtgaagagccagagctcatcttctgtcttctgcatttcagacctatgagcagaggaaaatcgtggagttcacctgccacacagccttcttcgtcagtatcgtggtggtgcagtgggccgacttggtcatctgtaagaccaggaggaattcggtcttccagcaggggatgaagtaagtaatgaaggacatgtcaaggccttggctcaaagaaggggactggtgatttgtaaaccctttgccaaaaactaaacatatgacacatatagccaggtttctggaatctctagtttatagagcaaatttaggaagcaagaaatgtagctttctagttttttcatctgacctccaagttttcaagtacagctaatacataaagatgttgatctgccattttaatgcatagcattagaagataaacctttatttgcaccttttaagttttttctcccctactttgattttaggaacaagatcttgatatttggcctctttgaagagacagccctggctgctttcctttcctactgccctggaatgggtgttgctcttaggatgtatcccctcaagtaagttgatcctctggtagctccaaaaagtatgaaatagtatgtgtgg

SEQ ID NO: 55728 - DNA, 1793 bp, Homo sapiens
gttttgacccacactggcaggtctttatcttcaaaatgctgggatattaggcagatggtcttaaaaagcttcttaaacactttagaaatgaaagaaagaaaatgttcagttgctctgggatggttaacagaaaagtactctgctcatcctataaaccaagtcttatgaaatccaaactgaagatgagtagggattccattacaaagtctgcagactgatttcctctgcgtctctaggccctgggcacatggagtagcaatctgttttaagacatttttatttgttctgttaatgactcagtagttaactgtgactgtacttggcttctcctttcaggctgattatttcattgtcactggtgatgtgcaatttctctttctttatttgaactgtgttcgtgtgcatataaattggtaccttactctatttccagacctacctggtggttctgtgccttcccctactctcttctcatcttcgtatatgacgaagtcagaaaactcatcatcaggcgacgccctggcggtaattatgggcattctgactttggttggaggaggagtgggaggggctatagttctattggttttttgtttccctcaaggtgtctaggctccctcagtggtcagtctgattagctaaggtgactggaccagcaaactgaccatagtcacatcttcagaatgtagatctcagttacagtttgaggactggtcatgttttagactttaaaatacaaaccaagtatgatttagtgaaaacttgtcagaatctaaaccatctttccaggtaacttggtattcctaaaaacatgtaaataagtacagttgaggtcccatgtttggattttaacacacccgacccccatcatcctccggttggttttcatccctgtttccctctgtaatgctggagcgaggaagactcactgtagtgtgtcttgtctgtctctttgccacccacaggctgggtggagaaggaaacctactattagccccccgtcctgcacgccgtggagcatcaggccacacactctgcatccgacacccaccccctctttgtgtacttcagtcttggagtttggaactctaccctggtaggaaagcaccgcagcatgtggggaagcaagacgtcctggaatgaagcatgtagctctatggggggaggggggagggctgcctgaaaaccatccatctgtggaaatgacagcggggaaggtttttatgtgcctttttgtttttgtaaaaaaggaacacccggaaagactgaaagaatacattttatatctggatttttacaaataaagatggctattataatggaatttgtctgtgccctcgtcgcttctttggtacagatgtctatgtgatctggagctgtggttttcaacatgagtccctgaccagcagtttatcagcatcacctggttgcttgctaggaaggcgggcccagacccactgagtcagaaatgcatcagcaatgtggcttaataagccctcaggtgattttgatttacattcaagtttggaaaccactggctaagaggaagcattctgcccgtgctcttttagttggagtaggtgagtttacctgacccattttttctggctgctgcctggggtgatagggctgtaactccacctgctgccttagcatctggctttttgatggaagagcacctcgcctaaaggatttccagaccctcagagtatactaaactgcagatgaggcccttctctttcagtctaaaagagacctgaagccttcctgctttccctccagagatcaccacc

SEQ ID NO: 55729 - DNA, 1085 bp, Homo sapiens
gaacacctcctgctttcagagctgctgtaaaaggctcccctcagtctcagccatgagtggtgcagagtgctgttaactgccggtgcttctcccaggctgtcattgccaactgtcgcctccaagcaaacacaacaagcaaactccttacctctggcaccaaacagtgatcgtgatctgccagatgatcatagtgtcttttttctccgaaaagcttaactcagtcctcatgcttggttgctgtgcacttccaagctgggccaatgcgggaggagacagtggtgactcctgtacactggggctgtggttgctgcacccacccactccagccgcagaactgggaggggcaggtggtcttggactctcctttcttggggcactttcccctgggatgatctctacatttgtctgcaagtcatctttaaaatgagccatttgctcagaccaagataaggaaactagaactaaaagatcatgggattagaaggttgtgagtcaggtagcaactggagcctcctggaaggtactttactggcccagctgtgacggcagggccagtcacacaagacgtctcttgtgaggtcaggctggcactggtggtatccgtactgcgactccctgtatgtctactttcggcatccctggagaagaccaacgcacatacgctgctgcgatgaaggtcatgggcatttcctgatgcaaaagatttgaaacactctgagactttagcttttgacaaggggaccccagagaacgttaagccagtgtttctctgacagctctaagaagccctggtcttctgggaaaccctggagggagcaaggcaaaaggaaggctctgaacttcacacctgattttccaccagaacatttctgcccttttctgtgtgacaatcctttgaatagaaagttctacagccaaacatttgatttaggaagagcaggtaagtgagctgctcttcatgggtaaagctggcaccaaagtcaggcctgctgtgggttagagctttcccaactttctaaaagcaggagtgcttgggctctcatttctacctctacgctcaaactctcctgctggccctgtcacta

SEQ ID NO: 55730 - DNA, 1033 bp, Homo sapiens
gcaaaaaggaactagatagtaagaagcagagggagacacttctttttttcttctttttctaaatccaagactttcaaaagctttcgtgtgtgctttcctctgctcccagaaccattggctgcatccttatcaactccttgcagctgctggcttggccaggagttgaaaatgtgactgcctctcccttgggtacccataatggttccatgttaagtcttatgtataatttttcctaatttttttctaatgttctttttctgccagggtatgttttaaaaagggaaatagagtattatggaataagattacccttctatgtccttcgtgcaaatccaaccagtatttatataaatgaatgtatgttccctcatgaggcatgcaatgaaaatgacaatttgcatttatgcaggattgagcagtgttttgctcactacattctgggattcctaagctttgtgggagtagttccaaaggtttggcagaaacgagagtcaagacaccagagagtggcatgctaggaagaacagccccggcctcttcagctgccctcttttcttactttctcatccatgattatctacagtgacaagaagataaaactggaccttgcaatactagtcacagcatgaaaaatacatccacccctccttttgatagcaggttctcagtatgtaaagggaatctttttggctgcctgcttaacgcattgcaggtccagcattcctgagctgcttttgattcataaaattaaccaggcatttgagggcttctaaaagtgcttgatggacagcatttctctcaatgaaagagcaggcactgctccttggtcaaaggagagtccaaccaaggaagcctaatgagttattcctcacccaatacctggagaccatgacctgggggtgaggggcttccccagccccatgtgactgggctgttctttcctcagccctgctcttaaggggcttaacagctcttgctggcagtccaaatggctgcatagctgtcagtccaaaagtcccattatcatatcccg

SEQ ID NO: 55731 - DNA, 3813 bp, Homo sapiens
aaaagaatataagggtcatcttccaccattaatggtagcaggggaaagacaaggtggtgtgggagtgtcaccgaggagcttccactgggtcaggtgaggtcttcaaaaggaaatgtgagcagtccaggttctcagccctcattgtcttgtctctctcatgattcttttcaggtcccaccctccagtccatcatctgctccaacgacgcactcttctacttcgtcttcttctaccctttccccatctttggcattcttatcatcaccatccttctggtgcgtttcaagagccggaactccagcaagaactctgatgggaagaatggggtgcctctgctgtggatcaaagagccacacctcaactactcccctacttgcctggagccccctgttctcagtatccatccaggggccatagactaagcgggtgatgccccagcggatgttggccacggaggagctgaggctctccctttctctgtgattggacagttgacagcacccaaactctggggtgcatgtgtgtggaaagttgtcagacttgaaaagtgttccaagttcccagtcagtcacagagacagactgcctctcggtggcagtcttggttggttagctatttgcgcgcaaatgttgtgatcctgccattatagatttcttgtttctgtttttagtaatgtagtgagtagctccaggtgccacatctactcacagatttatctagtattctcagatagatgttacagggcttcttattctttgtaatgtactctttttaaatccctttagtttaccctttttggattccttaatgtggacgaatttctcttacgtacaactgacagcaaaaggaagggcgaactttctagtgacaaggaatctcttccaagactttgtttttgcacatttgaaaatgccacccatggatcaaaatatacccaaacgttttttactttcttaacaagacttaagaattgtgtgtagtgtgggcaaaatttgtatgttgtcttttccctcagctggagttattggaaccactttgtagtcaagacgaaagcactgaattttgcttcaaagaactgtgtatgtacaagagaaatcctgcataaccccattaggagtagatggtgcccggcctatctgtcagggaggcaaaaaaggcttcatcccatccttgccaaaaaataagaaaactgtcttggagaatgggtcagaagccccaaacggcacacactttccaaattaaagtgggcaggggctgcttttagcagctgctgacctgcagatttgtcaaagccagtgactagagaaggaagggagaaaggctggctgttggcttgctctgagctgcaaggatggtctctaactgattaactgtgagcaggtgggcctgtgtcttcaggtgctttgccaaactcttaaaagaaagtgtccagtgaacttggaagtgggcccctgagctgagcacagggccaaagcagccatggcagacacctgacggagggcacggggctggctgacactaagtttggtgggacagtgaggggtgggaggggggtttccagggcctggtgttggagagtgcagagaaatatctacctccctggaggtgtgaagactaggtttttcttcttccttccaattagattttccttaattatagtgatgtcttccttattcatttttctctccctgcctctcactgccataagaatatcagcctgggggcagtccagacgcagccctttgtcatcctttctgtttgcctagtctcagcagactgtgatcacaaggcattgtctgtgggatttttcctttccctttcttgatctctcttgtggttctaggttgtttggttgttcattgttatggtggctttttattttaacgccccttgagccccatgatggctggtgtcaccctgttcttttacactgttgggccaggtgctgcttgtccttcttagggcatcatcaattgcaaatatttccttttgctccctttatgaagatgttcttatacccttgctttcccatatttttctggccaagcatgccatctcctttactctgggaacttacatcctgaatcccaagagggggtcacagtttggaaaaagtcatcagggattctggaactaagtctgataaaagattccagtgaagccctgttctgagaacgagcagactgcaggggaggccatgggattccccaggccagtgtctgtgctgatccttcaagggtctgcaggtatgcaggtggcctgggctgctcggcagatactttgctgattcccagctgaggggagcatggtggcgattgctcagccattttctgacagacacacagacctgccttttctcccccaagtataccgtaccctcctgtgagacagtgtgtgcaggcaccaccaccttaatcctgctgttgcctgacatgctgattctcatttattatgctgcatcaacacattagaggtacaggagcggctcagtcatgaaaaaagaaggtcttttgccccatttctttatttcagagatgtgggctttcagtgggaatttgctgactcctactttataggctgagtcaatgagggaagatgactggcgtttcctctgtctaaatgggaggttgccagagcgctggctgggactaggatgtgtaactaagatttcagtttgaaatcttagatttcagttcacggcgataaagaagtaggtgctgcacacaaatatgtaaagcaattgtaggaaatttgaaaggaaaaaaagaaaccgaagccagtattttaataattgctttttctgtgtattttgtattgggctgggggatagcatcaaaggttgaactttttgagctttctatgaaaaaccccaggaccttctttctttggccatttctatggaaatgcgatgtcagatggatggtaatggtgccctccagtggctgtgagacctcattgcgcattgtctactggagctttagtcttctgagacggaggaaaactgctgaatactctggattcatctatgtctacaatgttgcatttatgaaaaactacactgtgctaggcgcattctaggacatgaatatgaccacaccctctttcaccgggtgtttctgtagcaagttttcatattcttttcaaacaatggtttctctgcgttaattattgaggaaaaaaaaagatggggtaagaaaactacccatgcatgatgtagagagctgttgatttgtttctgtttttttaaaggaaaactatttgtaagatgttgcactaaaacattttatatacacttcagagacctgtagtaaattatgttgaaaatacggctgtttacatttactgcagtcttctatccttctttccccttactaaccagcccccttcctctgtggaactgtgctgtgggagcctacagttctgcccttggcattggcctgctaggctcaaggtctgtgaattgcagtctttattattacaccccataaccttcaaatgataaaaacacctcttcctcaagacacttcactgccatctgctgcaacatatagtaaatagacacctccaccccgatgatcaaggctatgctacctctagagctgtgcaacacacaacacacctagcccctgaaagccaggttcagaatgtagatcttataacctgtagcgtttttgttggggggtggggtgggggtagaagccggatgagaaggagagcaggaacacaggatggccttctctagggcctctgcggcaagtccacaccatccttttccaactatgaagtgctgccctggccatgaaatgcagcggg

SEQ ID NO: 55732 - DNA, 1073 bp, Homo sapiens
cctcctctttgctaattacgtctgcaaagttgctatttccaaataatcacattctgaggttccaggtggacatgcattttggagggacactattcagccactacaaggggttacagtgaaaataaacacctcttccccccgggattcccataaggaaccacactaccagcttcttatgaattcttccacagatattttatgcagatataaacagatatgtatgtcaaaataaaatatgttttctgcatacaatgacatggacagtaacattgttctgtactcttaacaatttttcttggatcaacttccacctgtagcactgcctatgccttttcaataggtgcataatatcttatagtatggatgttactatcatgtgtttaatgatggacatttagtttattttgagcaaataaatttaaacaaccccttccctgtttgtcccttgtcattccccagatgcttccctgcaggtggacacagtggtccccaatgccacggtctctgagaaggcagctttccagctggactgtagcatcgtgtcccgctccagccaggactcccgcttcgctgtggcctggtattccctgaggactaaagctggggggaaaaggagcagccctggcctggaagaacaggaagaggaaagggaggaggaggaggaggaggacgacgacgacgacgacgacccaacagagcggacggccctgctgagcgtgggcccagatgctgtctttggcccagagggcagtccttgggagggcaggcttcgcttccagaggctctccccggtgctctaccggctcacagtgctgcaggcaagcccccaagatacaggcaattactcctgccatgtggaggagtggctgcccagccctcagaaggaatggtaccggctgacggaggaggagtcagcccccatcggcatccgtgttctagatacaagtgagtttcccaagtacagagggaggatgtcactgttggttccaactgtgtctggaagataaatttgagcttgattatgggttaataaacagttttcttaactgtcatgggcatttattagtaggatt

SEQ ID NO: 55733 - DNA, 1061 bp, Homo sapiens
acctcggcgtcccaaagtgctgggattacaggcgtgagccaccttgtctggcagtcttttctttactgatgtcatatcagttccattcccaacctgagaaggaacctgtgtgggtttttgtaaggatgttggactacaattcgtagggctaacacatgaacagattaaactggctttcccctgcagttcttttgtagttggtggcccagcattttctagccaccatatgatcagttttaaaagtttactcttgcttttcagaggtttctcaccatccccttcccccgcccttcccagccacctgccccggccagcgacatgttttgtggtccgttgtcatttggatgtgcagtctctacagcttgtgcttgtcctcctgtgagcatcagaactgatgagggctacgactttgggacagctgttattgtaacattgagctccttgaaacccaggcattccgacacacgatcaaggaactcagaatgtttagggagccacatctgagaaacgtttctcctaatggagtgtgtgctgccgtccttctgtatttggaaggcatccattcacctaccctgggaaagggtgcgtacgaattgcttgttgtccttttgtcgctgacgtctcttccttactgttccagacagccgcctgaggctcagccaagcccaggggaacctgtcggttctggagacccggcaggtacagctggagtgtgtggttctcaaccgcaccagcataacctcccagctcatggtggaatggtttgtatggaagcccaaccaccctgagcgggagactgtggcccgcttgagccgtgacgccaccttccactatggagagcaggcagccaagaacaatctgaaggggcggctgcatttggagagtccttcccccggcgtgtaccgtctcttcatccagaacgtggctgtgcaggacagcgggacctacagctgccatgtggaggagtggctgcccagccccagtggcatgtggtataagcgggcagaggacaccgctgggcagacagctctgacagtcatgcgaccaggtgagggtccacg

SEQ ID NO: 55734 - DNA, 1014 bp, Homo sapiens
acttattcatatataagtaattatgaagtatttacttataattgacttatcagttactatgtcttattatttttatactagaatacatatatatatacacacacacacatttgttttctatctcttctactagaattgaagcctcctgagtaagcatagggacttggttttcttcactattgcttgtctcctaaggaggcctattcagtaagccagtggaacccgataccaaactccacatgtggcctgtgccctgctgaatgcagtgagtctgttcccctcctttgcctgaggttattatatttccagagattctcactggcctctcggtggcattttctgctaacctctgctggtgcattaaacaggaagctctggtctgaagtgattcccattggcattttcggtgacatatgtcctgacttcaggccagtccctggggcttttgaacattgaaggttgtcattaggcccaccagtgttcttttggttcctatttttcatctgttttcagttctgattattttctctactgaaagaacatgatcacccccaccactctgcatttccactctagtcatcaccattttttcctttcctcatttgtactgaaaccaagagattcttggaggatcctaaatttattgaggggatttccctctctgagactacaatcaagctaagtgggacagtgcggaaggactagaaggacccccctcaacacatttagtgaagtctctgttacagtgaactttaacaccgtaaacatggaactcagaggacaccgagtaaaacagctttcctcgtttctttctttgtgttgttttctttcttcttttttctctgcttctagttctttccttttccctgctgagaaagcctacacttacagagcttttggaaaatacatacacacacacacacacaaaaatcccccccaaaaaaacaaaactcaacaaagaaaataacctttcaaccctgagacaaccagagtcaatatcttcttttacatatg

SEQ ID NO: 55735 - DNA, 1050 bp, Homo sapiens
gccccaattaataatacattttaaagctctttctactccatgctgaacaacccagtttttttggccaagaaccagataattcaggtggtgtcatttgcactgatatagatatcatttgcatgcggtgaattgggttggaaaggaatgaaaagggagccggttgtttcaagtattataggaatccaatctgaaaagtcgactggcaagcgaatgcaaatctagtttccagagcttgggagcttaatggtaaaccctgtcctggattcctagtgtgccctagaggactttctgcatttgaagaagggagaaggcagaagattggacttgctaacaaaaaagatgaacccgggagggtggggccgtggcacacaggatttctctctaagtggtgcctggtgtgttcttgatggcgtgagaaggtctgtgggtttgtgaattcaacaagtcttcctggagagaatgtccgatttactgcgggagatgctccgcagtgttgctcagtcatggcattgggaattggactttgccacaccttggcttgctaaatccttccatccattcagaacatttgtctgtgtgttacagggagaccaagtggcagtctgtggctttcacaagttttggttctgtgatgcatgggactcaatcaacccttgatgctgccaaaccaagcttaagccagctggcaggccagggtcatgaccagtgggctgggtcctgggtctggatgcagttcctggggttgagctggactaaagagacaagagtctgaccagtagagtgctggagcctggccaggcatccctgccctgcccctgcccctgccctccacacaagctcggttggaggaggcctaggttgctgtccctgggtggaatctgcaccttgcccctgctttctttctcagctgggaagtggtttggtccctgtggcggaaaaactaagtgtgaagagagtggtggaggtggaacaattcttgtactattagttccctaagaggaacttagaattgtttttttgttttttttttttcatttttagtagcgggaa

SEQ ID NO: 55736 - DNA, 1078 bp, Homo sapiens
gcatgcattgagcacctactaagtgccaggttgccatgctggtgaggctgctgagatgggtgtgtcacgttcctgccttgcgggctctgtgggaggcagcaggcctagggacaaaggagagcagaaaagcgttacaggtgtggaggcagagccagcacagggcatgaacgggggcagggggcgtgaggagggaatggggtaggggtgagggtgggaggttgggaaggaggagtggagcatttcaggctcagagaagagtgtgaataaatatagtcacggagggtgggagcagcatgcttatcttgagatgactaaagcatggggtctggggagggttcacccccaggcaagctggcagggatcaagaagtcccttttgtacatgggagcatggggtgagggtgggcatatgtaatagctaaaagcaaggacagaccagacggcctgggtttgaattccagctctaccactaagccagctgtgtgaccttgggcaagtgtctttataaaattgggaataatatttatttcataggattggtgaggaccaaatagttaatatttataaagtgcttagaatagtgctgagcacataggaccagatgaaagtttgctaaataaatgagaatatcctaaactcagaaattaggactttagctcatacccagatcatatactccatttttgtaataatttataatgttccctttacccagaaatgaaattcatatacaatataacattcctaatcatatctttaaaatttgctatattgtcctagttgtgggataaagaaagttttttttaaaaaaagtagttcatagtaaaataatgagtttcagtgcgtaaatgctcaggacagctatgctaggaggcacagtcacagtcaacgctgtctctaaatgcacactgacagtcactgtatcagacttggcaccatgagcaggactgccatcctgacagggtttctgaagtcctgagtaactcttgctacaattctgaacaaaacaaaggaaaatcctctcttgactgacctggcatattttaaaaccatgcaaaataaaagtattgtgattatag

SEQ ID NO: 55737 - DNA, 1061 bp, Homo sapiens
ggaggctaggaagagcaaaggtgggtgcttgaggccgtgcaggactcccagagggcagctgaggcaccaggagagtgcatccccttaagtgttactgtctctcctctattaaatatttatgcatttagcacttaatattttccagagagcttcatatgagtttttactctttcctatatactttggtgctggtgcattcattttggggaaatagaagtggaaaaatacatgagagctgactgtgcgctggagactgttggacacttggtgtatattacctcacttaatcttcactgcaaccctgggaggaacatattgctttcccattttataaatgaagtaacagaggctctgagagattctcacttcctcaaattaaacacctagtgaatgggggaagttgggatttgaatccaggtgtgccttgttaaagagtaattgcggtagggagactttgaccttttaaaggctatgtaatcagagattattctttcagcattcagttaatcgtgtcctttacagaagaattttctccttgtagattgatgatgtggaggagttatagcactagtgttactggtagtaacaacagtagcagctaatattcactgagcatttcttgtaaaccactgtgaatgctttggttcctcgtttcttaatccatgcagtgctgtgagggggaccgttttacccaacttcacagatgaggacactgacacagaagttacataaattgcccagtgtgccatagtaagtggcagagccaggattcaagtccagacaggcagtttggctccagagtccaagttcctaattttattattatatgttctagacaagtgtttttcttctcaggaatcctctttggtactgtatacttgtatttaatgtttcctctctctggttaaccacccctgatttcctaatcccctttagcaaatccttaaatttgttttttggaagttggggtcataagacattggtagaggttcctcaagacacagtttgctgatggtgtagaagttttatcttgtgcctcttttaactcctgattcttccag

SEQ ID NO: 55738 - DNA, 3951 bp, Homo sapiens
tctcatgtgccaggtactatttgtaatatttataaacactgatttatttaatcttcacagagactcattttacagattggaaaacagaggcagagagaagttaagtaactttaatgtcactcagctgggaagtatcaaagtcttggctgctggctccagagtctagacctttaaccactgtgttatgctttccatgggtaaagcaacctaaaaaggcccctggaatcagttacatgtggttggagactaactctgtcattgacttactaaatgcttgatattgggcaatttatctaacctctctctgcatcagtttctacatctgcaggaagagatgacaagcctgcctgttctacaaggttgttttggggattcagtggagcatgatgagagcaaagcagttggcaccatgcttgcacctagatagtgctcaataaatactggctactgttagctttatgattgtgatcaatgtatgaatattaaacagtatttccaggctgaaggagctctgaggtactcatattgaggagtcagtattagggcttagcagtgctgcccattcaataaggaatattgagagacccacagccgctgagcctgcagaaccctgcatttaggataattgtcccaccccactggaggtccccacctgctctgtttttggatttcatgagggacgtgagaaagggactggaggccgactccatctgcttcccttctcggcaccagtgcgctaagggaccaggaaaagtggtgttggggctgtgtggttgtgttttcctcctgtgcaatggaggaaattggctttggggttttcttttcctgttctctcatggaatctcaagatttctaggagcaaccctgcctacatgcaatcagtccctgagaggattgtgatgtctaattccaggggaggagcaaatgcacgaggatctcactgggaagggttaggctagtgctgctcagggggaattgtggtgggcctttctttggagtcttggaaactcttggactgggcctcagcaggatactaaaagcaacactagcctgagagctcaaaaggggctccgagagcctctgtcccacactgcttgctttgccagctgccccattgctgatgtcatactgccctgagaaagccacatgcctcctctggttgaatctctctgctttctctccagaaatgggcttcgcagtcacagccatctcccggacaccgggggtgacctacagcgactcctttgacttgcagtgtatcatcaaaccccactaccctgcctgggtccccgtgtcggtgacatggcggttccagccggtgggcacggtggagttccatgacttggtgaccttcacccgggacggaggggtccagtggggggacaggtcctccagcttccgaacccgaactgccatcgagaaggctgagtccagcaacaacgtccgcctaagcatcagccgagccagtgacacggaagcaggcaagtaccagtgtgtggcagagctgtggcggaagaactacaacaacacctggacgcgactggcggagaggacctccaacctgctggagatcagggtgctgcagccaggtgagtgctgcggacctgtgggctatgtgcccatgctgcctgagcagacgtgagggaaaaagaaaggtgtgcgtggagcccttagcgtcacttccccctttcccagctcttcatttagacacattgcaaatcaataggaagttttaagaatcgtgcagtggacacttgtatttcctttccttgatagccagttgttgtctgacggcatttgttttcttcctctgtgtgtatgtttgttgttgtttttgagccattggagggaaagctgtggacattgggacacttccccctaagtacttcagcatgtaactcctaagaacctacccacccactgcaccatcatcacacccttggggttttacgttagtgtagtcctaccacctacatttccccagttgtcccagtcatgccctttatttttccctttcagattaggatccaaccagggatcacacatcacatttgttatcctgtctctttagactcctttaatctagaacaattccctaacctgtgtgtttgtgtgtgtgtgtgtgtgtgtgtgtgtgtatatgtatgtgtctgtagacatggacatttgtgaaatgcacaggccaattgttttaaagaaagcccttttctttacttaacctcatctcctataatcctcatacaattatgtggaagtgatatcattgtctcctgttcatagacaaggaaattctgagtaaagagggagggtaataggcacctattgagcatcttctttgcatgaggcgctgaaggtcagttactttattagaattgcacaacaaccccaggaaagatttaagtgactagcttaaggtcactaggctccacctagtgaatggtggagccaggatttgaaccccggttgtctttctcccacaatgttgcctgcacccaggccctgtccagttgtatgggccctgaatttgagctcctttctctatggaggctgagtctgtctcaaagcggatcataaggatgcattaatttggggagcattagtcagtggggctttctgcaaacactctcgccttcatcaggctcttcagctgacacgtgggaggagttaagtacatgcagctcttatggttttcctgcatctgtccttgtctcctgccaggttagaagctggtggagggtggagcccaggcagtaggctcccgtgttccttccctcgcccagcccatgcctcggctggaacagacacctgtgcaggcaagggcaagggtttgactttgcaaagatggctggaacgccttgccaaagggatttttctgcccactaacagccatggttagtgcctgacctagtctgcctgactgctttaggtggccacagtgtcgttttcagcaacgtgaggttaaataatggtaacctttgggtttctccttcacctcttctaaccccataacagagttctgttctgtaccagatttggaacaagtgagttgtataaatgacgagactgttcccttggccaatgacagcctaaacttcgactgacaagaggctcagggaagaggctgttttgcttaaatggattttcaggttaatggaaggttaagcagagaccccattttatgtgaacccttgttgtggaaaatgtcgaggtacccacttgcctgcattattgagtgggacattaggattgtaattgcaccttttttttttgtcccctctggctctcaaggtcagttttctgagcagcattgcccatcacatggttctgcagctgtagaaggtagaggagttgctgacctcaagaccttgtctgacattgcctttttgaatacatccctagtatttgcctgtttctggtactacttggaatctaagactggagtgcctaagggaagaatacagaattagttcattgaaggttctaattatttggattagtttatggtgttactaaaggcagacagggaaaaatatgtatgaagtacctcttggatgccaggtttctgcttagtgctttactcatgttttctttttaaatttatccaacaacctaataatgtaggtgtttgtatccctattttgctaatgaggaaaccaaggctcaaagtggttgggaatcttgatggaggcaagccagctggttaagtggcaaaactgagatttgaactgagattggagcccaggtatctctgacttccatagagcaaatgttttcctttataccataattgcctcctgggtaaagtagctggagggttgggagaccccagatctgctctgaggtcgtctttgtgtcttgggtgtcttgagttggtttctgttgtgttttcactgtaaagtgagaatgaacagtggttggcagaggagacttatgagtatcactgtacttggg

SEQ ID NO: 55739 - DNA, 2387 bp, Homo sapiens
ctcaggtcttagaacctcgttatcacagttctctgcacatggcaaagaacatcctagattatcagatctaaaaccacagggagcaaagcccagaaccagccagggcttgcagcaactagggtcagagtgtttttgaccctctgaggctcaccgtacctgaatatgattccatttgcaccccttctcctgtttcctctgtggggagggcgctgtggagaccataaagcctccagggtgtttctctctccctcttcctagagagcagcatctccgtggaggtggccagcaatgccagcgtcatccttgagggcgaggacctgcgcttctcctgcagtgtccgcacggcaggcaggccgcagggtcgcttctctgtcatctggcagcttgtggacaggcagaaccgccgcagcaatatcatgtggctagaccgggatggcaccgtgcagccaggctcgtcctactgggagcgcagcagctttgggggcgtccagatggagcaggtgcagcccaactcgttcagcctgggcatcttcaacagcaggaaggaggacgagggccagtatgaatgccatgtgactgaatgggtgcgggcagtggatggcgagtggcagattgttggggagcgccgggccagcactcccatctccatcacagctcttggtgagtgagcggtgggactggcagtgggtctggcatggagacagcttcagtgtcaaacaccttatcctgacttttctcagtcagagttttagcaggaaactatggccagtcttttacctatagagtttgaagtactttcctttatgtctattttatttcttataagggtttaattaattaagatagtgctagcagggactgagggacccacagtggatgatggggctcctgagggatagcaatagctgggagctgtgactactcctagtctggctgggagagagtgatgttatcagaactctatccaggttagtgaagccacccagccatagtggtggccccaggtggaggagcatggccactgccagcctggccttaaagagagcagagtggctgagcactgtgtggcatgtctttcctgccctgctgcccaggggccagccttcctgaaagagagcagagaagggtataaaatcatctgttgtcatttatttagcatttactatgttcctgcctgatccttaacacttaagcttagttgtcccattgaatccccacctagccaagtgacagacactttcattttatggaggaaactgagactgagacacattaaatactttgcctaaggctagaagtttctactacctgacggggcccatacctaacaaagctattccctcattagcgtggaatgaaaagataccttgagatttgctaaaaccaaggaagattagatttgcttctcatggggtaaagaggcttctatcaacatttatctgcctggatataatcagtctattagattttaaacgaccagtctgtgactttgctgggaaagaaacttgttatatcaggtcttcctgtttatcaggagacatcggttgtcctcagcaactttatgtcccactccctgggactgtgtcaccaccttccttgcaggttgggatggtggtgcttttggatacttccagtaaagatggcagccccaagtggtttttgtccttaacagagtcctccattttcttacccctctgagattagaattacatttattttctaaagcttaatcctaaagattgacctgctttttgcagtaattatacagctcagatttctgtcttagaaacttcctccagtgattgcgtttcctgatcagctcagttcctgtatccatactcagcacctgtgtgaacccagtgagatggaacttgggggacaacttttggatgtccagtactggtgtgttttttttttttttaaccatcctggaaggttaggaatgtccaatgagtgattagagttagtgaggattgtttctctagaagtaatttatgttatcaggttatcccctgagttttttcttactcaccatatgtctggtggttctcacagccaggggcactgaggggctctgccctgggatctggaggccagcactgttcacctgatctccaccactgagatacctctggctagagccataatcaggtggcccaaaggactgaacaaggaagaatgggagggcactctagactaattaaggttgtcttttcagtctaaagttaacaatgacacacatgaattttcatatcagtataattagatgcgggtcccatctaattacagtgggtcattatggctgttcggttagagcagcttgggtgctctgtgaccatggcatgtgcccgtgtcaggactagacaaagtcatttgcttggggaagc

SEQ ID NO: 55740 - DNA, 1064 bp, Homo sapiens
cacgctgtttacttcctatattttttgtactaagatttcccccaaccccttctgagaacttgtttgatgatctgtggcctgctatattgcttttccagcagataactgggtagttaaagtcccccagcaccaccagctcctgtcccaaggccacttgggtaagtctgccgaagaacaacaacaatcacatcggtaatggtgacaatgccttggattttaatggcgcttttcctcctaagagaccaaagtgcttctgcatatatcatctccttctccgctcccacctctcaaatcctcgtagaggccaatatgatatccatctaatgaatgaagaaatcagagcaccacacaggaagtgacagagctgattgttcagttagtggttgagcttgcattgcattaggaaatatttgcttctaactccacacccaccgccctgcgcttagcctgtgctacaccgtcaacttcctgatttgaaatttcatttgtgaatgtgtactcagatttttattagttctgtcctagttttcacttaatccagagagtttaaaattgtcggctgccttttctcaggcctggaaattcttgtaaatagtgttagtgggcagtgaggcaccaggtctgtagttgcctttgcctcagctgctataataaaatagcatttcttcttgtagccccacattctaactatgtgggtttccaggcttgctcaagcaacagacaccaccaaacagtagccctttcaataaatgagccaggacttggataagcgtccactgggatgacagtaggggatgagagtgaggtcctgcaagtcattcttctgcttaatacaagtgaaaggattttcttccttgatgctgcagttgcccttttaatcccttattttgaattgataacagtggggatgagtctttaatctaaagaggaatattgttgttattaatgatgatgaaaaataagtacctcatctgatcctctcaatgtcatgccctaagaagtaggcactattagtatctccattttgcacatgagaaattggagctttggtaggttaaggaaga

SEQ ID NO: 55741 - DNA, 1733 bp, Homo sapiens
tgttgcttaaatagagttctgggtgcatatatcaaggctagatatttgtaatctaccatttgagtgatattagtagcttctcactgacctgggggtctcatctaagacatctaaagcttcagactgagccccattggtcttaactggggtaacagtttgcttagaccgtctgggctgaagtagttttgaattctctctgtgatattcaggcgtttctctggaccttagataacctgggtctgagttggattttactctcaagctaagtgctgtggtcctccccgcagttagtattgtaaagaagaggaaggatagtgggaatgtgctaatgtggtttagttggctggggccctcattcacccaggatgtgtctcttttcttacttgttctctcagacaaagaattcactgttcggctggagacagagaagcggctgcacacggtgggcgagccggtggagttcagatgcatcctggaggctcagaatgttcccgaccgttactttgctgtctcctgggccttcaacagctcgctcatcgccaccatgggtcctaacgctgtgcctgtcctcaacagcgaatttgctcaccgggaagccaggggacagcttaaggtggccaaagagagcgacagtgtctttgtgctgaagatctaccacctccgccaggaagatagcgggaaatacaactgccgggtgactgagcgagagaaaaccgtgaccggggaattcattgataaggagagcaagcgtcccaagaacatccccatcatagtcctccccctcagtaagtagagagatgtgctgctttcttctcctttggctcagcatcatttaggagaggtagggggagagagaatagcgtggtgaaggtgaggggaggcagatggaaccctcgaggttaatgcagagctgggggaaaaaccattgagcctctcttccctgttgtagcccacctgcatacatgtagcaggctccccatagcagaggatcaggatcaggggtgtccagaatcagggcagtctagggctgggcataggcctatctgattgctagcagccctgtgcatacacaagcagtgccagctcagcttggagggaaaccaggaatcccagaaagctgtttgctcttgtgtgggaatcaagtcccagaagaagtgggtagatgcctgccttgaaatctcacttaaggagagttggtcttttatgggaggattttaaatcataaagtgcattattaaggatttgccatctgggtttttcaggtataaaggctggcatttccctaaatggcttttccctgttgaaattgtgtttctaaaagtcggtggatgggacctctcacatcttcctggagcatagccttttaagcttagctgatttctgaggctgcctcagtgggctccccagccttcatgtagactggccttgtgtgggtgggtagtggccattgctagggattccagaaactactggtgtttgcttgtgttgtgtttaaacattcatagtatcaagatattcttattaatctcattctcccatagttctgtttttagtaaagagaataaaaacctataatgctctgattttaaacaagtggtaaagttttaagactaacctttaaccttgtctcagctgctcaaactattctttctctgagccttgtaataatttcctttactttttatttatatgttttaatatttaaaatatttctcttcaagtgtgatatttct

SEQ ID NO: 55742 - DNA, 1027 bp, Homo sapiens
gtgagaacagggagaaaacacatactagttgtgactagggtactctcatcagacagaaaggtggtgctatttaatctccagaaaggtgcaagcaaggatcagggtatgattctgaccaagggatcacggagaaaatctcttctcttgcctgaatctctccagactgtggcttccttccagtgaggacccctttgatcgatgaattatgcgaaaattaaacccactaaaaatagggtatgatgattattttttctaccaaaaatggttttttaaaaaaatcatcttcctagggctgcattgctgaagtaagttacaggatggggatgtgggaaggaaagaaaggatgttgtatagaaatgtaaaactaaaagttccaggaggcatttccattacaggatcagtcagaagtgaagttaaagtatctcagagaagtgccagaatcaacagcaaatgttatttgacctataagacaattgtttaaagacagtattttcagggagtttatttattatgtaatatgaaatacaccccatgttttatccaagtgttattaaaataccagacaggtaagtgtaagcaccaaaataatgcatttccaaatccaaacagaaaactttctgtttatgtgcatttggggctgtctgtggccttgaatcgatggttcaaggatgactgttaggggcgcagtgcagtgacgcctgcgtggaatgggagcttagccctgggagtctcagattctgtggctttgtgactgcactctcaggacatttctgtgttgcagtgatcccagactccctgcagaccactgccatgccccagactctgcacagagtggagcaggacccgctggagctcacttgtgaggtggcctcagagaccattcagcacagccacctgtctgtggcctggctccggcagaaagttggcgagaagcccgtggaggtcatctccctgagccgagatttcatgcttcactccagcagcgaatatgcccagaggcagagcctgggggaggtgcggctggaca

SEQ ID NO: 55743 - DNA, 1098 bp, Homo sapiens
gggacagatggcagctgaactctgcataaagcccaaatacagctcacagaacccaaagactgtgtctctgcagcgtgcagcattggtctatatagcatttgaagctatttttttctctgtaagtgtccacaaaattcgtcactttacaatgagcctggcaggatagctgcagtgaagaaactctccacacaggtcccagtgtctcttctggaattttgcctgagcaagtaaatcaaatgcttggtaaacacactgatgtcactgtccctagccatggagatttagaactttttcaaaacccctttctctctgtggccccacttgtttctcgctgcagccttttatttttctggagttggctgtggttctccctcatgctccaggccaggctctgtgggctggacaggtatggctagttaatcctgccagacgaggtcagctctgagttaatgagtacagcctctctttctcccctccagagcatggatttcctttaatgcttttcttaagtttgaggagacaaaaatatatgcctgaaaaaggattactgggaagaattaaacacgagtccttcagcacgcacgtgtccatttgttgccttccaggtttgctttcttctctgcctgcgaggcttctcattcagtatgctgcgttgtgtggttagctgttccatagttatgttgaaagtggcttctcagatgctgcttgagtcctggggaatgtcaccatccaatgacagtctagctgagagatgctagcacgcccaccccttcttccccccacagatccatatctcatctggctgtgcacaaaaagcaactgataactcctgttatcagcactaggtggggtgggaggttttgggggatggtcagcattttctggtttcgattaccatgcaagtattttaaatctgcagctctggcaaactgataacctccacaactatatcatcagagccctcattaatggaatcattttctaatttgaacatcttgtttgtccttcctctcatttcttagtgaacttgtcagtcttccccagcccttcactggttgagttgtgcaagtttggagtcttttgcttttcaggaatagg

SEQ ID NO: 55744 - DNA, 1052 bp, Homo sapiens
ttgagagggtgtggtcggggtgatggctggcacctgtgaggaagacagttgttctggcgagtggaggtgtactgggaaagggtgttcaggagaataaccggttgattcatcccacaaacacttattgggcacctactgtctgaaatgcaaggggacacacaaagatgagttaaggatttgacttaaggcactcacacaacacaaggcaggaatggttgcctgcataaggcactgaggaaggttccctagcagagatgacggatgagctgggccttaaagtatgagtgggcattggctgggtgtggggtggagaaaaggcctttccagatgaagggctttgaaatgctttatgagtttgccttggcagagaccagagaccccataaccagatgttgttcatttgattcttggaatcatgggaatacttcagtgtcccaacaagaagatgccattacaatgtttgaagatgacattctttgtgcttaagctgccttaagccttttcttaaacagcctggatgtgcagcaaaaaagagtcctgtctgccccgtgttgtagggcattggaaaggatgatgtactgggaggtggctgatgcagcctccagtgcagaggcctggaaaagtggacaatctgtggctacaggagggagaggttagggtgggtgaagaagtattatgaatgagcagaatctagggacactccatgggtgagggtcatattaagaaatgagagaagggcacggactactctatgccaggaagagaactggggaaggccaactataacagggattgttttggaggaatagacagtgtggaccgtcacagtgaatttgtttaaacagatatctggaattggtgactcaagggcttggtcaagctcagtggcaaaaaatcagtgagaataggaacatgaagtaagttacagatggggcctagacatttgggattctactgtttagaagcaggtgttgcagttatccagtgctgcataacagatcatcccgaatcatagtggcttaaagcaaaaattagtttattctctttcatga

SEQ ID NO: 55745 - DNA, 1215 bp, Homo sapiens
tccccatgttgaccagctggtctttaattcctgacctcaagtgatcctctgccatggccttccaaagtgctggaattacaggcgtgagccaccacgccccgttcttcttttaattttctattgtgaaaagtttcaaatatgtaccgaagtggagagaacaggataattaacccccatacactcaccacctagttccaacaattatcagctcatgtccaatcttatctgtaccatcactcccctaccctccctgtagaattttcaagaaaatccgaggaacacctggtgtattcccacgtgttaatgaaaactcttgttgattaagctgcacttactagtaatttattttcccatttaaaattaattttcagaataccaagaaggcaccatttcatccttatatctgattggtgaaaagtgtaatagtcaaatagtaccaaggttgacaaaggcatcaaagaatagaaacacttaaacattgatcttggcaatgtaaattggtgcactgatgttgcagagcaatttgggcaatgcctagtgtggttgaagatacccttggatgaagatttacaagaatatttattgcaataaaaagttggaaaccacttaaaaatttatcagtaggaaaatgaatacattgtgctatagataatgattattcagacagtggaccatggtataaagcagttgaaatgaatgccctggagtgacatatgtcaacaaggattaccctcaaaaatgttttgtcaataaaaaaagatgcaaaagggtgcatacagtgtgatgccattttaaacagttttaaagcatccaaaaactctgtatattgtttatggctacatacataggtagtaaaagcataaaaatgtgcaagagtgataaataccaaatttgggatgttgtcatttctgggatgggtggaatagtggggcttgaaagggggtgaaatagggattgaagcacagcctgtaatgctttctttcttgaaaggaaaataaaaaaactaaaccaggtgtggcaaaatgttaagatttgacaagtcctggatgtgcacaggcatttgttatacatgtgtctgtgtaaatggttccttattcagaaatgaaaaatctgtaattgtccatcttctgataaacttgcaatggctgctgttgtcatgtgatgtcattttcttgactggagctaagaaacttggcattttttgttatttaatcc

SEQ ID NO: 55746 - DNA, 1458 bp, Homo sapiens
caccccggtcagctgattggctgtagacatggtgtgaccatttggagctggaatttgggccacactcagcacatagttgcgagccataaaggcacgacctttggaccccattgtcacctcccttggaatatcttggtgttcttgtttcagtctgataaggccattgtagctgggttctaggtatctctgagcatggagcactcacgccagcctcagacatcgctgtcaagggcatcggcagcagtgaggtgattcctcagccggtcatttgggcatcgctgcctgggtctctcctgaccttcagcctcatcttttttgtcacctgccatacctttgcctctaagtgtcccccagtttttattgctgccctctccatctgcaccagtgcctctctctgccagttccactgttctctcgcctgctctttaggatttcctttgttttgcctccttgcctggtgctttcagcaagcagcgctgacgtcatctcaggaactgtgctgcgtctgagagaagaacctgcattagccgtttaagtgtgcggtgctggcagagtacctccctgaaggtgtcctggggaaagtgagtgattgctcactgggtggtgagccaggggcagggtttggggagacatctgcattagcaagttagcatcacttgaaacacaggcatgtaacaggcaaggacgtgctcttcagctaccaggctgtcctggctgtagccggtggccacagacctgagggaccccggctttgttcccttagctggctttgttcccttaagctgcctttgttgtctcagtgtagctctctctacctcctctgtatttcaccgctgacaactcactcgattctccctctggcaatcttagttacctatgaatactctttaacgccatcttctgccttctcaatgaattaaggagattctctccttgactgtttgtgagccaaaacctaaccttctcttggctgataagtattaatatattgtgctgagaggaacttttggagtaaaattagacatcaaaaagaactggcacaattagtttccaaggcttttaaggttcctggaagtcttctgaatccatcctctttgtgtggaccccccccaattctccatcttcctcctaaaaataacgataatggcgtttcaccagaagccggacaaaagaaggctctgtctgtttcgcctgtgggaagtgacaggaactgctgaaacttgtgttccgtgtcacagagccaagggttcacacggtgcagaaacaaatcacagtgtgtcacggagactttttctgtctccggccccactctgtatttgagcccaaatgtggagggagatgctgcagttgtgggaaggcacttctatgacccctcattagggtagaggaagtgagaggcctgaggccacagccaggctggccttttgcaaaatggtcaaatcagcagcaattcggccc

SEQ ID NO: 55747 - DNA, 1047 bp, Homo sapiens
ggaatcacctcactgctgccgatgcccttgacagcgatgtctgaggctggcgtgagtgctccatgctcagagatacctagaacccagctacaatggccttatcagactgaaacaagaacaccaagatattccaagggaggtgacaatggggtccaaaggtcgtgcctttatggctcgcaactatgtgctgagtgtggcccaaattccagctccaaatggtcacaccatgtctacagccaatcagctgaccggggtggcaacccctggctctgctcaacaataatgacaaccaccatttattgagcccttactatgtgccagaccgatgctaagtgctttcctcagatgtttccatttaactcttaaaatcaccctaatgagtatttcctattattttacagatgaggaaatgagagtttagaaaagtaacttgcaaaatcatactgctggctccataacaaatgttgattgaatgttgtctgggcggacagaggcaaggatgaccggaacaagacaaacaaacgaaaggccgactgacagaccactcgggtagcactttttctgggattaagcttagaccttgtaggcctatcagccagaagcagtgtgtaaaataagagcagctgactgggcacggtggctcacgcctgtaatccaagcactttgggaggccaaggcgggcggatcacctgaggtcaggagttcaagaccagcctggccaacatgaagaaaccccatctctactacaaatacaaaaattagctgggtgtgatggcacacgcctgtaatcctagttactcgggaggctgaggcaggagaatcgcttgaacctgggaggcagaggttgcgataagctgagattgggccactgcactccagcctgggcgacacagcaagactccctctcaaaaaaagaaaaaaaagagtggctacccaagaacgcaacagcagcagcaaacactgatctgatgacaccccagttttgtagaagaggaaggaaaaataagaatgtcaactctccattcaacagagaaacagtgccaccac

SEQ ID NO: 55748 - DNA, 1072 bp, Homo sapiens
agataagagaggactgctggtcagtggtgttccctgacatttttccttgaatgataccaggttaatcaaaagataaggatctaaaatttttttgtgctctgcttataatttgaatgtgacttcatatgtgtgtcatctgttggactaaattggattgcagttgctcttcaaattgtcattcctttattttctatttctacctacctcctgatgttagcccaggttcctgctaccaaggtgtcttgcaaaagaatttggtgactgttactctaagtgaagcttttgatactttctcttaatataatggttcaacctctaacaatgtagactaatgaggaagattagtttgaattagtaaaatgtctgaattaccaaatatttttcaagaacttcactgttattacttttaagtaaatactgtaactcaaactaggctaatagaatgcctaataaagatccttaggggatactgctttaggagagaaataagaatgatttgcaattagtgcaccaattgtttatgtaaatggaatttctgaaatactagactgagcttgaaaaccgtttgttctcttaagtattttaaatagtccctatgaaacccctgtgcatgctggtagttgtttatatgctgtatagagacctgtttcatgaagacctaactcaaccttatatcatcagtatcagaaattccaagttagtgacgtccaggatcctcaccttccaagattagattagatctctctgccaaatgcttccatagcacatgcaattgtctgttgtaacactaatcaatacatttaacaaatatatgatgtgttctgctatatgcttggccagtgtgtgaaatggaggagacataatcctcatctttgtgtagtttataggctagcaaagaagtcaggcagtaaacaaataaatgcatttataattaattacaatcctgaagttggattgtacttttgtgagtaatggtttaataaactagattttaagttccattaagataggggttacttctgtgttgtttgtcatggtgtcccaaatccttccttagcctactgcttggaat

SEQ ID NO: 55749 - DNA, 1035 bp, Homo sapiens
agaagctgctgtagcagctcgatgaagggcaggctcttccaggtctgttccttgccagatgccctctcccaacctggggttaaccctaaggaggcattgatctgcacttttctcagagacactggtgacctcctgggtagccaagagcttcccccttctccgtgagccctctgagactgcaggtcccagacggttgtaaattctgcctggtggaaattgccaaggtgccaaagcaggtgcctgctgccctcaggagcctctgtgcagggccattcttctccctacaagcagcacttctcagagacctttctggttttcctcttcagctttgtttggcagtggtttggtgttggtttggagatggtggtgtgttgggaattctgcttcacatagatggacatgtttgttagtgtgaggaatgatggtgcagatattcattccgggcttaccccaaactaggtaaccctttatgacattgtttagagatgatttgctgaacagtttcataatgccttctgatgtttcagtacaaaaaatagcttgctgaacaacgttacaatctgtcttctgatatttcgttacaaagaagcaagagcacattctgagcacgctgcccagtgctttcgccttctctctgttggagcaggtgattggttccagttctgcgtttcggcacctctgtggctgggcatccctctgaactgtgcacttctagaagggagcaacaagatagagaactaatatgcctctaggcctgagttcattttagaaaaatctttgtagatttcttgcccagtcctcttattttaaaggtgaattgtcctagagggaagaaaaagaccatggtgacctgggtgggtagagggtggaaggagtactggaaaatgcccctaacaggagatgagaaagagactctgatgcacgtcatctttgttttaaattaaaacattatgcaatacaaacattcgccttcccactcttccccctaccacagaggagctgtaatttcccatatttggaatttggggagagctg

SEQ ID NO: 55750 - DNA, 1063 bp, Homo sapiens
ggtcaagagttcaagaccagcctgaccaacatggtgaaaccccatctctactaaaaacacaaaaaagccagatgtggtagcgggtgcctgtaatcctggctacttgggaggctgaggcaggagaatctcttgaacctgggaggcggagtttgcgatgagccgagattgcaccattgcactccagccagggcaacaaaagcaaacaaaacaaaacaaaacaaaaaactccatttcaaaaaaaaaaaaaccataatcagagcaaagacattctaacaaaactgtgaactcggagaaatgagtaatgcctgcttcccgtcaactttcaggtgtccaggccttctctttattaaaacagaaaaaaaaatctgataccagttgtgtgttctttctttgatgtagtgcagtttgcccaggcttgccttaagttggtgctatttttgtgtatttaattctgtttttgcatgtgacccattgtctgatgcttcagaatgcagtctgcggcctcctttttgatagcaactctgagaacactgtctctgctctcggcagggcactgggtacacctgtggcatcgctggtgccatggcatgaggcaggcttcccacttcacttctcaaggacccattttattaactctccttcccccaggagctccgtattttgaaatctttggtttcccagaccattagggagtaattaaaccttttttcccacatgataaccagtatgatcgttcacacttgatatagtccagttctaaagcaaaattagtctagtggtctgggttgcggatgaccaaagcacacatgtttgatccattaggttgcttagccctgtggttagggaaagtggggttattgttaggtgattttgaaatctctaaggtcgtcagcttcccaaccccatgtgctgctttgggccttaggaaccttggataacctgggtggtgtttgcccactacttctttgcattggtgaccttgattgaccttgctaggtggcacttttcatcagggagaggaaaggagatgcagagttgagcagccatcatttgctgtgggtca

SEQ ID NO: 55751 - DNA, 1020 bp, Homo sapiens
tggctttaaaggggcacagtggcagacatccagatgcaggctgaagtgggaaggtttggaactgtaggcatgcatgtggatctctgcctgatttggagccccactggtggaacctcatctttctcttcacctgatggctctcagtatggcaggaaggaggcctggctactactttactaatctgggagaggtagaaggcgtttggggagggagcaaaacccatgttggggtcttatttcctgcttgtcttctgatgtggtctggttcatgtgtcagcattcttgctgcataatgtgaattaatgtgtagtatgaatttaaaacagcgaagaatcccaaggttttaagcccatataggtcacatgcctggaataaaattttgtttaaaaaagttggataaggctaagtgctctgaaagtgagaccgatgcaggtaccagcctctagaaatggcaattttagttagaaaaccctggacagtatgtgaggggtatacagggtaaatctcggagacgctttcatctccctcaacatgacagacctgtgcttttctgcacctgtcctttgccagtgtctgggattggaatcagattcctcttttctgtctgttgggatactgattcctgcttatgtctttgtcctaccctttgtctttgtacctacccccttgacctctgtgtgttgtttccttctgtcctaaccctaggtgcctcacccaataagggttgtggtggcagtgcatggctctgccaccacaacccttggttccaattacaaagccatttaagcctggctctggttgaaccatgagggtagtaaagtctctatttgaggatagatgtggccagaggggcagaagattagagagagaatagaggctggtacagtggtaggaagggaagggtgactggaaaagtgcctctgtctgggagcagcctgcatgagtgacagtgacatgggaagatgacagcaatgtgggaaagagagcataggatttgtgtctgtaagaacaggaaggaaat

SEQ ID NO: 55752 - DNA, 1142 bp, Homo sapiens
gagccttaaaatattcatagcctccaggaatgcatccttaggaaaaaactagaaatgtgggccaaaacttatataaaaagctgaatatcatgttatttgtaacagcaaaaagttggaaacaacttaaatatccagcagttggggagtggccaaatgaatgggtagctatacacctttaaatatgtgtacgaagaactttatgtggagacaggcttacaaaatgagaagtagaaaaaaagcagggtatacaactgcttcaaagtccttaactgtgttaaaacacggatgtgcagaaatagaactagaagggaatgtactaccatgttaacactggctatctctgggatttgggtaaattttattttcttctcatttttttctcagttttctaatttttcatcagtcagtatgtattaattttataagcagaaagaacattaatgttactattttaaaagaaaaagtaataatcttgagtacaaaatattttgccacaaaacaaaacctgtcgctgtgtggccaaggcctggagggtgaggggggaaggttgctgttacctttttcaggccttcctggaacccataaaggttgatttcccactttacagtcagctagagactaggactggaacaaaagactaatggagggtttcactttgcataattagtttagttcatcaaggccttggaacatgcattcattttcacccccagtctaatggaggcagtgacgtttgttgtcattttcatgtgtctgaatctgtggagctggaattctgagactctttccttaagtttcaggtagcaaaacaacagatgactgatgatgctttcttttatagtggttttggccaataagcgagacttaacaagatatggataaaaaactacaaataagacattattatttgagagtcatttttgggggttcttttcctaataaaatgtactttttcaccaaaatgccaaatcaaaagattctatcacttattaatagtacaaaatggaacagtggttcttagacttcagagttgttaatcatctgagaaatgtgtttaagatgcagagtacttagcccaatccccaaagactctgatgcatacagtctagggtaagctcatgtttttgcattttcaacaaata

SEQ ID NO: 55753 - DNA, 1022 bp, Homo sapiens
agaaaaaaaaatggggagcaacctaatgtccatctgaaaggatctgatgaaataaaaatgtattgcatccttacagcttgagaggttgggagataattgggattgggttggagaaacagagaccttggaacaggaatgataggaatgacaggctgtgtgtgtcagaatagatggtgtacagaggccagagaggagcatgaccaatttgtggtgtgggctggtaagaatgtggagagacatgttgaacacagttttgttttgtttgagacagagatgttgatgctgtacactgtgatcattctctctaaccccatcaatctttaataatactttaaaaatcaggatatacttaatgtgattggatttcttgtaaatactggtcaaggactgagatttgtgtgtcaagcatggcctgaggccaaaagaaagtcagtcaagcagatgagacggacggccaacatctgggtcacatatgcttgtgtatgtgtaaaaattttattgaagcatatgcaaagatctgttgccagagttacctctagggggcaagactgggggtgctttatggaggtggacttttcagtttatccccttccaaatcactagcatttttactttaaaaacaatcttttttaaaaaagtatagcactcagacaatataactggagaatgacggtgactcctaaccaattgagtgtagtgtctcaactttgccccagatttgattcttgcatgactgtgaagactagaatgagtcttttttttttggagatagagtttcactcttttttgagatggagttgcccaggctggagtgcaatggcacaatcttggctcaccgcaatctctgcctcccaggttcaagtgattctcctgcctcagcctcccgagtagctgggattacaggcaagtgccaccacgcctggctaattttgtacttttagtagagacggggtttctccatgttggtcaggctgggctcaaactcctgaccttaggtgatctgcccaccttggcctcccaaa

SEQ ID NO: 55754 - DNA, 1004 bp, Homo sapiens
caaaattttttcttagcactgatttatttatgtgtgaaatctctctttgaatttcaacatctagtgttaagtaagtgtcccttttattattttaatgttacatttgatacataaaaagaatataggtcacatatatgtgttataaagggtaataataaaatgagtaaaacgaactgtggtagctttgtttcatcaccagttctgttgcattgtggtagattctttgcgtgcgtttgttccatttttcacactcttatgagatagatgttattcttcctattttaaaaattagtaaattgaggctcagaaagataaagcaacttctcaatctcacccagccagtaggcaggagaagtactgtggccgaccttatcagaactcagcaatatttgtttccccttccttcgctgagggcaaggtagaattttctaccttacagtgatgtgggccatgtggctagctagctctgcccatgcttgtgtgaatgtgtcacccctaggctgaggcagcataacattcctgagagactctgcagcctccctcctccctgctgggacagactccattagtgctctgctcacatccccttggtgctcacagtttgtgttcacgtcaatggcttcttactgcagtcacctgccactctttgttcaagatagaaaggtaggtgggaactgtcagtgggtgagtctgtccaggagtggctgtgagtaatgacacacaggatttggtggataaataccaccccatctttgcccattgagagggacaactccgggacatgttctattctgatttgcaggggcccccagcagttacctgttcattaaagtgcgctccattgatttcctttcctttcccatctcacttccatactcccagataaatggcttgtgctcatatcccaggttcagagtcggcctctggaagaaccaaagctgagatactttggcatgtgtccccagggtgcagcaactatatgatgaggatcctccacatgtgag

SEQ ID NO: 55755 - DNA, 1034 bp, Homo sapiens
ccctctggtcttctctggctcagacacttcgttccaactaacctgtttgctctcctttatgtagactatattaaaccttctggccccttctacttctcacctcttgcctgcgtattaatatttcctttttcccttgaaactcactttctccatgaagccttcctaagcctacctaccatgatcacaccagaacccacccagccacatagagcaggtttcacatccattgcctatgtctgacctgtcttgcccatccactcaatgtggcatttcttgagtggccactctgtgtgcaactgtgtgttcaatactgggagtcccagacaaatgacaaagacacagcatctccctgagcggctggtgggtgtgagtagacagagaataaaatagctaaccacaggactgaatgaaatacctgacatggaaaccaagtgtgggaaacaaggaaggggatgattaattttgacttgggggttggggctggttttgctgaagaagtgacatttgagttgagccttgaggataattagaattttgaaagaaaggatagaagagcattctgggctctggggaaaagcctaaagtgtggatgagtgaaagtacatggctcattgagaaatggcacgtaagttccctgtagctggagctgggaggaggaggaaataatgggggtgcaattatttgggggaggaggaaataatgggggaggaaaggtgggtttgggatagatcctgtaggttttgcatgctgtgctaaggagtctggactgggaggggtagatttgttggtgctctgggtgctgccagccagtctgtgccctgtcatcagagcatatatttccttcattgtatgtaattgttccctactctgattgtttcccctgggggcaggggccacgttgattttgttcactacaatgtccctattacgaataggatatataactcatactggttgtttgatacatattggctgactgaatacttacatatgtcattttatctgtgggaatgggtagccattaaaagtttgta

SEQ ID NO: 55756 - DNA, 1129 bp, Homo sapiens
attagctaagaagattttaatagtttgtattacaaataaaccattacatgtgtgtttttaaaatctacttctgttctttatacccttccagccttacttcatctcccaattaaaagaggaaaaaataggattcaggcttcagaatcagcctttcatttgaatcctgtcttccctcagtgtgaaccttggacaggttttctaacctctttgaatctcactttctgtctctgtgaaatgggaataatacctctcttggaggtttttccatgaagattaaaaacaatatatttagaagaatgcaaacattagtgtatgtaagttcctagaactctgctaccccaactgtgttctgtggaccaccagcattggcagcacctgggggaatctcaggtccaaacttgtgaatcaaagtttgtatttgaacaagatccgcaggggattcaaatgcatgctaaagtttaagaagcatgtctggaggaggtttggcatacaaattacttggtagtctgggctttctcagtgggactgaggcaaagccatggtcagagtctgagctggaggagagtgggctggggctggaccccacgggaatgtgacagtcattcagttagcagtgaaggatggaggatagcataggtctgtagtaaaggcagtgggcctagtttcgtggctttatcccaccaagtttggcagcctaggagggacagcatcatgtggtctctccatggaatgagagtggaaggatgagtgataaaggaaccgagggaactgatgagaacatcacaggaaagattagccaaggagtacacgtgggataggcaggtgagtggggcttccaggcttgatgcacctgcagaaggtttgagggcctggagggcatgatgatggcataaaagcagattctgaggtgcaagggaatgggtagtctaggaaagtaggaggtgaggatcaagagaggtaacttctgagttcagggttttggcagcagagatctaaggggagataggctggatggctagtagtgacataagcatttattcagagtttctgcctcttccaccattttggctggttgagctaatatctgactgggttgggcctgaatggattaggagagaggggtgtgact

SEQ ID NO: 55757 - DNA, 1043 bp, Homo sapiens
ttagccctaggcgttgtggggaaaaggcagtaacctatgactaagatgaattgggggttggggaccaggtgcgatgcaagagaaaccaatatgagggttctttccttcccaataaattcctgtctaccttttttgtagcatttattttgtgccaggcactacgcttttcttttcttttcttttttttaaagagagggggtctctgtcacccaggctggagtgtaatgttgcagtcatagcccactgcagcctcaacctccctggctgaagtgatcctcccacctcagcctccccagcagccggaaccagctaatgcactttccatagatgaacttatttaggaggcttcatagccccatgagagtaggcactgttgttacccctgtttaatagatgagcaaactgagtcacagaggtgaagtcacttgctcagggtcacagtgtaagtggcagacttgggattcaaacccaggtagtctggctccagagtgtgggttcataaccacagtacactagtctgtctttccatgttagtcaaaatatatctttgaaaacactgaaaggaattgatataattagctaaattgtgataacatttgtttccttgtctttcaagacaggaggcttggattttggcccttgtccttctactcactagttttgtgaccttggacaagttgctgaacagctctcagcccctgtaaaataagggttgggctagctgatcccaaaggtctccccttccatctccagaattctttgagttcatgctgacccctgctgttggccatgtggcctcttggcccagccctggcttcctgcccatcttctgagcactccttataatcctgcagcctgtgcctgttgtctctcacctggctggtgcctcttcacaacagtgggttggtgcctctgagggctctggaaattgttcggtccttgtgtaggcgactgctgcctgattgcagcccatttcctgcacactaaggatctttccctgtggttctctagggtacagaagtgtccccaccaccaggctaact

SEQ ID NO: 55758 - DNA, 1734 bp, Homo sapiens
ctactttggcttttacacccttcctgaagggtagaagagttgaaatacttttgtttttttgaagcagggtcttgctctgttgcccaggctggagtgcagtggggcaatcttggctcattgcaaccactgcctcccgggttcaagcaattctcatgcctcggccacccaagtagctgaaattacagggatgtgccactacaccgggctaatttttgtatttctagtagagacggggcttcaccatgttggctaggctggtctcgaactcctggcctcaagtgatccacctgcctcagcctcccaaagtgctgggattacaggtgtgagctaccatgtctagccgaagagttgaaattctgacatctccaaccaatagactcagctggctaaaaaatgtgcccctagtatttggggaatttcttccttttcattgctttggtctgaacaaggaaggttcaaaatgatgctggataaataccacctactaaaaggatacattctagaaagtctatgtgttatagaagaaacttatgtgtatgagctcagtccttactgcatcttggctgctgtctggccctccctggctactttgaggtgctactgttgatgctgctgctaagcctagtgatttcatctcagtggttttggatgcagatatttttgaggcttatccctttaggatgtactgagaagcgaatattagctgatttggtgtctgtccagtgtacactactttgcttatgttgcagcgaggagttaaaaaacacacacatttttggtacaactattcgttttcccattttctgaaagctggcgcattgaaacgttttcttatttattagaagacattacagtccatcatctttgattgagaaatccttacagtaagttccaagttaagaccatagtgtgtaactcacggcatgacacagcacagggtactgagtcacattagtcaaagtaaaaacagttatgacccttgaaggaataaattatttgtgtccaactttacttttcaatacaggacattgctactttgctttgtaatctttttttttttttagtacttccgcagcattaagggaatattgactctgtttctgacattgtgcaagattacaaagtccaaaatggaatggaaccagttataagtgaatggcagaatggatcataggtgttttttaaaggcttgggtgaatgagttattagatcactgtacatatgggactgtcacaattatagagatgaaactgaggccaggggctgttattattgaaaagttccatggagcaggtggggctggagagtcgggagccaggagcaggaggaaatgcatttcaggtatgaaagtgggcagtacggtttctcagaggtgggagtagataaatgtgtacaggttggtgtcccatttggggattagctaacttcagctggaaaagtaatagagaccttaggggacgtggatattaaactctggggaagggaggttggtggagaagaatgtgagcaaagtcaccctgaaagatgttggcagcatcaccagcgcccacagagcagctaagagccggcatgtgtgaggctggagaggtccgctggagcttacaggaagccagcctgctaaattaaggtgataagtcaggccataatcctatttttggttgtttcttataagaaaaacaactcacaaaacaattactgatgttccccccagatagtttatcagagcatttcttc

SEQ ID NO: 55759 - DNA, 1060 bp, Homo sapiens
aaaattagctgggcatggtggcacatacatttactcctagctactcggaggttgaggcatgagaattgcttgaacccaggaggcagaggttgcagtgagctgagattgtgccactgcactccagcctgggcgacagagagagactccctctcaaaaaaaagaaaaaaaaaagataaaaccattcataggaggatattggtttttaataaatgaggaagactttttgcagctagtgtggagggttgagttgtagggtcatttagagggaaaggattgagactggagagaaagtcctgagtgtaaagagcctgtgtgtcacctgaaggagcttaagtctaacatcatagatgaatttgtctgttttttcctgattctgccttccctaaaaagctggaggtccctcctttcctttatttacttgatgttttaaaaggtcctcatcttattggggactcatctccttccaacttttctataagtcaacatactgtttcatctttatcgactctgacgcttggccaggtgttagctcatcaactttccgtgatgatgtggttctgcacacagtaggcgtgcagcaaaaaaatactgaatgaaggaatgaagtatcagactgtagttaaagtgttccttaaagggcatgtgaacccagagtcttttttaatttaattccctgcaagccaaactgttaaacaacactgtactccttactgagcctcatcagggaagctcggcatagacccctcatcacccatggcttctagcactgtgtctacaaatgagaagggcaggcttaaagtgttgttggggaggaggggtggatgaggcaaaggaggagcagacagtggatctagggaacagtcaaataacgggagagaggacagagctgcccaaggaagggagtcgggttggtggggagtttccccaattatctcaggtgccttttatgctcatatgcaagtttaaacacaatatgaatctcccattctcttaaactagaggctaaaaagaggaccaggtgttcacacagaacttggcagatgatgttggccagtttgaa

SEQ ID NO: 55760 - DNA, 1061 bp, Homo sapiens
taaaggtttgacatggttctggcctcccaggatctctcaaaggccacaaaactggaagcaatgtcatagttatatgatctagtgctttactagtaagaaggaattcagttagttaatgatccagtcttgaagaagtaccgtgcatttttgttcctcacttgttggtggcactgtatgtctttctgccttgcttacctttttttttttttttttttgatacagggtctcgacctgttccctgttgcccaggctggagtgcagtggtgcaatcatgactcactgcaacctttgcttcccaggctcaagccatcttcctgcctcagcctcccaaatagctaggaccataggcacatgccaccatgcccagctaattaaattttttttttttttatagagacgagatctatgttgcccaggctggtcttgcactattggcttcaagccatcttcccacttcagccttccaaagtgctgggattacaggtgtgatgcaggaggtaatggttgtcttggcagcaaaaactaagaaaagttgcattgactttgaagagcctgtcagtactgatgaaatgcaaagtctttgtcgcctcctttctaatcttgtttgatttggagaacatgcgtatgaaggctgaaagaagatttccagatataaatggcaggatagataacattagagccagaactgccatgtaaatgtcaattagaaacaagatttaagtctctggaccacccttcttaccccctgtggcctgttggtcacactgccccttcctcgtgtttctgtagccaggcacaggctaacgaggactcagagagtgcctgctatgataattttagcccctggaaaaaataacagactttgtgagatttaatggccacacctgggccttgtcatcacttagtattctttcacctttttgattgtcaattctgatatttccctctgtgaccacaacctccttgctttactcctttcagattccctcctatctgttgaacctattcttcatcctaattgtgattccctgattttgaacattcttccttttcagtccatc

SEQ ID NO: 55761 - DNA, 2316 bp, Homo sapiens
atttaaataaacattgcaggagtagttgtttactttgaagaacttgcctttttctacctgtccccatcgattccacctgatagaagaaagtcgaaggcatttaattactttcttgagtattccagaggtagggaaatggtaatcgggaaacaattaactcttggttgttaattttctactgctgagaagtcagagcagaggacttctaaaagtccctcctgtatgattttggaataaagttctctgcaccatttttgagtataaatatgcgtggtgttaaagttggtatcacttaaaataacaaaggtagtacatcagaaaaatttttgaagaaatttttaacaatccagtttcttctattctctcatctgtctacttcacattgaaaatatataatatttcttctttcagtgactcatttctgtgttactttgctgcctatcttggttccattgcccatggagaatatgaaatatagggaattttaagctgtttctttttcctactcagattaaagacaaaaaatcaacagaggatgataatatataatgcaattgaaggcaaacgaaatccgacctatctttggcttatgctgcactatcaagtttgggtttgagtccctcacgttatagctgttatgaccttcaggaggttattcaacttctttgattctcaatttcctcatatctgtgataggggtggtaatagctaccttatggttgtcttctgtggattaagacaatttgtggatagtgcctggctcagtcagtcagtgcatgccatgtaagaaacactgtacattattattcttcctcttactcgattctaatattgttgtggagagagactgggagacttgatagtaaatcaaactgaatacatcatgaaataaatactatgagaaatgcttatatgattttagctgaaattatggggtctttgattaatcaagtattttttattctaccctccccctcccccaccaattagcttgttattcagtctttcatttttgtggttactctagagattagaacacgtatcagtgatctgttagtgtttactagtgatccttttaccacttccaggataatgaaagaccttacaacatttaagctccaatgtattccacccctcccctcactttttctgctattgatgtcatatgttttaattatgtatatattttgaattccagaagacattactaatattgtatttatagtcaatattcagtaggtttacccacatagttattctttctgttgctcactttgccttctcacatttccatgatttcaactgggattatgttccctctatttgaagaaccccctttagtacttatttttggtgcaattaattctttttcccttgttgagaattggttgaaagcatgtttatgttgccttcctatttgaggattttttttctctgtatagaatcctaggttggtggttacttcctttcatcactttaaagatgtcattctgtggtcttctcatgagcatcatttccgttgaaagttagccatcagttgtattcctgttcctttctctgcctttcagtagttttgctatgatttacctaggtgtggttttatttgtatttattctgtttatgatacatatcttatcttgcatctgtggcatgatgtcttttgttggtttaagaaaaatcttagccattatctcttcaaaaattatgcctaattctactacagtctctccctgtccttctgggcctctgtgacacatatgtttggcctttttactgtgtctcatagattcttgtctggcttttttagttcttttttataccctgggcttcagtttggataacttttactgacttttgttttattttgttttgtttttgtgattgttttgtttttttttgagacagggtcttactgtgttgcccaggcaggagtacagtggcacagtcatggctcactgcagcctccatctcctgggctcaagcagtccttccacctcagcctcctgagtagctggaactacagatgtgtgccaccatgcctggctaattttttctgttgttgttagagacagggtctcactatgttgcccaggctgatcttgaacccctgggctcaagcagtcctcctgtctcagcctcccagtgtgctgggattataggcgagaaccactgtgcctggctgctgacttcttctgtgctgcatctaatctgctgccaaacctatttattgacctcttaatttcggatattgtatttttttttttagttctaaaatttcaatttgattgtttcaatatatttcagtttgggtgaaat

SEQ ID NO: 55762 - DNA, 1849 bp, Homo sapiens
gagaaacctgtgtagttcctgtttttttgaaagaatgtacaatggtccatcaacaggtatttttttttctggtattaaattttaatggaattttattatgtgaatttttgtgtcattgaacaacccagtagtgtcctcaataggacttttaaggctgataaatgtttttcgtatgaaggtttcttatattgactcctgaaaacaaatgaagccataattcaagattgttacttagtagcggcatttttatggggaactaaactaatacagttcaggtaaagaagtgtttgggaccttcagtttgaaacactggtagaacttggaaaaatagaggaaaactttcttttcctctttttccctcagttatcaactgttacaaaaggttttgacaaaaattggcaacatgtggctatgtagatattctttttgatttgaaaagagccatatgctctattttttccaagttatatttatttttaaatatcattagctgttatttaacaatattacaagaaatctgtgctaaataccagattgcttggtggcaatttgaaattctgttaccaaaatttaagatcttgatttgcatggatgaggggacatcctagttctgcatgcaagacagtgctcaggtttatatcttttcggattagaatttgatctttcaagcatctgttcatatctgctttacttttcccagtggagctatcatatagccaatgttgaaggtacttttgcaggttgagttggaacatgaaggaaggagtacctaagtgatcctaggggagttggggaaggcttcacagaggaggtggtgctgcagctgcttcttacaagagggtgaagagatggatgagagggtattccaggtgatggaggcatgaaagcagaggccatgaagcaccagagagtatggcatttccagaaagtgaagagatgtttgttttgtgggatagaagcatcagagagtgggagaacagttggagatgaagctaaagtggtatccatgagccagatcatgagtggtcttgtatgtcttttattcattcattcattcatttaacaaatatttattgaacaactactattttaccaggtcctgttctaggcactgtcattcagcaatggacaaaacaaaaatcactactcatatggaacttacattctactggggaaaaaagaaaaagaaaacaaataatagtgaaaacataaatgttcataaagtattttagtaataattgataaggagaaaatttggcaggagcaagaatggggatgtgccactttagggtgctcaggaaaggcctcattgagaaggtgacattagaatatggatctgaagctggtgaaggagctagtgggatgaatgtctgagagtgtcctgggttgaggaaatgtgcaagggccctgaggttgcagtaggtgaaaccttgggagcagagcatggctggagtatagtggaggaagaggaacagacaggaagtccaagaaacaaaaacggccaggtcctgtaaggattgcctctataaggatttcagctttcatctgaatgagatgggaagtgattggagacctttgaacagagtaagatataacccaacttaaatttttcaaagatcactttgctgtattgagactagagaacaagaatggaagccaggagaacagtaagggacactgcagtaatgcagatgagacgggtgctggccggggccagggtgacagcactgggggtggctgatgggttgattttgtcctataggtgataaggagccattaaagacttgatcagtgaagggacatcggatttgtatgtggaaaatatgattttggcagccctgtggaagga

SEQ ID NO: 55763 - DNA, 1312 bp, Homo sapiens
gactcaaggaaaattgtctggtttcactttcctggcccttctgtttaggatttttcccttttatcccttagacagtttcaccctcacttctgctgccttattgcctagcccccagctaacaatatgtaccagtcagaagcaagtcttccttttctgtaaaatcacccaagtttcatcatgcacatggagaatgtataattttagttttacagtcttcaatagactgcttatcaaaagatagcataacagtgaagagcagagtttctaaaggcagatagcctggatttggattccatctctgccacctatcagctgtgtgaccttgggcaagttacttaacttctctgtgcttcaatttcctcatcagtaaaattaggcctcttagggttgttttgaggattattatatgtaaagcactcagaacactgcctggcatatatagcagatatatgtaaatgtttgcggctattgttgtttttataaaataagaagaaatgtggtatgttctgttaatttattcattaaatatttctcaagcacttacaactgtacaaagccttctaactttaatgctgtaaataagaacttaaaaggagatgctttaaagagggtggagaatagaaggggcaaacataatcagattacctagatgtatttgtttttaattttcaagttctgcgagcagctgtgcccaagaatgtgtctgtggctgaaggaaaggaactggacctgacctgtaacatcacaacagaccgagccgatgacgtccggcccgaggtgacgtggtccttcagcaggatgcctgacagcaccctacctggctcccgcgtgttggcgcggcttgaccgtgattccctggtgcacagctcgcctcatgttgctttgagtcatgtggatgcacgctcctaccatttactggttcgggatgttagcaaagaaaactctggctactattactgccacgtgtccctgtgggcacccggacacaacaggagctggcacaaagtggcagaggccgtgtcttccccagctggtgtgggtgtgacctggctaggtgagtggtttggagaatgactcttaacctcttcagcttaacccctcctcggagttatctgaaggagttatctcaggaggctctgcgctttgcatgacttcgacattatttctattggttcatgcatactttggcccagatagatcccaagctggggatgaaatagaatctggcagacaagggaaatgtttagataatgtggcctcagttgtctcaataccctcatttgagagtatatagtttccttttgttgtcgac

SEQ ID NO: 55764 - DNA, 1036 bp, Homo sapiens
ttcccttgtctgccagattctatttcatccccagcttgggatctatctgggccaaagtatgcatgaaccaatagaaataatgtcgaagtcatgcaaagcgcagagcctcctgagataactccttcagataactccgaggaggggttaagctgaagaggttaagagtcattctccaaaccactcacctagccaggtcacacccacaccagctggggaagacacggcctctgccactttgtgccagctcctgttgtgtccgggtgcccacagggacacgtggcagtaatagtagccagagttttctttgctaacatcccgaaccagtaaatggtaggagcgtgcatccacatgactcaaagcaacatgaggcgagctgtgcaccagggaatcacggtcaagccgcgccaacacgcgggagccaggtagggtgctgtcaggcatcctgctgaaggaccacgtcacctcgggccggacgtcatcggctcggtctgttgtgatgttacaggtcaggtccagttcctttccttcagccacagacacattcttgggcacagctgctcgcagaacttgaaaattaaaaacaaatacatctaggtaatctgattatgtttgccccttctattctccaccctctttaaagcatctccttttaagttcttatttacagcattaaagttagaaggctttgtacagttgtaagtgcttgagaaatatttaatgaataaattaacagaacataccacatttcttcttattttataaaaacaacaatagccgcaaacatttacatatatctgctatatatgccaggcagtgttctgagtgctttacatataataatcctcaaaacaaccctaagaggcctaattttactgatgaggaaattgaagcacagagaagttaagtaacttgcccaaggtcacacagctgataggtggcagagatggaatccaaatccaggctatctgcctttagaaactctgctcttcactgttatgctatcttttgataagcagtctattgaagactgtaaaac

SEQ ID NO: 55765 - DNA, 1877 bp, Homo sapiens
ctccagagagtgaaaagaaataaagagactaaattgtggaaaaggctcagttactatccaaaggatcccgtcatttgttttcctttggagtgctactaccattgtgaaagtcatcagtgtgcttttcctgactgatgctaacagatacagaacctgcaccttccctgctgctttgcatgtaataagcactcaataaatattagctgaacgggtaaataaaccagtacccacacatggattttgttaaaatatgtgcataggaaagctagaattgctaagaaagcagtaatgttcaactcctaggatattcagagatatttgcccctgagtaaacctaacgaaagagcgagtagtatgaaaaacaattgcattcttttttttttcttcctcttaagacttctcctccttccctgtgcctatgactcagaccattacagctgcttggacacttgtcaggagcgggtagggcatgagcatagcagcagacccttctcaaagacttccccgctggactctgtccagaagccagtgagcctggcctgacactccatggttgtctctagatatgtaatgtgcatgtatatgcgtacggataccataccacatacaacttgggaccaatataaggtaaccgagaagtgaccaaaaaagatagacagacaacctgacaagcactctgttgatataggtggtcttaggtcatgtaactctggaatgttgtcacagaaaagttttcgagagagttggtttgctacacaggtaaaatgcaaaactcagttttgccacttgacagattaaaatgaataattaccatttattgagcatctactgtgtgccaggcactggactaaggaccttatatgcattaaatgttcaatgtgaaaatatttttggccttgggactcagcttcattcctgaaactccagagcatagtcctaagagctgggtagttcttgtcttcatttgcttggggcttgtgtactgagctaggtgaggggattgaagctgattggggtcttctagagttccactgtgctaagcaggaagacggggcaatgacatgaatgggcctggcaagtccagagcacttgcagccactgagaggatcatgataatgttttagatgttgagaaaaaacctcttttacttagaatgtatgtcctactttaaagggaaagaaaaaaaagatttaagttggcttgcaaaatgaggtacagtttaaagcaggagacataaaatcaagatcaaaagggtaaaagaagaatagatattgcaaggtggttggtatgaattagttattatatttgagcactgaatttgcctctgaagttctgaagagttgagacaaaaaaaaagatgtgattatacagttctcctctgaggaaggaaaacattaactctttcagcaagacaaactttctcttggcattgaatttatcatgtgctttttcattttggggcattggaaaagataatagacagggctttcaactgttcttttacaaaaggccctaaatgatggtttaaatggatgtttcttatatccaccctctataaaagctgaggacataaatcttaagtgtgtgaagggtttctgtaagaagctcaattactatgggggacaaatgatgctttgtgttgatccaatttagtatatgtctaaaacagagaacctagcagaatggctagttaatctgcacattaagccatctccttctgctatcagatgtcttaaatgagcctttggcaagagttggatactaatcagttcatggttgaactctgcccgaagtaccagacttctgtggcgttaattggaaggggttccacaggctttggatataagagctggaggaggcagagttgagttctgctg

SEQ ID NO: 55766 - DNA, 1059 bp, Homo sapiens
gtgtgccagcaaggaaggtaattattttatttaaaagagctgttaatctgctaagtacttggtagaaactttagagttctgggccatttataggcgataagatttagacctgtaggttttttaaggataactaatatcagctgtctgtccaagattattctggaaggcagaagtgcacgtggccaagtgttggagtcaggagacatgtgttagtcctccttctaggtatgttgcctcgggtgtgtcgatgaacatttccaagtaagttttggtttcctggtttaatatgataatgcatataaagtgcttagtacagtgcctggctcttaaatgctcactgcattttcttggtggtggcgatgatgatttgttagtgtttgagggtcttccccaccaagttcttaaccaattaagacctaagagtttgtcttagggcatggaggagcccagcatagaggaattaggaacatgtgtgtcctaaaagcagctgctcctaagaggagctagagaaaggggttgagctgaccacacccagcccttttcatccctctcaaagctagtaattcacttttccttctctgggaggagcaaatgaggatgaagaaagaaaaacttcatgaatatttctttttttttttttttttgagatggagtctcgctctgtcgcccaggctggagtgcagtggtgcagtcttggctcactgcaacctccgcctcccagattcaagcgattctcctgccctagcctcccaagtagctgggactacagggcgcctgccaccatgcccggctaatttttttttgtatttttagtagagatagggtttcgccacgttggccaggctggtctcaaactcctgacttcaggtgatccgcccgtctcggcctcccaaagtgctgggattacaggtgtgagccaccgtgcctggcccttcatgagtatttctttgggtgcagggcatagatgttgcattcaaatgatgttatttttattgctctgaaatggctagtgctccatccatcctcataatggttctgccacagtaaggtaatgagtct

SEQ ID NO: 55767 - DNA, 2853 bp, Homo sapiens
cccttgataaatgctcgttgtttagcattattattgtaaaatggggataataataccttccttacaaaattgtcatgagagtaaaaggaggtattttgtatgaaaatctctagatcagtctcctgcacatagtaggcccacaatacttgtttttacaaattagccagtgattctgaaggctttttattgttttgaaagttgtgacaaaggagtctaatgagccattatttttaaagcctttctttaggggagggtcactcttttggagtctgtgcatagcttgggagatggtgtggacatgagcagacaccttcctggcatccagattagggagcagatccctgcttctcagaacgttagtgatgctgcacttggactggcctcagtattctgtgagagggcttacagtgtgtgttgttgtttgtttttaacttttaaaaatagaaatttacaaatattcacagttgaagaaataaccaccaacttcaacaataatcaatattttgctgatcttattttatctctcttccctattccagacaccagacacacacagacacacacacacaaaaacacacacttttttcttctagaagagtataaagtatatcccagacatcatgtcattttactgttaaacactttagtatgcatctttaatgataagcagtttttaaacataaccaccattgcattcttagctgatttcttgatgagatcaagcagaatgtagcagtaatcagtggtgaaatgcctgtgcccaaaatgagcattttaatgcaaaatattaaatttagttcaattcagccagtatgttagtattttttatgtacaaggcactgcatgcacagcacgtacagagaatcaaggtggcagtccctggccctgggaagagtcctgtggaaagcccataagacatacatacgaataaccaaagttcaaggcaggattcacataaaacccttagagagcagggagcttggcaggtggtgggatttgttgaatacgaaataggagtgtgacatgtgagttcaaaggaggcattctccgttgagtaggagaggatacacagaagaggtatgtgcatgacaggccttgaagaagggcacaatctctgcaaaccatttttaaaattgtaaaacaatgttaaaggacaatctctgtccatgcaccaaaacaaaaacgaaatcagaacctgctcctactcctaccattctgacatggtggaatcatatcttctccaggagtgtaagtctaaagttgagctacaaggctggtggatagctcaaatgaacctgcccctcgtaagttcacaagccaagaatccacttatttttgtttgcctttgcattaaaactgaggcctccttttctgaggcctaaggttagttttaagagaaaatgaagagaccaactgttgaggtcaatgaagagatttttctttccttccaagctggaattcctatagctagatgcacacattgtgcaagtcccccgtactctcattccgctgtgtttgggtatgtaggattcaaacagattgatttcagggtggagaatggagtagaatgaaagaatctcttcagtcattatttaaactacttatcgagcaggtggcccaggtgctgaggcagacagagcagcaggaaggaaggcggagcataggagtagctagggaatggtgagaggtgccatctgagtggagttgagaaggcagtgggtgctgcggctgggtgcacgcagtggagggcctcgaatgccaggctggggagcattttcttaactcagtaggtgagggaagaagccatgggaggtttatggagcagatgcccaagcagtcatgtcagtcatgtcaagtggcaatgggaggttgttattatagtcttggctagagggagtgagggccagggtgaaggtgttcttcatgaggttttcacttctatttgcaaatattcataaagtgtctactctgcatcaggcctgagaacaaagaaatggaagagacactgaggaggtagaatgtgcgagacttaggaaccctcagagtggagaggtggaagggaagggagagcgttgaagatggcacacctttgacactgagtgaccttgagaatgagtggcgggaatgtggtagcaggagtggttgaaaagtttggaggtggggctggctgtgtttggaacaaggttttaactctctctctctctctctctctttctctctctctctcgctggctcgctgtgtgtgtgtgtgtgtgtgtgtgtttgtgtttgtgtgtttgcagaggcagatgtggagtgaggtgaattcggttgtgagcgtgctgtagtaaagacgccatggatgctcagttagaatgcccagacctcagctcaggccagtgtttgggtctggaggctaaggaagagctgggttttcatgtctgggggagtgagctttggggtgtgagcaggccagggagtgggaggagagagagagctgcccaggtgattggcacaggagctagttttgaccaccttttctgtgtgttctgtgatctgaccactaataggtcagtcaagtcactccaacatgtttttttaattgacagattaaaattatatatgtttatggtgtaccacatggtgttttgaaatatgtatacattgttgaatggctaaatcaagctaattaacatatccattacctcacatacctataattttttgtgctgagaatgtcgaagatctgttctcttagcagtttccaagtatacaatacatggttattaactatagtcacaatgttgtacaatagatttctggaacttattcctccagtctaactgaaattttgcgtcctttgcctagcattct

SEQ ID NO: 55768 - DNA, 3325 bp, Homo sapiens
acccacattgctgcatcctgaattcgacatgaaagtttagatgtggagtaatttgagcattccttatcttttgcatatgatggtgtaaacacagttgggtggtgtgtgtccttcagtcagtttttgctagggtgatgtgtggtgtggtgtattagcaccatgctcaggttcaggacatcccctagcagtgtgacagcatatgagcctgtaaaatgagcagtcagaatggccagtggattcctctctagccctggcagtcccacagcctgtggatttctctatggtgtccacatcacagtacgatgtactcccatggatgggcacaagcaattaaatacttgtgaagatgacatttgaggaattaggattttgagttctttgcattttctggtccactgaatcattcttggagaaatcatgatgttataaattccattagaagtgtaaatcacaagaaaagttccttgacctcagcagtttgtaatctgtatgtcataaatgaaaacaatgttaaataaaaccaaactttgatcaaggtgatgcagataaagataatgttgataaatggagagttctgtttaggtagtattatttttctcccagaaggcaaagtgctatggaagaaaaacgtagccctttataggccgggtgcggtggctcgttcctgtaatcccagcactttgggaggctgaggtgggcagatcacttgaggtcaggagtttgagaccagcctgtccaacatggcaaaaccctgtctctactaaaaaaatgcaaaaatgagctgggtgtggtggtatgttcctgaattcccagctatttggttggctgaagcatgagaaacgctggaacctgggaggcagttgcagtgaactgagatcgcgccactgcactccacttggggacagtaagactgtccaaaaaaaaaacaaaagaagaagaagaagaaaaatgtagccttttctaaaagcctgaacattcaggcagtaaacatttactgagtgcctactgcataaaaggcagtgtatttggagcttgaggatgagactataagcaaagagtcattgtggagtgggctaactggcatacaaaagtgcatagatggcttatgggagcacagagtatatcccttctggggacccaggaccaggtgacattgaagaataagtggaagtttgtagtgcatctcacatcatcacagtggcgtgagactgtgtggagactggagaacctcgagtaatcaggtgtagaggagctgggggaaaggagaggaagccacaagaggattccaacatcagctccttggcaggtatggaggaagccttggggcaaaggaggacagaaccatggaggtgcagaaatggattaaattgatgcagtgaaccccagaggaaggaggggtttttctcccagtggaaacaggaccgtggcagaggcaaggggatgctaggagaatgctggcttccctcccacccttctctgcagggacatggggtgctcactagggcaagattcacagtgacacaggtgagttacatgtggcagtagcgagaatgtctgtgggagagtttgaggatgggagtgcttattgaccactgaacacagattccgcagaaaaagtcagaggaacggtaaagtgaggacataaatatgtagggggaatgatgacctgagggccttgcatttagggcatggccaaggatgacaggaagctgagccactgtgccactgatgggcctcgagttctggaatttactgttgggtggggttttccgatactgttccagtgggggtgttggaggtctgtgggcttacttggcattccagagcaatcttggtagggggtggacactgagcttcttaagagattcttctcagaagaccttaacctcttggggaaactgacagcagaccccagtgccatggaaggatcaagattctggccgaggacattgggcttctgttcttgggaggttttcttggggtgggaggtatgagaagcggtgttttacaagttttgcaaaaacactgttctaggatcctatccaatgcaacgactgatttctgtctctctagtccggcaggagaagcatttaattgttaaaacaagagcagtccttgtctcattccttttgttaattcttgccatgttactctaattattttcctatcctggcctttctgtctctcgttcagaaccagactaccaggtgtacctgaatgcttccaaggtccccgggtttgcggatgaccccacagagctggcatgccgggtggtggacacgaagagtggggaggcgaatgtccgattcacggtttcgtggtactacaggatgaaccggcgcagcgacaatgtggtgaccagcgagctgcttgcagtcatggacggggactggacgctaaaatatggagagaggagcaagcagcgggcccaggatggagactttattttttctaaggaacatacagacacgttcaatttccggatccaaaggactacagaggaagacagaggcaattattactgtgttgtgtctgcctggaccaaacagcggaacaacagctgggtgaaaagcaaggatgtcttctccaagcctgttaacatattttgggcattagaaggtaggaacttttttcttgttattcatttttgttttgtctttgcttaagtcgtgccgctgtgtgttgatgcacagtcaccctctgcaggttatcacttacactaggaatgtgtgtcctggacattgatcgccatgcgacccgttgcacatgctctttggactcactatcacccctcctctgtccccaagccccagagaggtccctctccaactcactgtcaatcagccaagtctcttgtttcctgaactttacctctgaatgtttcttttctctttcttgcattaaacatggtgactctgaggacactctttcccctggagaaaccgttacctctctgaggacagtttcccccagagcccaactaagtgatgcccattttcttcccacacttctcataactgggcctagaggtgtggggcaggtgcccttcttgatcctccctgcagcttccaggtcgttttcgctcactcctaaaaatatctagcttcgaatctcgtgtcatcatcacaccataccacctcttcttgttactattgcctgttgcctcctaggtcctccgttcattctttgaagatgttagcgtttgtttcacggccactctgtctgacactgctcccatcttgctaacttcagtatctgtgtagagcactgggtcacaattggaagccccctaggaacttaaaaaaaatgctggtgctttgtccca

SEQ ID NO: 55769 - DNA, 1033 bp, Homo sapiens
gatcctcctgccttagtcgcccgaagtgctaggattacaggcatgagccaccgtgccgggcgcccccccttttttatgctagtcttgatcttccttcttcatccgtctttctgtttcccacacccatttgtctacttattactttttccttttataacaacaatatttgacgtatatatactcagtgtgtctggtttttctccttccattctctctggtacctactcaaatcaggctttcccctcagctgcttgtggtaagatggccagtaatcatcatattggaaaatcctattgtcagttattttctttgacttagcagaatttaacgcaggtgattccctcctcctgggaatgctttggtttttcccttggcttgtgggacactgccttctcagggctttcttccaactttattagccatttctcagcctccttttctggcttctgttcattttttggacccggaaacattagactacctcaggacatagtctttggacatagtccttggacttggacttcttttctatttaacctcaccttcttggtgatgtctctaatctcatcaatttaaataccatctagaaaccagtgactccagatttacatgtctaccccaggcctctttccagaactccagactcaatattacattgcctccttgacactacttgactaacaggcatctcaagcttctgttcaaaaggacgcttcccatcacatctgccagctctcttctcccagctttctccagcaccattgttctagtggctcagcccaaaaccttcatccttgactgctcgttgttaaaattgacttagaatctggctacttttcacactctgccatttatggcgccacccttgcctggattacatccctggcctcccagatcgtctccttgctctgccctagcacacagcagctggaacaatcctgttaaatataagtcaggtcctgaaactccttcactctaaactttcaaagcctccccatctcactcagagcaaaacccagagtcctctaagtgg

SEQ ID NO: 55770 - DNA, 1025 bp, Homo sapiens
gactataggcacatgctctgtgcctggctaattatttaattttatttttagaggcacggggttttgctatgttgtccaggttgatcccaaactcctggcctcatgcaatcctctcgcctcagcctctctaatcagtgagattacaggaatgagccactacacccagctcaggttctttttaaaatgttgcctcctcagtgaggatgtccctgatcactctatttacggttgtggcacacacaccttccttccaaatacaaatccacgctttttctcttccttggctgcttattatctcttaaacatttatcaccatataaccataccatatattttatttgtttatttcatttgtcttccttcactggcatataaagggagggatttttgtatttatttgttcaccgttatgtttccagtacctgcagtatggaaggctgtcaataaatatatgtttaaattgatgaatgaatgaccgaactcacaggaaaatcaagaaagaatgtggtggctcagtagaagctcagcagtcagtggttctggagagagttcttaatatacatgttctgctaatcggtttggtggaacaagtgttccaaaaaatctaacgtaaaaatctcatcttgtaactggatggattataggattaatcatcttattaaaggataaaaagaatgtatctaattcatttattcatccactcaacaaatatttaagcaccttccaagtgcctgacgttgtgctactataatagatgaattctaatgtgtacatgcataggcattgttgttttgacagagacacaaggagtaatccacttaaacctaaagttagcgtagccatagacacctctcaaaatgtttaaacagcatttctgaaattaaagtgtaaagcaagtggaaattattagatctgcaaatacatacgctacagtcattttagcaatacatctgttctgtaatgtcactatcatatgattaaacagggagaattcatttctcccttgctgcattcctccctgcagg

SEQ ID NO: 55771 - DNA, 1050 bp, Homo sapiens
tgctgtctgtaggaatctgttccatcttgttttacatttgttatttgatctttcttttaaactcttatatggaaaaggggagacacagagtattttgtatctatttctgggtgaggaatggatgttgagtctattcctcagttctttaaatctcagcataacagataaaaccgctgtagcttccaggttgaatagattgcctaaggttttattttatttaatccacagagttgtcatggccagttcacattttaattaggagaagctgccatcaaattcagcacccagaacaatactatagccctgaatagccaccagcaaacattgatttgaaactgaacagcctttgcttcctaaaaatccgtgacataccttaagacacgcaacaaaggggttcttcccatgttcaccttcctgtcccctgatttcagggcacctgctttttggtattaaaaaccaaggggccctactgagtgctgggttttactgattcaaagtgtcaagaggaaaatggtatttaaatatgatagtgtaggctttggccttttaaaagaagaataataaatttttttcttcgtaatatatagaaaatttgaaaatatagtaatgtagaaagaagggaaagagacttatccatcatcctaccagagactgttaacttgtgttgttcatcttcctagaatgtttttcttgtatattttcttcatgactttgagatcaagctgtacatacaattttaggacctgcttttctccctttagtgttataagatcagcactttccatattgtcaccaattctaggtaaacattaataccacgtttaatgactttacatacttgaatttgcttagccattaccctattgatggacatgcagatggtctgtaacttttgctttcattaaaaaaactgccactaacagctttttttagaggccaaggttggaacatggtttatgtcaatgtttgtatttaaaagttaagtagttcctatactctctgcagactaggaattgggggacccctagtgactccggttgttcatttaaa

SEQ ID NO: 55772 - DNA, 1050 bp, Homo sapiens
ttccccagcacccagcacagtgcagtgagaccactcactccactggaaccaaaagctttcttgcttcagtccctgttcctctgatccctaagccaccctggcctagaagtgaaccatgttgaactagaaccagcccaggctgttccagggtggagggtagctttcgaatgaggtcactgtggccaccagaaagaaaagccagagcaaaagtaattctttcagaagagttctattttggttgtaatcttaagatgaagctcacttggatgtgcctaatgcccatgtctctctgaatagaagagaggcaaccttggaacacctattttgtgagtttctagaccagttcccagggaagagaaccacattttgatgccccttagagtgcaaagaatggaatttgacaaaagcatgaaagagaataatgaggctggcattactttttttccaggtcctatatttaatgcttctgtgcattcagacacaccatcagtaattcggggagatctgatcaaattgttctgtatcatcactgtcgagggagcagcactggatccaggtacctcactccatcctcaccccttcaccatgttgctttctgtaaatgtttctcatatcatccgcactgtgttacacagatgtgggttagggataggattatctatttatcccctaactgcctggcccagtactttgtactcattaagtgtttaataaatacatgttgagtggatgcatctatctgctagatggtttggaaatacatccagacatttgaatctgagctgtcaagacagtcagtggggtcacttccaggcctatttcaggctgatttgaaacccactggcagagtctagctccttctcttgtgtctttcattcatttattcattcagatatttattgagttcctttggtatacaagtgctgctctagatactgggaatagatgagtgaacaaaatgcccaaagtcagggggcagttccaagatggccaaataggaacagctccagtctacagctcccagcgtgagcgatgcagaagacgggtgat

SEQ ID NO: 55773 - DNA, 2025 bp, Homo sapiens
ttccttggagagacactgggaacaaaaaaaaaaaaaaaaaaaaaaaattatgctcaagtgccacagtgggtcaatgggagaaaaagagaagatattacatgtttagagtgagctaaggaagaattatcatttggataatttcatagaaattcttgcttttagttctgcttacttttttaatatgtaagcatctgaaaataatttatttgccttatgtgctttttgaggctattagtgtatttttactaaatgaacaaatgttatctcttgttcggcaaaaaattgtgttatttgacatttatataaaacgctttctcaagtggatttaagacaacagtgtcatggctgttgtcttttgttgctggatgaatctcagagccgacacagctgataatggttggtaccagtcaagggaagaggtcaagggcttatgatgtgtgctctgttttcacattccatgagaattaccacttgtgccaaagtcttctttctcttatgcccatattaatttatttgaggctgttagaatcttaattttgcagagtactttacgattcagcattactctctgggactgttaaactgtgttccattttctcagcttgacattttttttcctcttgttttgaacttaagcacttctgcaaggaaagaaaaaccatagtgtacaataaaatctaaactgtttacaactctaaatttggtgcaattcattttatgtacattttgttccatatgactttagtgtccttccagtcttgggttcttctgcctaaactgtcaaaggagctggctttctttgggagagagagcctgcagtgtcctggcataccagctttcggatcagtgttctctgtgggagacagtttttggccctgactcttcttcctgtggccccttagtctgggtggcagcagtgcagtggttaagaggctgggctctggagctgtactccctgggttaagctgcacactctgctacctgctgactacatgaccttgagcaggtatatagtctggcaataatggcagaataaaagtatgatagtgccttcatcatagggctgttgtgaggatccagtgagaccgaaggcatgtagtgttgtgcttgccatacgtagtaagggcctcatacatggatgtggccatacatatgacttctgcccattgcactgaccccagggttttggcttggtaatccgtagatgacatggcctttgatgtgtcctggtttgcggtgcactcttttggcctggacaaggctcctgtgctcctgtcttccctggatcggaagggcatcgtgaccacctcccggagggactggaagagcgacctcagcctggagcgcgtgagtgtgctggaattcttgctgcaagtgcatggctccgaggaccaggactttggcaactactactgttccgtgactccatgggtgaagtcaccaacaggttcctggcagaaggaggcagagatccactccaagcccgtttttataactgtgaagatggatggtaagaatgtcacccaaatttctcagtgtttgggaatgtcttcttcttgtgccaggctgtagctgacagaacccaggtggccacagtttgaggaatgtgccatagcacgtcctgctttctttctagacctggcctgagcctgcacccagaagggcaccagcagcccttgcagtttccccagctttgctattatgtgctagtgtcaccattgataaataattttcaagacttactagaaaaattttcaaggctttgcctcttccataaatttatagaaactcgctttatggtgtccgagggttggcatggattctgctaggcacaggcagagagcagccttgagagagagggctcaggtcaataggggaggctatagcttagggacctgctactctcactaccactggttttgcttcttaagagagactcatggctgggcacagtggctcacgcctgtaaccccagcactttgggaggccgaggcgggcggatcatgaggtcaggagttcgagacc

SEQ ID NO: 55774 - DNA, 1455 bp, Homo sapiens
ggcgagggtgcccccaaagcggcctccctcgcagcactgactggcttcccctttgatctctccctcccagtgctgaacgccttcaagtatcccttgctgatcggcgtcggtctgtccacggtcatcgggctcctgtcctgtctcatcgggtactgcagctcccactggtgttgtaagaaggaggttcaggagacacggcgcgagcgccgcaggctcatgtcgatggagatggactaggctggcccgggaggggagtgacagagggacgttctaggagcaattggggcaagaagaggacagtgatattttaaaacaaagtgtgttacactaaaaaccagtcctctctaatctcaggtgggacttggcgctctctcttttctgcatgtcaagttctgagcgcggacatgtttaccagcacacggctcttcttcccacggcactttctgatgtaacaatcgagtgtgtgttttcccaactgcagctttttaatggttaaccttcatctaattttttttctcccactggtttatagatcctctgacttgtgtgtgtttatagcttttgtttcgcggggttgtggtgaggaaggggtgatggcatgcggagttctttatcttcagtgagaatgtgcctgcccgcctgagagccagcttccgcgttggaggcacgtgttcagagagctgctgagcgccaccctctacccggctgacagacaacacagacctgtgccgaaggctaatttgtggcttttacgaccctaccccaccccctgttttcaggggtttagactacatttgaaatccaaacttggagtatataacttcttattgagcccaactgctttttttttttttttttttgcttctctgccccttttccatttcttttgtatttgttttctgtgagagcactgaaatggcagccctggaatctacaatttggctctccactgagcaccttatcttgccaccttagccttaagaatgaatatgaagaaaaatacacagccacctctgtccagggcagtaagaagggctgcaaggaaggggaggatggggacaaggaaaggatcagatacctgctccagtagttgtgaggccactgtgtctcaggggactccaggaggagcagaagagggatcccacgaagttattcttacgcagctggggccaggagggtcagagtggtgccaggtgcaagttaggctaaagaagccaccactattcctctctcttgcccattgtggggggcaaaggcattggtcaccaagagtcttgcagggggacccacagatatgccatgtccttcacacgtgcttgggctccttaacctgaaggcaaattgctacttgcaagactgactgacttcaaggaatcagaaattacctagaagcaccatgttttttctatgaccttttcagtccttcaggtcattttaaggtccactgcagggggt

SEQ ID NO: 55775 - DNA, 1630 bp, Homo sapiens
gggtgcttagctttggacctgaccgggtgtgtgtaaaaccatggactgagtcacagcagacactcgatggtggtaaatgtgatgggtgcttacacactgtaccttttcctttcatactgatgctgcagttcagggctggagttgttaaggcattgacctccacccacctgccccatgtccactgggctgcccaagctgcatgtcacctgagggctggcaggaaggggcgagaaatcccagggcattgtaccaaggacctagttccttctagggatataaatttccaggaatgtgtatttttaatgtggtgagatgcactcttttgttgtaccaaatagggctccccaccccacccctgcgacaagtgctcttctagaacaggttcctaccagcagcactggtgtgaatgaaagagagacccagccgcgtctcacacaggtggaattgcacttcttaacaaaaaggaactttataaaagtttgggattttttttcctaatcataaaaatagccccagaaagagcctaagctatgttcagatagaagcctcgaaattcctgtaaattgtttactttatgatgtttacatacacgtttcactttgaaaaaaaatgcaaatcgactttttaacaactgttgagatgtttcatgggacagtagaactctgactcaccaactgggctaaattttaatttaaaaatgtatttatttgagtgtctttccccccctcaccctcaccatctgaggggctccctgagatcttggtagaggaggcccctcctgcccagaccttcgtttgtttccccggtggcccttgcttcttgctttgcagactgcctgcagccatgattttgtcactgacatctgtgagccaaagactgagcctttttggcaggaataataagcaatactacacaacttgctactttcagaaaacttttttttagcttcaccgatgacaacagaggaagaagggaactgggatttgggtaagttctcctccactgtttgaccaaattctcagtgataaatatgtgtgcagatccctagaagagaaaacgctgactttctttttaagtgtggcacataaggatctgcagaattttccgtagacaaagaaaggatcttgtgtatttttgtccatatccaatgttatatgaactaattgtattgttttatactgtgaccacaaatattatgcaatgcaccatttgttttttatttcattaaaggaagtttaatttaaattgaagttgtgtgaggagcttgatattggcctctgtcctttcatatcttcagcgtgagggattgtgactggattccagcagcaactttagcaccttctgatctctttgaatcctgtaaaagcattgcagattttcactaatgataagagaagaaatggatttgatgggatcaatgttgaagttcccaccgggtggaaaggtgagggctaggatcctattgtttacagaaggcctcctgctctttcagggaattcccatgaccttacaggactcctctcaggaaagagagaagttagatattgttcctctctgcagttgaggaaacaccaaagttctgtgaccatatcgtgactggaacggagtggtttttctgactcatgatgca

SEQ ID NO: 55776 - DNA, 1007 bp, Homo sapiens
ttcctgtctcctctcctcctttctgcctctctttaaggcctattctgatcccctcccctaaactttttttaatctttatagcttgttgtcaactgaccctccgcaggaaatttaaggaatagcccttcccaaggaagtattcacttagaaaacaggagatggcctaggatcccatctgtttctctttctcctcttttgtcaggaagctaaactcgccctattttgcaccccatgcttctttgcctcctccatagaaacctagttcatgctttcctcacaggtaggaagagttgtcacccaccttgaaaacttcttcaggattggttaactcatcagctcctggtgaagctgggccagtgggaaggaagagcaaagaggccggggagttgggacctggacttcatcctccatcactggggccaagtcccagctgggcctatgcaaggcctcagtttcttcctttgttatatgagggagttgactgagatcactatggtcccttcttgtagtgtgactgcttggtgttatacacatgcagaggtgaagctcaacttcagggtctccctcacatgggcaagtccaggccctgtggaacggtaatcaatttgacctgagttcaaagagctcaagtgggataaggggtgaaataatgatcagcctcctgctgaccccttagggttttttccccctcctccagccattcactatcgtacattctgcctcctgtaaatcatgagtagctagctagaaggtttgttagaaagagctctgaaccaaaagtgagaaggcagccttagaatcccgccattttctagccatgatattgatatactctgagtctgttttctcatttgtagaatgggattagtaatacctaccacatagtgatatgaggtattctataagactgtatatgtaaagtgccttgcacagagcctgatatgtaaaaggtccctatttaaatatttcttgggcctgagtgcttatgatcagaggacataatacct

SEQ ID NO: 55777 - DNA, 1062 bp, Homo sapiens
tcggataccagacccatgtttgccgtatatggctgctgtttttttttttttttttatctcagctgtttattaaactagaccccaagttcctggagggcagggccctcttacacctcttttatcccccaagccttgcatagtatcttgaaaagggaagtacagggcctttcacttaagacttcaatatttgtagtttgaccatcactggagggctaataggtatcattgctaatgaataaaaccagaagaatggatgagtgaatggagggatggatggatgtatggatggatagatagatagataaagttagatgcctccagacctgaatttgtagaatgtaccccattctactataattctcactaggaaaataaattttactttaaaatgccacctttcccctgaagattttactgacctcccattcattctctccagattagacatgccctcttccttctctgatatccctatgtgacagtcaagttcttacctgctcacctccaccatgccacatggcacaagcagcagctccttcagatcaaaggctgcagcttaattatgtccttaatggatgtccagcacatggtagggtgcttactgcacagggagtattccgtaactatttgattattttatctatcccacctctgtctttatttatttatttattttgagatggagtctcgccctgtcgcccaggctggagtgcagtggcgtgatcttggctcactgcaagctccgcctcctggcttcatgccattctcttgcctcagcctccccagtagctgggactacaggcgcccaccaccacacccagctatttttttgtatttttagtagagacggggcttcaccatgttagccaggatggtctcgatctcctgacctcgtgatccgcccgcttctgccacctaaagtgctgggattacaggcatgagccactgcgcccggcctctgtctttattttaaatgccctacttcaggcccttattattgctcatagagacaactacaaaaaccttgtaactgaccttcttgcttctagccttgtctccctt

SEQ ID NO: 55778 - DNA, 1321 bp, Homo sapiens
aagattcacttggctctactgagggccatgcagaggggcttgcctgatctaggggcatttatctatgtttgaataggatggaagaagagaaaatttggaggtagaagggagagtcagatgagttgagcaggtaatggaatagtttcaaaccagatagcaggtactttttatgctacagttttcattaacatctggtaaagagaatagactccatctcagaataatgtttaaaatgcataaaataaaatgcatagaattacagaggaaatcagtcacattgaaatacaggtatcaaaatattttaaataaattataatgcagtaatttatttgcttcttatttatgcattacataacaaaatctacaggtaggtcttttaaccaccaaacttcaaagtaatgatgagtataaataacatttcaatatatcttaagtagttgtaatgtgatatgaagatatctgtggttgtctacatacataactgaagaaaatactaaatttccattagaggcaaaaatgaaaataaagatgtaagattatttttcaccctagtttatggaccctttaatcctacatgtggacccagttaagaactcttgctttatagctgggcatggtggcacatacctgtggccctagctacttgggaggctgaggtgggagaatcgcttgaacctgggaggtggaggttgcagtgagccaagattgagccactgcactccagcctgggtgacagagtgagattccatctaaaaaaacaaacaaacaaacaaaactcttgctttagagagactggatggagccagtgcagggacccgaatggctgggatgattggggaactaaaccaagctgcatttggtgtgaccaggactatggctgaagaattaaaagaaaagaatacagcattcagcacaaagaggttgcttaataaacattgattgagttgaattgtgctcatgtctctaggtacatatgatagtgtgaggttaagagtcagacctagggcctgcaggggaagttactgggaccacttgctgggtgacggatgcctgccagactggcttggcgggtgttgatggataggtgcactggtgggatcctttgggggctggtgtgtttttgttgtttggttaagttgtctgagtgtgattctcaagtgtatgtgctttgtgtatttgaattctatgtttgctatgtatataggaggaaactgggtttacattgtgcaataattcatagaattgcaaattctgtctctttttttggtaagcaggctagaagccctgggggaaggaaagtagtaatcaaggctcaaaaagg

SEQ ID NO: 55779 - DNA, 1050 bp, Homo sapiens
gactcatctgaagcactaattttgtgtagaagcacagtttttatgtgaagaatacataaatcaggaagttactggaaaaagctttagaagtctgctgtttgtccttacaaatatagaggggaattgaaataaattatttaaataacgatctattgatcaattacattggttagcaaatttacactttgtcccaatttttttttagtaaatataaggactgaacaatcctgatagaaaatggtgccatatgagattaatgtcatgggtaaatgagttctcggatttagcagttagctttgtctgcttgatctatttcccccacccaaactagctgccctacaaataatggccattaatatggcagggtttgggggaagggctattgtctgtcttactgagtttgcattcatgaaaaataaaaaagattccacttagtatggatggaagctatctcagcctccaagcatatagggtttttgaatgtgaaaagagaaagaagctgcttgttatgttggctattcctgaggtaggttttgtataaggtagcattatttgaaactgctgtttttttggtataaaaagtgctcaagtatggaccattttatacagttcaacctaatcgttttcattcaaataatactgcagtggtaaatttgacaattccagtgatatttttaaagaaagtcaataccatcgaggaatttttggtgttttgaaagcatgattctaatgttagtatgtcagtgccaagctttgtactcatcagccaacaagaatatgagctactattcaaaagtagctaaccctctacccattaaaagagagagcaagagggcagtcctcacaggtgtttttcggagggtggatgatatgtacttgaaaaaacccagagagaatatatttatagtaagatgcttaagcttatggccccagtgcatagccatttgagttgatctctgccagtcatgccttctacctgaaaaatacctttgaaatctccacactatttctttcacttttctcagaaagtagtatgtcttagactgtttg

SEQ ID NO: 55780 - DNA, 1082 bp, Homo sapiens
aacacttgtatgtaactgacctaatctacatctaacagttcagaactctccctagttacaaacagacatttacaggagccaacaagaaacaatggggacagccatggatttggcatttgcagatctattaatatgttcaagtctggctcaaatcctaggagtttttacataactaaatatgggaatatcacagggtttttgaaaggattcgattacaaatattttcaaagggttaaagtctatttaaccctttgaaaatatgtataatttatatgtaaatataaatatctatatttaaatatttcaaaatgtttgctggatatccttcctgtctattccatggtcttcaaatttagtatttctaaaattaaatgcattatattttcactcacccttatacacacaacagtaactcttcctaatatctgtatttctagtcagagtatcaatattctcccaggcagccttatcaaacctatgatctttgatttcttcctacctctcatctcgccatttaaccctgctactcccaagcatccaacgcactgaaaactacagattttgtctccacagtagctcagttatagtacctttacttttatccctattgcttttgtcacctctgtcctgagctcctacaattacctgattgtctatttctaacttccatcattctgcacacaaactgtgaggttcattttcctaaaacctcctaaacactttcagtggattccccattgccaatgaatcaagtccaaacttttaaatgtgatagtcaagtcctttctgctctggacccaaaaattgctgtccagttttacctctttctattaatctttatgcagccctcccccatccagttgattactctttaattttgagtaagtcttttgattcctactcagagtcttgccatgaaatctccttcacctaaaatgctctgtctccccacttaccttgtcataatcttcccaattctccaaaatccatttctaatgccatctcttatgccatctccataaacctatttccctcccctcaaaatgtagtccctcttcaaaatttttgaagcacttttatta

SEQ ID NO: 55781 - DNA, 1114 bp, Homo sapiens
acctgtgggttctctagaactaaagtctgcctgccaggtgactgctggaggatccagtcagtgctatcgaggtaagacccaagggcctgaccctgctgtgaatagccacccctgtgagttacgtgccacccggtacagtagtcacctcttatccacactttcagttaaccttagtcacctgtggttcaaaaaaaggtgagtacagtacagtaagatattttgagagagaaagagacagaaaccacattcacataacttttattacagtatattcttataattcttctattttattattattgttaaatgctttctgtccctaatgtattaaagtttaaaataggtatgtacgtatggggaaaaaaaaaagccaaaacatagtatgtgtagggttcagtaccatccagtttcaagcatccactgggggtcttgcaacatacgccctgtggataaggagggactaccgtagatgtctttgtgcccacatgaggggagaagccattcttaagtcagaagttgcccatataataaagattgtgcagctcagtagagctttgcatcgtgttacttagctttctgtgagggcacagactgtgtctaccttgttcaccactgtatgctgattagtcagctcagtggctggcacataggagtcatccagtcagcatttgtggatgaaaactctagctcgcatcattatgaggtaggcagacctgcagatatgctcttattctttcgtgtgtgtgtaagtgtgtgtaagactgaggagagacatgagtcaagactgatgactaatagatccacagagagcaataacaccctattagctaagtgtttccttcctgaactttctaggcaactttgaattcagaggtaactgcagaatgaagattccaagtggagcctgaaatgtgtaataggatcagttgacaggagactgatcaggagataggagcttggagattgggttggctggcagtgaccagaaaagcaaaagccacttgtttcccaactgagaactgctagagacatggaaagttgaggagagtagttaacaaggagggtaagaaacagatacagggccatttgtagctaagttcactctaaagggata

SEQ ID NO: 55782 - DNA, 1061 bp, Homo sapiens
gggctgaaggtgagccagggaagactcctggtgtagtcctctatgacagtgctccagcagccccatgaaactgctggcagagagactttctgagatacctttcctacagacagatgcttaaatggcttcccttgcagcatcctctccttttatgcttaacagtgcaaacaataacaacaaaaccccttttttaaaaagtcataaagttacttatttctgtagcagtaaaggatccatttgttgagttggtaggtgccacaagaatgtgaaggaattgttgcttgtaatgaactagttggggtgaaaatacatatacaatgtaaataaaacaattagcaaaggctttaaggcagaaataaggggtgccttgtaatatactataaagtacaaaagggattcagaataaaggaaacatcactctaggtcagtgattatttgttgtctgcctactttgtgccttaaaggttgaaagcctttagatagcagagaggaaaggaataaaacgctgcaattagagggagtggtgactagtgggaagataaagagattggtattcagaagtggtgatcagctgtcatcagtacctgagccagcagtagcaggtgatgttactgagtaggagcctggcattgatgaaggattagatctgaataactcaagagatagtatggaatcgctgtagcatttaagcagggatgactgatgaagattagtttttcttaacagagtacaagataaactggagtacagaagactagaagggggactctggtcaaagggctattgaaatttatgaccagtagtgcagactgggacattggctgcagaaaggagaggcaaatttaagagataatgaggaaataatgaaaagccaatgtaatggctgctgaaaatagggtcagaggtcttggttaaaagcagagagctgggcatagtggctcacacctataatcccagcactttcggaggccgaggcaggcagatcacttgaggccaggagctcaagactagcctggccaacatggtgaaaccccatctctactaaaaataagaaaattagc

SEQ ID NO: 55783 - DNA, 1071 bp, Homo sapiens
ataatgaatcaactcaagaggagttaggaaatgatccagctttcacttccagccactctgtgaaagcacattgctttttcacactgaggtcatgtgccacccactttcctccccctgtttagcctctctttctgcctgtacttttagtggagaaaataagtaatcaagtgtttcagtttaaaagaccatttcttccatttcctacttcactataggctctgtatagaaataagagcaatggttaaacatattaattgaaggagtaaagtcagtcaagaggaagaggtaatgcctttaagttaaaggccggtcaaacacgatgactcacacctgtaattccactgtgggaggctaaggcaggaggatcacttgagcctaggagtttgagacagcctgggtaacacagcaagaccgtgtctccatatattaaaaaagaaaagttaaaagccatttggtgaatgtaactaggcactgatttttttcccttctcaagactcttgtgactttacttcccatggaacactaatcatctgtcctgcctccctgatccatcattggaaaaatgaggtggagaaacgggtgaacagcaacaaactaagagtctatctctaccatgggccaaaccgggattcacgtgccagagtgtaagtgcaggaatacgcagttgtgggggcgttcagcacctctgcccaagggcccacgggcctttgctcccatccctgagatttcacttaatcaggacgcgtatttgtgaaagccaaagacagatctttagtctcgtcaccatacagcctttgcgttgtatcctgaggtctactggtgatcttttgctgtgtccttgtcattgtcctcaatgaaagctgccctgtgaggaggcctgagatgccggagctgccattcaggtgacagcagcattcccctagtcaaggagatgtgtcgcaaggccctcatggctgctggagttctgattccaggtgtacatagtgtgaatggaaccagcccagttctacagagcatcttgatagaatgctaatgattagttgctataggttgattatatttttatgactt

SEQ ID NO: 55784 - DNA, 1124 bp, Homo sapiens
agtgcatggtgcgatcttggctcactgcaacctctgcatcccgggttcaagcgattctcctgcctcagcttcccaagtagctgggataacaggtgcccgccactatgctcggctaattttttgtatttttagtagagatggggtttcgccatgttggccaggctggtctcgaattcctgacctcaagtgatccacccgcctcggcctcccaaagtgctgggattataggcatgagccaccatgcctggccatattaggctctttatgatcttgccctacctgtatgtcgctcatctcttgatgacaccctgcccctccctggggcacctcttgctcagtcataccaagggatctgtagttcccaccatgctctgtcacagtgttgtgtctgttctccctccgaatgaaacgctttgcctccactccttctcccaggttaatttttttaaacctgcttcaagaatcttttctggaccactcccttcccaccttcccccggtttggttgaatgcctctgccagcaccttgtgcttacataagttatagcactttgtttcttcagcagacgttgagtatccactatgggtcaggtgctgtttcgtcaagagcagccagattcccacttcaggtattgaactagccagtgggacttactatatctatatcgtattgtaattatctttacacttgtttttctcccctgctagattttgagctcttgcaggtaggaactgttttttatatctggtttagcatctcacatctaaaagtagacttttggaaaattgttagtaaatttagtaaaatttagtaaatgttttattgagtgagtgaatttgcaggttcaatgcctggtgtagtcatggtctacagccattgcttaagtgtgtatttaaagaataaaagaaaagtcggctgggcgcggtggctcatgcctgtaatcccagcactttggaaggccgaggcgggtggatcacgaggtcaggagatcgagaccatcctggctaacacgatgaaaccccgactctactaaaaatacaaaaaattagccgggtgtggtggcgggcgcctgtggtcccggctgctcgggaggctgaggcaggagaatggcgtgaagcccggag

SEQ ID NO: 55785 - DNA, 1802 bp, Homo sapiens
tatatgtcttgttgtgacagcgtaggcatcgttaataggaaaactcacatttttataatgtggttttgttattgacttacatccttttgatctgtccagcaaaggtttgctatgaaattcacttttaaaagtgattggatgacaggtgtaacagaaaatctgatttgtcatcttatatcttactttgaacctttattccattctccctgacttttccttccctactctgtgcccttcttcctcaacaaaaaaggtttctccgttgctctccatttgatgagttcaatctgtggaggagtcaggttgacaatggctcaaagaaaggaggagaacggttaagtattttaaccaagagccttttgctgaggagaacaaaagaccagctggactctactggcagacctttggtaatcaagtttgtacctgtccctgggggaggccagggaaggaacatgactgtgtccttgtcttgggttgaacagccatctgctttgcttcaggagcctctgagtttcccatcctcctgtgaggaggccccagggttgcagttccatgcctagtgtcatagcaatccagttgtactgtatgttggagcagtcctgtgtctaagaaagggtggaagctgcattccagggttgactagatatgcagtgtcagtatggggaatttgttctataataggcagttaatttgtatagcttcatgccagcttttttttttattcttccaggtgatactgccccagcgtaaatttcagttgcaccatttaaagctttctgaagatgaagagactgtttacaatgtgttttttgcaagatcaaggtgtgtgtattaaagaagcaccttctcacacacattgttttattcctgtcttttcttgggagtgagttgaaggtcaaatttccacaaactttatggcattattgattagttggatgtctgtattccctttttttttttaccccatttttctccttctcccctccccagcttacctctgtctcatacacacatggaaggcaaaattttgaacctactcttcattggcttccttgcatagaagtcatagggtgtggtcaccatatactgaatctgtctggtcctcatggggctgtactgaataataatatctctttgacatttgacctgtcatccagcatctcaccggaactttaagaagatgactttgtaatcctttgtgtcatctgttctttgcactttctcttgaactcttatctttccctgaattccagatttactgtttcctatttggtacctctcatttacatttctaatgtaaatatattttttcttcttttacaccttatatttgttagcttattttaaaaaaagattggttttttaaaataactgtttcttttgcattacctttggccattgcttcttatgagcttggcatcatttaacaagtcttctataatttgtcaagatcccactgcaggcacagttaagcaggtcttagtgaccattatacatgcattttttttctttttaatctgaggcaggtcagctctgcaatcctatctaaaaagacatgaaagtagaggcaaccaatctggaagaagccctaataatccattcagtagaggtaagctgtaggactctcataaatacatatgactggtgaaaatggggatttggattcagtaaaacacagaaatgtgaggttatgaatccttggtatcagagatttggcgttaactaagaccctcaaaccagagtaaaatctactgattgcaaacacgagatctggtgtttatttagcttctttttaattgttt

SEQ ID NO: 55786 - DNA, 1299 bp, Homo sapiens
ccgccagtgttgctgtcatctttctttactgaagtcggtaagaaaagccctcagcctgctgtcatatagtgctccagaggggccacctgagaagtcaatttcactctcctccaactggaatccagtctgcttgatcaaaggaaatgctgtttcggtttttctatttttgttttttggtgggttggagaaaagggggcttatttattttgctttatttcatattaatcttgataattcctatggcatcaagaatagtgtatttctattgtttattttgttttagattaactgtttaagaaaagaaaatgatattttgtttaaaaagaagccatttgtgaatgctctggtacttcagaatgtcataaagctaatttagttcttggggttttctgctttcaggcagttttggggttttgggttccagttataaaaactcagatagttatacagactgaaaagttgcccctaccttggatagaggcacatccaaaattaagaggagtattctattcatttaaggagctgtaataatgtattctgattatcaacatctcaattatattctagcttggaaaaaatagaatgattatgtcatctgcctggcaagtctttaaaaagttccatcatttggtttatctttaatgtggtgaaaaaacttgcaagatcacactttaatcaaggtgtcttgaggagttactgatgacaaattacaagatattttgctctgtgaagtggtaaacaatcaaaacatcatcaacaagtaacaaggtttgctcccttgactcccagctgctcctgtccttttttgtctgttcaggccctggatccaatggaactgaagggtgaaggtcttgtcctttccctggaagaacagctcagtgctttgaccttgtcagaactccgtgactcagagccatcttccactgtttcccttaacggcaccttcttcaagatggagctttttgaaggcatgcgagagagcaccaaggtactttttgtctcctctgtagtagtcgagagacttcgattcctcacacattttcctgtgtgacagcacttcatttgtccaagtgggaacagccatttgccagcagagctagagccgttaaattctagctgatcagattctccctccagtcttaaagcttcatttatttcacagataacactaaagccttactacataggggactttgagagagtaatttgggacaaccccagcattgcactgaagtgggttttctgtcatgggtcactggggagcttgccaggtttgtgctagggacggggcctatgcaa

SEQ ID NO: 55787 - DNA, 1050 bp, Homo sapiens
gcaattcaaagaaattcagcatcccaaaagaggtaactgcgttttctcattatccaagtattggtcataattatgtgagaaaatttgatattgccaagagttataaatcaaggactgtgagtcatgctcagcagaaagcactgaggttatagcacacattccctgtgatttctaattaaaatatttgtggtacaaattgaaaaggagatccctagaggatcagggtaagcgaagcatctgaaaaagtgtttaaaagtagagaagcatataaagaaaagcaagcgagtgaggaggctccagcagtgctgataacgttcttaagctgagtacttggatacaaggactcatttgttatacctgacatatgtgctatacacctgcattatttataaaataattcaatataaaaatttagaactcgaattaagacagcgtgggggcagggaggagcctgttgttctggctggcacaagaagggtggtcagtgtgtcccttttgtgcaggaccacagatttctggatgagcactaggaccccaaatgaaagaaggctggagtcatcactttactctagctaccatttttttctgacttcatttagcactaaataaattgtagaaaggacctagaaataactggaagcattataatcttcagatatgacctaaatgtgtgccttctcccttaggtagcagaaggcctttccttgtcaacatttgatagctaaccttaagaatgatgagggcattaaagccctgcagatgagtctgtttaatctatgttagggtatttttttattttattcttctttccagtgtcattgtctctcagtggaccaacatgctgaaagttgtagcattgcacctgaagaagcatggactgacttatgccaccatcgatggctctgtcaatcccaagcagagaatggacttggtagaggcatttaaccactccagaggccctcaggtacaagctggtcacatcagagccgcataattaactgttctgagttatacaaagagaattctttttgtttggttggtttttgtttt

SEQ ID NO: 55788 - DNA, 1442 bp, Homo sapiens
ctcagcctttcaagtagctgggattacaggctcctgccaccaagcttggctaatttttgtattttcagtagagatgaggtttcaccatgttggccaggctggtcttgaactcctgacctcaggtgatccacctgccttggcctcccaaagtgctggggttacaggcgtaagccaccgtgcccagccatataaagagaattctgatatggcaacttaaaaatatttacagccttgattcctccgagtgtttagaatttattagacatgtattgggatacttttaaagagcacaaatattctaaaaagaatcaaatatgaggactaaaaggagattaacagcagagctggttaggttgaggggaatctttgcagaggaggcaagctttgaaggataggtggggttttggtatgaggaaatatggaaggaaatgaaagaacacaggcatctaattatagataataaagatttggaaagcattagtagaatgataggcaggagaattattgtagcaatggaggggtagggactgatgaaataaacataatctggttaattgaaagtttattgagctgaccatccccagggttctaaattacagtatttatatattttggcaagcactcagttaattttttgaggttgactcacacacacacaaaatgtgatgtgagaattttctcaaaagtgagacatgggagatagcattataatgttaaaaaaaaaaacaatttataacagcagaaggaaatttgataggaacacagtgcttatctgtattgattgtggacttaaacctgagaccgagatgtgttacgagaccaagtctgtttaaagttaatgttgtgtttccttttgaaggtaatgctaatctctctcttggccggaggtgttggtctaaacctgactggaggaaatcacctctttcttttggacatgcactggtaatgattccggatttgtcctgggttgtcacagcacatcaaggaggccagtgggctacaggggcagcaagaactgacttcttatgttgattgctgtgttcgtattgcagagatgccttgctttgtatgtgtctatagatacagatctaagcagggtatagggctagctgactcccctgaattcctgagctagcaagccttcaaatgactactcaaaatagttcattcacgttattgttagtctaacatctgtttccatggaaacggggagcatagcttttcctcatggctaagagttaaccttgctcagttttacctcttctccagaatactgtattccagacacacttgttggggtccaaggaaatttcaacctttgaaaagagggagaagcattactccaaaaagaaaaggaatagggattttctaattatgttagaaatacacttaatacctcacccttggattcattgtatgtagtgttaataccaggagtacaa

SEQ ID NO: 55789 - DNA, 1038 bp, Homo sapiens
aaaaaggcagctagtcaagatcattagctggcccttcaatttccaagtagcaatctgaagcctagaggactgaggttaaataacttgcccaaggacatctagctacctagagaccagacctgagttttggtttcacctctgttacttaagagttgtcaactgatgatagtgctaagagctattattaacagtctgaccctagtttctcactagaaactaggcaagaaggtatctggcaccagcttgtcttaggccagtatagcttaggacagggatcgacagattttttttctttgaggcttttcaggccacatagttctctgtcacatgatgtgtgtgttttgttttgctttgctttcttttcttaaatccctttaaaactgtaacaataatttttagctacaaaaacaagctgtgggctggatttggcccatggcccatagtttgccatttctgatctagtatgtcagttcctttgagctttagctgtcttctaacaggaatccatcacttgaagatcaagcttgtgaccgaatttaccgagtagggcagcagaaagatgttgtcatacacaggtaagtaatggtccccaggacccaggacccttctcaacttgtactttgtgaaagtctttctttcttaggtagtgttttcatagaatttaaagtatttggtgatgactttactgatgatgcccctgaggcataccttcaggcaaaccacagtcaggagaaaaacgagcaatttggggtaagcttgaagttggtcactgcaaaagaagagcaaatttgtgtatatggtgagggcagtccatgaaaggatgctcctatcttttatttttctttttaacttttattttgacataatttcagacatacagaaaacgtacaagaatagtaccaaaaagttcccatatattatggtgtgcatgtgggtagaaacatttttctggaccacttgagaacaagttgtagacctgatgctcctttgtccctaagtacttaagtgtacatttcttaaaattaagggaattctctt

SEQ ID NO: 55790 - DNA, 1046 bp, Homo sapiens
tcttattccttttagaaccttaaataaattccaaatgaggcatggctaggggagtggatgattaaaccaattgaacaaggtctgggtctttcgggggacagaaaggatagggagtcagtttaggttagggatctaattactttaaaaaaaaattattgtgtccttactctaataatgggccataaaatgggcttttgcatccttctgtataaacacttgaggatctacctctatttttttaatgtccaccaacctatccttttttatttcaatgattttacagttaaaatccaaaccaatttattttacagttaatgtgcaaactagttcgcctccttcaggtggtaagttctatcactacagcattcttagaactccggctaacatgagttgatttgctgtgatcaattctcagggtcctcctgactgcacaacagtcagacagcttgttcctcttgccaagattttcttagatattttcactcccatgaatctgcatgttgccaggaggtctaatttccatgataatggtaactgctggcctccacgctaatggttgatttttgtcctttcctctttgtcccatgtaggtgggtacctaggctgtggccatggacacaaaggccacccaggtcatccccactggtcatgctgtggaaaatttaatgagaaatctgaatgcacatggacaggtgggcagagcgcaccgaggagtctacttaggactgtggctctctgatgggtttgtgctcagccttttaaagctgcaggcagcaccacttgagatttccagaggacccagaccttcgttcattctaaagagactgatagaattaaaaacaaagtgccttatcttgcactggagttcaagtgctcttttgttagttattcactgattgtacttgtggatggttgagcacaaaaaaccacctctacatttctcttaaaggtaggttggcaacgttctttttctaccacaggatactccttttcattttgtacagtatggaggtatctattccattggcactgaagggtctaggtag

SEQ ID NO: 55791 - DNA, 1044 bp, Homo sapiens
ttcggacgctattgcccttcgcgccagccgtcgagtgggcagcagcgggactcagccgggcgccaggttcctgccaggcagcgccgggaagcgcgggcggccgagaactccttcctgctacttcgcccagcgccgctgcttcggcttcccagcgaagtgggagaccttcctccctgtttgcagacgtccgtgggagacccttattttttccaccgctaaggttaagagattctggaatagaagcgtcgaaggagatcaagtgaaccttctacaactcctcggatgtcgccagtctccctttcggggcggaagactacgtttgagcatctcactgaggtgcaggaatggaagaacccaccttgcagcttttctgcagtgtggcttgcctgatctacccctaggaatgaagaggaggcttgtaataatccgatgaagtacagatgttgaagaggatatcgcaggacctaaacttgtgatcgtttgggggaggtcacacacgtttctgagtgggaatggatgggcgtgaatgacgtgccctcttaaaaagcacaacagtcctttaagaggagcaaaattgagttttcccattttggccaagattttgaagacagttcaatgtattctacatttgacataagatgagaactttctaaagtattctctccaagagcgtaaacgatgactaccccagccctgctgcccctctctggacgtaggataccacctctgaacctggggccgccttccttcccacatcacagggctaccttgagactttctgagaagtttattcttctccttattcttagtgccttcatcactctgtgttttggggcattctttttccttccagactcttcaaaacacaaacgctttgatttgggtttagaagatgtgttaattccacatgtagatgccggtaaaggggctaaaaaccccggagtcttcctgatccatggacccgatgaacatagacacaggtttgtttatttcagaagttctggtactaacatttggcagagcaaggtacggtgattggatcga

SEQ ID NO: 55792 - DNA, 1054 bp, Homo sapiens
gtagagtccatagactggtaggactggagtcctacctaagtcgttcttctcttcggttttatataagaaaaacatttgcgttcagagttgtgtctaatgtggacatctgggaagggaggtatgaaaacttaacctaaagaaatggtgacataagctgtgcctgcatttattaataacgtgttggagtcagtcattgtgccaccatgtgaaatcaaagcatcgaaccttgacagctcttttgggtgtgctctcccagagggctctcgttttctggcttgtagttgaagcttagtagtgagtcagctttttaggatgacaaacgtgggcagaatatacctgtcatttcttaacgtgaaaatatcctgatttttgttctttttttggggatgtgtgttggtgctgtatatgaaatcagttaagttaaaaggtattgaatcctaagttattgcactttgtgaggcttgtagacaagatttatttttgtgaaacttaattttgctctctcttttaatgtaatagatggactgtgtcaagcaactattggaatttggttgattaaggggttcacattctttcagatcactaaatctaaagtgagctctggggagagcatagccaaactaggataaaatgggagctctagttacaatttttataatttttatatttgtactcaagagtttgggaaagtagttgacttttcttaaacctgccatcttttccttgtttcttaaaataattcttgagtatgtgggaaaaaaaatcatgtgcttgaattcatttcccatctgatgatagttttaactttttgtcaagcaccgaaaaagcttaggttcacgtgtaagcctacattaaatatttgggaaaatgcactgttttatgagaactggtttttctttttttctcaacctagttaattcattacttgtgtgatggttctttgacttttggatgaattttatggagtagttacttctaatattgtttcatgccattcttttgtaactaagttaatttggaatttttgccattttcgactactgtactcctgtat

SEQ ID NO: 55793 - DNA, 1003 bp, Homo sapiens
aatgttacgaagttgtactcagtgctttcagagcaaggaatgtgtgacctagtctatagagttgggggtggaggggcagtgggaataaggaagacttcattgagaaagtgtgcctcagaaacgtagaatgagtaggagattgcttaatgaagtggaattggaggttgaggggaggttgagggtcaaagcagaagacacaacatgtgtgagagccctaaggaaaaaaagcttggcatcactaagaatctgagaaatgttaagtatggctgttgcagagggtgtgggtctgggtgatgagactagatgagaggtcaggtttggcctgcttacaagttttttggcctccttattgttgttacaaaagtttgaattagttgtcagcattcacagatcaggagatttcatgttaaagtctggatttctgatctttcttgaaaaattagaggttatggcaacatccagtgtattttcagatggtaatattcaagccacaacccagtagcagctgctcccttgggagggggacgggggcgggcatgtgccactcagagtgcgaaataagtaaatacaaatcaatcaatatttaacctggttgttgttgagtttgcaaattctagtcaggattctagagagtttgtagttaaatattttggtttttatcataaatactaagagaagttattgaaggattgtaataaaagcaagggaatgacatgatcattttaaattaaaaaaattaaataatcactttggttgcaatgattacttactggatggtaagaagcaggaggataacaagttaagaggggctgggtcacagaggatatattggcttagatcgcagtggtgatagtggagaatgagataaattagtggagaaaagtggttgagtcaagaggtgttaaactattaagtttcacagaaaatggtggttggttaaatatggggccaaaatagaaagaaaagtgagtccaagataatgtctaggtttctgggtgacatg

SEQ ID NO: 55794 - DNA, 1032 bp, Homo sapiens
aatagctaataagtttcaccctccagtcagaactttgttagtctgaattgaatacttgagggtcaggtatatgtttacctttgatactttcctcaaaggcattggagttataaataaggctgcatcttagttctactaactagctgtgtggcattgtgctagacgtaatcactcaaacctgtgcgctgtccagtaccatagccactagttatatatgactattgcacttaaaatgtggctagtccaggctgcagtgtgctttagtgagtttctcaagttcttcatgttatgattcgtgttttttttttgcttgattcagttttgttacaagagtagagatttcaaatctcactattgcaattttaattttcttgtcatctttctttgtctcatccctcttctggaccttttttttctatcctgttttttatttggggctttctgctcctgtttgggcgacgtcacattgttttatgcactaatattaaagtctgctggatgttccatttcccttataaattgctcatggttatttttcccacttccctttactcagacatgaattattgtgaggtttgtttgtatttgacgtttgtcaacaacagactggtgtagatgcctttgctgcatttgttttttttttttttttttgggtacattctgtggtccaggctggagtgcagtggcacaattacagttcactatagtctcaaactcctatgctgaagtgatcctcctgtcttagccttctgagtagctgaaactatgggcatgagttgggactacaggtgtgaacaaccatgctaggttaagttttaatttttgtagagatagggtcttacttgttgcccaggctggtctcaaactcctgtgttcaagtaatccttttaccttggcctcccaaagtgttcggattacaggtgttagccactgcacccaaccgaatcttatttttatcgatatggatactttcaaattggagctcatgcctaagattggaaagttggtaatgcagaagctaagtatcttcta

SEQ ID NO: 55795 - DNA, 1033 bp, Homo sapiens
gtgtagttagctatgattgtgtccgtgcattccagcctgagagacagaggctctgcctctttaaaaaaaattaacttctggtttgggctgactccacatatttcttggataggaaaatcatattgctacttttattttccctagttgtgcaaattctgtcagaaaagtttattttcactgctattgaatttttgctagaactttattcctgttaaaacatggttgtaatgaagtctgcactggagttttattttcagattgggtattaggatttgtcattaaaaaaaaaatctccttcaaagggcattctttccaatgatctgtttttgaatttaatgtagtccagaaggaaggcatcattatatattagaaagaacattggactcagtgttaagagacaggggctttagtttcaccattgtccttggttgttgaagtatatttagatatgctattcaacttctctgtgcctcgatgttcttatttatgaaatgagggaattgattgaatctttaaagatttttttctagctcatgcatatgaaatacaagtaattttatgaagtagggaactgaagagtgtgcagtaatttagttcatacatctcaaatattacaaagataaaatgtattctaaaggaattagtgtcttttttgtatataaaaattagtttaaaatcactttggaaatgactaaaatttatttacataatattattatttacataatgaaatctataccgatttaaaatgtgaaaatgaacgaaatgacttttatacattcttgtttcttgttagttttaaagtatagtttattgagcatttgatatgccagcctgaatgtagtgggtatatttacaaaattgttttcaggtgtcatttcttgagcccagttatcaattacacgtcttcacctgttacctgagactttaggatagattctgtggaatacagtccttgactgaggcctcagaccctttgaaggctcttactactcctgtggcacaattttctttgatttaaggctataatttc

SEQ ID NO: 55796 - DNA, 1034 bp, Homo sapiens
tgtttaatgtatatatttatagtttttatatcttctaaattgacttccataagtattttagaatcaggttatgaagataccatccttatgctttcaagttttgctttagtgcttcctgttggtggtacctagtagggaaccagctgacaaaagaaagatgtaatttgcagagtctaagccccagcatcatgaagcatagacgacggaatttggaattatatagaagagtggatttggaattgaaaattttggtttacttactgatgctgtctggctgtctgaattttagcgtatgaactttgattaggtcttgataagcagtcagtggaacagcctatgagggacctcttccttgtagaattagaattgaatagccagcagctcacctcagacaaaatggatgcctgttgaaatgggccttttctcagtagatccctgcagaattttatgacttgtgcagtctgaggttttgccccaggtagatgagcaggagggcatctttccagtagtaacagagacaagctctcttcacctgtgctggaggatataccagttctcaaatcagacatgtgatagacttgccaagagaagaacctatataggtgagttccttgctaagttccaggtctcttcctagattcctgacagtgccttctatctgaatgtgtagtagtaattatggtctggttgactgccttcctgcattccaccctattctcatctacaccatattcagagtaacttggagtgttaatcatataggtaggatccttctctatttttcacggatgttgtgatggatcaaagttttatgttctgtattgtttgacttgccttagcaagaattgagggggtggggtgatgagttaaaggcatgtgcttaaattttattcccagaatacttttccatttgtattacaaataattacaggagaggaatcctggatacagacagtagacagcaactgtaacacatgcagaaaaggtatttattggaaggatgttagactgtaacacatgcagaaaaggtattt

SEQ ID NO: 55797 - DNA, 1043 bp, Homo sapiens
cctttttatacctgctctaaaagttactgttagatttaatatagctgttctcacttaaactttattgagttactttacacactgtaaaatttacccatgttaactgtacagttaggtgggagctatgcctcctgtacataggatgatgatttccaaatctgtgttttcagactttgacatctgaacctacgagctttgttgacttcttaaacttaacaggtctaaaatcatacacattcatctctttctcactccttccctttatcccaaatcaccctttctttctttgttcttggttcagttaatggcacccgtttctatccagtcagtattgtgaaaaatctattattgttaattaattccttttccttctcatgtttaatcacttgcctaaatttctagctttctaaggtctcttatattggtccttcttctctgtatctactttaaatacattttattaggcccttgtcattttttgcctgggaggactgctgtgacttcctgactccttttcctacttccagccttatatcccctccctttctactcccaccttgcctcaagtcaatcctgaggaggcattctttccaagatttaagtacaatcatgccattttcaagttgaagttctttagtgccttgcatttttccccaggctgcattgttagctcaattaatgattgagcttttgtcttctctagcttccttgctatagtatattgtgttacttcttctgtgtctttgtacactctgctatcttcgtctagaatgcccttattacttgatctgcatggcaaactcttattcttttaatttttatttgaagatcatgtatgtctttctctgtttccctatgtaaatctgctttcaagtcatatacttgtatggttaacaagtaactattcttttctatgtatatcttaccttttctatagctgtccgtggtatttattttctctttcacacattttgtgcttactttgtttatgtattcattagattgtgaactcctgtgggcaaatcatgtgccttatttttctc

SEQ ID NO: 55798 - DNA, 1022 bp, Homo sapiens
tgctaaaaagagtatgcagaaaaggaggactatgactaagtaagttcaagaagtgttgtgttaggcaactctattgcagaacttctcagggcttttaaaatgcccatgtgcgtggtgaagctctgtgaggggatatgggatgttttgtggcatatatgtcttgccccccacagggtggactctagaaaatggtgtgtaatacctgttcgtggaagctcactggtaggtgaagatgctttctgagtgataacatatgagctattgcaaacatggtcggggattccacatgccatttagcaataacttggggataatgtggtacgtggagatagaaatggaaagcttgttttcctggggcaatctccccatttgtcatcaggacagaaaattacccttgaaagagccagtcttccccatttgatgttgctcttctttggggcccatttccaggtcctctgtttttctgaatctgtgtgcctgcttgcacagtgagtgggtgagttggggaaattctcagctggaaatgtcagaatacccattgatagttactccatagaatctgaaatctggggacaattgagggccgtggtggtaactcatgatagcaagcactttccctctttctcttctgtcctgaaccatgttggccacttgacctcaggcttatagtctcttgattgcaagatggctctcttagctttaggcttcacaaatacatttgaagacaggaataggtggttgggtgggtttagacttagcaggtaaatgtccttttctcaactggctctgtccatttgttaatccgtaaaggaaaattcctggtagttcccttttttctctctggttgaaatagggttttatggctacccttagctgcaaggacagctgggaaagacttgattaacatagatggattatgatctgttctctggggttagtagtaccgtgtttttctgttggtaaaatgtggggctgggattggaagactcttgggtgtttctgccttggatatcttatataag

SEQ ID NO: 55799 - DNA, 1007 bp, Homo sapiens
actgttatctttgctcttagtctggaaattgtataaagagattataaacagagtttgatcttaggcatccagggttccttttctttctcattccagatctgaatgtgtctcactgataattctttccttttaatggcaaaagtagaaaacaagttcctgggtttaatggagaaacctttatgttttatatttaaaggttgacattcttaagtaggctcactgttacgttttatttccttcttttctcacagggaagaggaagaacgtctgagaaataaaattcgagctgatcatgagaaggccttggaagaagcaaaagaaaaattaagaaagtcaagagaggaaattcgagcagaaattcagacagagaaaaataaggtagtccaagaaatgaagataaaagagaacaagccactgccaccagtccctattcccaaccttgtaggaatacgtggtggagacccagaagataatgacataagagagaaaagggaaaaaattaaagaggtaataagctgagttttgtgatatggagtgtttatggatttgtatttggatacaaacaaatatatataatctatggtatcctgttttgatctgtttattcttgggtcatagttgtagtatagtttccaggttggtaataaggactagaactctttcttgtttttttttttaatgttaattataatgtaattattggacacttaaaatatttttgatacaacttttggatggttagtgccactcattctttgttcagagatcttttgaaattcagcgttttattaataatatatctgtatataacttattgtctaagcagtttcttaaatgttcagttacaaagggactctgctagatactatgcagatcacctcataaacatgcttctaaagagctagcattatatctccaattttttaaggaacatgtcatggtatccctcaactatactgtagattaagaacacattccttccaaaaagtctccatggattgaaaaat

SEQ ID NO: 55800 - DNA, 1078 bp, Homo sapiens
acaaaaaaaataaataaaataaattttaatttgaacacaaccatgtccatttacttagatattatctgggactgcttttatgctgtaacagcagagttagtttgttgatctctggtctaaggataggggattttctagctagggtgagttaattggtggtagaagcagagcctcttgattgacagctctgttatatgtgaggaaaggagagctgtccccaaaaagacttaacatttctcaaaaggaaagaatgccaaacaaatatgtacctcctgaagaaagaagacttttctattatgcccatttttttcctgtcatatagatgagattaaacatagttatgtatgttttcatactgatacaaatgctaattgaataatgtactaatatagatctggaagaatgggcaaggatatagtaatagaacccaaaattgtatgaaataaaaaaacagtttgtgaaaaatttaaattgatggattataatttttctcttttcagatgatgaaacatgcttgggataactataggacatatgggtggggacataatgaactcagacctattgcaaggaaaggacactcccctaacatatttggtaagtttactttttctaattactatttccattttctacctccatcttttaaaacaagatgtaacttttcaaagtactttctaaaatctgagtatttctgtggaactataatttgaagaaacaggtatgattttttgcaagtgtcagtcacgattaagttccagttgctttggagtacacatatatgtggtagattttctatttacatatggatgctttagtcatttatctgagtatttaaaagcttttttttggcatttttttctttagtgtcaggaaaagtaggcacctacttgtcatttttttcttcaacacaatacctattctgatattcacattacagaggaagaggggagggataggaaattcttgtagttctgtgtacattttttaaaaaagtgacatacctgggatgattgggttactgaattcagtgggttatgttgtacattcacagttcctaaggaaaaattaacaatgt

SEQ ID NO: 55801 - DNA, 1036 bp, Homo sapiens
tttattagagaaggtattctccctacagttgctcagagcaaattctgcttaattttaggatattctcaattctaaatttttgcatattaaaatgtttaaatatttcagaccagatatttttacaaatcccattcttttgctttcattcagaataccttccacaaatctgagatatttttacattgacttttatttgtaattattttaaataatcatccagtttagatgatacagaatcatagggcttctcaatttcattccattgaagtatacaatataaataaatctaattgaaaataggagctccatcaaaccattattcctacaaatgaagatacttcaacttaagcttacacattgagtgttttaatttcttcagttcattctttgcttttgtcggaatgcatttcaatatcagtgtgtttgcaagctttgtttctaataattgcagtttactgaaagctttactccattctttcaatacattgattaaatatattcgactgactttgaacaaaatgcaaaccaaaatatagaagactcattatcaaaacaatttaatatgattgtagaccacttagggtgatttactgtcaagagtttaccaaacatttttagaatctttccttttgctggtggtcaggtaagagaaacatacgttttgcttgcttgtttttgttttttggtattcattgcaaattttttgttactcaggttctctgagtatatacgtaaattttagtatccagaccttttattttgatcagttgagaaaaaaacataacatttgcatgaaatgatgatccggttattttttggcagctcatcatcattttatagttggaaattttgtcctcggcagcattatatcttgttcttagggattttcttatttttctgagttgctaggatatatgtaagtatcaaatttaatattttagattcttcctgtgacactatgtaaaaaatttaaaaaccttatttagaatttagtattttgaaaagtgttactttttgacttttggcgagatgttct

SEQ ID NO: 55802 - DNA, 1051 bp, Homo sapiens
agatatctattgtgggaacaatatttaaagttcaacagtttgttttacttcatttacttttttatctgttcaattcaaattaataacttttcaaaatacaatggcattttatgattcaattcctgtgaagttatttctgttcttatatttgaatatatatgtgttgactgtgtctagaatgatgtttaaaataactgatgtttcagatggtatttctaggtagtagcatgttgagatttaaaatggtttctatctgtgcagttttctctgtattatttttattattgcttgattttaaaataatgaacacatatcatcttataaaaatgagtcatttaagaaatagaaggcttccctgacttccccctgcccctccaacacacacacaaaggcagggaataggtgtagattctgagtaagaaaaaacacaaagcctacattaaaaccaagccttgatgacacttatttttattaattgcattcttaattttattttactcaggttatgcacattcggaaactacttcagaaaatggatcgtccaaatggtctttatccaaattatttgaaccccagaacagggcgctggggtcagtgtaagtattctagtatacctgaggctttcttaaaaaattatttgtctgaaaactctttgcttgatgttgtaaaaagtacactacgtggagttagaaaccctcagtgtctaaccttgtggtctgctggtgctgttcttaggcatgtttctgatctctcttagcttcagttttcccacttataaaatggaaatgttaataacatgtctcctaagagtattttatttcctgtattgctaaaatatagtgtggcagtttgaaggttgtacttaaaaactcttattaataaattatatcttcatgtaaataaaagcactgcttaggagagggaggtagaggaggagtatgaaaaacaaatgagtatttactagaaggggggcagttgttcttggataagccatgtctgttcattcattttagaagagggcatcctggccttcattatttaccagtctctg

SEQ ID NO: 55803 - DNA, 1007 bp, Homo sapiens
taatagagattgcaactttgccgctaataaaacatgattcagttatttttgagactaatgaaatcttaagtagtaaataagagacaaaagtaatgatcatttaattttagtattgaaaacactgctgattctgccagtaagaaaataagctggtgtgagtaccaagaataggaaaacatttgccctggaattgtctttttgttcctttctaggaaattgtcttttattttatgaaaggaaagcagataggtcaatataattatgtctttcatggatctgggaatagatctcaatcttctttgactctttttatacttacttttcctgtttcctgaaattatttacatatgactcatttttctctttattttgaagaagataaaagctctaatgcctagactgagtgggaatgatattttctggaaaaacaaaaccctgagagctgcatttctaaaatgtaaaaacgtagttttcttatttcagataagagtgactggattggatgtctacttagtaatttggatgaattctatcaatcataaatctttacccctgtgagttgtattgagatttgagaatattatgataatataatgatataataatgtatatgaaaaattatgttcagttcctgtcttagactatatgccagtgtatattctatatggtattactatttaaatgtaaaagatgaaatcataaaagtactaaaaaaagggttgaatatataatcaggaaagccttttctaagcatgtcatgtaaaacagaaactacaaaaaaaagatgtcagttttcctgtatattattgttaacctctgtattagtctgttctcatgctgctataaagaactgcctgagactgggtaatttataaaggatagaggtttaattgactcacagttccacagggctggggaagcctcagaaaacttacaatcatggcagaaggggaagcaaacacatccttcttcacatggtggcaggaaggagaagtgccaagcaaggc

SEQ ID NO: 55804 - DNA, 1618 bp, Homo sapiens
tagagcagtaggggacttaagacaaataacaaatatcttcttcaggaaataggaaagaacattaatgaaggagttataaaaaagttgacaggcagtgttgaggctcatgttgatggtgaaaacggtaaatttggaggtaatagtaaaacagactgacagctgggctgacccacagttgatgtttaactgtctgggtacaacaggagaacagtggagtaagggtcttgaatggttggacaagtgggattacctgttgcttcctttcgtattcaacctgactgcaaaggatccaaacttatttgagaatatatatatgtatacttttctctttctattttatctaacaaatcccaaaactcgtatcaacccagccacctacttttcccatttacatacagagtcaactaagcattgctggtgaaaataacagtacagattaaagttactataaacgtacaatttccagttttatgtggatcaccagtattccatgagttttttttttttactttgatcaatttactttcctattctttactctccttaagttttctatgtaacccctctatccatctccagctcttattttgaccatttctttattttcaagttcctaggcaattttagtttagatatatctttagtaaaaatagtatttatatagatttaaaaaatttcagtttgagagtctcagtgttttaaaaactgagtcaaaacaactaaattggtggaggttactgatagatttggactaattccaaatattctttggttttgtttatttttgaaaaactgctttattaagatacaatttacatataataaactgtacatatttaaaatgtacaacttggtgttttaaaataggtgtacacctatggaaatcatgatcacaatcaaaatagtgaacatatctatcaccccttttcctcatacccttacatgttccttctctcaacctcctcccttccccctcccccaaaacaactactgatctgctttctgtcattaaagcttgggttgccttttctagaatcttagataaatggcatcctttatttgtactctttatgtggcttctttcagcataattattttgagattgatctatgttgtgtatatcagtagttctgagtggaattccactgtatggaataccatagtttgtttatccattctcctgttgatggacatttaggttgtttctggtttggggctattacaaataaagctgctatgaacactgacttacacaccttcatatgttctcacttctctcggggaatacttaggaataggctgcttttatcaaatagtagatgtgtatgtttaacttttttaaggaactaccaagttgttttccagagtacatataccattttacattgctatcagtagtgtttctccatatacctgccaacacttgatatgatcagtcttttagttttagccattttattacattgtatttttttttcctttttttaaaaattatacttgaagttgtgaggtacatgccagaacgtggtttgttatgtaggtatacacgtgccatggtggtttgctgcacccatcaactcgtcatctacgttaggtatttctcctaatggtattcctc

SEQ ID NO: 55805 - DNA, 1054 bp, Homo sapiens
ttcaattttatattaggatccatgagaataaggattgttattttgcagattttgaccaaaaatcaaataatagacctaaaataattgaatttcatatagcatacattctaaaatatggtatatcatagttactataattaaatatttactccatgaaacagggaacagccattatatgccaagtattatgctagatgcttataggttaaagtatgaacaagatacattccctgcctttcagaaattcatagtgtaccagagtttgaaaggatttccttatatttctgattttaatgtttcataatgacattgctgatgctgattcttgttctgattgtcattttcacattgcaagttgatgaacccatgaccctctttgttatggtaaaccaaaaaatgattatttgatttgtgtcctgtattttcaagtcttctgttgtttttacttgtctttaatctcaatttagatcctttaattaaaaagtacaatcctagttttgctaactttccagcaggttattatatcctctgctgtgttttcttatagctgtgctataatttttggccaccatattttaaaatatccattcatttttccttagtagttattccagctaaatatatactgtaattatctacaactaaatcaattcataatctaagctctaaaatgtttccttatatgtgtgtattatggcaaaatgtctttaaaattaccttgcctttaaaaaaaacatccacacagtgtcattatctatatacttttattttagaccacaatggactgtatgatgtgcaaatgtctagtttgcatttgtttccaaaagattactagactctttttggtagaattagatttagcagtatgttgatacacattattctgagaaacattttatgttagaataacaggaatgtttataagtctattttaagaaaaccaaatgtggatcttttaaaatgactcattttgcactgagtgcaaacagcaacaataaaaataaacaacaaaaattacttcatattctgttctttcagggaagaaagaagtcct

SEQ ID NO: 55806 - DNA, 1029 bp, Homo sapiens
tagcatgttgtgggttattgtttgtccttggaagtgataaaattgcattaaaaattgttaattgaaactgacctccatcttgatttgttagaactaatggacctttattttgccagacagacccctcatttagaaaaaatagcctaaatttgatttctaagttaggaaaatataagatgtcttaaaaagattaaagagttttggagacagagaagttctataggaaacatcctgtttctcgtatgagttaatttttccagtatgagaatatttccttttgataatatattattcttaagccatcaaattttcatacaaatctttatgagcttttgactattgtccttcaaagttttgttgtccttcaaaacttgaaattctacggaattgcttattttgtctgatctctttcataggccattgaaaagtattgccgagttaatggtgggttttctggagtcaaagatgtatattcctctactcctacacatgatgatgtacagcagagcttttttcttgctgaaacattaaagtaagtatatagctttaaaaaatatttttatactagactggttttgctgtgtgatcactagatgatgaattacaactatgtgacaggttacactaaattttgttgtaaatatctttttatgtaattgggtgtgtaaatttttagctacatctcaaaaagaatgacttagactataaggtaggtattttatcaaaaaagtacttagtacctgttaaaattttttgttctttgctctttaatgtgcattaaaatcacctggaaggcttcgtaatacacaggtaactaggtccacactcacgaagtttcagtagatctggagtttagcttaaaaatttgcatttctaacaagctcccatgtgttactgataatgctggtcctggactcatacctgagctccctactgtagctaatgaaatctgttaggaatgatcatgcagttttgatagtactaaatgaccatagccactcatccacccgatgagccttactgtaaaga

SEQ ID NO: 55807 - DNA, 1075 bp, Homo sapiens
catttttgggagttgagggagcatattactttgacaaatgagacagaattttttatgttgctaaattataaaatgacttaaattggataactctataaaaatattgaactattaagtgaaccatatgaaattacccttttaaaaagggtaatttgaatattggcaatttagtatagttcaacctaatacataatggtaatggtaaatattttgaaaatatttattttgtttgaaacagtgatcttagggaagatacaaaaacactcaatctgatttactctttataaaaactgatggcataatattaaaatacaattgaataaagtcatttctgtgaagatctaaattaatgtagctgtagttttattgtaaaaatagagcttaaaactttatagaggaatgaagataagtatggtctcttaaatatttctcaaatatcagttaatttaaataggctttgtcagaagctgtcagtttaagattatgtattctcccaattggtgggaatttactgcggattcattaaaaggcaacaatcaatgtgttttagctaccagagatggaaactgattgtcacggcagtggcaaagttaaatgaaaaaacctgtattcttgacgtaagttgaggctcattttaccttttacatgtgtcataggtgctataccatggagtagttattgctataggcatacttttttccccagaagaggccatgtctcctactttttttgtttccctcaatagaccttacttcatggattaatatttatctagcatatatactgatggcataacaaaaactatgtaatgaggaaggtcagagatagattccttcaaaggttctaaaactcttatactctagtacaggaaataaaacacaagcaatatatacaacaaattttaaatacattaagtgcataagagaaatattaacaaaatgcagaagtcttttagagaagaaagagtttgcttaacctgaaaaacaagggaatacttcctggaagtagtagcatttgaaccagacttgaaggcaaggtgggtaaaataggatgaactggtattcagggtaatagc

SEQ ID NO: 55808 - DNA, 4905 bp, Homo sapiens
aaccaatattcctcctgaacatagatagaactaaacaagattttgacaaatcaactctaacaacaaattacatagataatatgttatgactaaatgggtttatcccaggtgtggagggttgatttaatgtttgaaaatcaatgaactaaaatagaccacctcagtagacagaaaaattatttggcaaaatccaacacccatttctgataaaaactctcagcaaactgggaatagaaggaaacttcttaccctgataagggcatatatgaaaaacctacagctaacatcatattgaaaaactgaatgtgttgctcttaagattaggaacaagacaaaggtgtctgctctcttcaccacacctggccggatttttttttaaactgttttatttcagtaggtctagttgttcatcttactggatttcttatacactattctgaaacctcttgtctttgtgtttagatcatttgggtgtctgaggtttatttctttgatgtttttcatcaaagctgctcaaaatacgttattggttttctgtgccattaaaagtgagctcacttcatgttcttgttgaattctaactgaagctcatttctcccctttttattttcagatatttgtatctgctgttctccggtgatgaccttttacctttagaccactgggtgtttaatacagaggctcaccctctgcctgtgttacatttagccaacaccacactttcaggtaatcctgctgttcgatgaaagcagttccagaaggaccattctcacctgtgttttgtttacatggaccactacagaaattagtttgaaggggcggcttttgaaaacctggacctctatgtcaacatgacagggtgaaactattccccctaagactgttcaacttgtagatacatcaactttgaaattattccattttatacctgaccaaaacatgttctgatatgtgtaggacagagacctggatgtgctttgatcgttaatgaggtggtcacatgagaaatgatacctgttactactgtattgtttttagagtcctgaagtctggaggctagacttcctgaaagcaagtcaagaatatagagcaccttgcaggagttcaagatggcctttggaaccaattatgtatttgtttcctcctacagtggagcagcattcaaatcaaatatttacatattgcttatcactttttctccattttaataatggaatgaactaaaataaacaagaacaaaagaatagtataattatatcagtaacaagaagactcaaaaaagaaacaggagtacctatccctatctgaattttcaagttccccattggatgaccagactggcaaccatttcaaatcccagtctatttcattgaaatttcttggttaagtttaattttctctgggggcatgatctcacaaagaatactcaagtctttttcttcttatggaatcatcgaaactgctatttatcataatcaccacttatgagcctgggtttgggattttgtgcatgtagttcagtctagtgttggtagcatgacagaaagtggggaaaatgccgcagtttgttgccttgaaacctaagagcaatccttggttttgttgctacattatttttccagaccaacacatctaccaagtaaattttattcactttaatttcataataaagttagtagagtcactcaacttacaactttatttatgtggcttggcaaaaatcactataaggcagctctaaatttgccttgataagctaaataaattacttttataacttactaaagcagaacaaacagtgaaactttctaaaatattctatctggaatagggacaggggatcttttatttataatctcatcagatgagtgagttgttcacagatattttatgtttttttaattttctccaagaatatttatagaattccaaagaatcagaatagtttcaaaataattttcagtgataaaagagtgttgtaattaatcatattacactaaaattgggatacatctaaggaactttatcttactatcagtaggttttgcattgatatttctttttaaataaactactagttctttatattttgacaaaaagaacttaaattttatcaggaactgtaagataaatatctagtgcttataaattttctgtccttaaatttatgtgacagtgcaagatacttttgctcttttcatttaatataggcatcttccattgacattaataaaacttagaaacagtataattagtataacatttactctgaatttgaagatttcctgaaacaaagtttgtacaagaagcccaccttggaattctgaaggcttattttcttgtttgataagcttttcttttaaacttaggttttaagttggggaaagacttaattaactaatatagtattttctaaggttgatcatcttataccacgaatcgttaattttgacagttctactgatccgtaaatgataaccactgcaaattttttcagtataaaatttttcactgcaaaaaaatttcagtagaaaataaggatgcagggccagttacaatagtccttaagagagttaaattatagcacatgttttgacattgtaatatcttttactacttgaacatttaaatttctaaatgagaaaggtatatatattactgtaactgtagaagggaaaagggaaagtatttggttctaaaaaatgttagccttcctcgtaaaagtagcacaagcccacttatgaatcactgagaaaaagtgaaaaacttgagttggcaaagatgcagagcagcagtgcagatggcaatgaactctctgaattctcttttaccttatttagaagaatgcagagtaaagggaccttcttggttctgcaggaacttctcaagggatgaggagacagaacccctacttccaagtgctctatttgtattacccagatgactgaagcttaagagaaggcagggaagtatacaagcagagccagttctggtacaaacaaagaatttgacagggacaatggaagggtcttcttcaccactccttaccttctatgtgatggaaagactagagcttataaaagtacttccatttttttattctcctgaataccaaaggcaattaaagtcagctacaaatgacttgccagtgtcatgttttatttttgttatagatttttaaattatttccttcaagatcaattcttatcccatataatgcttagcttccaagaatattctttactttcttctgtcttttacagctctttgcattttgtagaccttaatactcaggttaaatattcattgcatttataagatcttctgcaaaaagcccagaaatggtccttttcaggtgcctcttcaaagagctgacaccttaccttgtgcctttggcacaaatgtgcagaatagatacatcagttggtgcataatcgaaaaaaataggaattttgaacactgttcttccttctacatttatttctcttcattttagaatcacactttttatgttaaaccagattattattattattattattcaaccagtattaagttgttaaaaccaagggaatggggccctaaccaaaaagaagtctcaactcagaaaaataagtccccagtcaggtggttcttactttcttgtgggttgcacattttgtatctctctaacatcagcgtattcctgactttaagcaggtgtttatatgtaaaataaaacctgggtatcgaagggaaatgcattctttttatggagtattgaccctgatcctctatgatgtcatatagagcaactcagggctatacttgctagattttaaccaagcagtttgaaatattaatcatcatcctctcatcttctccactctccattgccaaagtctttgtcaaaactccaaatttgttgataaaagattgtgtttgccattctcatttataatgcagtttctccttaagcctggagttttttgaatgagtgcatgagtaaatgagagaatgtgtgaacgaacatttatgaagtatctaacatgtgccaagcattgtgcctggcactttcaatcattagaatgttttatgtgattccacagcattttctgtatgagagtagctcacaacattttaaatgtttccaatatgaatcgtgttacaaaattcttaattttatatttcatataaattaaagaggaaaaagaaaaggtttataatatattttaaaacaatgtgttactgtataatacaactataattgtagttaataactaaaacctcttgaaaatgtcaaagaaatacttgatttctgatgcaactttgactaaaatatttactttagaaataaaaacgttcttattttgctatatcactttaattgcataattaaaaagcagtgttttatagaaatgctggttattttatattcaaaaagattttgtcacataattcatgggtaaaacttgcagttgtaaattgtgtctgctctggtatgggccctattaatagtcccatgctgttaaatataaagaaaaatatactaaaatattcaaagttccaaataacagttcctagtaatagtattttgagttatttttctttaggtttccttatactcaaattggctaggtcctatcttttcctctctctctctctctctctctctctctctctctctctctatatatatatatatatatatatatatatgagagatatatgagatatatgagagatcaagatctatatatgtatataaatacaattatacacagataatttttaatactctttgttaacaaacacagttgaaaactggtttcggctgcacaaataagcagaatatttgagtaactatatatgatatggagatattttaatccatttatcctggctcaagaacactgataaagatga

SEQ ID NO: 55809 - DNA, 1034 bp, Homo sapiens
caggaaaactttatttacaaaagcagatggagggctggatttggtccatgggtcatagttagtgaccctgatcccaagtttattttgtgttagaccctctaacctttgatctgcgtcttttctgttttgatttacataattcatttttaaatcaaaaagatgtgcgtatatatggttgtgtgtatctgtataacctaaagctataatattttgttgtcttgaaagcagatacactcttcctggagtctgttcaggtttcaggacgattgactataatgaaagagacagaatagggtaagggaagatgggtatgctatcagccattttctttgccttgtcatttaatgccataatttcagattctctatgtaaaaagaaggtctgtgtattgtcaaaataatatactctccaagttctcctgctcattgacccttgaaccaggattctggattgctagagctgcagaaattcacccacttgggtactcttagagctctacagcaagaatatgatagaatgtctgatctttgtgctgcagaaagcaaacttttgaagaattctaagcaacagaaaatgggttatgtgactcatctgctatttggcagccactattccttttttagactgcagaacggtactgcccctgttacctctagaatagcctgagtctgaggagtgcagagaaaagatatatccaaaaggagaatccctttctcttgcataactctcaatcctttacaagtaagtagcattatttcagaatgtctatatgcatcattttcaactaaagcatacctcatccttaaacttccactatttaacagctaatccatttcaaacttggtttgagcctagcaattgcagaactcataaaattgcttgtgaaattacacaccatattactagcatatacattgcagtgctccaatcatgctaacagataatagatttttctttaagaattttatcaaatatttcactatttggggaaattttagaggaggggaagcctgtattcaggatgatagagggag

SEQ ID NO: 55810 - DNA, 1015 bp, Homo sapiens
tcactgcaagctccacttcctgggttcacgccattctcctgcctcagcctcccgagtagctgggactacaggcgcctgccactacgctcggctaattttttgtatttttttagtagagatgctgtttcaccatgttagccaggatggtctcggtctcctgacctcgtgatccacccgccttggcctcccaaagtgctgggattacaggcgtgagccaccacacccggcctggataatttttatcttttttgttttttgtagagatggagtctccctatgctgcccaggctggtctcacactcctgggctcaaattatgctcccaaagtgctgggattacagatgctagccactgcactcagcctgaaaatgcccacttttatactgagcatttggcaactcccaaactctgctcaacataatttaatctttagagatgaaaaaattactttttaatcttccaaagctttgctgtccttattatggataaccattatcattatttctgagaattcctaaatgggcatttctaatagttagaattcagggtaaaccagcttctacttcattgagcttaaagctctggaaagcatctaagaattatatctgtcccacacaaaaccagctggggaagctgggtagagagaagttcagagctgtgggttccagtcttggctctctgtaacttgctctatgtcttgggtaagctgcttctcctctctgagtttggggttcccattcgcacagcaagggtgttatccctaggtcccaaggcccttctggccttagtctgtatctcttgaggggtaggggattggccttcatggttccatggaatgacacttggtctttgttctagtttaacgggttagagggcagttagaactgcccttgctgccagtgatccagttcgaaatacgtttttatttgctttgcacagaacaaattccccagggcagccatccaagcagagcggggttggtggtaatggagaaagcctgagatgaggacatagt

SEQ ID NO: 55811 - DNA, 1081 bp, Homo sapiens
atttcaagttgtgtgtgtagcacttaatgctgacaccttggaaaaaaatcaaggcttttatgccctgcttccatctgaagatgtctgtgtcctgaccttgttaatatttccatttgcaaccacgtcagagtatacctttcaacacttgaacttgtgtggcatccctgctgtaatatctaggccagtgttttgattctgtttgctgttttgcggccacagcattagttcttccagcgttatctctccacccacacttgcccaagcatcctattttcaaaggtgggaaagagctttctgtttggagttgtcgttggtgggtgtctatggatggagcccagtgataaccattcagactgtgtgttggcttctcacttcttagtgggaagtgagaattcatggaggccccttaaacagcggagatcacagcctggttctgtggcctgcctgggtttcagtccagggctgctttccacagctcatgtgggaatctaaccacattttttgactctagtaaacatcattggtaaatggctggaggatgataataaccttaagaaaatagaatgagacgctggctgaatgcaatggagctgagagtgagaaaagaccaactgtggggtttgttgcgtcactgacttagaaatgttttctctgggcacagctttgtggcctggggcagttacttctttgaactcaggtagaatgtgttgcgggcatttaagtgggcaactgtaaaaataacatcttggaaaaatagtgagcataggatatattttattggccttttaaaaagtaaagcattattttatctgtttttattgcttcaggccattcataatctaagctgctattccatgtacatgaaacactcgagtgtctgttatctgtaactttcatgtgtttggggctgtggaggagtctccagaatgtggccccctccctatgtggggggtctggccctagggaggagctggcagacaaaagccttccttagactgcctccaaacccttcctagataacttctggccttcatcccccaaggaattcaaggagtaagagaggaggatttttttcagaagg

SEQ ID NO: 55812 - DNA, 1021 bp, Homo sapiens
accaatctgcgttgagcagctctgtcctgggcagtgggaaatgattagatcagacatcaaactttttctcagggaccttggtttaaccttctggcctagtttgttttttcctttcttttgctgctatctctgcaaacctctttttttttttttcccttcagtgtgtgtattctacctttactgcagtcagataatagaagaaaagggagtacgaaagtacctgagatagttggtcatcttgaattgtcaaaaacaaaccctgaattctcaaatctgcaggaacaaattatggtttccacctttccccatttctactgtataaatataatgaatctgtttctcaaacagtaaaagggaaatgaaacactttaatttgaatttactaggcttcaaattaatttgttctctattttgttaattctgctaactagaatttgcctttaaccagggcctttcatgaattgggaatgtgtgttccacgtgattcttttatatggggattatatcagtgttgatttaacgtggttaattaaaactaaaaactgttggactaagcactgatgtgttacctaaacactgagggcctatgacttggatgtattctagtaataccaatgtttgtctaagtaactttaaaatgtacttttggtatttgaaattgtttggacgagtgagggacaatgaagaatccctttctaataggcacaagtgacttattttatgctcttccaatgagctaagcacttagtatgaactcagcttaaatttgtgtcttcagtggcttaaactcctctctatgtaaatcatggtaaattgagaaagtgaaaaactacgccatggacttggcatttgtcatgtcccacactgtgcttttatacagactttttcccctagaatttaactccaatattcatatatgtatgagaagaagttgtcatggaagatgctaaccacaggcatattgtatttctgaaaaaagtgtttgttaaagtttttgcagctgtagccagcaaccaactta

SEQ ID NO: 55813 - DNA, 1044 bp, Homo sapiens
tttttttttttttcagtagagacagggtttcaccatgttggccagactggtctcaaactcctgacctcaagtgatcttcctgcctcggcctcccaaagtgttgggcttaccagtatgagccaccgtgcccatcctgtatttcctttttcaaaggaatacatctgcagtattttgagagtaattagcagagggttttttgagtatttttggtaggaaaaatagatgtagttttttaatcaaatttctgaaattgaaaatatcacttctttttaaagagggataagtatagtcactctagtagaaaaacatggcttgcctatttcctcttcttttctgtttgcttggatattgtttaatgaattcaaactgtaggtttagtcttgtctttataacagttaatggagaagtgataaaattaagtattcagcataaactaaagatcactctttgtatttccccgatacattgacagtatgtatgtatatagagtttaaattgcttaatatatgcacagaaatgattagaatttgaagtactatatagaggagagttacatggttctagtggcagtggattgattgtattaaggaccaaaagaactgcaggataatataaaaacaccttgaaaactggagttagttaggtttctttttctttttcttttttttttttaaagggccttactgtactttttttttttttttggtcacccaggctggagtgcaatggcacgatctcggctcactgtaatctctgtctcctgggttcaagagattctcctgtctcagcctccccagtaagtgagattatagacatgcaccaccatgcccggctaatttttgtatttttagtagagacggggtttcaccatgttggccaggctgctctcgaattcctgacctcaggtgatctgcccaccttggcttctcaaagtgccagattacaggcataagccactgtgcctggccaggtttctgattatagttttcttaagttgtaatcatcataattaacgtgcgctagagtgttttaactgtgctggca

SEQ ID NO: 55814 - DNA, 1015 bp, Homo sapiens
aagatttaaagggatgactttaaaagcgcctataaattgtctggcacataaaatattcaataagtggtattattcttaaaaaatattatgatcctattgcctttgtctgtcttatactctgagtgatactagttgaactacctaatggctgagggcctgcttagtgccagacatgtgctagacattttatatcactacctcaatgactgtaaatccctttttttcacatttccagttaaattggttctgttacttaaatgttcttctccttttttctttccacaggaaaacgggccttactatacatcatatcccccatcaccagatttgtgacctgccatctttcagtgcttcttggttcccaggatgccacttcctccacgaatagctacctgttgaagtgatattcattgttgctgtacagatccagagagccttttgtccccacctctctggtatttttttattgactgtatattttctggcacataagcaatctaaaaatggtaggccattctgaactgcacacattttaaatttgtatatttatatgaaatggaaatgttcatttttagattgttaatagaaattggggagcaacttttgagtatctttagtttcctgaaggacaccgaattctccattagataaaccaccaagactgttcacatcatctctctaacattgcacgcttcctttgtgtacttaagtgattctcgaaatatacagaaccaatgtatgctaaccagatgcattgtttgcttcagatccatggtgttaataccatgtatattttataaagataatttggctgtgttaaaagagaattacctgagtccaagaatgtggaaatgtatctgacaaaaaacatcaaaatcattagcaaaacataggacttagaatgttaatgtacaagttaagactaaagtttaaggactaaggttccttggattatatgacttgttaagattgccacagttccgatctcaacagtgtggggtgaaacaagaagact

SEQ ID NO: 55815 - DNA, 1172 bp, Homo sapiens
agaagtaccagaagttctccctcacctggtatggtatattaactgttctatagagcagcacttacgagcacaacatcctgtcattaccagatattaatgtaaattagtgagtcttaataaacttggtaatatcatttaacatactttccctatgataactttaggaaaaggatttgtcccaagagaggcattttctccagataaacgtttcagtgggagatctctctgctgtgagttcagaaccaattttcgtttgtattgtaagttttctaccatatttaaaacagatacctctgcctaattttcttaagattgaatggctttccatctacacagagccagaagaatttattggtgatcacttttagaattaattgcaaatcatgtggcctatctcagtagtctttaccctgctaaaagtttcatttatctaaaaggttgtataatgtttttaagagcatcatctgataatattattgttgttatttatagatgcgtttatggatctgttacataagcactagtcacaggactactcgtgaatttcatcaatttattctattgtgtttattcatgatatcaccttagtaatttttgaaaaaaaaaaagtaacacacttggccaaaagctcatcaagctgattgtttaactgttgctgattgcttatctttatattgtatgaaccaggggatagatttgaaagttatattaagtttgaaatgaattattcttccctaattattgtgcagtgtttatacagcaaaataaaaattctgcaacacaatttctctctaacatttctctaactttagctataatttttttccccttatgtgcagagtaaagtgtataatgtgatctaatggctaataaaatttcatatttggctgttatacagagaggatttgtaactggagcagctggatcatagatacaaaaattgttgaatataggaaagagaaaagagtacattagtttgtatttactgcagattgctggagtagaaaatgatcttagtgtttttcctttgaactctacatcactcatcttaatgcttaaaaaaatggatagcagaaaatgtgaaaggcactaagcaacatttttacactcaaaattttgaagacaattcatagctagtatctggatttatcatttattttctgggatagaaa

SEQ ID NO: 55816 - DNA, 1038 bp, Homo sapiens
acaaggattcagatctcattcatgaaagctttaccctcatgagcttatctaattctaattacccccaaagaccctacctcctaataccatcacattagggggtagggtttaacatatgaattttgagggaaccgaagcattcagttcataacagtgggcaacggttattgcctggtgggtcttgaagcatatgacagaatgggactcctgcctgttattttattggggaacttccccagttatctgtaggtcctttaggtttgggcctctcaatttcttggaaaggaatcctccaggagtgtaagcctagatgtctgttttgaaagccatttaggggcagagggctagacctttcactgttaagtataacactttaactaaatcccctcttttcagctgtgcctggggttctggaatccagaaactctctagttgagcatctccagagaataaacttcttccctgctgctctggtggtaaaaaaaaaaaaaaaatcatcaccttactgtgctggctgggggaggggttgttgcagatttgactgtttttatacaaacttttaactggacctcctctttttagcaccacatcccacttgacagcatagcctttacaagtacttagggctccaatttctgagcctttttagcattctctagtaataataacaataatttcttatgcatgtatgcactttgcatatagtaactcgtttaatcctgtgaagtaagtactactagtatccctcttaaataggaaattgggttgtaacaaggctaagcccctgcccagagtgtcttgacaggaactcaggatttgaatcaaagcagtctgtcttgtatccaacactgcttttcagtacagatcaacttgcttcgtattagttatctcatttctgcaagcaattaggtttgtctgctctgttgagtcagttactagtcagttgacattctaccttccaaaattttgatgatgcttatctgcttcatggtctttctcattctctttatctgtctctgtgcttatacctattgtatt

SEQ ID NO: 55817 - DNA, 1054 bp, Homo sapiens
ctagactgttctctgtgcctgctgcacagttactgttctggaacttttttttttaacatcatcctgggaaatccttttttctgtttggtggattggatctctcatttttgtgagtaaatctaccaggagattttaaagaagaatgcaatagggtaaaactactgagattttacttccaccttcgtacttaattggtaatttgcttagaaatagaattctagtttggaaatcattttctagaaatttgaaggcactactcctttgttttctactttgattagtgctgttgagaagtcttgtgctattcttatccctgattgtttgtatgttactggtttctttctggaaagcttctgatctcatctttgtttcttagtgctcttaaattttacagggatttgccttcatatggtttgggtgttttatgggctctttgaatctagaaactgatgtctttccatcctgggaaatttttttgttttatttcattaataatttccttccttctgtattctctgttctctctgaagaaatcctattagatgttgtattttcttgtttaattcttcagttttctcatctgttatctcttattttcaatttatttttgttttattttctggattccttcaagtttagttttaacccttctattgaacttttcatttctgctgtcatatttttcacttggctatagcagttacataagtgccatttcctgttctctgaatagtttgtttttatgacattctgattttaagttttttttcccctgtgttgtctatttcttgagcatgtgtttagtctccccttttagtttttgttagaggcttttctcactttctggtgatccttaagtgttagctggatttaagatggaagaactgaaaagttcatgggaaactttgtacacatgggtgtctaagtcatttcaggctgctataacaaagtatcctaggctgaatggcttaggaagaacagaaatttctggagactgaaatccaagatcagggtgccagcatagtcaagttctgctaagggctgtcttcctggc

SEQ ID NO: 55818 - DNA, 1927 bp, Homo sapiens
gaatgttcttgttatactgtatttattgttgacatatttgactacttcagttagtcttccaatctgaaaatcttttttaaaaaatgtctttctgatggcataaaatgattcttaagtatggtgttggatggtggcataaaatgattcttaagtatggtatgcacacatatcctcatgtactctgaactgttaaatattgaaatacaaagtcataaagaatggtaaacccggtaattaatggcggtcaagtgcatgcaccagctctctttgtactgttgttatccaggctggtctgatcaatgtaagcattttgaaagacaggtaaacaggttaaaagttaccatttttctctcttaaatgatatcattttctttctatccagaaaaaaagttttttttgagatggtgatccaaggtattatgcccaattttgcccagttttgaacaataaaatctgatctctctagccaatccaattattcatattaagcagtatttaaaggacttcttaaactaaaagatgacaggatttgaggaaaaaaaaaacaagttacagtgtaatgagagctgtttacactgcaccatttgaattataaaagatacatagtgggttatctttgtctttaggtcctcttcactaaagtactgaagatcatatggatatggaaatagatttgattcattatggaatcttctgtttgtcccatgtagactttttgatccttggaaattaatgtcttgcttcaagagcctttttttttttaactagggcttagtgtttgtttatgaacttattaaaagtacagagctgatcaactgattttcagtggacagtcttgctctcctttaatgttagcaaaaattctggctgtggctatagattactgggtgtaggagccttctcctcctccctttgtcacttaagcaatctgtttgcattctatcactgagattctaattcaaatttatttacaaatctacttgtatgagctcatatacaaatattctggggagtgaaaggatctgtatctttcatgtgattctcaaaggggcctgtgaccttgagaatgttaaaaaccactgttctctcagggatcaggtttttctgcctagcttgggtttgtggctccatttactgtatgtattactaaggtgtatatgtgtttaggggaaggagagattcaaacctctttttggtgagaaacatcaattctgtttagagatggagttgaaaaagaattcaacctctgttaaatactgtgacacttcataaaatgccattaaattttgtcctacaataagagctatgagcattacttttacttatttaacatccaatatcttgtgggtcacaattacttaaaagctaggaaaaggatccaacaaactctactgaccaggtatgatcagggatataggagaaccaccagggtataatgtcaaagaagataatagagttttgaggaggaaatgatcagtaataaatgtggataaaattggattaattcttggatttgacatttgggaagttattgttgaatagagtagttttcgtatagctgtagagcggaagcaaaactgcagtaggttgggcaaatgtacgaagaggaagtagagctacaaaacaaattactcttaaaaagtcaagtggtaaaaaggagtttagtattctgaagaagaaatgaagtagaagaaataaaggaggaaaacctttttgagaacaggaggattgagaggaaggaaaaagccaagatgtaattgtaaaaggagaatttatgttgtaacactctcttaagaggagaaatggtcaaatgaaggaaattgattaaattaaagtgatttggtgggcttaaacgtgtggaatataccctcaaatcgtcacttggaagttggaaacagtgaatgattttgagttggagggaagttaa

SEQ ID NO: 55819 - DNA, 2033 bp, Homo sapiens
taagcaccttggatttagaatcagatgtaattattcagtacttcacatcatattagaaggaattctatcacaccaataacctgcaacacttaaaaaagcttttcttccttatatgctcattatccttatttatttgagctcaggttagctttaggcttacagcttctggtaatactaatgttttagtttgtggcactcttaatcagatattcttggacctttgggtgtccatggatggccttcagaatatctgtgaacctttcccctcaaatatatatgtagaattttatgtttataaatatgtatattctgaaaagatctataactttttcttagacattcaaagaatttacatagaagaaaagcttgcagaccttaggtttagctgaatttcggtgtgtgctgggtccagcagccatttcgatgggagttacattagtaggctaggggttatcttttctttatttaaggagaaaatgtatctacctgtcttgcgatgcttttgcaattcctaatgccaatttgaattttttgttctataatatggtcaacctttcacctaaatacagaaaattttgaagttagtgaagagtggggtcattattttttcaccattgtcactaaacagtagtccttatgctatagaaagtttttggagatagtataataagtaatattttgtttgtatattatgtagtcagtttttaataagttctgatacctgccttgctactgaagaggtttgataagggagatcactgattagaagctgttattggccataagaaagatttctaagtcttcaggattaagagttacctcctgggccaggcacagtggttcatgcctataatcccagtactttgggaggctgagataggaagatcacttgagtccacacacacgtttgaggccagcctgggcaatatggcaagaacctgtctctacaaaaaatttaaaaattagtcaagcacagtggtgtgtgcctgtggtttcagctatttgggaggctgaggtgggaggatggcttgagcccaggagatcaaggctgcagtgagatgtgatcatgccattgcactccagcctgggcgacagagtaagactctgtctccgacaacaacaacaacaacaacaaaacaacaacaacaacaacaacatgcctcctggaacatactatttcagcttttattttctcatttttataaaacagattgaagacccggaagaaccagaccccaagaaaatcaaaggatcttctcctggaatacaagatactcttgaggcagaggatggtgcctttgagacggatgaagcccctgaggatgtaattcattttcatttcttaagtttaattgtgttgaataatgggaaagtaagaattgcagatttttagggaatcatcactttagggaatatttttgtcacttgcacttattagaattatgtttttttcagaagttcagcagaacttacatctaaccttcatctgctcttgcttcttctgtagcgaatcctttcatgcagaaaagctggttccataatgcgggaaggaagagacagagttgtaaaccttgcagtcgacaagacaggcaggattcttgcttgccatgtgagtaccatacttaggagaaaataacaaggactaggctgttccttccaaacactcattctttcatattcaatgtaaagatgactttttcttgactcatgttaataattcattatatggtactgtgtggacctataatctctagctttattagcataacaacaaaaatattaataattactattaggttggtggaaaagtaattgtggtttttgccatttaaaaagtaataattgcaattacttttgtaccagtattattattagcaaccatttattaaatgcttgctcttctaagcaatttaagagcatttaacttcttgttcagccttcagagcaatgctacaagtaggaaatggtatcctcattttacagatgagatagcaaacccagagagattaagttgtccaaggtaatgcaactac

SEQ ID NO: 55820 - DNA, 1061 bp, Homo sapiens
gttatatttcatatgttcaaaaaatcttgtggacagaaaattctgtcatactaagtagttataagagcattgctaggtgtcctgggcagtgatttcacacttggctatatattaggatcatctaggttgcttttaaaaatatagattactgagccctatacccagagagttgataggaccaggttgggcctgggaaatttttttgtgaaacaaatgccctggaatcttttcagtgaggagatacagagatctgactgaggcagtaagcttctgggggcttccttgcctccactatactgcagtattcttggcaagcacatggagggtctgtgtagtggacacaggtactcctgccaagctgtcttttgtgggttgtctttgaaaatacagatataaagcaatttaaaaatgtgtttaaagttatattttagacctacatgtaataaattatacccatattttatagacagacattaattatgtttttttgatgtttagttttttctgtcactgtatggacacaaactgcctgttatatgcatggacatctctcatgtaagtagtttaaatagtgtctcagtaatatgttgtcttttttacagcagatactttcttaattctggcttgatgtcttcatcttagattatttgtttttatcatcattctgttatatatctttctccaaaaacagtctcaaattaatatatattgtatcttatatatattactttaatgttttcagaataattttgcaaatatcatctcaatcaatccttataaatattatctctttccctcttgtagctctcccaaatagtactttattgtttaaaatactataattggtagagtacactaaaatatgaaagactttaaaaaggcattcctttttattctgaaggataatgctgctgaggagctcggatttatatttggatagttacggtattttacactatgtagacttttggtctcttgaccaaaatcatttatttcccaatacctagttttgattaggagtggcaatgtatattaaaaacaatgtctattctgcagagtga

SEQ ID NO: 55821 - DNA, 1938 bp, Homo sapiens
cactaacaaagttaagttacaatgttaaatgtatttctttttttttttttttttatgttgacaaccatttggaccacgcattgaaataggagagataagagaaatactgatagggaatgtgggctacataaacattctagtagagtctttctcagcttctcttctgtttctttctcccactttctttccaaatcccatgccagagattagaaaatctttttcctatctaacgaagtaaatagataaccctatgtcaaggcacagcactgccctgtgacagtacgaaagtatttaagccacagagttcgtgcttttacttaacaagctttttaagttcctctgtaggtaagagcaaagaattcagtgtttttagtagagatgaaaatcagttttttggcttcattttaatgtgtttgaaagaaatgggttaaatattctggttagctttttattcatatacggaattcaaaaatcaaggtagtgttttacttttatttctcataggatggagcactcatagcaactggctccgctgataggaatgtgaaaatctggggtttggactttggggactgccacaagtctctctttgcacatgatgacaggtatgtatagtcttttcaaatgtctccctttgagtcacctgtaagttatcactttccttgagcatctgtgtctatttttcagtgttctcaggcagtgatacaagttctaaaatatagtcagacaccctagaactagctagtcaaaagctatttatgtgtgtaaaactctttttactaacctggaatttgatgacattttaatatttctgtcacttttcagtgtgatgtacctacagtttgtacccaagtctcacctcttcttcactgccggaaaagatcataagattaaacagtgggatgcagacaaatttgaacacatacagactctggaggtaaccacatgccttctgtgcttgcttggtacttaagaaatacttttaagaatatttacattacccactaagtagtggtcaatgaatgaggtattctttattttttttttctcctccagggtcatcaccaggaaatatggtgtttggctgtaagccccagtggagactatgttgtatcatcgtcccatgacaaatctctgagactttgggagagaacaagggagcctcttattcttgaggaagaaagggagatggtaagaactttaggcttggttacaaatatgccagtaggtatctgacaggctgtcctagttgaagttttctgtctagtgcagttacacctgatgcattgccaagtccaagaaccttcaggagatcttttcaagaccattgtcacccatttcagaagctaggcagagataaagatgccattagggtattatgttgtcaaaggagcagcttctcgcttcctcatttctcttcatatagagaccatgtttttttctctcaaattaatgtatatctatctcatggcaggaaagagaagcagaatatgaggagagtgtggccaaagaagaccaaccagcagtaagtaaattttggggaccttgagattatgccccatatatagttatcttattgaaattgactataatgtccagaatttctaatagaattaaaattgaggctagaagttgcaggtatcaccagctgataaagaatctgtgtaattctttctcttcaactgtatatcctaattttgtggttcaagtgattgaccaaatttgctactgaataattattctgtcaattgagactttagggaattattttattcactgtagcacaaaaataaaaattagaaaatttggatattctctttttaaacatttgcaggatgttcttacaataatacatatgctaagttctgttactggtagctgataacactgttagtattttcataaaataataatagctgttctcatatggatgtaaga

SEQ ID NO: 55822 - DNA, 1408 bp, Homo sapiens
aagagagtacagtaagttacagtatcaataaagggaattcccaaggagaaaaaccattgttttgggatttattaactaagatcaggatatgcaataaatggaatagaatctttccaactcactatattagaagaaattgaggaagtgtgggaagaagggaacttggtcttaatgaaagcgaaggaaaggaaattacagattgaggtgattattgtcttgagtagaaacccacgttctatgttggtttgggaggcagggtaaccatttcagatttctagataaaatacattgtccaagctcattcatgagtactatagaaactaacaggtttgataattcttttacactctgtcagttttttagggtctcttttttcccttttcaaaattataaaatacagttaccactctgtctataacaagtgctacctaagtctcagtttttttaatgacttgatttaataatttcttcataggttccacttcccagcaaccccatcctaatggcttatggcagtatctcagtgagtaaaatgtctaacggttttcctttgtttattaaaaggttacttacaaggacaagaaaggaagtagaggcattatgatttggggatggattattgggaatactttgtcttcaaaagtctcttttgaatcttggcattctctaggatattttgtatttcaaaaggaccactttagtgtgacttcccaagccagcctttttggttggactggactggcattcttctgttttctagtgcctgtttatgttcagtgtccaaagccctctgaagattctgttaatctaaattaacttttgaatcagccttcagaaggaaagttgacagaaatcagtctgatgagataaagaagagagagaggggaagagtgatgggagaatgtatgtttatctagtaatctctaattagtattttattgcatgtctcatcacagtaattttgtgagtcagggtatcttcaccttatagataaggaatctggcttgacttgtagcatagttggtaaggggcagagttcagttgtcaacccagatctgactgactctaaactcatgcagatcttgccattttagaatactttttctgaagtaagaaggaggggttcctgttttataggagatagaaattagagaactttagtagaaaccaaccaagagtatcactaatggtattaatccttcctttatagccttcagcttatgtattagagatttttaaagggatcaagtcgaggtgagtgagtccttgcgcacaatttttgtaatctgtcagcaaacatttatgaagtgcttatctgaacgggaaataaatagaaattataattgatggttatcttataggtttaactatatcaaagttttgatggaaaataatttataatgttctt

SEQ ID NO: 55823 - DNA, 1029 bp, Homo sapiens
agcaaggcagagagctgggaaaacacaggacgtgtttgaaataccacaggtaaccactaacaataaagtgtgtgctttacacaatggttattcctcaaaacaaccaaaaaagtagtattcccatttatgtgaagaaattcagactcaagaatttacacagagcaatttgcctgagagcagtaagagtttagaaaagtaatgaagatatggtgttagaaatatgttaggaagagaatgtaaagggctttgaattccacacttcagagtttgggctctacatgaaggaagacacagaatgataaagtttatgtctcagaaaaactaatagattggagatgagagtagctggaagcttaaacagaccctatagatggtgttttcaatagttcagattcaaagtggttataggtagaactaggagaatagtgatgagaataaaaaggaagagacagattcaaaaagctcttggaagagggcaactgtgattgcatatctgagagaataatgggggaggattttaagttatgatgactgggagaaatggccaacttcagactgactgacaaatttagtagaatgaacttagtttttattgtttgtgatagggaggtttttttgtttgattgttttgttatgttagggtttggagagatatgaagagctcagtttttagacatgctgactgtgagattatggcagaacattaaagtagaaatgttcatcaagaagtcaaaaatacggactatatagctcagactgcaaagttggagatgtagactagggaattgtcagagcagaggcaatagcatgggagtagttataatatccatagctaatatgtgccaagagaacagaattctgtgggatacctaaaaggtccttgtttatgggacagaagaagagaaagagcctgatggtcagagaaggaacagccaaaggaataaagacagaatgagaacggggtggtgtcataagagtcaagttagagagaaggtcacaaaatggcaattcaagtccccaacatacaaa

SEQ ID NO: 55824 - DNA, 1063 bp, Homo sapiens
ttccagagtggcctttgaagagactgaataatcacttcgtcataatgttaagggagatgctagtgtgtggcagccatgaaaagttacacatacacacccacatacagacagacctacctatacatacgtgcacacacacatacatattcatacacaattcatacacatgcaatcatacatgcacactgactctgaactgggtgaactctgtggagggaggcccagaatgggtgctttcaccaagaatttgtctgtgtacaactctagatggagtgggccagcagtagctgccagtctttctcccctgcagcttcctctgcttctggaatgaaccatgtatcctggagaccctcccaatggatgagagtggaaagacatcagtacaactggacttggcttccggaaaaagattgcttttgaactttggctctcttcacttgtatgctatcattgatattcccagtggtgcccgtggaaagagggagaaagagaagctgaacaggagaaagacaaacagaaagaatagagaacaggaacgaggtggagagcaagactgacagagaaagtgtgagcaatgatgagaattttaattcaccaaggagacgtgtttttggtttgtccccccaaaccccgcccgccccactacaggttatggaaagaatcatggcattactgaggagtaaacctctctggcacactgagcatggtcagggcattggtcagagggacagagcaaggaatgcatcctgagcccacagctttgaccactgtgatccagaagagaggtgcactacgtgggaagtgctgattccacagcatgcagcctggtaggggaaggaaaataaaagggtgtgaagaaggaatagttttataatctcggaagatgataccaagagcagaggcaacaaatagaggcctggcctccaggtgccggatccagacacctgacctagaatgcctgcccgctatccctgtggcaggaaatatcccctcatgtcccagggaattgcagatgggtcttctatacccttctacctgcccttagatctccatttttatcaaa

SEQ ID NO: 55825 - DNA, 1049 bp, Homo sapiens
aagaaactgtaacctgcagagggtaagtgatgtgcctaaggttacctgggcagttagtgtggcagagttgtgagcagacccagatctcctgactctcaggtcactttaaggcctttttagcttcttgttctgataaatattaaaactccaaaggctccatttacagtctttattccagtctctgagaatggacatgatcctataaaaggagatcagcagagcctctggttcataatgattttgttttgggttagccctgctttattctaatctagctcttataattgtgttcccaatgtcttttatgtgatgcaacttcaatctcataccccaggctccactgctctgcacccccaggcctcaattttgacttggcactgtcttccattaccccatttcctctgtgattagggtcccgcgttggtgtcctgcatgtttggctggaagactaaaaatggcaaagtaggcaacagcctttgaataaaatacatatttaatgcatttccattaagaatgggaaaagctgagctagtggattttaatgctgacatcagaggtcttattagaaagtgaatttgatggtgagaaatggcaacgtgaatcttggaaggtttattgttatttttatacaaaggacttactaaggctcttacagagaaaacaaacaaaagagtttagtgttgtttttgatccttctggagtgtgtgtgtgtgtgtgtgtgagagactgtatgactgtgtatatgtccacaggtggaatcgcttagcataggtctgctgagttaagaggaaaaatggttctgtaaaaatcagccctatcttggacatttgaaggcacctcctgtatggcttgcatgtgacttaggcagactcatcttaaaagactctgtctcaatagtattcacgttttatttttcaggaggcagcacaggcacttccccaaccacctccagcactgggacaccatccccttcggcttcttctcatcttttatctccatcctgttctcctccaacttttcatctggcccccaacactttcaatgtgggc

SEQ ID NO: 55826 - DNA, 1041 bp, Homo sapiens
cttctagaatcttctcctgccagagatccttcattatatcaaaataattccatggaaagtacttgttgttggcgattcacactttatattatttgaaacctcagttacagatatgctgagaaggacagaaactgaggcccactggttcaagcccctgatttcacagctaatgagaatgaagaggtggcctgcattgctagtggtcatgagctggacagaggttaataggcctagaatcaggctcagggctctttccgacatggccagctgctgtcttccttctctcagtggtatttacaatgttagccttgtctcaaattgtggaataaaaatcattttacttttcttaaaggattttaagttgagtattagaaaggaggaaggagaagttttgaaatgtctctaaaatcagcagctatttatatctaaatacaattcttccttgaaggttcattggggggaattcttttgaaattctttcgttattagttaggctttgtcaaaatttacctctgaagaaactattataataacaacagccaaatttgtacttctatagccagcactactacctatgcccatggatgtaagatgaacgcttttttttttcctgctaaaaattaactttcggttcctctttgagggcatctgtctcttaattgacacatctgggacccctgtgtccttagcacactgtggatggtttctttgtattccagtgtctctggaatcctgcttttttttttttttttgagagttttgctcttgttgcccaggccagcgtgcaatggcactatcttggctcactgcagcctccgcctcctgggctcaagagattctcctgcctcagcctcccaagtagctggtattacaggcgcccaccaccacactcagctaatttttgtatttttagtagagacggggtttcaccatgtaggccaggctggttttgaactcctgacctcaagtgatccacctgccttggcctcccaaagtgctaggattacaggcatgagccagtgtgcccaacccctgctagtt

SEQ ID NO: 55827 - DNA, 1043 bp, Homo sapiens
aggtatgaacatggtgttttgtaaataaaatattccccaagatactgtttatttatgactcttttcaattctcctgttgtttttatttttttgtttgtttgttttttgggacagggtcttgctctgtcactcaggctggagttcagtggtgtgaacatggctcactgcagccctggcctcctgggatcaagccatcctcctgtgtcagctttctgactgtagctgggaccacaggcgggtatcaccatgcccacctaattgttttgatttttttttagagattgcctctcattttgttgcccaggctagtcttgaactcctgggctcaagcaattctcccacctcggcctcccaaagtgttggggttattagtagcattgttaaacctcctgtttctgctaacttccattttgtcacccaggttgaacacctggttgtcacaacatccagtctgtcactaatgtcttttgcttctactgacagaatattttcttctttctaatctgattgattttgcccttgttctgttcctgccttcccccaaccttgggttcttatgatagcttccaattaggtcacttggactgcaagcttaatgtctcacaagccatcctatacatcattgtaaagcccagtgataattgcaccatttctatgccaaaaattgtcaatgactcctcagtgcctagggagtcaagtgctggaccccgagtctttccaataatgtcctctgtggctaatgaccaactacatttctaggctcaatttctgttattcctcctcacacatctgcaagagtgtcgcaatctggtcagatttttactgttgcctgaactttgcagcatccttgcctttgtatgtccctttttcttttccaggaatgcccttcccttttgtttttatttgtcttgattccttctactcttcaaaaattcagtgaaaataccattccctaccacttcctttccttttttcagctgcaaatgagctctccccagttagaactgttaggggactgcactctctcgtgacctcatcacatt

SEQ ID NO: 55828 - DNA, 1045 bp, Homo sapiens
ggagctcttaaaatatcccagacacaaaataggatttgggaatccatgtctcaggggacatgaattagtgtgtttggctgagtgtgtgatgatataatggctctgctactgaaaggcctatagaatcaggctaggatatagatttgtcactcagcaacagctgtcatcttagataagtagttctacttttcagtgcttggagaagaccaaaaatagctgctacttagtcctaggtataaaattatgtgcttagacatgtaaaacctagttataaaactttatagttttttttttttgtgggtggggggcagagggggagggagaatgaagatagtgactacatcttcatgtagtgattatgggtaaactgaagtttttggtcagaaacttcccctttatttagaagtttgatttggttctttaacaacctgaatatcttcacaagtgacaggtgaggaattagggagatggagagaaatgacactttttcccctgtgggcactttattccctgtggctttgacacagctgttagatattcttgccagagatgctgcctggggttgcaagagaaaaaagtcagtgacaaaaggaaagaaaagtaaaggaacaatggggtgtatctttcacaggtctgcaaacctgctgcaggtaagtgaggttggcagcaacgtgattgggcattctgtcccattcttttccatcttactagtgtcaaggattgatgctcaagaagctctgacccttgacaccattgaaaagtcactcatcagagtacaacacttgtttccagcctttactcatgaatatatttaactccaaggaaagcaatcagaattctagatgttaagggtgggttagagaaatggattcttaggcttgacttgcagcatcatttgacctaagaaaattatactagataatctgaatttgaaaaatgttaggacacacaattcttggcattaagctcctaaaggtaaatatttaaaattccagtaaatcttcccgggtaaatctggctctagccttctccatcagtcagcttc

SEQ ID NO: 55829 - DNA, 1030 bp, Homo sapiens
accctgggcagtgtggatggaagtttagaggatgtgctggaggcaggccgaataccattttacattctaagggcctctgaatgtgcaatgagttttcttctagttctcctaggaattgggttgagggccaggcctagaggcacacagtagtgatatagagggtttccttcacttttttttgaggagccagtgtttctaagcccagaatgtctacttttgtgtttcttcagctgctgcccagcaggcccaggagaacctgctctgcacgatttgtgaaatcgctgctgggtgacagcccattaggtatcttcttctgttcatgggcctccagttttccctgaaagactgaatcaaaacctcaaagtcacaagattggttctattcttcttttcatcttaaagtgccaggtgcacctctgtgcctgagaagattgtgttggccccagtttctattctctaataggctgtgatattttttacttattcttcttttttacttataaattttaaaaaactcagataatttgtatacttttaaaaaatccaaacagcccaaaatgaacagtgagaagcataaagagcaatctcccatccctagtttccgagcttatcccaggataaccactcttaccagtttccttttgcatcattccacatacatgtatgatatattatatgagtccttatatacacatacacacatatgtatatatacaaacctttaaaatgaaaagagagattgtggcataatatatatagtactttagactttataattttagttttgagctgttatgttggagactgtcaaatagtcattcttgcaagttctccacttccccctcttttaaaagtctcatagaattccatcgtgtggatctttcataatgtttattgaacctattttgacgagccttcaggttgtttccagtcatttccttctttaaataagactccatgattatttttgggcattcttgtgatagcacttatagaataaattctagaagtagagtagagttgtacagttg

SEQ ID NO: 55830 - DNA, 1016 bp, Homo sapiens
gctattgtaatagttctaccagtatacaaacaaatgtcataactgagaatattcattactgtagctaagtcagaaaattactttttgttttaataggagggactatggctattgaaataacgtgagaggagtaagtaatgtctgattacaggctccctaagcaaatgaggcctgggatgtttttctggctgtggcaaatacagcttgttattttatagaggtcatggaaaatgaaactccttcagggttttaacactgacaacagaataccattctggaaatgaattaaattagaattaaatttaattttatgcaggttaactctgggagctatgctcaacatttgcaactcttaggatgatatttagacctgaatgaaacaccaaatcgaataaaacacaagtttaaaagtgaaacatttgggtaacctcttcttgtgtctacatggctttaaataactgctttgactattttatcttctacttgtccctttccttcacttaactgatggatttgatttgttgagttggcagatgaggtgctgtttgtacggaatatagctatctttgtcaggcatacagagaacataaaatcttagctcagtggtggcaaacacatcattttaaatcattttgtttgaaatattgcctaattatgctgctacttataggtcatttttatgatttttatatagcatttctaccactgtgaaatcttgacaattttagtccttcatttttgaaattattcacttagatgcttgactaagtgaaaacaatacaaagcaataaataaaaaataaagatttggtgaatctgcacgtgaaggtcaataatgtaggtgtctcgaggtcaacccttttctttttctcttgtggtactttgcttatacctctaacagaataccacagtgatggtattggagtacaattatttgtttacgtctgtcttcttcactagatctggtatttcctataggtcaggagtctgtctttatctctgtatgtctagttttca

SEQ ID NO: 55831 - DNA, 1043 bp, Homo sapiens
ttctaaatgttaatagccaacagactctaggaattgttgaatgacctagtgtcttctgggagaacgccactccaacatggttcttattctgtatcctctttagaaagggagtctgacccaggactcaacccaggaagggttgtacaagatgactcaccaagatctgattataggtcatgaaggacccaatttgatgcctctgaagaacaagaagtctcttcagatgctgaactgctttctgaggatatatattgtccataaagatttgaaagttcattattcattcatctgtatgctgatccttaaggcttacagaattctcttataggcttcccttcaggtctttcatggtccagaggccagaatcaacaactccagagaataaccccagaaggtcactgccttgacacccctataataatcacacagtttgagctctcctattttctgtttcacagtgaaatgggtcctattcagtgatggagaagatgggatgaacctgaaccataggctactgggagaggtctatcctttgagctcagtaggtacagggaatgagtccatttgtccacgatgctaaggaacatggtgcagataatctggggcaagagatctgactgctgtgccagttgctttttatgacttgcaagaaggtttttctaacccagatcttgttaacaatccatgctaggtgatgtattgattatgccatttgggctgttctatcttaggaaaaccccaaaacctactttctaatcccaaccatattaatacttttcaaagaagctgaagtgcctggtattcacgatggagatagaggcctggtgtctttatctccctcctccctcctcaaaaagagggtctaggtaaacagggaagctccctgtgcctggctctggggctcactgtagactgtaatccaagtttcacatcatatggttctctttagatgggaagtggggcaccaacaccctcttttggaagcccaaatcagaacaaaccctcaaactagtttccatgctgagaacttctgggtctttcct

SEQ ID NO: 55832 - DNA, 1073 bp, Homo sapiens
aataatgttatgaaaacaaaattattgtcttgactttctgctatttcctgcttccctttttcttcagattaattcacaacaatttagcctagattgttttagtttttatatgtgattatttataaacagcctaaaattttaggccatctgggtctatgcaaatcctaaaaggggaaataatttaagttacattggtagatagggtgaacagagattagttcaccaatattagaatcttagaatcgatgaggatttactgaaaccaagaatggggtgttatttttcacagtgggtagtaaaattacagtacttattaccctgtaaagggttatatggcctagaaataaaaacagttgagcatggattagatttatgagtgagaaagtcataaaattccaataagcatgagttaggaatgttcaaattatttctgaaaatgtctgacatcaatatcgtagaaggaaactaccacctttgctgtcaccacctcttattataatcttcagtgttcagaacactagtctagaccagaccagaccaatgtggtattcgttgtgggctggcaagtagactgtgtgagaataaagactcttgtacctaatgtgttttgtataaaacctgtgcacacttcagattagatagataataaaggtagagaagataagggagacaatggatgcaactcataaaagaaaataattatgatttgagattaaagacagtttgccattattcttactaacaagagacaaccgagataattgaaatctgaagataatctaaaacctaaataaaatattattattactatacacagcaaactaatctaatgtctttggcataggagccaaatactttggacagtgctaacatgatgaagaagaattagcaaattcaaaatctagccaaacttgggacttcagtgaatctataatagtttctttggcataatgaagacatggcagttagcattgccctacttcccccaaattatgtgactctttaaaaaaagggttgaatttccccacctgctgttagaaacacaaaagtctttctgcatagctgctaaaaat

SEQ ID NO: 55833 - DNA, 1760 bp, Homo sapiens
atcttctccaagtacttgtgatactctcttgtgtgtcctatgatattcttagccctcacttctccctccttgcctccttttcccctcccctctccttactttaatgctgttataattattcccccaaaagttcttcatttgtacacagagcagtccttagtttgctctcacatgcagcctttgatttctttcagttcaccctatcaagtgctgtgtgcccctgttactagttaaagggaataattgtgcatgtgacaattcttggtctctttctcttcaacacaaggactctgtctgtgttctctttgtgtgtcctccctatgtgatcgacattctcttttcagtctgtcaactggatgcatcttttgaaatgttttggctaggaagtcaatccctccctgagattgagctgaaaacaaattgcctattaatagcacttaacattttcaaaccaccccctttaagaagaacaacctggaggctttactgttaatcattttaagtcctcatatgttaactctcaacagttctgttatattggccaggcagggattatcttctttctctaggaaggaaactgggtttcagagctatagtgactttatccttagataggtaattcaacattatgacaaatgtttgtgtaggcactgaggaaatgcaatatgactacaatttagaggaggacacacagagataccagctagcaaatgctgggtgtgcctgggaatgagtaattcacaagaatgttcaaggaaggaatatgatcgatataggacaggagaaagggcttttcaattaaaaagtagggcacagaaacatgagcacatttagggaaaggcaaattcatacaatatgtggacaaaattagatggaaatattatgttgagtcacatgaaattgtaatatttgattactattttttaccaaaaacactggcagttccatgtggattcacctaatatactcagtgaacaagcatttgtggagtgcctgttttgcaggtacaatccaagtacgaagaattagaaatgagacacagtctctaccctcaggctccttgtctatgtagagatggacatggaaagccagtgagaggtcgaataggaattataaccaaagtcttctgagtcttgtccctctcctgtgcattagctatggcatttgctcttaattactgggaatgtggcctctagatgtcacaatcacttagtagtccttgaataaataaaatatttaatatttgatataaccatgttggctcaatggaatgcaaattcattttataatatgccctcctcacttctacccacctatgcacatagtaaagcaggcctacagtcgtccttttcttctaagtgtttctgaaaatcaaatgatatgactttatatgactctaggacaaaatggtctggttttacagatttccctttgtgggagtaatataaacatacaggctcttcctgggaagaaagccatgtcccatttcctatctgtaaatgcagtgctgaagaagtgctacgtgcttggcctttaccaccagatctccccacaccagcctgtcctgtagggaaacccattgcgaacaattgtcagttccaataaataggttgttcagcgagttccctgagtttgcagtagcctcccccaaaaagaggcttctgtaacgacttttttttgttttaatgagagactgcgtggcttattcagacatgagtgtgggaaccagccctggggagagaagtgttcccaccatgaac

SEQ ID NO: 55834 - DNA, 1572 bp, Homo sapiens
cagcctccacctcccaggttcaagcaattctcccacctcagcctccggagtagctggcattaaaggtgtaccaccacgcccaggtgatttttgtatttttagtagagacggggtttcaccatgttggccaggctggtcccaaactcctgatctcaggtgatccaccctcttcagcctcccaaagtgtcgggattacaggcacgagccaccacgcccggctgcagatcttttcttatatgtctttgcatttgtccatgtttgagtgcaaaaacatttttaatatcatttttttgtgcctagtagcacctagcatagtgatttacagtgtaggcacaaaataaatggatgatgatgactgtcagattgtagtttacaaaaatataactagctcccatagctatgataacatgggcataggattcatgggattctgcctcaaaagcaaatatgcttgttttcctttgttccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtcagcttctcagattagaactgagaaaactcttatgtgtagattatttgaggaaaaaatgttgaatggttcatacagcccctgctcgtgatttttaaaaagtgtttgaaggtgactttttcaaatgtgatttttttcagcttaatgttttacttgtatttatatcattaagtatcattatattgcaagagtatttttcagcttttcctccactgtattcggtaagtttatgatgcttcatataccaagaattgtgtttcattagtacttctagccctggaattgttttgctatgctgggttgctttcaaactgattactttgtgttgttgactaatctccttgtgatcaaggatagaagttagtgaccaatagttttatgtaattccaatgttgctttattagatgttctatttagaaggtctgttggatgattcccattgttcattctttttataatagtttttgagaagatttgatagcacaagttgggaaattggaagacaaagtcccagtgtgttgtgtctaagccaagaaaggcttcatagtaaagccaaaatatttgactcatatcttcactatggatgaatcagtttattcttggacaggccgatagtctggcctagagacaaggcaatcaagatacaccctagaaaaagatgaaaattctaactagatcatgccttcattatgtatctgctttaaccttaggacaaagcccagccaaggaatggtatgttatacatgctatggtacatgttaacatgcatgtatatatgcaaccttccttgattgtacatttctatcattatttttatatatgttttgttatacataaaacttaa

SEQ ID NO: 55835 - DNA, 1055 bp, Homo sapiens
tttaaaaatgtgccctaacatatgtaaattgtttcatatttttaaataaagttatagataaatacacttgagtcttaattttgatggctttatttaggggtaatatgaaggaaggaagaacaaattttttaccttttaatttatatagttctatgttatttgacttgttaccagaattatttgacaattttttaaaatctagtatggtgaagaggagtaaaaagatgacattatggcctgaagtttcagtacaaaaaagttaaagtacaaattctcctttaaaccacaggattccttttccagagcttctaaaggagatattgggtcagtggcatatgataattaaaatagtatattattaactactaggtatgggcctgatattcctatgtctagctcttgtaaacttgattaagcccaaagctcttgacccaaatccaaatgttgggatgtgaattaccacctatctgaggtaatgggtaccagagaccaacttgagctactgcatgagggaagagcaagttgaggaagccagacctggccctagcgtaggcttatagggataacagaaacggcaagactcctctggtgaaaaagaaacaaacaaaaaaccacaaaaaccaaaacaaccaaccaaccaacaaacaagcaaacaaacatggaccagtaatggtccttgaatctggtcaattcgatgagcaattctttgacacaagtggtaaacaagatcagataaataaagtaagctctcttgttctcttttccgtgaatattacctgttgtagcagaaaaaaaagtagaaaactgctgctttagatccccatttattgagaataaaaaatgaggaaccaacaaagacaaaattagagaaatcagagtgtaaaatacaaacaacgcagtgtagcttcatgaaagtgagaggggagtgttttataggatgataataaacagtgtcagttgatagattcaaagagatcattgaagagcagcaagacaaaaacagcctattggattaaaggattaggaatcattttttgtttttattttagaagagc

SEQ ID NO: 55836 - DNA, 1044 bp, Homo sapiens
gctttggccttcctaaatagtgggttaaaagttatttgtttccttttatagcattacatatttttcacatgtctaaattgaagacacacactttttaataaccagaaaaacgttttgaaatcataaatctttatacagatctttagtcattaatatcatttgtgatattttaggattctgaggaagatacttgtcccacaatgctgttattaaaatggccttagaaaaggactactaaaaatttatggccacttttcctgtatgtatcttctttttctcttgaaaagcttcctttgaagtcaaagggattttgtgaacagatgcagaaatatgtgaaagaggcattggattcttaaaccagatgcattagacatttttatgatatctcataacctttgtagaaaaaaattattttgcaagagtatagtataatgggaaaaaatgtatatttatcatatgaatggttccatcaaaaaccaagaaatagccaagttagtttttattagccttggctgtgcacttactcccttaggtgtaaagcaaaagtgaatgagccataacagtgctatgttagaaactctaactaataaagtgttgtgattcctaagttgttttaatggtttttagtgttttctttttttaaaacaaaatcttgggtaaaaatgttggcatagggcatctttgcttatctcagaggatgcagatgtaaactcaagttgaaaataaaacagggagaaacaggaataacagcacatcactccatactcattatgggatgtctacaatttatatgaaaacggtttattttgccaggtgttgcctgacagaaaactgttgaaatctgacaagatgagcgtagtcataaagtcagaggagttaagatctgacatgttctgtttaaatgttgatggtattaggtaaatttaagcctgtcatcattggccaaacacagaatccatacttctttaagcactaagtcatgattgtattgtgcaaagagtgaaatattgatggttagtagatttttgcaaaagtatttgttat

SEQ ID NO: 55837 - DNA, 1034 bp, Homo sapiens
aatcccttctcatttaagaggggaaatggagctatagtagtcgaaagagaccctcaagttaaaagagatcccaaattgttcagaatcaggccacgagatttggtaacagcaaatcaccttgtgtgtcctctggcatgtgattaggacagaaagcttttggttaggccactgactgcacaggttttgatggcacaggaagataataagttggctattgtgtgaaagggaggcaacaggatctgggcttgtgcccttgtcaccttctgtatgaagccaggaggatggagcttgatgacatcgcctaacaatacccacatgcacatctctgtcatccttaaatcactgagtcttggactttagggtctccttgttccagtccacaagggaaccaacccactccatggttttctgctgggcttcctcccagctgtaaattggcttatacgccagatctcgctgagccttcttgtaagagaaggtgaccatgctgttggacaatgtcactgtgtggcagttgaagggaggtcaataggtataaattgacctgagcaggaagctcactatttccagcaggaagccaattcagtacctcagggctaaaggaagcctccatctggaatcaaggcagaggccgaactctttgctcagggcgtaattaaggttatcatagctttggtgaggcgtgtcatctgagatgtagtagaactgtcctcagacacttgggaccttcttggggccccacagggcctcaaggccagaatgtgggcccagcccacatagactgggttggttgtggagaactttccaacagttgacaggatcgcattgtttttcaaggccttatttatattgtcagtaagaaatgggcttccttccccatagatatgcattgagcttaaggcacaagtgtacaacatgccagcatttttcagagtccacacattagccaccagcacagccttctcagcaagtttttgctgtatggatatggagcagaccatgtgttttccagatgctcttgtttgtgtcgattc

SEQ ID NO: 55838 - DNA, 1071 bp, Homo sapiens
aaccttctccatcacctgacaattgcctaaaaccccatgatgtgctggcgtgaatggaactgaatccgtgttactgggcatgcagatttccagttttgcactaacataatgcattttaaaacaaatttgagtagttgttgtgccatgaatggtatctgggtgacaggaacttcaagctcttttcagagcacacctaatcctccctcccctagtctaaatgaaaataaggatcaggaactactcccttcggagctcagaacctgccttaattctgaggcagcactgtgaacttttcatacgtcagccctaagtggggaactcactctggttctcccctctccctgccttcaaatctagaaaaaccatgtttccacgtttaatatctgatgtctcggttcccaataaatcacaaatcagaaagttctgttgttccattattgctatgtctgaggtgccccataagaagcctgtccataaaagggcttagaggggaagccctgctccctgtttcccagatcggactcctaaatcctgtccttcaggatggagtgctgcaatcccttttatgccatgctgggcactgtacctctgctattttagttttatgagattctgatgacatgcttatttgactttattgacacagaaccctcctgctggtctcaagattggtagaaaccattgattaatcccctcttaactccccccgccccccgccccgccaacgcctgcactgttttccactactagcaaatcaataggtcatgtttaatgacactactcttgcctagccactttcaggtgtattatatatgcagactcaagggatgtatttgtccattgcgtctgagctccaaagaggcaagagtgatgggcagaagtgatttggggtcagtagtcatggagtatacctcttaaaaggtttacagctttaatgagatttttctcctactgtcttagacaagaaatctccaaatgttggaaacttggtgctttaaacagtatacgttctaaaggaattcaaccgcatttcaggacctgttgactgaccaacctcagacacagccatat

SEQ ID NO: 55839 - DNA, 1113 bp, Homo sapiens
ttctccccacctgtgactctttttcttgttattttttttagtatatgagctttccccatcttttccttttttagggggggatgtgtgccagatttaatttaatataaaactagtttactccagaactgagaaaccaaaatgtgaaattaactggaagacacactccccttttaccaccccccttataacaataagcatcagttgaatttaaccagactgcagccacagcctacactagtctggggggcagttgccacaggacatcttttgtttctgtttctctacttcctaatatgtgcttgtgtttattgattgaataggtggtgtggtaagtattcctggtcaacacttcctgtatggcatgtaatctttactaactttcttaagagccttcatttgtttcccagcctaattctggacctttagggaaagggttttctaggctgatgattctatgtaggtgagaagagaaatcaagaaatccatgcctttcttgttgtagtaagaaaaacaaaacaaaacatgaaactcttgaaaactgccagagaataaaactttagtctgaatagccactcttaatgttaaatgcaaatctccccggtatttgaatgcactccctgccctgccttacccagcaacttctttagtctcataattactttgaagattaaatgttggtctttcttcattcgtcatttaatttctgtgactgctagtcccaattttccttgggtgggagagaagtagttgtcctgtcatagtgggacagtctggtagcattccccacaatgaacataaacagcactgtgccacctctgtttgcacagctgaatcaagggttaaacccttggagtggagggaggacccacacaggggcatttgatacaaacaaagcatgctggcatttgggccaagagatgtagaattcttttttgagaatggtctgcctaacttttgaggctaattgccatttcctgtcatggctacctatttagcagggtaattaagcatgtttggctcctggtgctaacaggttattggatccagttgggagagttaggttgtctctatgactctaccttacctgatgtgattttgccaaatcactagatt

SEQ ID NO: 55840 - DNA, 1047 bp, Homo sapiens
tccacgattttcctttttcctaaccgcctcccccaaccgcccccgccctgcctcccccacaggagtgaatcacccaccccttactacatgaaccctgggctgaattgaagttggtgatgtatccctgtccttgtagtgggcatgtttgtccttaacctgtaggatgacaccaatactccgcatcccctactgcgttaccctcctccctcaagactgagcgtctggtaaatgcggttggataatggctagcgagttaaatgtctttgagtagctgtggtggatgagtgggcaactttgaatacagtccaagtgtgactgttgtaactgaactcagcatgcctaaggggccacactcactatctctcctttctcccctcacctgattttttgttgatgcccccaactgtttaccttcttctctcaacaagccaacatgtggatattatttaatgtggaatacgtttgaggaaccaaatgaacctttaagaatgccacttatatggccaggcaggagtatgcaaggctcatggtcgaaagaatgatgctgtaggacatggagagagccctgagcctgatataaatggctttcgaggtgaaacaaaacatttcttccttagcttctttgggagagatgaggcatttgaactgagataaagaatggaatcgagaaaaaaaaccgagttgtttaggatgaggccatgaggataatgaagtgaagggaagaggctctgtgaatttagatgatttctagttagaacatattggccgtgtgtgtgtgtgtgtgtgtgtgtgtgtgtgtgtgtgtgtgttggaagtgggggttgttgttaagggaaagttgatgtcaaaagttcagccatgcccaacagagaataagatggcatcctattgaacaagatcataaatatgaagtcaggctgccctttacattacacaaaggaacacatagatggcttttcagaactactgggatagaggggtaaatggatgctagtcagacagaagaaccggctggattgatgcggctggattgaagtggtaaatagt

SEQ ID NO: 55841 - DNA, 1056 bp, Homo sapiens
atccataatgaggggttgttccatgaagtcaggaatcagctgggtggatgctgggagtctggtgctgaaacttggagaacattttaaaggcgctgaaaactcttggcaggagaggaggagtgtttgttggctaacttgactgctgggcatttttggactgtttgggagggctcagctttcttgtctgtctttgcaacacatttggttcagaatgccaattaatctccttggtcagcccactgaagggtcctcatttctacactatgcctttttattctgcatgaagaggtgtctggcatagtgtctcctgccctcccccactgaagtctctttaatgctgaaggaagcttcggcagcgttgctagaaccgggcctggccttggttcccactgccttgtattctgggcaggcggtctcctctcactcaccccctggtcaggaagtacaatcattcctccctgccctttcagtggtgcttttcagacttggagcaagtcatagttcagtttaaggggtcatgacgagcattttaaaaaacaaagtaggaaatatcagacagcaatgcagatagatagtaaggttgtaagtattgtttcatgaattttgtttcatttatgttgtgtagttgtatgtgtgtggcatgtgagtatgaaattacaacttaaaaatgtgtttcttggccgggcgcggtggctcacgcctgtaatcccaacactttgggaggggccaaaggaggcagatcatttgaactgaggaggttgagaccagactgggcaacatggcaaaaccctgtctctacaaaaaatacgaacattagctaagcatcttgcacaagcctgtagtctcagctactgggggatggggtggagggctgaggccctggttgctgtcactcttcccaacctggtgctctagtgggaggatcgcttgagcctaggagtttgaggctgcagtaagccatgatctcgccactgcaatccagcctgggcaacagagctagaccctgtcccacccctccaccaacaaagatgtgtttcttacaatgaacctcagtca

SEQ ID NO: 55842 - DNA, 1087 bp, Homo sapiens
cttggggatctgacttagctcacgtatagtggctatgatgaattcagtgtcttattttttgcatatgtatatttttagtctaatattgcctgggtgtctgagcaagtctagatgaatttaattgctctcatttttcccctgcccctcttcctttggtctctcttttaggaaatgtttttctttcaacattcgtttcattcattatttactcattcggccaaccaacatttattgagtgccttccctgtatcagggacaggggcttacaaagtagaatttgatcccacctctgccctcagtagctcagtgtctaatggaggtagtgatgttcattaagcgtcgccagatactgtgctaggtgctgtgcctgttctctctcgcttgttcctcacacacttgagaaggccgaagctgattcatagcttggaaggcaggggccttggatttgaacccaggcctgaccaatggcagaacctatcagatgtgtggacagatgacattgcctttctttctttggatatatcaaaatcagccagcaggcaggaactcccattttgagcaagcaatgtgcaggaatgatagggtatacagagaggaacaggagatggcccctgacttccagcatgtgtctgatggacatccaggctgcaggcatcatggtgctgtctagagagatgagccaggtgcccagagcccatgggccaatgctgccctttcttgagcatgccaaacaaagcggttggtgtgttagaggcacagtctcctccactctaagtaaaaatcagcatgagtcctagcccacatttccctagtgagtataccaaagatatctatgaactggcagtcatcagtgacttcctaaggttccggaaatgcatctcttactcaggagtaagcaatgatgtgcctgcggctttacgagttctcacagaatgactttctggacccaaatgttttttctgcttcaggactgtgaaggccttattgttcgctctgccaccaaggtgaccgctgatgtcatcaacgcagctgagaaactccaggtggtgggcagggctggcacaggtgtggacaatgtggatctgga

SEQ ID NO: 55843 - DNA, 1807 bp, Homo sapiens
tttttgcacgctcgctcactctgaggtttttggcatcaggttaaaggcctacatttaagtactcaggaggctggccgtgctggggttgactttgctggctttgaatctgttcaagtgcctccagttgggtgatctggggagaactgtttaacctccagtgcctccctccgtgcagctgtgaatgttagaggagttaatgtgtgtctaaacatttcttttaggatgtctaaaataaagtgctccttaaacattgtttctcaaatcttccttttttgcctccagagatgtgttgatgacccatgcccacaggacatatatcgccctttgacctctaatgttgccctaattgccacttcctctgtctcctccagaaaacacagatgtagactcagacttccatctggactaataggaggagacaggctgtgaagagtgtgtgtgtgtgtgtgtgtgtgtgtgtgtgtgtgtgtgtgtgtgttggtggtggtgggacaggaaggtggtgcggatgtttaaaaatgttgggaccacgcattcaggacagaatggaagtgtctgggctttggcatccacccacccactctagggtccagactagtctaagaccctcggggttaagaaactctcaaggaagcataggtaattaggtgtcctcttcataatagtagaagacgtcataggttatggtgctggatgagataggtagatcaaaataattccttgagcttctggagtactcgatgtcatcagagttgcccagtaccccactcagttatccctacagaccctggaggattggcgatcgcttaaagtaaaaaactcactctggttgatgcctcagtggctgaggtggaatccatacctcctcccagatgcctggctggtcacagaaatcccaggctttctaagtcagatcttgccaagggtttctctcttctgttttccctttatcccccatcagtgttcctaaacctgaacccccagacccagttcttggggaagtggctgtcatgggcagtgactgtgcaaacctgatgttgcatctccttcctgggctggcgggagtccgaatggaccctctgaacctgtgtctatccttgcaggcagattccccaggcgacggcttcgatgaaggacggcaaatgggagcggaagaaggtgagcagcggccttgactcgccccacctgggctcagggcccggggtccactcatgttgctgacttcagcttctttccttttgcctgtttggttgcagttcatgggaacagagctgaatggaaagaccctgggaattcttggcctgggcaggattgggagagaggtagctacccggatgcagtcctttgggatgaaggtaagatgttgctggaaccctgtgatgtgggactttctgcagcaattttgggaaaggcagcatgtctgggcagaagccagaagctttgttctaggagggtctgaccctctcttggagcccccatctaaataagtgttaaagtcaaggagggagagaacactggcctgctgatctggactcaaaagctggaaatacttggtgggggtcctttagctctctggtgagtgaatagccctgagtcccagtgaaccaggtgttgatggctcttttgagactttggttcctgtcttcttagtttaaaagaatttaaacaagagacacggtgcagcattgaggagtttattgcaaaggaaaaagaatattttgaaagttaagtgcagagtagacagtacacctcgggagagagagaattcagggtgggctgctcataagagtgaggcagtgttggccgg

SEQ ID NO: 55844 - DNA, 1012 bp, Homo sapiens
ccctcctgcctccactccccatcttatttatttaagtcagccagatatctttcctaagcctctgcactgagaagggccaggtgtattcttgatccctggactcctgagagaggcagatgtagcccagcaggatcattgatcatgtaaacaaaccacagccttgccctctgtgcagggatggtgggatgccataagccacaaagagcactccctcctccatcctcttttgtaagggatcaagggtcaaggtttagtccatggagaattttgatataaaaggcagaggtcaggagttaagtaaaactaagagcactcatagccaaataggtgagcatttcattgatgaagcagtaactgggagacaggctccagaccagtggccgttccaaggctcctgcccccttccccagggggtcctcttccccatgactccccttccccaggcttccttctccgtggcaccactacacatcaatattcctggcaatattcttcatcatggagacttcggcagcgacttcaaccagatgaaaagccccacctcattcctgaatgattgaggtgctaggtaagcttgtctgtccatctggcactgcccaactctctaccctgggatgcttccaagaggtgcatgggtacctgggaccttgagcatcagtgtcaggaaatggctgacacctctcgtgcatgtgtttgattgaaagagatgtctacggcctgctcatttcagtgttaatctgtgcctcagagcaggtcacccactgaatgttttattcccattcccagcatggtgtggagggtgccagtgccttcactttgcatttcttctgtccagatgtctctggagggtcattcttaactgtcttgcttccagaacatgctctttgtaaacccctgaaacatggcttggatcattccgtctcccacctcagcccctccggagctgcctggacctcatcattccggagagtctaagtggcctcttctcgtgctcagctgcttacctcaacca

SEQ ID NO: 55845 - DNA, 3261 bp, Homo sapiens
ccatgagaagattctacactagcgtcctgttgggaattatgccctggaattctgcctgaattgacctacgcatctcctcctccttggacattcttttgtcttcatttggtgcttttggttttgcacctctccgtgattgtagccctaccagcatgttatagggcaagacctttgtgcttttgatcattctggcccatgaaagcaactttggtctcctttcccctcctgtcttcccggtatcccttggagtctcacaaggtttactttggtatggttctcagcacaaacctttcaagtatgttgtttctttggaaaatggacatactgtattgtgttctcctgcatatatcattcctggagagagaaggggagaagaatacttttcttcaacaaattttgggggcaggagatcccttcaagaggctgcaccttaatttttcttgtctgtgtgcaggtcttcatataaactttaccaggaagaagggtgtgagtttgttgtttttctgtgtatgggcctggtcagtgtaaagttttatccttgatagtctagttactatgaccctccccacttttttaaaaccagaaaaaggtttggaatgttggaatgaccaagagacaagttaactcgtgcaagagccagttacccacccacaggtccccctacttcctgccaagcattccattgactgcctgtatggaacacatttgtcccagatctgagcattctaggcctgtttcactcactcacccagcatatgaaactagtcttaactgttgagcctttcctttcatatccacagaagacactgtctcaaatgttgtacccttgccatttaggactgaactttccttagcccaagggacccagtgacagttgtcttccgtttgtcagatgatcagtctctactgattatcttgctgcttaaaggcctgctcaccaatctttctttcacaccgtgtggtccgtgttactggtatacccagtatgttctcactgaagacatggactttatatgttcaagtgcaggaattggaaagttggacttgttttctatgatccaaaacagccctataagaaggttggaaaaggaggaactatatagcagcctttgctattttctgctaccatttcttttcctctgaagcggccatgacattccctttggcaactaacgtagaaactcaacagaacattttcctttcctagagtcaccttttagatgataatggacaactatagacttgctcattgttcagactgattgcccctcacctgaatccactctctgtattcatgctcttggcaatttctttgactttcttttaagggcagaagcattttagttaattgtagataaagaatagttttcttcctcttctccttgggccagttaataattggtccatggctacactgcaacttccgtccagtgctgtgatgcccatgacacctgcaaaataagttctgcctgggcattttgtagatattaacaggtgaattcccgactcttttggtttgaatgacagttctcattccttctatggctgcaagtatgcatcagtgcttcccacttacctgatttgtctgtcggtggccccatatggaaaccctgcgtgtctgttggcataatagtttacaaatggttttttcagtcctatccaaatttattgaaccaacaaaaataattacttctgccctgagataagcagattaagtttgttcattctctgctttattctctccatgtggcaacattctgtcagcctctttcatagtgtgcaaacattttatcattctaaatggtgactctctgcccttggacccatttattattcacagatggggagaacctatctgcatggacctctgtggaccacagcgtacctgcccctttctgccctcctgctccagccccacttctgaaagtatcagctactgatccagccactggatattttatatcctcccttttccttaagcacaatgtcagaccaaattgcttgtttctttttcttggactactttaatttggatcctttgggtttggagaaagggaatgtgaaagctgtcattacagacaacaggtttcagtgatgaggaggacaacactgcctttcaaactttttactgatctcttagattttaagaactcttgaattgtgtggtatctaataaaagggaaggtaagatggataatcactttctcatttgggttctgaattggagactcagtttttatgagacacatcttttatgccatgtatagatcctcccctgctatttttggtttatttttattgttataaatgctttctttctttgactcctcttctgcctgcctttggggataggtttttttgtttgtttatttgcttcctctgttttgttttaagcatcattttcttatgtgaggtggggaagggaaaggtatgagggaaagagagtctgagaattaaaatattttagtataagcaattggctgtgatgctcaaatccattgcatcctcttattgaatttgccaatttgtaatttttgcataataaagaaccaaaggtgtaatgttttgttgagaggtggtttagggattttggccctaaccaatacattgaatgtatgatgactatttgggaggacacatttatgtacccagaggcccccactaataagtggtactatggttacttccttgtgtacatttctcttaaaagtgatattatatctgtttgtatgagaaacccagtaaccaataaaatgaccgcatattcctgactaaacgtagtaaggaaaatgcacactttgtttttacttttccgtttcattctaaaggtagttaagatgaaatttatatgaaagcatttttatcacaaaataaaaaaggtttgccaagctcagtggtgttgtattttttattttccaatactgcatccatggcctggcagtgttacctcatgatgtcataatttgctgagagagcaaattttcttttctttctgaatcccacaaagcctagcaccaaacttctttttttcttcctttaattagatcataaataaatgatcctggggaaaaagcatctgtcaaataggaaacatcacaaaactgagcactcttctgtgcactagccatagctggtgacaaacagatggttgctcagggacaaggtgccttccaatggaaatgcgaagtagttgctatagcaagaattgggaactgggatataagtcataatattaattatgctgttatgtaaatgattggt

SEQ ID NO: 55846 - DNA, 1021 bp, Homo sapiens
aaggtccaactgtctgagagttcagtaactttatcccctgttgattccctagaatctcctcacacgtatgtttccgacaccacatcctctccaatgattacatcccctgggatcttacaggcctcacccaaccctatgttggccactgccgcccctcctgccccagtccatgcccagcatgcactatctttttctaaccttcatgaaatgcagcctttggcacatggggccagcactgtgcttccctcagtgagccagttgctatcccaccaccacattgtgtctccaggcagtggcagtgctggaagcttgagtaggctccatccagtcccagtcccagcagattggatgaaccgcatggaggtgaatgagacccagtacaatgagatgtttggtatggtcctggctccagctgagggcacccatcctggcatagctccccagagcaggccacctgaagggaagcacataaccacccctcgggagcccttgccccccattgtgactttccagctcatccctaaaggcagtattgcccaaccagcgggggctccccagcctcagtccacctgccctccagctgttgcgggccccctgcccaccatgtaccagattccagaaatggcccgtttgcccagtgtggctttccccactgccatgatgccccagcaggacgggcaggtagctcagaccattctcccagcctatcatcctttcccagcctctgtgggcaagtaccccacacccccttcacagcacagttatgcttcctcaaatgctgctgagcgaacacccagtcacagtggtcacctccagggtgagcatccctacctgacaccatccccagagtctcctgaccagtggtcaagttcatcaccccactctgcttctgactggtcagatgtgaccaccagccctacccctgggggtgctggaggaggtcagcggggacctgggacacacatgtctgagccaccacacaacaacatgcaggtttatgcgtgagagagtccacctccag

SEQ ID NO: 55847 - DNA, 1037 bp, Homo sapiens
gtgctatgttgagtacaaggaaacaaccttgaacaaggcttattttcccttcttgagaagcttacagccttgtggtggagatggccatgtagtgctgtgtaagcatttaacacatgatcagttaagcagaggtaagcagagtatgctttttagggccaacaagaagaattaaagtttactttctagtggagggtaggaaaagtgagaattgggtgctctggagatctaaaggctaaagcctagagtttgggattgggggagggagttgtctagatgatgcaggaaaggtaagcaggagccacatcacgagagcagtgggaagccaaggctgaggtaatcctctggaggggtggaggagtaggaagagagaaaacaatgggagataagcagcggtggtggaggctctggacaccttctgattagcagtttctggtggtggccagattgatagggagcattgttttcacctttcaggctgaagatgaggccttactctcagaagaagatgaccccattgatcgacggccatggacacagcagcaccttgaagctgcagacatccgtaggacaccatcgctggctctcacccctcctcaggcagagcaggaggtggatgtgttagatgtgaatgtccgtggcccaggtcagcaccgggcctcttcccctcttcactgggctgtgtctgcccatggttccacattgttgtccctgtgtttgccctgtccagtcataaaccccttcccaatttcacagactctaaatcagctcgaggaaatgaatgcttaaggaatgtagccacaaagaaattatcagctcagaaagggaaggatttcacattgcttcatgtacagtgtgttgagactaaacaggctgataaaatgggttagattgtagtgggatagaaaaataatatcccaaagcagaggatagttagtatcttatgcatgtattaattgttctattaatattagatatttttaaatgtccaattaaaataacagcacttaaacttgaacagaaaaacgtgtttagagaag

SEQ ID NO: 55848 - DNA, 1034 bp, Homo sapiens
ggaaaataaggactaaaaacacacagggatgtatgtttagagtagcaccaagtaccactgagtaggtatgaaagagtggaagaagaccactgaaaccttcgggaggaaagcacagcttctcactttgtcatgcattgcctcagccagaaggctttggtcagccagactaaggaaggtgggacatcctctatgtgggaattagtgtttaagatctcaagggacagtattctaattcctgagatatgtcttaaggcagcatcccagaggtggggacctgatgctgaaggggaggaagggaggctcctgtcaccctttatgacatgttctgcctgacctgcactcttctgttttacccccatctctcctcctccgcttctcccttggcatcccacagctctaaagtctttctggaaattgacaaccgccagtgtgttcaagactcagaccactgcttcaagaacacggatgcagcagcagctctcctggcctctcacgccatacaggggaccctgtcataccctcttgtgtctgtcgtcagtgagtggcactggtgtaaaggggaaaggtggcgggggaagagtgtcaattgggggaacaattttcattatgtagccctctattttttcaggactgttgaggtcaaagttgccctctaaatgaatctaatgctgacattgagaggttaatgttttattcagcactttccctgtctctgtggactttcaggtgaatccctgactccagaacgcactcagctcctctatctccttgctgttgctgttgtcatcattctgtttattattctgctgggggtaatcatggcaaaacgaaagcgtaagcatggctctctctggctgcctgaaggtttcactcttcgccgagatgcaagcaatcacaagcgtcgtgagccagtgggacaggatgctgtggggctgaagtaagaggcattgccaataagccactattcacagtataagtagggatgactagaaaagcatatcttgttgaatcatgattttaaattctaagctctg

SEQ ID NO: 55849 - DNA, 1044 bp, Homo sapiens
gtcgtatgtgctgcctgcattgactaaaatgtcattatgcggttgcataactgtatttattgttatgttcttttttggactgtttttatattttggattatactttggaaaaattactgagcctctcttgagctccagtttccttctctttgagatgggacaaataataggacctacaccatagggtgctacttcactggattgtgtgggagagtacatgcggagccctagtatgttctttcctttacttgtacaactcaccaggatgacagctgtcatgaataaagagtgtgctttgccctgcccaactacaaggtcccactaccagttgaggagtatactctgattcattgtgaaaatgccaacaagggtggttatcccttgctggaaagcaggttaaaaggattttcataattctgtacctcttctctttcctccaggcctactctgtgaagagaacattgatgactgtgcccggggtccccattgccttaatggtggtcagtgcatggataggattggaggctacagttgtcgctgcttgcctggctttgctggggagcgttgtgagggagacatcaacgagtgcctctccaacccctgcagctctgagggcagcctggactgtatacagctcaccaatgactacctgtgtgtttgccgtagtgcctttactggtgagaagctctctagcctcctggccactctgccttggaggatggttttagtgaacaaattgggccctgtgagttgtcccagacccaagtgaagcttttcttatataagaaaaacaacagcagcttaattttttaaagccagttttttcttagtctgtactttatggatgttatgatcagtgtctacctttaatttttcctaagagattcttttgttgtgcattgattatatcatgctatggcaggaatattttttacaatgtatattgaaagtagttgaacaaaataacattttttaatagtggcaaaatatccaaaacctaaaatttactatctgaatcattttaaagtgtacagtgtacagttc

SEQ ID NO: 55850 - DNA, 1042 bp, Homo sapiens
atttttagtgcacacttttactttttaatcaagttgaatttatcacttttaaaatggcttctggattttgagttgtagttagcaacatcatatacacttgaagatcgtaaagaaattctcccatattttcttcaagtacttttgccatatgactactcatttgttaatacacaatttattgaatattttgttttttatatatataatgatttgagatggcacctttgccagattctaaattcccatgtgtatttttggtgttcttctggattttctttattttctgtgttattctattaattcaccaataacgttctatttcaattattaaggatcttcttcttcatagttttcctggttattttttttcacataattttataatcagcttgtctgttaataaattcctgttgataatttttagtggggtctcattaaatttatgaattatagtatagagaaaactgataactttatgatgaggagtcttgctaaccaaatcctggtatgtctttccatttattcaagtctcttttgtgtctgttaggacagtattaaagttgtcttcatttaggtgtaacacatttcttgtgaagattgttcctaggtattttatctttggtaatttggtaattgcttttgaaaattgggccttactttacatttaaaaaaaaaaatcttgcttttgttagtgtatgctacaatgcaagtggcaggaatacatacagaactgttttcttttgtaccttttttttttttttttttaagacagagtcttgctctgttgcccaggctggagtgcagtagcgcaatctcggcttactgcaagctccacctcccaggttcatgccattctcctgcctcagcctcccgagtagctgggactacaagcgcccgccaccatgcctggctaattttttttttgtattttttagtggagacggggtttcaccatgttagccaggatggtctcgatctcctgacctcgtgatccacctgccttggcctcccagagtgctgggattacaggcttgagccactg

SEQ ID NO: 55851 - DNA, 1049 bp, Homo sapiens
ctaaacctggagatcaataattgcatgtctgtactaccatccacatatgccttttgaccgagtcatagggtcctcatcacatacggaggaatgtgtattttaaagatgaggaaacctgtacccaggaggaacaaaaggtttgcacacaagtcaaatctgaaacatccttcattgtattcagtccttgccttccctttaaagtgcctttttcaactgaaagaggagtaggtaaatgccagtaagctgcaggttttctgtccctgcatagaatgattagcagagagtgtgatggttccagagaaaacatacaaaagctaaattaggaggtgggagacagtcacagaaatgttccagatctcactagctctcatggtctgtttccagtaatggtccaatatttcttgtcctttttgtttcctcatggcagtgtgtcccaggctatcagggtgtcaactgtgagtatgaagtggatgagtgccagaatcagccctgccagaatggaggcacctgtattgaccttgtgaaccatttcaagtgctcttgcccaccaggcactcggggtatgaaatcatccttatccattttccatccagggcattgtcttaagttataaatccattcttagtgttcaggggattttataaaattaaagataggaagactagcttcattccaagcatttagttctacatcctagtaattcaagccattttattctcccatctcttgctagctctgatgttgtggtttatgttgtcagttttatctggttgtttggcatcttgatattccatgaaacacagaatatggaagggatacaacattagcataacattaaaaaattagcctggtcagtaagatttcttgttgcttcacagaaaagcaactaatggcctctaaaataaacaatttacatttacctgcttttgtatttttttaattagccaagtcttacctctataaggtgggggaatgaatgaaatgaaaatatctgcctattttcatagcttcaggggaggatactgatggtgtaaggttctaccttagga

SEQ ID NO: 55852 - DNA, 1053 bp, Homo sapiens
ttcagaccctggtgaatctctgcagtcggtctccatgtaaaaacaaaggtacttgcgttcagaaaaaagcagagtcccagtgcctatgtccatctggatgggctggtgcctattgtgacgtgcccaatgtctcttgtgacatagcagcctccaggagaggtaagctttgctcccttgggctcaggtcattcactgcagtattgactgtccagtggcatttagagaaggtatcatttttttgtggaataagagggaagggcagatagtagtgggtgggcagggctctggggaaagggctcaagacagaaggtgtaagggtagaggaataggttcagagattcggagaagaatgtatttgaaatgaaactaaggtatattccactttcagggtttatttttaatatgcatctggtactgagggttgtgaagaactggctaagaataagattggatgtgtcagccagtttagatttacttgctcattggttgatttgaaccccatgtgtcacatgttcttctatgacatttctccctcactgggtttcccaggtgtgcttgttgaacacttgtgccagcactcaggtgtctgcatcaatgctggcaacacgcattactgtcagtgccccctgggctatactgggagctactgtgaggagcaactcgatgagtgtgcgtccaacccctgccagcacggggcaacatgcagtgacttcattggtggatacagatgcgaggtgaggacactgagcaagcagaggtcatggacctcccaggagattgtacaactgtttgagcactgatatattgaatttagctgcttgtatcttatattgatagtttatagatttttaccaatccccgtcataatgtttaccactgtttctttcagcctctctgtgcaataagttaacaggtccctagtatgatatttttataggcgtctggaaccatcccagctccttaggcttgcttttaggattcagagccaagagtcactaccagagtgcattttacaggcccacccaacatagcagtccacacttccctgaatag

SEQ ID NO: 55853 - DNA, 1050 bp, Homo sapiens
agccctgcatgaaccatggtctctgccataacacccagggcagctacatgtgtgaatgtccaccaggcttcagtggtatggactgtgaggaggacattgatgactgccttgccagtgagtatgccagtcagctcttaagcccccagaggagaggaaaacacacagggagcagaggagagcccagtggaggctgccgcctttcacgcctgacattgggcataccggtcatttatccagcatatttaacagtagtgttttaactctttcttttgaagctagtgtccttgggaattgaggcagtggaatatattttaagcattccctttaatttgtgaacattgaaaatgtgaggacaatgctatgatagtgttttttaaaaaacagatttattgaggtataattaaggtacattaaactgcaaatattttcagtgtacaatttggcacattttgacatatagtaagtgaaactatcacccaaaataataaacatatttgtcaccctaaaactatcttcatcccattgcaatttaaccttctctctttcttgcctgtggagtcacagttttaccttctgtcactatagattattagttggcagattttatcattttatataaatgcagttagataagcataagtcaggagaggttctgacttgttttaatgaacatagtatttgagatccgtccatgttgtttatatcaatagtacattctagtttattgttctgcagtattccattgtatggacatattacagttcattggttgatggccatttgggtgttttccaatttggggatattacaaatgaagttgctatgaatgagtctttgtgtggacatatggttttagttctcttgagtaaatacctaggagtagaatcggtgaatcatgtcgtaagtgtatgtttcactttttaagaaattgccagaatgttttccaaggtggttgtactattttcattctcaccagaattgtatgaaagttctgtttgaaccatatgctcacaaactcttggtgatatcatttaaatttagctcttctag

SEQ ID NO: 55854 - DNA, 1050 bp, Homo sapiens
tggcatgcacctgtggttctagctactcaggaggctgaggtgggaggattgctgagcccgagaggtcgaggctgcagtgagccatgattacacaactgcactccagcctgaatgacaagagtgagaccccctgtctcaaaaataaataaataataaatagatcctgcaacaagcttttgaaccaagaacttcattattgagaagttatttgtagttggaggggcattaggctttcagatcattagaatagactgtttttccattcatcttttcaactaattgctgtcatttactgactgtatttcagggacatggggctgaaatgaatgaacaggtatttcagtggcctgaagaaatgaatgcaatttctgatgtgttcagtttttacccctaaagagaattggttagaaattgatgaggctgtcagaaagttttactgtttttggttttttccttttgtctacaggctataactgccaggtgaatattgatgaatgtgcctcaaatccatgcctgaaccaaggaacctgctttgatgacataagtggctacacttgccactgtgtgctgccatacacaggtgggtcctggaggtaccagcagggaccagaggggatacttgaccttgctttgtcagtgcctgagtctcagtgcccaggtctgtggggctgtaatgctcctccgagggctcactcctcagttgtccttcctgcctttactgactggatcttgagctttgaggaaacattgtggcctcctaagatgcaagtggtggacagtcatttgcctacattgtactttagtatttgaaagaaatttttttttaattgtatgtggctggaaccaggcacatagatgatggttgtctatcatttgaatgtttccaggacattagctatttgtcttagtttcaataatacagctaccacttattggtaatttactatgtgccagacactttttgtactttggattatttaatgtattcctcaataattctacaatgtagaagttcctattgccattttacacatgaggaggctgaggcaa

SEQ ID NO: 55855 - DNA, 1486 bp, Homo sapiens
tagtgaggactgtgagttcccagaaggcagagacctcgtttaatcatctttatagcaagtgtctaaagcaatgtctggcacgtaggaaacgcttagtgaatgttgctgaatgaacgaatgaatgggactcaaatatagcgcttttgctagctaatgccagactctgaagtgtggactataccatgttttcatttattaaacaccaatttattgagtgcctaagtcagaagaaacactgggtaacttctcattttagttacctagcccaaaaaatttcttggccttccactggactttcctcatgctcagtggaaactccttgagggtaggaccttcctgatggaacagctgtcaatcaacatagtggactgcatttaatgctttcagataaagatggcttgaaaatttattctgcaaagaataaatttaaaagcaaataaagaaaacttgggaggagtggcttctgaggagacgcttccaagaaaagaccaaaaatgaagaaacctttttcctgttatccttcactatattacgggccgaggctaactgtgtggttgaagagctctggttcatattttggtgccactgacaaacagctcaaagaatcagtggttgaggccaaggaaatagtatttaaaaataagctattaataaaacacttaagaggaaaacagcagccacttccagattatgggtttttaccacaagaaccaccaatgatggtttagagagcaatggagggtgaaaaaatgtgaatactcatacttcataggagtgggtatctgtttcatttggaatgtcctattctaaatacaggattgctctttcttaaatgagaaaaatgcatgttttcaaaatcagaatcagaacattgtgttctttgaaatatataaattcatagcagttgcttgatgccactcatttatagaattataggtaattttaacatttcatatcattttggaatatatagttaaatctcagttactcaaaatgtaacaaatggaaacacttgtataactgacccgtattactttattcagcctaagaaatatcaaggttatagcagacatctttttaaagagcaatcttggctatgtcttggaggagcaacatattcacttcaatttcacttactcccagtatccacattgtatgatgatgataagtaataattgtctagaacagaatttctcaaaatctagtttttacaccacctacatttaaaaaaatatggtttgctagattctattcatcacaatctatggtgatagggcctaggaatctccacttaaaataacaacttaaagtgatgattttgcacattaaagtttaagaaccataggtctgcagtgacagactgcattattttctctaatatcagaagacaacaaaattatactttgagactctacttcctgaggtcaaaaaaaatggattaatagactctaagaatgaaaacaaaataacctttctttacaatcaa

SEQ ID NO: 55856 - DNA, 1001 bp, Homo sapiens
ctcagatgagccactttctttctttttgcaaatagttaatgcttgtcagagaatccagattttgtcttcccctggccagattcttcttgtagaggataagtttcaaagagattaaaaacctttagctcaggtttaaaagtggggggaggactcctggagtcttttagggaaagatataatgtttgtctatttacacctcgaagaaaggaaatcttacttgtctctttttcttttaaattctcataacaggttcattcattttattcaaccagtatttatttaaaactactatatatgcatactactctcagaggagttgagagaagtaaaataaagctctcttacctccaaagtcagaattggggacataagatacatgaaatcattaacctgtatattggacttgggaagaaagaaatacaaagataaatatataaaggaaaaatattttgagctgttatacctgaagcctagtaagaaatgaaggtgcagttaaagcatctctgcaatgaaattattgatcagttgcgaaggtatttcaattctaaaatttgatttggaaatctttattttaagcacctctctccaggcatactttctaaatcaatgcagatcgtcgttttctactgctcaagacctgcagtattaattgaccacacatcgaatgtgtagagtaaatggatgtagctacacttgtgttctggtgtggaatatctgccttggtctttgagaatccttgataaaattctttccaaaggtttcactggtgtgttgtgtgaggagaacattgacaactgtgaccccgatccttgccaccatggtcagtgtcaggatggtattgattcctacacctgcatctgcaatcccgggtacatgggcgccatctgcagtgaccagattgatgaatgttacagcagcccttgcctgaacgatggtcgctgcattgacctggtcaatggctaccagtgcaactgccagccaggcacgtcaggtaagcccac

SEQ ID NO: 55857 - DNA, 1064 bp, Homo sapiens
tcttgaaggccctctgtgagactgttatttttagacatttcacccatgagttcagaaacagacaacacatgccaatttttccaagattctctgtctctccttttttttcctcaagctatttttgaagatatgccaaattgtcctccatagattgcatcttaccccattgtatcttcagagagaaggtttctgttgcctctgaagctacagttacttgtttgaggttccacctataaatttcacttcctacatccttcatttagaagtgaagtctgtctgtgaagaagcaatggtagagacacaccacaagtgcctctgattccctgagtgtcacctggttattccagttacctgttggggagaataataaagcataggcttattgacccattggtataagccctgctagtaacctaacatcattctcatggtaaagggagacacaagataatcctttgactcatgttaccactgtccctttttgaggtttcactgggccagtttgccagattgatattgatgactgttccagtactccgtgtctgaatggggcaaagtgtatcgatcacccgaatggctatgaatgccagtgtgccacaggtaagattcttctcacttttcatctccttggtaggtccatctgaacaaaatagggtgattgtccctgtcctctgctagctgctgtgccaggccagtccactcccagaggctcctctgtgtttaggaagagctgtttctaacaaattttttgctgctctctttttctgcagcacctgcctcctccaccacaacagtggtctggcccagatatttccatttggtatccatgtctttctgggacagattttggcagcagtaagtttccagctggctagattgactcatttaggaaagagaagaaatccagttgaaagctatttttcactggggcttctcagcaggaggcctggctctgtgtttcttgaagcaagtgactgaaagaaggcccagaaatttaaaggctgaatgtgtacaagtgcaggggtattctgcataaaagacaccaaaataggattgagagtcaa

SEQ ID NO: 55858 - DNA, 1015 bp, Homo sapiens
ttgtttatctaaaattcaactggacatcctctattttatttgctaaatctggcacactatctggaagatagctccactttcctgtctccgtcttcttatcttctggcctgtagatgtctctgtcctggaggagaggtctagctgagagctcagggtcagagtctagggttgcatctaggtgctttgctggtggccaagcatgtccccaaggtagggtcaggcaaagcagaagttgcgtataaatctccatgttggattctgaggaactgatcatgaggttttccctcctgggtgaaagagaaagctcttccccaagtgagagacattttctcttagttgtcctttgccccaccctgtgacaggtctcctgtgtcatctggatgatgcatgcatcagcaatccttgccacaagggggcactgtgtgacaccaaccccctaaatgggcaatatatttgcacctgcccacaaggctacaaaggggctgactgcacagaagatgtggatgaatgtgccatgggtgagtaagcagaactttttctgttctgtgaagtgtctgttgagctcagcaaatgtttaaactgaagcacattttactgtagaagcaaattacatacacccaaacctcagattactcttgctacatggccagtgtttacaagtgacctttcagcatagccataaccatatattccattctggggattaactgtatgaaacgtatgtacttgattcttaatataaagccctacctcaatgacagtttgggcagaaactgcaatagcagaaatgcataacagttgaggatactccgcttttatttctttttaaattaaggaaaaaaaaatagaaaattgggaatgatattattgaaggcctggccctgatgctataaccatcagatgctcttctattgttcacatttgtggaaactcaactgctttgatcccagtaattggtacttgtgtctttcagccaatagcaatccttgtgagcatgcaggaaaatgtgtgaaca

SEQ ID NO: 55859 - DNA, 1009 bp, Homo sapiens
ggttccttctcattattttttcttactcatttttatactcttctctccttgctcttcttacttatatgttcattgacccagggattagttaactcgagggtcctacaggttttaccttctctttgataagttggctaaaccctaatgttgttagagtttctaacggtagtaactattcatcttgaaacgatttgcctggaaaaaatatcatttagatggctcaaattggccttaaaattcatgtgaagacccagccttctggagctctgcttgccttaatttcagacaggtcacatgaagatgaagagtgtggggggctggtatggtactagtcctttgagactcaagagccctaatcaaaagtaatttccccctaaaaggacagttctgcacagaggatgtggatgaatgcctgctgcagcccaatgcctgtcaaaatgggggcacctgtgccaaccgcaatggaggctatggctgtgtatgtgtcaacggctggagtggagatgactgcagtgagaacattgatgattgtgccttcgcctcctgtactccaggctccacctgcatcgaccgtgtggcctccttctcttgcatgtgcccagaggggaaggcaggtaggtagcagaaggacggatctagaaacagggaaggggcagggggcattcaggactctgccttctctttcatcccaaacagcatattctttgagttaccatctatgggaacatatcactcaggactgttccagaaatgtaacctgctagccaaagtgctatgaagataatcttcctctttaggactttaggctctcttctcaactctacatactttagtttttcattccaaaaaaggaaagttagtaactattgtctttggaacatctgctgaagtccttaagatcttagactgaaaagcacctcagctattaagataaaatggctaataaatggatccacaggcttcattttaagaagaaaccatctatttactcagaagaagttggcaggag

SEQ ID NO: 55860 - DNA, 1088 bp, Homo sapiens
ttcactccctcatccctcactcactctttctgtattaatactttgggatgcagttgacacagcctcgtttcaaattagaaagacctgttgcaagaggcatctctcagaatggctatgccactgagtaggcttactagtagttgggcttcagtagcaattggaaccaacaacttgaatgccaccatgtttttttctctttgtgcacatcttttctatttttctttttttgagacagggtcttgctctattgtccagactggggtgcagtggcatgatcatggcacaagtgattctcctacttcagcctcccaagtagtgcctgcaggctggtctctaacttgtgggctccagtgatcttcctgtttggcctcccaaaatgttgggtttacaggtgtgagccactgtgcctggctctctgtgcacttctgattcacccatatcactttctctgcagaccagcctcctcatctttttggtctatgtggcaaagtggtcctactccaataatttgggagagatacagtgatgtagcttggatcagatgcccatcttgggtcagtcagccatggccaggagggtttgatcatgtaaagacatggttgctccttcaagaattatatggctggagttaggagaagagcatggaagggttatgccgagcacggagttccggagacatccacatacccatcctgccatcctaggcagttggctcttgctgggaatacaaaagaacccctctaaactgcagccaagtagtgggagacagatgtgcaaccaaataagtgtgatagagtgatattggttctatagtaatggaggtacatgttagataggaataaagaacaggcagtcagttaggttaagtcagacacaactagcatccgcgagtaatgatggctaacaggccttctacagatacatgagccagtcaaattgctaggtattctgggtctagagatagccttggcattttccaagcacaaatattgtgttctttttttattaggaggcctctttatcagagtgccttttaaaattatttgttgagttttatttacaaaggaagaatgaaggacaccttgaca

SEQ ID NO: 55861 - DNA, 1037 bp, Homo sapiens
atacattccaggatggattgaatggaatgatgcaatggtggagaatcatgaggagatgtgcatttggagacctactctattgataagacaggtacctcgccatgtgaataagcagggaaaaaatgtttcaggtggacagagcagcttatgcagcagcactgaggcaggagagaacttaatgtttgaggaatcaacaaaagttattgtggttagtataaactgtacaaaggagaggtgtagatttgagtatatttacgaggcaaaagtgatcaaccagaaaattgtcagtagttacaggtggcactcagtgtttaaggtatcagccaaggatatgctagtttgacatttcatttcagattattccagagtcattgtggcattagagagggtagtttttaaaaacaagttatcttctttctcttttgcccataggaaataagagcctaactagtccactgcctcagtcctgatgttaaaaaaatgacagtagcctgcaatatctggcaggtggaaattactgagagggataattattgctcttgaaaacttgcctaactgagctttgtgcaacattttgggagttcaccagcaaagtttgtgtgttgacacaggtgatgatacatgctgacacttgtttgtattgaagatttagtagcttggtaggacatggaaacaatacagctctcctgtttcaccaaaggcttttatttgctaggtagcctataacttagtgctctctcctgctttccctactaacataaagtcatttgcttttaatcccttctatgttctattggccaacttaccttcaaacacagtatcgatcatgtctttcctcatcctcctttacttgttgtatcaagttccgaattcatactcgaagtcaaagcctcaatgacctcccactttttcttcttctaaaaccccagccaaagaatacactgcagttattttaatatgtttaagacttaatcctgtattcctctgtaaatcttcaaccaccagcccaggctggtgctttcttgcaccagtgggat

SEQ ID NO: 55862 - DNA, 1319 bp, Homo sapiens
gacatttgagttgcttctactttttgagtattatcaataattctgttatgaacattcttgtataattttttggtagacatttatcttcatatttcttggatatatacctaggagcagaattgctgcgtcagatggtaatgctgtttaaccttttcaggaactgtcagactgttctgaagtgggtacattattttacattccaaccagcagtgtatgagaattccagtttctccacatcctcatcaacagttgttattgtctgtcttttttattatattcgtctgtaatgtgaagtgtttatctcattgtggttttgatttacatttccctgatggttgatgattttcaacatcttttcatatacttattagtcattatgtatcttctttggagaatgtctgttcagatcctttacctactttataattggtttatctttttaatattgaactgtaatagtttttaaaaaatatatcctaaatacaagtctcttatcagataatatgatttgcagatattttctgtcattctatatactgtcttttcacattcttgatgatatacttttcagcccaaatgtttttaacttgatggaatacaatttattttttcttttgttgcttgtgctttcagtcatatttgtgaaaactttgcttatcccacattacaaagatttactatttctaagtgatttataattttaccacctacctttaggtctccgatccattttgagttaatttttatgtgcgaggagggagtctaacttgattcttttacatgtggatatttagttgtcccaggaccatttgttgaattaagtgctgtttttatctaattcgtttaatctttacaataaccatttaaggtgggtcctgttaattccccaagaaagtttaagtatattgcccatattcactcagctattgcatggcaatgctgagagttgagcctagacagtttggccccagaagccatgcttttagctatgaaataactgtcttacctacctcccttcttacctacctatctacctattgacagggaaaaagtacctcaacaatagtcaatcagttataaaaagaaaacactttatttcttttctgttgtggttctgctgaaatgcttctgctttcttgtctgtggttggtgaattcagttagttgtaacattggctaatataaagttagagtcacagtttctattccttatagttgagctacaagggcttcgctacctccctgacaccctagtcaactgtatttagtcttactcatcagagagatcgagttaggggaggatgatcattgaccttctac

SEQ ID NO: 55863 - DNA, 1021 bp, Homo sapiens
aaaagggaagtgagaattttgtgtggggtgggttgctagtgagggaggagttttatgggcccactgtggtccataaactgagcaggggataatttagcatgtcagggtttatgatgatgagtggctagaaaattgtttattgtcccttttgtagaaacagtgagaaataagaggaacagagctctgggaaagggacaggcaagtctggaatggaaaagaacacgatgagaattagacactggaaaatatgtatgtgtggttaataaagtgctttaaactgaattgacattaacagtaggtgatcaactttcctatgtgcttgtgcttttgcttttgatggagtaattcattgttttcttatccacctaaatgcacccagctgcccttgattttctctgggctactggccttcacaaccctctcccatgtaccctctctgactttggggtaaccctcccctaacttaaagctagagaattctgaaactgaggaggggatcctctgttaatcagtgagcactttttgatgagctgatagatgatatatgagagactatgcgtggcacaatactttgttacactcttcactgatacaagtgttctagagtgcacacacaacccaaagatagaaacaaaaagaggagcagtgtcggggagcttggggcctggtgttccatggagagggagaaaggaacaagcctggccaattcattcaactccttataaaaatgatgaggaggctgaaaaccaagaattttgattgggaacagaatacaagcagctggagcagatgaattactaagcaacaaagatcctgtttttatacaaatatccttagtacaaaaacaaaagaaggaaaactgtaggggggagtaatgtgctaagtaagcagaattgcctcaaaaagaagttgttctagttactctttcagagtgggaatcttagattctggtattgtggatatggttcacatataatgggattgtgtgttttattttggagagattaaaggtcataggttg

SEQ ID NO: 55864 - DNA, 1029 bp, Homo sapiens
tgagagaagggggggttgagagtagagtgggaatggcaagaagtagtatgacagagcttcttctctttttttcccctctttaccaggaagttaactagaagtcctcatgcatgtttttaaaacaaagttggtaattagcataacctagttagttacctttacacagagtgacagaattaaaaagttgacaagcccatcagacctcagccaggaggtactgaaaggagggagaccagtgagtttagaccaataggtgggttaggcctcctgaatgccagcctagaagtttagacttgattctataggctctggggtacctacaagtttgtagtcggagccttgggaattgaatgttacataggaactttcactggttccagctagccttggctgttagcaattatttttatctactttaacaggggggacagagtaggggggcaggaaactaagctggcattatggtcacaggaaagaacagactgatttggagcctttcaaactgcagacctttgttactgaccgatgcttaatttggtttctgggttttgttagttttttcccctgcccttacctcatttaccttaacgacagctcccccctctagagctcagctagggcaggctgccactgcggattggggggccaagaggcccagcgcaagaagaaagtgggttgaaagcagagttctgttcaaagaattttctgctggaaactagcccagagggagtaaagaggagctttaatgaggagcagctgcagtgccgacgcaacccacatgagactttttttccccttcgttccacattctgtatagtttttttaaaaatcatgattttgaaatagctgttttgtaaagcatgcctctctttttcttcttgtatgtggtgggattttgctttgttgttgttgttgtttttttttgaatggccaaatcctcgtttttaaaaaaaaaaaaaaaaaagctaaagacagagctgcagcaaagccctggatgcaatttggcctcaccctgctgatacagaacat

SEQ ID NO: 55865 - DNA, 1086 bp, Homo sapiens
ccccttaaagctagagattatgtttattcgtttatttatgtattccatttctccttttttctggatcctaattttgtgcctggtgcatactaggctctcaattttagtttgtcgaattactgttattgctgtttctgattacttcttgaagcggtctgttttaaaacttcacctgaaggctaagtaattcatcagtataatggtgatctattatttatctagcattttcctaaacactcattgatgaatccttataatactcatctgaagtatctaaatcccaagatgatgtgtcatgccatagatggtatggctttaatttttaattgggagatggagatgtaacagctggagatactaaaacacagagaaataagagcatcattcaagaccacaaacgtggttattgttggaagatagttttgggatgggcttctgtgctagaagccagaacataaaaaactgattaaaactctaaaaagaaacccagattaggtgggaatgaatgctgatctggattggattacacttctttggtgtctgagggttatgattagtgacttacttctaatgtgcatttgtttttatttttagcattgcagtgtcgagatggctatgaaccctgtgtaaatgaaggaatgtgtgttacctaccacaatggcacaggatactgcaagtaagtttttctcttcatatattttctttttgcgatagaacactggacaagatttgattctactcctctatttttaatgcttctgtggaatgttactggttcttgagctttcctggtacagattttggttgggggtgaggatggaaggatgtggatgccagataattggctaataagaacttcttactatcttactgttatctttctcactatgaaaaagacttttcagtgagtggctagttaatgtatatggggtagaccaggcatggtggctcatgctggtaatcccagcacttcaggaggctgtgttgggcgaatcacgaggtcaggagttcaagatcagcctggccaacatagtgaaaccctatctctactaaaaatacaaaaattagccaggtgtggtggcgcat

SEQ ID NO: 55866 - DNA, 1218 bp, Homo sapiens
cacctcccctgcttctggggtacacacacctaattttgcagaccactggtccagaatgtaaattgaagagtttaatgtctaagatatttgttcttttgtttgtagcttatcttttactccccacgtttcaaatatccctttgcaaaataatttttgagttaaaattttcaattaaaaaactgtatacttgaggtagaaaagataaagatagaagatatatgtgaattaggttgtatctctccttaagagggaatactgttttttatctaaggagaactaacaaccctccctttcattgtctgggttggtataagtaaaaatccttgtttgaagttattaagccttcccacccatatgatgattagtttggttcataagctagagttagggcttggtaaaggctcctttttttttttttttttaaagtctttccaccttaactagcaagtaagctagaaatgacagagcagtagaagggggaatctaccagagtgtcctacaggaccttgttgaatgctactgctgcatgcaagggttgtggatttggtgtgggccttctgcagtatcacccaaatttgagcagtacatgtaactaaaagtaagaaaaataaattagacagtttatttcatttcagactttggaagcccaggactgtggggattagctattagctaagacaatgattcactgagcaaatgcagtgaaagattcttttgttacactgatcatcatttgtggagagactctgaagaaggataaagctctggctgcatagtcaaaccagacctactactcaaggacatgcatactagatatgtaggtgtttccaaatatttttttcagttgtggcggtgcaaatcatttcaatagtagagtaactcagttcattactgttactggaaaaacaagtttaaccaagcacatatcctactgagggtgagtcaacagtgtcattttaacataagaaggacagtacatgaagtgagttattccaagtcctgtggttttcctacagctgagcaaagacagctgttctttcggaagtggggctctaaaaagaagttgcccatctcctttctttcttgattatagccttttagttttcttttggcctgagacatttcaaaaattcatttcctccttagatttctatcaccaaataccctgaattttgataatttatttatagagtatattatttattatagacttattat

SEQ ID NO: 55867 - DNA, 1038 bp, Homo sapiens
caaagtgactggcccaagtacctagagctgggtcagggttggggccagaatccaatctcttgacttttagtcaagtgatttttccactatgctcagtactcaaattatgtatcaatatgtcggcccttgttttttgaggtctgaaaagggttagtgccagtcaacaacagtagaggagtagaaagggtgttgggatgggagaggtgtggctatatttaaaatttcaatgacagcagtgaaaataatttgcctgtgaacctctgcctgtccctttggacttctttgtagtagttgagacaacccggcaggtctggtgtcattagtgattcagaattggattaacctggactggtggagttactttctcagaaaagggctttatattttaacatttgtttcccttgacagtttgcttcttctcaagttttggcagccttgaacaagggttgtcaggtttttattttgttttgttttaagaaaaaattccaaattttattttgccgatttagtaagttatcctctacctgccactcccttctgctccctctataattatttctaagactttatttttccattgtgggaacattatggaaggttttcttttacagtctgagatatttataattacgtgtaagcacacagtttatagaatatgtaaatggtccatatgttaacttaaatacccttaaaatattttccaataatttaaatctttccataaaagtagctgaagctgcttataataaaagagaagtatacacgaaggatagcagaatttggatgtagttaatatagataaatatgaatgtcactttggaggaactggaagtatttgcatgaatactgatcaagccatgcctccttgttaatagagtgaacaaaacagatgaatgtttctgttttcatgaagtttatgtgactatcagtagcttccatattctgagggtttattatgtgacagatgcttggggacaaaatactttacttgtttcctttagtccttaaaatagatgttaggattcttgtttacagaaa

SEQ ID NO: 55868 - DNA, 1723 bp, Homo sapiens
gaggcaggcacgttttaaaattgttgtttgcttctttttcatctctttttattttcatctttttttttgtgagaagattctgtaagtttttaagcttcaaatattttcaataatctattttaacgggtacctagcagggagaggttgttctattggtatacctaaccaacattcaaataagaataattgaatactgtttactcactaatctgttctgttgagtttctaagtatgaataatcacaaaactagatagtgctgatatatcaacttctctaaatggtaaatgtggtaagtagcaaagacatttttgtttaattctctccttacacatgctttggttcagacgctgtcaagacacattgaagtttgaggacatgtgtatttcgattattttattatatttttatttgctgtgaatatgggtttatttatttgctagatcttctttagttagaaacattaagggcatttactttattacaacatttaaagtgcattctaatcttcatgaggaattttaggtaaaagaccgtatcctgagattcatgcaagtctttggcattatgttactatttaaagtaagtaatatgtagtggcttctctgacatattctttctaagagagttaaggaaaatagttgtaactaaaaacaaacattgaaacagtttaaggtaggtttacgtagcaacagaattattcgttatgtttacagataattaactcgtatttatactttgctgattttctctggcacctttacaagatttttttatttttgtaaaataaaaagtaattatgtttgaaaaagtagttaaggatgtttgaagaatctagaaaagcataaataaaatgtccacaatcatgctgccattaattttttggtatacgtctttggtttttttacccttagatttagaaaagctgttgatttatttttatatatatatatatatatatttagtttatgaacagatctacatatatatatatgcacacacacataatatactattgtcaacactaggttttatttttaaaaatctttaccatttgataagtggtaaatattacttaatcttaatatgcctctctcattacagtgatattgaatgttttttcatatcatcagtggcgtttgtattgcctttttttctacttcttttggtaaattgtgtcttttactcatttaattattttcttactggtttgaaaaagctctttaaatattaagggtgttagtcttttgtcttaaatatgtcacaatatgtatggaaataattagcagtatataacataacatcaaattgctaccaatgttgatataaaaattgttcatttcataggttaatttttttaatcctttggtttctaatgatattggttaattcatttgttaactgctattttctgtagctacttgaaagttcttatctgactgtatcgtaaatcagcatgctttcagctgtatatgtctaggaaattgacatttactttaatacttaataaaaaaatatgttggagaaaagcagtgtattctggagtcaaatacatgattttgggtgggtgacgtaatcggctactgtcctccttttctagatagccaagatttttgaagcatttaacatccctgaaaggcaggactaatgctatgtctaccatgcactgctaattctgacactttgacctaatggataaatgccagtacagtgggtctagccagt

SEQ ID NO: 55869 - DNA, 1038 bp, Homo sapiens
taagtacatttttttttaccttcaggtgtgtgtatgaggtctttctaaatttaagaaatttccataacaaatgtaaccttagtcattccagtgtttaacgcttctgactcaaggaatttaaaaattgctaacgtaagagatatagaatataatgtcatttcttctatttatctgggtgcaatatgtctgcattgaccctttagaagggcttcatatatttagatgatataataaattctccacctctccttttcccttttcttctgttatctctttttccttaaatgtcattcatacatgttgttttttgaccctttatctatatacgtctgcaatgattttagagtaaaaaactgcaaggcgtgatttgaataaggatataagaaattttacatcattttctttatattgtgttcacagtccatagttacatgcttcctttcttgatgtctcagttcgaatgcctaaatttgaactattgattttccttccaccctttcctgattttcctgtttttgtttctccccctttctctgcaaatgacttgaaaccaaaaggtcttcttttctttctttgtcagcctaccgtatgtgtagtattttggacagatcactgaactaggagccagaagaccagaattcttctccaggtctgttattaattggtttggtgaccttgtaggagagccactgtttccgtcctccattttctgatgttcattgttcatggtcacagagccaattagagttgagactagaattcctttcttctggtgtccagtgcctcattcactgtcctcattgcttccatctcgtgtacaaatgcgcttatgtgcacaaaaactcttataacatcctcaagtgcttattgttaatgcgtacatgaggaaggaatcgtgtattttcatttatgtgtttattctaatgcccataccctacccctgtacctggcatgatgccttggtatctaataggcacacaataaatacttgttcagtcgaacaattatttttagccattttcttattttggacaactg

SEQ ID NO: 55870 - DNA, 1051 bp, Homo sapiens
gaaattctgagtgccgtcagaatgagcattttgccttgttcatctctccaagtcagcatcctggagcatagcagatgatcaggaaatgcctgattgccctaattccactggcctctgaattctcactcaaaagggcataatacccaggcccctcctaggtttcaaagaattctcaggaatttgcaggccagaagcaagtatagcctggactctggaaggaacttcctccaggttggcccgagaagagggagaggtagctgccctaagctgtaccccttgcctacaagttgctacagtccaccatcaggatagttgtgtagccttagctgaaggcagagttcccctcagtgctcgaagataaatactttagaaaggagtgcacatctgtggtagactgaataatagccacacagagatatccacatcccaatccttggactctgtgaatatgttaccttatatggcaaagggactttgcaaatgtgaacaaattaaggaccttgagataaagaacttatcctggattattgagatgagcccttaatataatcacatgaatccttagagagatgagagggtcaatcagggagaagggggtgtgatgacagaagcagacattagagtgatctgtccaggtgctaaaaaatgccagtttctagaagctggaagagtcaaaaagtggattatatacctggagcctccagaacaaaccagtccttcagacatttgttttagccccttaaaacttatgttgggcttctgacctccagaatgataagagaataaatttgtgtggtttttttcgttttgtttggtttcatgtttttttttttttgagacagagtttcgctcttgttgcccagtctggagtgcaatggtgtgatgtcggttcactgcatcctctgcctcccaggttcaagcaattctcccgccttagcttcctgagtagctgggattacaggcacgcgtcaccacacccgactaatttttgtgtttttagtagagacgggttttcaccatgttggtcaggctggtctcgaactcctgacct

SEQ ID NO: 55871 - DNA, 1020 bp, Homo sapiens
gcaaggcacgcccttcccgcttcttattggaagagggtctacagtctccaccggtctctactctttattggttaaaattccccgcaacacccctcctctctaccccggcccaattggccgtgcctcagctcaagagtttgtgtttggtcgtcggttccaccttaatcccgcccatcagttctacttaggggttcaacaacccggggtggagcttaatctgtgaccacgcctcggcagtgctagtcacacctccaagttttgccagctcctccccctcattccgggcctctcgggatcagctcttcctattggctatgggccccatcggtcgatagaaaacgggcggtgattggtaaaggggtgggctctacttcccggcggggtcctgcggagttggcggaggctcctccagggactggggcacagatctgcgtagaaacgggtggcggggaagagaggggaggagagctctgagtgggaagcggagccgggggcctgggacccgtcgcgtcagagccaggtaaaggctccttccctcttccttttcttcctcccggccgccgggctggagccctgactgaacaaacccgggctggggcgggaaggagagggcgcggatgctgctcgcggcatcgccttagcggtgccgcccggaatccctcagaccgcccctcctccaccctctccaaatctcccagtacagcccataatacttctcaggactgcgagtctctccgcccatcactgtacagcctgggactctgtcctggctcacggaccgcagcgcagccggcacccagccgcctctccctttcctccgcacacgggcagccgcggtccaccgtagggcagtcgtcgttggcatcgcgcgtaatcatcggccggcctcctccagtgtctcccagccctggcggacagcccgggtcccagcctaggacccaggaggatgggtgttccgcgcagcttccggggctctccccgagtcccaccccccggcccgccccgatggacttctcttcg

SEQ ID NO: 55872 - DNA, 1631 bp, Homo sapiens
tgctgccaagagaagctagtaaccaaaaacaaaacaactgggaggaggggcgggagaggaagaaaagttgtgccctggtggcttgtccctccccggctttgatcccctttgatgtacagggaggtgccccggccgggggtctggggccacgtcgggggctaggtcgggagggctccctcgggctggccgctgcccagcgctggcggggctcagcaggccgccgaggtgccgcattccccgcccggtgccccgcgttcctgcagttcccgcccggagcccgcgcaggcggctgctccaaagtgttttctttcagccttaaaatccggagggagcttccttcctccccacctcgtagcgccaggctctgcgggcggggagacgttaagcggacaggaatgggcccagggcgggctcggaacgacgtcccctaccccacccccgccgcgattaggatctgcgctctggctgatcgccccctcccccttttcctgcatttacaggcaagtgaaccggagcaaacgacttccgatccagtctgcgctgttgcggctcccgtttgggatttgatttgcagcatctttgagcctctacgacaaaaaaccgcgaagcacgcccagccctcccccggcaccccgaaaagcacccactccctcccggggacacagctgggcgcgtccacacccccgcagccccacaccatgttgtgcggaaggacttccactccccgcctgtgtcgttgatgtcagaccccaggccagcctccgggcgctgcagttctcccggctaatgctgaggctgcggctccggctctagcacaggcaccagccgccgccgcacccggcctcagcgcccaccgtctgcatgtgcccgccgtagccgtctgcccagcccgcagcccgcgctccacggagcgctggagaccaccgtggggggccccttctgccctcgagagaagcggtcttggaggtattgatttaggtggttggattttttccgtggatctatcaattcacaattcgaatttggaagaaagaaggaaaacatgacgtctccagccaaattcaaaaaggataaggagatcatagcagagtacgatactcaggtcaaaggtaagggttttgaaaaatagcacactgcaaatgctctgtggactggtgaggcgtgtatttccaccgtgatttgcaggttgttcatttctttgggtggagcagatgggggcaggctgaccccagaggtggtttcatagatgggtctgaacctccaaaggatgggcaatgccagggggccattgacactggaaaggaatttttgcagtgggctgtaggagtatctttgtggggctgaccatgattttggcagccctttccccccaagccgggcagggtggggggaggggcaggaggctcttagagaaaggcagtttgcctccggttctctgggtcaggtttccttgaaagacaactgaaatctgacaggtgtttggacatttgtttcagagattgaagaggagtccagacagaaaggcaaccttgggaaggtgtaccatttggagagccttgggagaggcggggttttttggatgcactatattaaaacatgagatttgcaatggcattggcaccaaaagtcca

SEQ ID NO: 55873 - DNA, 1166 bp, Homo sapiens
actgggattgagagaggtgtggttgtgagttattattgaggtcttggcctcttgtcactgttcataatccaggcctgtttttgtaaacaataggccactggcctccatgtcctgtccagatgcattgcatttgctcttggaatcccccctgcagttttaaccagatatgtcttttttttttttttttttttttaacacatcctattcttaaactgttgccatcgggagtgttaataactttgatcttcccagatttctctccagaagcacgccatttgactaaggtgcaaagtgactttaaatgtttaatttttggaaggttcaaggctgataggtgttaatagaaccatatctgccaatttcttattggcaaaggatttctcaagagtgtctcaaaattaaacactttggatatttacaaacattgctcattgagatgaggtaatgcagtcggctatttgggttctctcttcaaccttgccacaaacagactattttgctttgctctgatattttcccattgatactattcaggatcatagaattttataggtggctgagcatgatgtcttactccgagaaggtgcctgatgaatgcttatggaactgatttgaatagtttagtccttcattttacagctgaggagaatacagagaactgaagaggcttgtccaaggtcacacggctagatggtggcagatctgaaactagaagcagatttaccaactctcaattctctattctgtatctttactatgaaacatcatctgaccagggtggaaaaaaataaaaaattcttaaggagcccaaatctgtcaatgaataatgatagtaataatgataatgataatagattacattttggttgctcattatgttccagtccatcccaagtgctttaaatgaatggtctggtttaatccttacctcaacccagggaatgggtattattgtcaccttccattcaccatataaggaaactgaggcttagagaggatgagaagcccttccaaggtcacacagccaaaccatggcagcttgacttcattcctttattcattaactatttattgagtgcttgctgtgtgttctggcgattggccatacagctgtgaagaagaaaaagtctctaccctcgtggagcttatattctggaagctgggct

SEQ ID NO: 55874 - DNA, 1028 bp, Homo sapiens
agtggcacctgtagagttgtccttccagaagtgagaatgcttcatgggaattgtgcttaccttatacccttgacctctgacagctacattaggaaaatatgtcatattgcagggaaaaagcagttgatatgtagatttctggtagtaataaaattagcagttttaacctggtgtcagctccagaattgactttttggggaatctgggaaagttgccttggaagttgttaggtttaaacataagtaataacagcacttaaaatcattttaaaaaattacaaaattaacacccttactgattttacaataatgtgtaagaactctcatctctcccttactctctgtaattgtggtagaatacacaggaggttgaccatcttaaccattctagagtacagttcagtagcattaagtacattcacattgttgtgcagccatcactaccatccatctaaatgactcttttcatcttgcaaaactgaaactttatacccattaaacaacagctccctattccctcctgcccctgtctctggcaagcaccattgtactttgtctctatttgataactccagatactgcaggtaagtggaatcatattgtatatattttttgttactggcttatttcacttcctataatgtcctcaaagttcatccatgttgtagcatatgtccaaatttctttcttttttaaggttgaataatatttaattgtatgtatataccccattttgtttacccattcgttcattgatgaacacttgggttgtttccaccttttgcctattttgaataatgctgctgtgaacataggtgtaacataggggtgttcttttttctttttttttttttttttttcagatggggtctcactctgtcacccaggctggattgcagtggcttgatcacggctcactgcagccttgacctcctgggctcaagtgatcctcccacctcagcctccgaagtagctggggctataggcacatgccaccacacccagctagttttaaaattttttgtagag

SEQ ID NO: 55875 - DNA, 1080 bp, Homo sapiens
tgaaaaaagtgaggtgtaggacattcagttatttctccagggtctgcagctggtgaataatggaataggaaccttggttgtcgccagagtctaagttctacgtgttgctcatgaaatgcccctttttcgctgcgcagtcccgtatcttcacctattgaaatctcatccttctgctgggggcagtggatcacctgaggtcgggagttcgagaccagcctgaccaacatggtgaaacgctgtctctacttacaatgtagaattagctgagggtggtggcacttgcccgtaatcccagctacttgggaggctgaggcaggagaatggctggaacccaggagttggaggttgctgtgagccgagatcgtgcccttgcactccagcctgggcaacaagagtgaaactccatctcaaaaaaaaaaaaaaaaaaagaaaagaaagaaagaaatctcacctttctggtaaagcccaacgtttctgggattccttccttaattgctctgaccagaaataacccttctctctatttcacccacatagtgcttctcttaatagatctcatatggcattgatctcatactgccttatgtttggaatatttgtatttcattcttttttcttctaccagacttctgaatgtaggaatgttttgaagttgtgtagtgcaatgcaaagaatacaggctctggaaccagccctcagttggagtcttgtcagcatcacctccttgctgtgtgaccttgctgaagtcactcaacttctcttccaagcctccttttctgtgatgtggagataatgagacctgccttgctattaattgcagttgtgttaagagtactggctcagtgtatggcaaatattaaatgctaaataaatagcttattataaggtcccttcagataggaaacgtgtctggaagactattgtagctcaaatggtggctctcagtaaacacttattgtctgtagtactgaatgaatggatgacctaactactacaaataatcttttagaaatagtttaattgtatcttgacactgtatcttgcacaatgtcaccagagtgatttttaaaaactcatttt

SEQ ID NO: 55876 - DNA, 2585 bp, Homo sapiens
gaaactatttggagtaggagtgaggagctagcattgttttcagggcatgggaaccccctccccacctcactagccaaatatgtttgcctgggccgagagtgtcagatctctgagagatcttgacagagtatttaaatacattctgccctcggacaattcttcagtgttaatcatttcaggaaaagggctgtcagctaacctttaaaatcctttccagaatagtataccacagcccacctttccatcttgttccagtgacccaatctataaatggtcagttccttcatttgcagaacttgaaatagtttaaagaagagacttgatgaattgaactcatgtttttgctgctgtggccacaccctctatacagacatttgcttcatttgggttctcagcaacttgggaaggaggaggctattgatgaaactttcaaggcgttggcttatagctactggagtgttcttctttcctgtcccctcccctcctcacttcctccagtgttgggacactttgtattgaacaagaagatcatgagctaatttcaacctggcagccatttatttagcacctactgtatgttgtcttttttttttttttgaggcagagtcttgctctgtcactcaggctggagtgcagtgatgttatcttggctcactgcaacctccgactcccggattcaagtgattctcctgcctcagcctcctgagtagctgggattacaggcacgtgccaccacgcctggctaatttttaaatttttagtagagacagggtttcaccatgttgttcaggctggtctcgaactcctgacctcatgatccgcctgcctcagcctcccaaagtgctgggattataggcgagagccaccgtacctggcctatatgttttatactatgctaagctgtgggcatagagagatacagaaaaaagtttctgccttcaaggagctgcagtctattagaaatgtcttagtccgttttctgttgattataacacaatgcctgaaactgggtaatttgcaaagaaacaattttttttttccggttctggaggctgggaagtccaagattgagggctgaatctggtgagggccttcttgctgatgggaactctccacagagtcccaaggtggcgtaggatatcacatagagagggagctgagtgtgtaaacttgccagctcgggtccctcttcctcttcttaaaaagccactagtttcactgccaagataacccattaatctattaatccattcatgatgacatgccttcatgatccagtcacctcttgaaggccccaccatggggattaagtttcaacatgagttttggaggggacattcaaacaatagcaagaggggtgatcggattacacaagtacagtgatagggtcatagtagagagatatcgaaggctctgtggataaggaatagtctaacagtgagtaatgctgatgagactggttgatagaggaagatgatgatgttacctagtatttacagggcacaaggcagtcaaagtgccttgccatactttatctcatttaacctcagaattgtacaacacagggcaggatgatatccggcctttttttttttcttttttttaatattttattttgagataattatgcattcacatgcagttgtaagaaataatgcagagagattgcacatacctgttacttagattcctctgatggttaacatcttgcaaaactataacacagtatcataatcaggaccttgacattgatacagtcaaaattctaaacagttccatcactgcaaggatcactcatgttgtccttttctagtcctgcccctcccagttcactctttcatctcaccccactttagtccttagtccttaactgctggcaaccactaatctcttgtccatgtttataatattgtcatttcaagaatattataaaaacggaaccattagcatgtagctttttaggattggcctttttttttcactcagcacaagtgtctgaagactcattcaggttgttgtgcatatcaatagtgtatccctttttattgctgagcagtattctatggtatgaatgtatgatggttcggacatatgggttgtttcctattttaggctgttatgaatgaagctgctctgaacattcattatagatttttgtgtatacaggtattttttagaaaatagagataagccaggcatggtgatgtgtacctatagtcccagctactctggaggctgaggcaggagaatctcttgagcccaggggttcaagatgagcctgggcaacattttggagatcctgtctacaaaaaaaaaaagatggaggtagttttttgtaatggcaagattgtacattagaagatagaaaagtaggttttgcatcttactagggaagatacatgtatatttctctccctttggactgatcatttaagttgtttcaatttccttatcaagaaactggcataatatatgttctgcctacatcccagggtggttgtatagataaactgagataatatatggcctcctcccaagtaactgggattataggtgcgtgccaccacgctgggccaatttttgta

SEQ ID NO: 55877 - DNA, 2534 bp, Homo sapiens
attatttgatatataagaaattccaagtccaagcatggtggctaacacctgcaatcccagcactttgggaggccatggtgggaggatcacttgagtccaggagtttgagaccagctgaagcaacatattaagactctgtctctaccaaaaatacaaataagttagctgggcatggtgatgcactcctataatcccagctactcaggaggctgaggtgggaggatcacttgagctctagaggccaaggctgcagtgagccgtgatcatgcctctgcaccctagtctgggtgacagaaggagaccctgtctcaaaaaaaaaaaaaaaaagaaagaaattccaaatttaatatagtcaaatttactttttgttaaagaaattaattttctttactgttttgatttatttaaaagacaaacacacacaatcataaggatattcttctatattttcacctacacattttgcctttcacataacgtcttgaataaacaaggagtaaattttcgtgaacagcgtgaggtagggatctaactttattttatattccatgtggctatatttattaaagggttcatctttttccccattgatttgtaatgtctcatttgtacatacattaagtttattatacatatttgtgggcaagatgagttctccatcatgctgtagcggtgctgccgctggatgtgcatcaggggttgctgatgagggagtcaaatattttcccctttgaggtagcagcactaggctgtccccacagctccaaccagaatagctctgcttttatgttcacgatattgggtgtcccgctaagattttatttgaataactttttagatggaacaattttaaaagttaaaaactaccatttttaaacaaattacattttggatcgttttttgagatagcaagggtttcgtctctcatcttgggttggatgaaaagtgtaagacaacacagaactcagaacctagcagcgagggaagtgcctgtttttcaaagggaaaggaatgtgttattttgcagttgtcagtagttccaaatatatcaactattccacaaaataatgagtatgtagtttccgtgagagacttagaactgtctagagcctagtccttattgtctgtgatcatagaaaccatggagaaaaaaagcctacctatacgaaagtagttaaaaaaaaaaataacccacagcaatacaagaaatgacatcagccagcagatgactgaaaatgagtggtgttgataagaacttgaggaattttgagatgggagaggtgtgggccagaatgaataagaccttgatttatggactaggatttggctaagtcgatagtaggaggaaagaacagaggcagtgtgtcttccctcagtggagttcccacagcccccaccgtgcttaccgctcctgcatcacttcctacaccctaatacaatgatggttttatccaccctcacccccacccccacgctccttcccccagactacactcactaccagaaagcttgtgagttctttgagggtgggcagtgggcagcctgtcatttcaacattcccagcctcctgcaccatgtttgcatgtggtaggcacccaataaatgtgtgctgagtgagggagtagactcttgggctggagcagaggagttatagacagaggagtaagatcgaactggatagtttttgatgaccttgaagatcagccagagtctggcttcatactggggcaacaaagaacagtgggggcactctgagttgaagagtgatgaagtgtgatgaagtcatttcagagggactccctggttgctctgagttgcctggctgggggcaagaggcttgttcctgcccacacagcataccaggccttgtggtgggtgctgcaaacatgctgttaaatgtgatcaattactggagtcacctgtgagggaattgcgagtccccatttactgaacaagaaatttgagtcaggcagatgatccgaggtgatggtgacccatgatggaatggggactgcagctcaggtctgtccaactctaaagcctgctggttcttttatcttggatcttatgtttgaccacactgtaatcaggagataccactaagatgggaagatgagctgccgagatgggtgtggggcctaggggtgaagtaagagtcaggaatgcctgaggtttttagtttgggagacagggagaacgatggtggcaatggcagaaatagacatatggaagccaggaagaggtgcagcagttggtgagagaatgagcattattttagataccctgagtttgagatgacagttccattcaagcaggaatttcattaggcaagtgacaatgccacccccatccgcctttcattaaatctgtcattttcttttcttctaaattgggaatgttgcagagaaactgtgaaatagatgacacccctcttacgtgccaaatacctgacctccttttgcagcttcttacctttcactttcagaaatattctcccttgaaggggcttcgtgtttgtgtgcaggaattaatag

SEQ ID NO: 55878 - DNA, 1048 bp, Homo sapiens
cttgaagtatgactgtgccaatactgtactcgctatttaacaaaatgaggtcataccaatcacactattttgcacgtatttgtttacacatctcttgtctgctaagctatgagctctttgagagcagggactgtttctgtttatcgttgttttctagcatctagcagagtgcttagcatataataaatgtgtattggatgaatgaatgaacgaatgaaattctttgcatttttactcggttagagagattttttgaaaggcatatatgtgggattatttgtgccgtcatctgctaatttcacagatgtcttctcaactgtagaccttcatataagggaaagacctatttacccatagttgagttgcagctgctgctgccctggcctgatggcacagtggtgagggctgtctcaatatctgtcccatgtctctttcatagaataataccctccctcagccccttttccctgtatcttcctttcaagggttgctgtgtagttaactctgcctcaggcaatttatcttatctgtacttttctcttcctcattcctcttctcttttccagtgcttgtccagtaacctcaaggaaatctgttccaacccttctttgctgttggtgtattcctattcatgagttaaatcccaaacaaaacatactctaatcagggcagtcgaacttgaaaagagtcagtgagaaatctgaaaggaggaaaagcctggccacgaggctccaagtgaaatgaaagccataaacaccagcttcgtcaaccttgaaagcttctaaaagtgcccctaagcctccttttgaatcactaaaagttttcacttacctccctgtctttctcagataaaatttcctctttctcagccatgagtcttaaaaaacaaagcaaaacaaaacacttcacacctgcttcttattcagttttacactagtggaaagagaacgggatttagagttggaaggccaacgtgagcgtcctgctgccacttagtagctgtgtgactctgtataagcttctaggctttctgtgcctcaatttcttc

SEQ ID NO: 55879 - DNA, 1306 bp, Homo sapiens
gaacaactcaagtttcgtcctgtcctcagtaagcagatgagaggtagggttgacgttagaagccaagtttttgtggagcaataaggtaaaattatgaaggaagcctatagaattccaggagagtttaaagaaaacagtagaatactttcttagcaagggtatgggtgggcttctgagtggaggaagcaggctagaccttgggatgttccagtccaaattctgtttcggaagctccctaaatgtatgcagaggttgtgtaattgtattcatcactgttgaatgtattattggtttgatttggtttcactgctcctaagttccttttgtcttatcttgcaagcatatcactgtgagtacttaaatcattaacaactcattaaaactcttgaccattttcattttctaccaagctgaagcctgggtgtggtggaaacttgtgcaggcctgcttggctgtgccgcaactgagcagctcctagcagtttggctgtcaaaaggtcactgaataaacaaattgataggaatggcggacataatctctgcagttccttgaaaagaaggaaggggctgcaggatacaggatagtgaaggatccttctcttcaacctgaaggactcttcagcaattaacaccttgactctctttttatgcaacactttttttttgtcctctcagagactctatttgtacttggtcttttcttctttcaggatttctatagcttcttttagagactcaaagtgcttccagttttgttacctcatttattctctaggggcaggaattaaggtcttgatggagatgaagtggtacatcacttactgggctgtggaggcagtctacaacaggcagttgcagcagttcttctggttacatgttgagagagagatatatatatacacatacacacacacacacacacacacacacacacacacacacacacacacacattttaccttatttaggatctcccagaagataattttaactatttgtaatttctatatattttaaatagctgatttatgcctcataagtaaagaaaaaaggtttctctgcttttgacttgaattgttgaactatttgtcccttggtaaactgatcagttgccgtgcagattgagagaaagccattcaatcaatcaaaatgtttctactgcattggcatgctttgtaatggaaatgaaaatgacagcatgtttttgtcagtttaaatgaataggtttcctttagatcgatgctgaagttggtattataggtatctagcctatgaatgctaataattaattacggaaatgcctcatg

SEQ ID NO: 55880 - DNA, 1051 bp, Homo sapiens
ctaattcattcatgtactcaacacatgattatgtatgcctactatgtaccaggctctggtctggtgctagagatagagttattaacaagactgaggaagtccctgctttcatggagctgtatttgtttttttttttttttttttttttttgagacggagtctcgctctgtcgcccaggctggagtgcagtggtgcgatctcggctcactgcaacctccacctcccgggttcaagcaattctcctgcctcagcctcccaagtagctgggactacaggcgcccgccaccacgctcggctaatttttgtattttttagtagagatggggtttcaccatattggccaggctggtctcaaacacttgacctcgtgatccgcttgcctcggcctctcagagtgctgggattacaggcgtgagccaccatacccagcccagaatggtattcttaacgtatggacttaaaaggagcatttgcaaggaagagtggcagtggcagtattgtatggggagctctgattctcatttatgcaagatatgtaatgcctttctaaagaatagtgttgctacttacagctcgggcttggagataagacccactactctgcaggtccacttgaacttctttgtaagcccacttgaactaatctggaagagtttcaagctttggtaccctatttgccaacagctgggtacaaaaccacctattgggtatgattttagggctattgtcaaggtccctgaaggtggatagactgaagacatctcttctactggtagctttatctctttaaaacattcttttattgtatctcactcaaaagactagctgtttatttatactttagtatgagattccatttgtttctttacaaggttttgataagggtctaagactactagatgccagtttagtgagggagggcactctgggggaagtaagcaggtatatggggctaaaatcaaaaggttgaagcacctccagtttgacctacttaacaattttgcttagccttgaactcttggcttctctgataattagttttctaattttt

SEQ ID NO: 55881 - DNA, 1045 bp, Homo sapiens
ctaattatagttacctcctatttgcttagcattttgtgcttttaaaaatgggtcttatttcatatctcatctgatcttaaatatcctgtgagctaagcaggtcagaaattatcattattattattttttgagacagagtctcactctgttgcccaggctggagtacagtggcatgatcttggcttactgcagcctccacctcctgggttcaagtgattctccttcctcagcctcccaagtagctgggattacaggtgtgtgccaccatgcccggctaatgtttgtatttttactagagatggggttttgccatgttagccaggctggtctcgaactgatctcaggtaatccaccagcctcggcctcccaaagtgctgggattacaggcataagccatctcacctggccagcaggtcagaaattagtaatcccatttaaaatatgagaaaactgaagcattaggtaggctaagtgacatggccaaagtcacacagttaatagggcaggatcagaatttagaatgcatgttttttcttttaaaaacaactttattcaggtataatttatgtgcaataaaattcactatttgaaacctatagttcaatgagttttgacaaatggtatatacttgtgtagccacaattataatcaataggttgaacatttctatcaccccaaaaagtcccttcacggtccttggctttaatcttcctctttccttccccaattccccctgtcttttgatgtctaatgcaatgctcttttcactgtcccacactcggacttgacagcccttcagccatatccttctggagagagtcctggctggcagccagcctgcctcatcatgttgagttatgagagtgaatgggaagttagtgggttgcttactccattgttagttccttccttcccttcttttaccagctccaggctatagaaaaattatgtgggttctccttcccaggagagcttgaaaaacaggacaccagctcacctgtctgctcttgcttcctggtagcctgctgctggggaggggtgggag

SEQ ID NO: 55882 - DNA, 1059 bp, Homo sapiens
agcctgctccttttcatagccagctttgcctccataccagcaagatggaagataggtgccttcactaagcccctcaggtggccacaggatatgatccagaatggtggtctctacttttctatttgctcctatttagccacccagtttgggagtagccctgtgtattatgattatctctttcattcattttgggctatttgagtttttagggccctttcctatccattatctcctgttctcaataagtctgatatcttctgttagagtaaaagctccatctcctctgatctaagacagctgcaaggacaggacagactcagatttcttctctgcaaaggctcctgttaaatcttgggccctatggtattgattttcttctagttatctctacaaatttttctggctttgctgaagggggaaaaaatcaccagactgcatgcttgagcttcaggtttctccttagctggcagcctcaaccagaaaaaaattctttttgagagcactgagcctcaggcactggttttgccctgtactccccagtgtctaactcttaacagctggtggccatccctggcctccatctttactttgctgcatacctcagcttgatgagtccttgatgttgactccttgaccttactgccatcttctttcccctgcaggggcctcttgaactatggggagcttagaaaacagtgggcttcctgtgttttgtctaccagcaaagctgggtacctgaatccccatgtgacagtgctgcatggctgactccagtattcttcaggagacacagtagcaggaacagagacttagttgaaagccccaagtgtgtatatctgaagtgtttgtacaaagatgggggcagagagctgctcatgtctgcaaagagggacagtcccactcttgcagaggtgacagtccacagcaatgctgtctcttccatttctcattggggttaggtttccaaaggtccatgaaggttttattcgttttcgtgccccaagagagctttccatagtaatgaaagaaatgttaagaactgcaggaaatgggtaagat

SEQ ID NO: 55883 - DNA, 1068 bp, Homo sapiens
gtctccttcctttattcttcatagcccttaatcacttctcattagtggactccctgggagggagggaagaagggttttgttctgatgccagcctcctggaagggctgtatcccaccaagacagatggctgcctagcctatttttaactgtctctggggaagaagattccacaacctattttgaaacctgtttcattgattgacagctttccaattaggaatttcttgctgatacctgacttaaaatttgacagctatagttgaaactcatttccttttgtttctttgaaatcatagagtttgggaaagagagggattttaattagaagtcgtctaggcctacccctaatgaagaaaataagttgaagttgaaactgaaaatgcctcctcatcctctcattgaggatcccatcagttttgggatctgcctttgaaatcacacatttgggtaccattctgtaagaatcaatttaattttcaggggaaaaaaagtgttctggagctggaagtttagagcgcaagtaagtcgttaatacgacttactctattttgtttgtagtgagaaagttaaatggtgcttatagaattaccttgcctctattggcagagagtaaaaataaactgagctctcaatatacaaagacttccccagttcttttcctttcgctcatatcaatgcctgtctttaaagaaaaaaagagggttatttttctctcctccatcagtgggattctctgtattttaaatatcttttttaagactaatgtcaggtgactcaaattccactgaagtctctctttttagttgtctttctgccgctgcagacttctcttgacatgagactctgtgctgcttctcttgacagactgcatctcgatggcagaacactggtaagaagctaatgatgttggttccgtttcagtgtgtggaatcttgttatgtggtatagaagtccagcattctaggcgaataaaccgaaaggtattagactgactataaaggggtcttgggaagggatcttactcctctttgatagttggtacttgtaccttttctcaacacctgtgac

SEQ ID NO: 55884 - DNA, 1052 bp, Homo sapiens
tctgttattctctttccaatgctataattaatagtctggtctaaaatataaaaacctcaaagttattaatggaaatgtcactactcacctcatttttacagaggccgcttggcctctaagtcattgagtctttggacaaacatcatttagcattgactatgtgcaagaactgtgctgtatgctggggatttaaagacaaagaaatacagtttctgcctctgagccgtgcatcatctcactggtgaggctcacatacaaacaaacaggcagaattcagtgtaattgagaaatgttgtaattgagttatatatagggttcttattttgcacgtctctgtagagtagtagtttccatactgtgcggtatttgcctgttcacttgcctgttcctttgtgagctctcgagggccaggaacaaatatggatataaacatggaaccatgagcgaatagatgtttcttatcaatgctcggcctgtcttacgaggtgttccatagtggaaccacctgggaaacaattgattttgcattcttgtttgttagctaaatgcctgatttgctttttaggattcttttaggttaaatcatatgaaattaccattttgttgataatttcacatggttccatgtaataaaaagagatcaattttacagacttctggtttcaggtcatgcacagaggtgaagttctgcacaggtactgggcatcctatatgtatttccactaggttactatttccgagtgtgagtctctatttggaacttcagagagggagcctgtggcccagctactcctgtgtcactcagctctggagtggaattcttctaggtagtgcctgtttgtagactggacagggaataaaaccactactctgtgcccgtttataaatatttgcatttaccttggagaatgtacaagacctgggcttcatgcgtgtgtgagagaaaatagcaagtgaaaaggatgtgtacacagcagcatgaatggggtgctattcttagctgggtctctaacctagagaacaggaaacaagatgcttctgaatgtggacta

SEQ ID NO: 55885 - DNA, 1526 bp, Homo sapiens
accggctgtagacttgacaactgttaacttggtgaacagcatgttcttgtttatgttaactgtgtactttgactgttcaagatccccattacttttcacttgtcatgccacatcattgctgcaagttagcctccttagataagatacatggcagttagctatcttcacctgatggggaggaatagggtagagaaaagaatgtgaccagctgttgtcagcttctccgtggaagtggtaaccatgtcagagccaggccctggagacctggcttggaaaagaatgaagttttcctactaggaacttctgtagagccctagacctttccatcttagtgccgagttaaatgagtcacgtagccttcaggtaaagtcatttccaagggattgtgagaatgtgcccaggttggtttggactgtgtcacacttacttgtactggcttatctttgctactaatttttttgtgtgtgttattgttcttctaactattgttgatgatttgagtgatgcgaaagattttgatgatggtaactttctataagagatgtagaagcaagaggcccagagaattgatcttgcccttcatctgacacattgtgaccagtttgttgaacatgataaggcctggaattgtcacttcgaatgtcttcttaatctgggaaatttgaagaggtctgcagcagggaggctggtcagggaagtaactttgcaaaataaaatcttcatactgatgcaatcccagagaacttgcctttgggtttgtgattgcaaagtgttgaatcagtctttggtgtggatacagaatatttgaagctagttgaagtgtaggggtgttgggacaggagaaatgatgagatgaagtcttatcagaggctgaaggtcaccggatattttcctagtaaaggttcctttgatgtggaatttatccgtttagcccacctaattggagttatctggtttctgtccctgaagattctgctgttggccctggactacttaattctgtttgctcaccaaatcggtgacataagttacaagttatgagatttaatgtttagagtatggttttggattataggttccttgcattcttaagttagcagaaggaaaccaagagaagcagcatggtacaaacaaaaccccaaacaagtgctaatgtcagagagacctgggttcaaatcctagctatgccacatataagttttatcatgagagtaaattgcgtaatctcccagaacctcagtgttcttgttgctaaatgtgcacaaaataactggctatcttatagagacgttgtgaagttagagtgagtgaaggtgacatgcctagtaaggacctggcacgtagaagcacacaatcagctttaactgtttctgttattagcagtggacttagcactgtataaatctgtccctccatgcttcccacttgcccatttgtcaaatggacttgacattccttactcagtggttgacagggagccaagtgagatatctgagctgttgaggatggatgtgtatctcaagatc

SEQ ID NO: 55886 - DNA, 1026 bp, Homo sapiens
cgtttagcttcattaggttctgcagtagtcccaagattttccaagatcatcctgtcctccagtgttctattgattcaacttcagaatatatcccagactctgtccctctttactcctcactgctgttgccctgggtccatctgccatcatctctcacctggattatctcagtagtttcccaactggtttccttgtttccattcttgcctccttctgtctactctcaatataacagctagaacaatccttttacaatggaattcagatcatgtttacccctctgttcaaattctccagtgactttccagtttttacatgatctggctcctactacctgtctcactgtgtttcctactactctcctgccctttctcctcttaataaacactgggctcatggtgtttcctttaacatgccaggcatgcttgaccctgtcctgtctcagggccctgctgttccctctgcctggaacattcttcccatagtgtctgcatggctcgctctctcactgctttggattgctgctcaaaagtcaccttatcaaaggcctttcccaaaggtttaaaaatcattctactataaagacacatgcatacatatgtttattgcagcactattcacaataacaaagacttggaaccaacccaaatgcccatcaatgatagactggataaagaaaatatggcacgtaagcaccatggaatactatgcagccataaaaaagaatgagttcatgtcctttgcagggacatggatgaagctggaaaccattattctcagcaaactaacacaggaacagaaaaccaaacaccgcatgttctcactcataagtgggagttgaacaatgagaacatacgggcacagtggggggaacatcacacaccagggcctgtcggggggtgagaggcaagggaagtgatagcattaagagaaatacctaatgtagattatgggttgatgggggcagcaaaccaccatggcacatgtgtacctatgtaacaaacctgcacattctgcacatatatc

SEQ ID NO: 55887 - DNA, 1263 bp, Homo sapiens
cggcccttatatatattttttaattgaagaggtagagaagcaatctcaaggtcaggacaacttaccctgaggttctcacttgtcagggattgtgctggattctgacttaggttctgccatcaaacacagaatgccctgatccttagaggcagaggcagctctttagcctatagggtaaataaccgggaatggaattctcaccaattcttatcttctatgctaaaagttttactttaagatttaggcctgcttttttctttctctctgtctctctctctttttttttcccccagtaacagtttaaaattggtgccttagacgcaagcaaaaagatattagcacagctttagaaataagtgtgagtccgcatgtaattttttagtttctcctctcccttcgctttttgctttcttggtagtatgctaattgtattctttttctgcatcttttttccccattctttggcagatattattacttgtcttgaaagagtaggtgaagagctgtttttaggactctttgaaagggtacagtatggatgacagtcttggctaaatgtaatcagatccaggaagctggagtcagtgtgagctggaatcagttcaaattagcaaagcactggcgctcagtggcaggaatacaagtgaccacaaagtgttaaacacatctggaaagggattctgacatcatcctgagaatctttggggaatacatatagcctgtagacccattcctctttgaccctataaagattctttaaagagtaataccctgagtggttttctggccagcttgcctgctcatttatctttgaggagatggaaggagacaatatgcctcgtggagatccacaggccctagaggtgtatggattgtgcatttggaagtgctgaagctgagagactgggtctcttggtggaccccaagggatctgcttttcctctactcattgtccctacacaacttttcctggcagctggcattgctgtttagatgggttgttctttgctgtttaagttgtttggcagtggtgtgtcaggatgcgggttttctgaatactttcccagctggttacttgagtggtggttagggaggggctgttctggggctgctctggagctgttgaggtcgggtgtctgtctggatactcacagctggtctgtcgaggagaacgctgttctcattctgctgcctttggtggtgctgtgtgtggctctttagatgtgggtggagatgagttgggggagttaatgagatcttttt

SEQ ID NO: 55888 - DNA, 1049 bp, Homo sapiens
tggtacagagaaagctttctcattcgtatatcagagctgcatagtattccattgtgtggatggctgcctcctactttattgaatcagttccttacaaatgtgcacttgagttgtttccagtatttgctattacaagcaatacttcagtgaacaaaggcagctttttaaagggtcgcacagcactgcatatgctacttaaaatgagattattattcttcattcttagaatgccagttggttttgttggttgataaattcccaattactcgtattcatgagtgcaacattgatgatgaatgtgacatcccttcataacttaagaatcattagtatgactgccccatggaggcatactgttctatctcaggtttatttcaataataaaacctttggaaattttaataatgaaacctacttaagaccctttgcttaagaagtctgaatcactgatcactgcaattactgccatggcagctgtagagcaatttaacaggataatagtgaataagataaattacacttcagattcttaatggattgatgtgcagaagtatgcaagggaagatgggggtgggagaggagcgcctttaaaatttcagcacacagtaataaaatagggaactgggccattgtagccgttactactaggagttagtaatctcgtacaaacctctggggctctgtggtgggtagaatgtcctgtttattatagacaacaaattgggttaattctcttgtttgtgtgcctctgtggagtgggtggaaattctaggtgacttgctaattgtcttatttggaatactcccgtttctactaaagaattagtatctttggtataaaaataaggaggcagaccagttttacaaatagctgctggccaggagaataacagtttctgccaggtgagcagttaaaaaaaaggcagactggaaaaataactgtggaatggtgtttcttatttacaaggctaacataaagtctccctgtgtgttggggatgggggaggggacggattggctaagaagtaagtacggtgcttgctttgtatg

SEQ ID NO: 55889 - DNA, 1031 bp, Homo sapiens
ctccgcctctcccgggttcaagtgattctcctgcctcagcctcccaagtagctgagactataggcacgcatcgccatgcccagctaatttttgtatttttagtagagacggggcttcaccacatttgccaggatggtctcgatctcttgacctcgtgatccaccagcctgggcctcccaaagtgctgggattacaagtgtgagccaccatgccaggccccattgccttctaatagcccttttctcttaccctttagctcttggcgcttgacttcctatgtccatccccaatatccctactccgtgaaagtgaggtgaaaatgccatcatctttctgcctgtcctgcttttaatcatcttccaaggcagcagcaagtgcaattctagtccctttcaaccccgtccatgtgggtgttagactgattgtttagcttctttatgaagatgcacattagccattcagaaacttaatctcataatgatttgtgtgtgttggtaaaaaagaaaagccatgatctctgactggtatactcagatgttccctttggtcactgatggcaggatttcagaagcgaaggaccatttaatttaattttgcagatggcaggaggtaagcaggaaagcttggtcacaatatgccccctcctgggagagtggcttcagtaaattcaggttgccgagagccttagatgtgagaaatttaaccctctgccttctttccacttcccctcccttatataaaacttggttgttgtttttgtgtgtggggttggggggtggggtagggggtggagttgaggaagggtgggaaggtggagtgaagaaaattgcctgggttgaaaagccagtgactgatgtgagattaccttgtagtgatgttgctttgggcatatggattatgaccagatacagattaacccgttcctctataattgttttatggcctcatccttctgaaattgcctccttgtggcctgaaatcctttctggggttttccttaggctgggaactctgcttgcagatgagaaata

SEQ ID NO: 55890 - DNA, 1029 bp, Homo sapiens
ttctgcctcagcctcctgaagtacttgggaccacagtcacataccactatgcctggctaattttttaatttttaatttttattttttagagacagggtctcattttgttgcccaggctggtctcaaactcctggcttcaagcaatcctcccacctcagcttcctaaagtactgggattacaggtgtgagctacctgtgcctggcccaggttgcattttaaaataaggggtagggagcttttagatgaggcctcatggaataggtcacatttgtgcaaaaatttaaaggaggtaagagtgtaagccacgtggatattgggggaagggcatttcaggcagaggaaacagccagtttaaaggccttaaggtggagccctaaggctcaagtgtgcttggtgtatttgaggaatggcaagaaggccactgtggctgaagcagagtgctctggtgggaatgaggcggaaaaggactaggagatgaggtcagagaggagagggtgagaggtttttaggaggaagggaggagatgcctgattacatcataccatgttaggctgttggcttttattctgtaaatatctatatctacatcaattatatctctcaggacttacaactttccatctttatcgtcttctgaactccataagatctttctaagaattgaggggaaagttgattataagggagaatatacaaaacctggcatcgaagccttactagagacctggaacctactctttttgggacttggtaaattgatgagattccatgcgcccccaccccccattctctggcatacagaacaggaatacttatatagcttactctcaacccaacctttcccttcgtctgcttcaagaatctcaaatacttacgatttttggcatatttgacattattttagttaatttctgaacatgttttcccactgttaaccctcttaccccagacagcattttgaaacacttttttcttttttttcttttttttggcagggtctctctgtcaccaggctggagtgcagtggt

SEQ ID NO: 55891 - DNA, 1077 bp, Homo sapiens
tggatttgaacagtaggatgttttttcagaggtgtgaaatgatcaggcagcttgataactttagacatactgtacgttatgaagcattttcttgcttcttgttgtctttttctggtggattgagtcaatgcagttggtagaatcttttccacttatgttattgaggcatgtggttgaaaagtggcctttaaatggtgtgaggtgggtaggcaggggataaattcttaccacagtttctaggatgaggaaagtgaaactcagaggcccaaatcttctgactcacacagtgattctggggctgtctgtaatatctaaacgatgagactgatctacttgcaaggtcagggcatgtggtcattttcttgctagcctttggatcaccaggctgtcagcattttgagggggagtatttgcatcttgctttatttggaagattcagcttgagggagtcattattagaagattcttagaacacttgagccctctgaaaatgaaaagtctcacatttcccttctactttggctctctgttggaggggaacacttatgtcattaaaaacattgtactttgcttatctaattcccactctgtgttcacattaatagcttcccattgctcttaggaacaattccatacttcttcagactatttgcaatactcaccagagcttgacccctgcttctttcaacagtctcatctttttttcctcttctcatttaaattctatgcttcagttaccctgaatttcttcgattatttcggttccttgcatgcagcttcttttctgttgcctctgggcctttgaacatgctgttggctggagtacttttcctgccttcttcccataggtaattccaatcctttacgtctagctcctctgcgagcctcttgctgagccctagaccaatttctgtatactcctacagcatcgtctttttccccgataatgggctttttacattgcaattacttcttatggtagtctgtcttctctggtagactagattcctttggaaggcaggcccaagaagctggtttaaattactggagtctgactaaaaagacttttatattaga

SEQ ID NO: 55892 - DNA, 1079 bp, Homo sapiens
cctcaaataaccagtgagtatttattgattgaccagttctgtgcttgtacaaggcattggaaaatacaagagaagtttagggagtcattatgtggttggagagaagattttgaatacaggaagcaattagagcataaagcagtaatgatctcattaattggtgttatgtacaacatagatctgatgagaggtcagagatggttaaaggttctggaatagtctggaaagttgtcatgaagcaggtgggacctaggcttgagaggtagatttgtgtggcagaggagagaacagcaagtgcaggtgagaggaagcaggaatatttggtgatgagagggtgtaggggctagtgtgggatccagctttattaaagggaaggttcctaacacattcatctaactgatttccattgcacattccttgaactcctttgtgccttggagtgtagcagggaacaaactgctacacttagcacttagcacttagatgaagaaatgggcatttaacaaatcacacaattagatatgtaatttaaagttggggtaagtgttgtggaaggaaagtatttaatacaaggtggcacaagaacctggaagagggcaacttttccactttatagctggtttactccaatagcttcctgcctgatcatattctgggtaacaatcagtctacttattcaacaaattacttttaaatacctactgagtactgtgctctgtgttgattcctataggaactaacataaacttaggaattcctgtttaagcggagcatggtgacttatgcctgtaaccccagcactttgagagggtaagataggaggatctcctgaggccaggagtttgagaccagcctaggcaacatagcaagaacccatctctacaaaaaataaaaaattagctcagcatggtgatgcacgcctgtagtcctaacttctcaggaggtgggaagatcgcttcactccaggagttggagcctacagtgagctatgactgcaccgctgcacaccagcctgggtgacagagtgagaccctgtgtctaaaaaaaaaaaaaaatccctggttaacagggaaaagagc

SEQ ID NO: 55893 - DNA, 1038 bp, Homo sapiens
accatggtgtgtatcaggctgaacatggctgtggggccaagtgccatgcacaggcaccagtggatcaggatctttgctctgctcctgactctacaagttacctctgtcaccgtggcctccatgggcacgtacaagctgttgggcacaaagtgagccactgtggggagagtgagaagatcacggcagactcttcttccttggtgactctgtcagatagatcttctttaagatggaaaacctccttcatctctcctacaatgatcttgctacttattcctgagcagtgttccctaagtatatttgggtgtccacagatgctgctagtcttgcctgatatttttggagttgccattttcatgtttcagagctcagagcaccgctgtcatccctaaggtggtttgcctcactataggagctgtctgcaagcaagaaaatgaacactgctaacagtgcttgtgcttggttctttccctgaaagcaagactctagccctggtacccctgggtaaacataaggccaggattccagttctctgtagaacatcatacgttttctttcattcatggattttatagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggtatgcaacagccaatggggcagaagcttcatctcctctttctctgctgcctgtttgatttttcttcaacgacagaggtttggactgttaggggcctaaatgcatcaaaacctagacagaatcgagaaaccatcctcattttccagttgtgtctgatttaagaaaatattttagaaaataagtaatccacatcaggttttgatctgcataccagttctgaccagtagttggctaatcatttaaaaagaaacatttttattggttttctctcattttatcctgggagcaaagaggcaaaatgtttctccca

SEQ ID NO: 55894 - DNA, 1040 bp, Homo sapiens
tgtatgaacagtcttaattttaatcaatataaggaggaagacacaccctagatttgtgctgtccaatagggtagccactagccacatgcagtcatttaaatataagtaaatttaaataaaatttaagattcaatgctttgaaatgtgagccatactacccacatttcaaagctcaatagccatatatgactgtgtccactgtactgggcaacactggcacagaacattgctgtcattgcagaaagtcctcttggtcagtgctgccttagacctttgcccataccacaaactgcagctacttgtaccttagagcaaggtgtagatgtttgggccctagagtggctgtgtccatctctggagaatgaaaggatgggttaaatcccacggggataaagcagtgcaagaaacccttcaggcaaagggtgtctgcatagaataagagtttgagagaggtgaggaggaagggaggttagaggaagaaattagggaacaactgaatcctttggtgtcttgaatcttgactagacctgaaccttactaggacacaggacccccagagggaagttcctcagagagattgtcaccctatgcacaactgatcccaacaatagatacctctgagagattcagggcagctctaatctccaggcactcagtggtggggaaagggttaagcatgttggactcatattatggaagagaaagtttttatgtagccaggcagtggggaataattcaggctttcttgacattcgagtggggtaaccagtgcatccgacagtcggctccttagaaatgggtctgtgcaggcaaagtcagcttatgttgtgaggctcaggctggagtatgagtaagaaagtgtctgtgatacaaaaagttctatttttctttccagccctgctggctagggagaatttctgccccatgtatatggagaaaggaagaaatcagagtcagcgggcaaaaagagtataatttaacctgctgtctggaagccatctgtgaagggaatcacttttcttttctggacttgtttccag

SEQ ID NO: 55895 - DNA, 1014 bp, Homo sapiens
tcaagatcattcagatagtaacatcaagtataaaacttccttctgctgatgctatttaggttctgtggccttcaactttctcagtcttcaacttataagcccatggactacttcagtttacttacaataacaataataatattgtttaaggatggtatttattgagtacacactgtgtaccaagcactgttctaagcacttcaaaatcagcaaaccctttaaagttcacaacagtatggagtgggtaacactcttaaccctaattattaaatgaagaaacttagttatggaaaggttatgacttgcctgaagtgacataactaacaataaaagcacaattcaaatcaagacagtctatctccatagttcttgttcttaattattatgccatactcaatttaaaaagttctacaaaagtatgaatttttgcttcagtgataagaataccttatatttgcataacgcttacattttcacccaaggattttatggtcttatgttttagaggtttatttttgtgtactttgtagaattagatagctgatagaaaatacttttctaaataagggacatcttggtatcacctccattttgtattgttcagagcctagaaacttccaagaaccacaagttgagaacttttattgaagcctcaaataaaagttttttataaaattgccagtctaacatgtaaaacttaatctcgaagaagcaagttaaatgaacagattcttagctcccagagaatctaaaggcggcaggctattttatattttatcaaaaaataagcagacgagtcatcaatataaaatcataggtaccttaaattagaaattcaaaatattccaagttagttctgaagacagtgtttcgttgtgcagtaaaagtttagaaaagggtatcacacaagagaagttctctcatttatttaaaaaaatggaaaatggtaaaagatgtctaatgtcttgtatggaccttgtatgagataacttactcttttattcccatattttc

SEQ ID NO: 55896 - DNA, 1305 bp, Homo sapiens
gactagtttgtcgtgtcattacaacaaggcatttagggaacatctttccttaattttactaatagaccaaccaaggaagccttctgaatcgctagtaagattcagctctgggtgattcttcatttctaatggctcatagtgattacagtttatgttaataatcactcctacttctgtcaacctccagcaagagtaaattgatagcaggataaattaaaagtctgatcttaatgtcataaatgtgactagaatatggtactaactttttcgggtctagatagctggaatgaggcttgcaaacagtgttatctggagagagcttgctggtctaacaactttgtgtgataatttggcatctgattagagagcatgagtctgataaattttataatccacacagagatcatgctgtggttggacacatcatttaataatatttagcatgatataatattccattttctctacaggagcacagactctttctcatactggattattttacctttgacagtcatttttcaatgacagtaattttaaataaagcatcgtgtgcttatagaacctgtgcttgagtaaaaatagtcttcaaataaaaataatgaagtaaatttttacttaggccatgcttaattggaagcatagaacttaaattgagaaaaaaatccatatgatagattttgtttttctcatgcttcccttttgaataatagcaaataatgcagagtaatggttctaagagttcagggtagatgaagtctgtaggttttagaagtatagagttgaaaagaacctccaagaggacttatttaatgagtgaaataaatgtccttagatagatattgtccctaaactcttttctattgaaagtttatagtattgaaaatttgatgattattagtacctagtataaatcaacattcatctgatgttctctttttagatagccaagttataacttttttgaaaagacattattggactaagttagtaggtcagccttttcctttgatagtgtgtactcttatctgtcacccaaccttctccacaccctcttctcttcattcagttgtggacagcagtaattttttcaggacctttgcttcttagaggaaatacatttttccttatttatatttttaaaagatgtttctattacattatatatagcaagagatctattaaggatccagaaaatcttaacctgtagaggatatgagttcctcatcataagaattagtttccttgagggttctttagtatattctatttacacagtttatgcataagtaaactctgtggccg

SEQ ID NO: 55897 - DNA, 1050 bp, Homo sapiens
tgcagatgcttatgatactgaagaggggagaaaaaagagggacaattaccggggctacccactttgtcatttgttttatggattgctctgagcctcagtgtcaaaatcttaagttgggattagtgcctgtttcacacagctattgcagagattaaataagaagacagcttttgtgtctaaaacaatgccttgcatgtagtaagcactcaatgtatgttcatttcttttctgtgatccatgtcctgttaaaggctgttctattataaacgtaaggctatgccctgtctctactaaaaatacaaaaattagctgggtgaggtagcgcgcgcctgtagtcccagctactcgggaagctgaggcaggagacacacttgaacctgggaggcagaggttgcagtgagctgggttcacaccactgcactccatcctgggcaacagagcgagactccgtctcaaaaaaaaagaaaaagagtaaggctataatgggcactgatattcatttaatatcatcaaagaaaatatattaattgggatggctaatatcatcctgggaccaccaatagctatcatgatgaatatatttttcttctacctcttgatttttggtcacatatatgatacctctctggatcattttatattctcttcatttttgttttctcattttgccttccctactagccccttttattctttttcaatttttattattattattatttttgctattcagtttcttgtaatttattgttgggctttaaaaatgttttctttctaccaggaaaatgaaggcagaggaaaggtatgataggaccagttgattgtgttactttttaaagaacctctggagctttagtttttatgaaccagattccttttcagcacaccatcccaccgtcaagtttggtaacaaatgagaaaacaaatatcttcagtagtggttctacttggctcagtcttgctccagtttatatttagtttgtcctgggttttagtttttcagaaacaaaagcttttagccaaataatgaaatttctcttgtttgggcta

SEQ ID NO: 55898 - DNA, 1305 bp, Homo sapiens
cgcagtaaatttgtagttttattttaacatccttagcttgtaatgattactaagaatagttcaataagtttatcttattgtcccatatataaatcattgttccatatataaattgtcccatatataaaatcatacttttttctcctgaatcttttaagtgaattgatattcctataaaatatatctctttcccatttcactatggattatttatctgtgcttatgctataaatctgcctttaggcacatctattttaaatttattttaatttttctctttttattttgaaataatttcaaacgtacagagatgttataagagaaataccaagaactcccatataccctttacccagatttaccagttgcaaatattttgtcacatttgctttataaactctcccactgtctgtatttgcacagtattttttaaaaattcttgaaccatttgagaattagttgtagatagtatactcctttaccctaaatacttaagcattatttcttaaggacaaggacatctcttatataattacagtacaattatcaaatttagaaaattagacattgataaaatactgttacctaatatatagtccatatcaaaatctgccaattttttccaataatgtgaaacaagcatgttgtaagaaaggtagccggaatgtaacttctctcaggaagtgtaagtttgatgagtatgccttttcaactccttgattaaaaatagaataaagcaaatatttggtcattgtaagcatttcctttattaaatcctccccttctcattgaactctgaattacttgctttcgctgaataaacatgtagtgtttgtgtgaattggtacagaaaagtggagagggaagctggggagcatagtacaaatggaggtgaatcagtgttcttaataaggaacagacctgtctttaggaattcatactgataatttatgcaacaaatctgattctctaaatctctggcaaaagatgcaacagacatttttgaagacaaaaaaaaaattttgttggccatgtttaactcaccttactcgttttgccgtttcttccttgccgtttcttcctagcccatgactgaagagttgctgaaacaacaaaagctgaattcacatgagaccactataactcagcagtctgtatctgattcccacttggcagaactccaggaaaaaatccagcaaacagaggccaccaacaaggtatgattagtactatgccctaggagatgacaaggttttcctgaggatgtgactggctctagcctgagtctgtcaacctttgtaggac

SEQ ID NO: 55899 - DNA, 1035 bp, Homo sapiens
cattaaaccccattgtctgaagtatattaatttaagtaagtacttattttaaaccaggagccctctttctctaacctaaggatgctcggaggattctttagagattatgtgaaaaaaattgtcatctgaatgaacacatataaactatggtaactgtatcttcaggtcaagtccctttacttcactaaatttggacattagagctttaagatggtagtgtatgacctttctgctgtgacttgacttacattgtttactgtttctagaaaaacaaaaattaggaggtgggagaaaatgtcattcagcttcaagaaatgtggcatttaattattatgccattttctctaataatttaggatgtcagggaaaatagatgaattgggcccaacatgtttgtaaataaaatgggcggtgtatctattgtttaaatctggttacttttaagctccttaagagccttatgacaaaaccagtgctagatgggacaatggcagactggtttttgtctatttctctgaacaaatatggaaagaatagaaataatataattttttttggtagttctcttttttagtttgtagaaacacgaaaccatgaaagaaaaaaatgtttcctttagttcagttctgccacaaatatggagaaaaccttttatcttaaagagcaagattgttctgtaaggttattttgattcctttgtttaatcctccacttaccatattttatgcactattaaatattgacatcaggattcctcctgattgcttttcctcttttttttctttccttctttccgtctttttctttgttcctttcttatttattaaagaaaaatagcaacagtgtagttctgcttactgatattctgatattatacaaagtaatttatttcccttctacagaatttatgtatgaggacctaaggctgttcagatatctaaagaaaggtttgaagccttcttctagctggtaattcccttctttattgtctggccctgaactagaaaagctatgatgggagggatgtggtccctt

SEQ ID NO: 55900 - DNA, 1110 bp, Homo sapiens
acaggtactattaaaatctccaataatagataaggaagctctgaggcttagagaggatagatcacttgcctaaattcacagctaatgagtggcataatgaaatttttcatcagggtttttccccttggcactgttgacatttggggatggataattatttgttcttggggactgttctgtatattgtgtaggaggtccagcaatattcctggcctctaccctctagatgccagtagtaccactacccttccccactttgtttgtttgtatgacgacaaaaatatttctagacattgctaaatgtctcatgggggcaaaatcaccccaattgagacccagtggtttttattaagtttttgtcgactcagacaaaaacttaataaccactgtactttagtgcctaaccactgtactttactgccttgttctaaggccttttaatgatgtcttacctcttaggagtccaggaataactttttaataaacagatatctcaaccaaacagttttatatttaatcaccttaattgtccaggccagataattcaatgtattttcatttttgtatgtttttgttttcttatcagtgtactttcagtatttacactgataatagatatcatattttaggtatttactaggtgcctgtacaagctgccatattaccgaagatggacagttattcagataatacaatagagagtaaaatttacaaaataatgtagacagagtattttatacagggtgtttcctctgtgtttaactgaaaatttagacttagggcaggaagagagatgagcgtttcttctcaaatgtggactccctaactgataccctgtttatcttttttcctcattccttttatggcatgtttctccttttaggatttttgcaatttctttatctacctttctgttctgcctcaaaattattgtattttctttcattttcctctggcatcgtgaagggcagtccagacttgaagaaagtgttagatctcaccaaataggcagcaggaagctccaagaaagcagatagataacatgttatacagttaaattgtctcacgctcccaatcactgagggttgattaatccacttactgtaactg

SEQ ID NO: 55901 - DNA, 1053 bp, Homo sapiens
aatgataagagctatgaaggcaaaagttgttattgatacaactagttgttcagcagtcttaggtgacagcaacgaaaagtattgcggttgtgtgtcaagttactaccttctatcttttgtaatatatagatccaaatcctacatttgctgttggataacctcaaatttgtttcacagtttttccagttattctgatccactgcattattggattactaatagatatctcataatcatatcatatacaaatttcattaatcttttctagatgaagtagaaaacacaatgaggatatctaaatatttttaggtggactggctaactgtgggccctttgtgactttgatcttgaaagcaaactaaaggtcagtatgtaaaacagtggttaggttgttttgtgagatctagatcagagctgccccatggtttcttgagcatttccaatgagttagaattacatagtaagacttcacctaaaaggtggatctactattgaaacaatttcaattatagagttagggtagcataatgcttaggagtaggggctccagggccagattgcctgcattcagatcctagttcctccctttttagcttagaggctaaaaagtttgacttctcaagtaaaaaattgacataataattctaatcacctcatgaagaataaacgagttaaataatgtaaagtgttcagaacagtggctggcagaaagtgaacacttaataatttcatttgatcatttctgaagaatcttttctaattccatcttgcctttcttttttttttttttttgagatggagtctcactctgttgcccaggctagagtgcagtggtgtgatctcagcttactgcaacctccggtccccaggttcaaacgattctcctgcttcagcctcccgagtagctgggattacaggcacctgcaaccctacccggctaatttttgtatttttagttgagatggggtttcagcatcttggccagtctgatcttgaactcctgacctcatgatccacctgccttggcctcgcaaagtactgggattacaggcg

SEQ ID NO: 55902 - DNA, 1255 bp, Homo sapiens
ataatatctgaaatattttctagaactctaattttcaacaccaaaaatagtcactcacttaatatctagtatcctcattttcaccatggtttagagaaccaagacctaggaaagttctcatggaattgagaagagattttcttctgcctgattcctttaggacattcataatctcatatcatcctttatttccatccaagagctattaagggtttattctttgccggaccttatattgagtcctgcatttaatgtccataccttttaacactgttctcttagtacagagagagacatatactcaaacaagtatactataatatcttcattgaaaagatgttgtaaattagatttaaatgaaatgttttgggaacagagagaaggaaggaacaaattcccatttgtagggggtaagtttgaagaaacgggacagaggaggggagtatatttaaagaagtttcacagaaaaaattatggtagaattgaacatatggaaatgaacaggatttctccaggtatttaaaagagcattaatggttagaaaaaacaatataagcagaagtccacaaatatgtaaagaacctagcatgttggaaaacagtccgccatttggtttattaaaatatatgatagaatgttgcttacacttgttttgaaaggctgtaaatataataccatggagtatgattttattttgtaggtattagggaacccttagagtttgtaagcagggtaatatggtcatctgtagtctctgggaataaaactgatggtatagaagatggtgtagactaaaagcaaagagaccagttaactcaggtgcccaagcaaggaataagacagctgtattattaatattattttaagggacctgagagatcatataatagtctttatcctttatggagccctaggatgcctcaggagccacatagaaagggcaaggatgggagtatatataatgctttgggcccctaaactcctccttatgttttaaattttttccttttattttcagttgacatgtaataattatacatatttatgggatacagagtgatatttcaatacatgtatacaatgtgtaatcaaatcagagtaattagcatattcatcacctcaaacatttatcatttctttgtgttgtgaacattcaaaatcttgtagctttttgaaaatacgtggtaagttatagctagccatatttaccctacagttctgcagaacaccagaactcattcttcctatccagttg

SEQ ID NO: 55903 - DNA, 1739 bp, Homo sapiens
gggtgatcgaaagagccctgtctcaaaaaaaaaaaaaaaaaaaaaaaaaaaaaagagaatctaatggatgaaaaattataataaatatgtctaaatactccttttagaatatacggctaataggctgggtgcagtggctcacgcctgtaatcccagcactttgggaggctgaggcgggcggatcacgaggtcaagatatcaagaccatcctggccaactaacgtggtgaaaccccgtctctactaaaaatacaaaaattagctgggcatagtggcgcacgcctgtagtcccagctgctcgggaggctgaggcaggagaatggcttgaacccgggaggcggaggttgcagtgagccgagataatgccactgcactccagcccgggggcagagcgagactccgtctcaaaaaaaaagaaaaaaaaaaaccaaaaacaaaaaaaaaagaatatacatctaataatgggaagatgtttgctttctgattccaaggatttgcggttttaaattgactctcgtttagccagcctcaaagtatttaggctagatttttaaaaaagtttgcatggtacagagattctgctttaaactattgtcagtgctattactttacagacaactttgtcttgctttttatgtctcaccagctacattattgagcagggggtgtgtgatttggttttatgtgaagctgccttccctaagacgttggcttttgcctacctagaagatttgcactcagaatttgatgaacagcatggaaagaaggtgcccactgtgtcccgaccctattcctttattgaatttggtaagtttttgcccctcacttctctctatcaagggagcaaacaatatggagaagctatttgttacactgatataatatttatacattttttctgatgtttacttgctgaagttttagcttctgcttccttttccattccacttctttttgtctttttgagtgactaaggctttgttctgaaaagtaattttctctagtcttttgatctttcccccatagaaattgttgccttttgccctttctgttatttggtttgattcttctttagagtcacatgtgacaggaactttgctaaagatctacttgattggcatataatggctgagttcttctttaccccagtccacagactcacactcacaataaggctcattttatggagatcagaattgggaaatcagaaagaatgatgttttgtttcttttagtagaataagatcctctaattaaaaaaacaaaacagaacaaagaaatagaagatacctggtactcatggtattggggtataatatttactacattcaggaatggtgagcataggtgtctgtatttgtacaagaattatagaaagactaattactaatcagacctggtaaagtatctgatggtaagggatcaaaggaaatgtcctaagtacagtaagtacagggagtgagaacaagtaggatcaggctatatcgctgcaatttttagttaaaagagaaattggttttactggcttagaatttttgaagtgtttcaagtttgctagataaatgggtcatcttgctttggaaaaacactctagtgtttcataactatatactctccaagtgctgctttatataatgtccagtttttcaaattttatttttatagacagtaatactcccataaacctccctcaaaaagaagacaaatgtatcagggtcatacaggaaacagatggcacacc

SEQ ID NO: 55904 - DNA, 3286 bp, Homo sapiens
gtatttcaaaacgttcatatataaattctctcaactatgacttgtttcatagggtctaataattgttcctctgctgagttattctcagcagatttagattcatttagcaaatgtttattgagcactaactatataccaggccctgttctgggcattcaggatatagcagcaaacacaataatttaaaatccctgtccagtgaagtgtatattcttgtaggctctgtaaaaagatgccctgtgcattgtcatggttatttctcagtccctgactcttcttccgtcactagatgtttttcttactcatgtgatcagttgctaattcagacgtggctgtcatgcctgtgttattaagtaacgccatgtttcccaatcaaaaccagtctctattaagcaactccaaatattccaaaagcattctttaaggaagaaacagccggattgcaaaatagttttttctgaaatttcaagaagtgaaaagtttgatcagaatttattatgtcaaatggagagtttgtgtttattattaaaatatgccctatattttaatatggtctagcttgtgtctatctggctatttctctaagtgtttagttaactgttataagaagataacaacattacaaatgtccttgggggtgaaaaaacttgccagaaaatactaaaaagcttaatttacttgcgtttttttttgtagtacttattgtattttagttacaactttcctatgtctattgaaatataaatcctgatagctttaacttcatagtagtctctactatgtggagaatcttagaaatgttagcagtcatcattgaagtatagcttaagactgtgtttggttaattgaattttctggttatctgagtttgttttacatggattatcattatcgtttttcaaaatataagagaatatgattcagaccattagaagattatgaagataataattattaacatgtaataattattataatttatcatgtgcaggcattgttgctcactttacaggcaatctcatgtacatacaactttatgacatagttactgttattatccccaattatagatgaagaaactaggttttaaataggttacatgacttgaccaatgtcacataacttgtacaggtgatatctgaaccaaagagtctgaggccagaacctgcacttctaaccaccttactatatagcctcaaaaattcagacataatctgatcagcatcatcagttaattagtatatgcaatgttagcctcaaaataaaaatgatgatttaagattcatggttgttgcagtgctgctcattttggttatttttaatgccttaatactttcggtaaaatacttccagggactaattaatgttttccttttttcctctttgacagcattggattcaaaggctaacaatttgtccagtctgtccaagaaataccgccaggatgcgaagtacttgaacatgcattccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgtcctgaaaatgaaaggttgcacctcatttaatgaagcttaaccctatgtagaaagtctctttcgggggcagaggctttctctgggtgccaagccatatatattagggaatagtagattgttatttcgttttttccctcccagtgcattttaaaaacagcactggctggggcattctcattctctgatggagccatcaatgagatttaacttagtcaacctgtgctagcaacattctgaaattccttcaaagaaggcagtcctttgggaaggtgtttttttttttgtttttttgtttttttgttttttttgactctaatcaacattccttttgttggtgacatttgtgattttcagtaatctgagtttttgatggccttttaaacaagactccagtatgtgaaagttaattgctgtgctccacagatcttgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagacttaaattagtttgggtcattattacttttattttgcagcatttggtttgttattagtgtaagagcaagtataggatatggagaggcccctggcttcatgagaacaaaggcaggcccaggttataattacagctttctcctgccccttctttactttctctaccacagttttctccgctgtttgttttcctcttgccacaatttgctaacacttaaaaaattttcctgcacccagtagtttcatatcctgtagacatcctcttaggacattctcaaatttcaaaataaaaaatattcatctatgtagttaattaaagttaaagtttctgcagatcaactactcaaactactaaatacatttacctgagaaaaagtctctgagagcacttcattcctgttttagttcgtgtaaattctctgagaatgttctggagatagataactcatttacagtggtttctattaactaattaaagtacccatgattttttccttttctgctcagggatgatggagatttccttttaccttttttaatggggtaaattttttaatggggaaaataggccttttaaatattattgccagggtctgcaatataacttaaaattcctgtacatactgcaaatatttctttaaattgcacaggaaaatgagcgaactttttatttcttaatatctttggcaaaaaactttaaccagtaagcaattttataaccctgagggatcatcaaagatactatcctgattcctggtaaggaaaaatatattatttccttataacaaggcaaggagaaatgctattttattcctgataatttatatagctagaataatttttttcctttcttttatggacctaaatctgccaattgggaattttgtgcatgaaatatgaagttactttttatagataatcagtgcttttaagtccctaaaaggctcctgctgaagtaatgatgatgttcataataaaagcctttgaaaggctgaaaacctacatagtggt

SEQ ID NO: 55905 - DNA, 1167 bp, Homo sapiens
ctcttggactatgtatttgacatgtaaaatatgtacagtattaacgtcaaccatctctttaaagttagcctataaatattgttgtataattttctttggtcagaaacacttggactgaatagtgacactcggtaaggattttcagtgccatttagcaaaacgtctttagtctatgcaactagcaaaaatctgcataatgcaacaacacagttttcacacttcaaattttacatgaggggttcttcacgattctcctggaacccagtctagcaaaatgagaggaaaggccctagggagatttatttctgttaaatagttaactctgctgagtatgacaaatagtgtctactatctcaaccctccaaaatttgcagagtgttgggactgtcatttgtgatttttttttttttttttttttggtggggtagttgaataaaattgggcagctaaatttttcagttccatgtgcctcccaaataaaaaacagaaaataagtagtttttgtgaattgacttgcagacaaagtagaaactgtgctgcatgatgttattttgtaaacagatgacattttctgaccaggcacatgccatccaattttctgtcaatcacactgttgtataaagcagcagaactgaaggggaaaaatgattgttgtatacactgaattgctttgcatggtctcatttgagataattgatgtaagaatcctgacttttttatatttggaaacatcaaataaaaatggaaaaaatgaaaaaaaaaaaaaaaagaagctgagatataaaacttttagaagaaaactaactcttttgacctgagttaagcagtaaatctttgtgactttgagttaggcagtaatttctttgatgcaacatcaagagcacaaataataaaagagaaaaaaagttgataagttgaacttaatcaaaatgaaaaacttctgtgcttcaaaggacaccaacaagtgaaagaacagccccacagaatcagagagcatatttgcaaattatactatctgttaagggactagaatataaaaaacacaaatcaataagaaatgacaaatgatctaagttgggaatgggcaaaggattacaagatatttttcaagagaaaaatatgcaaataagcacatgaaaagtcactaggaaaatataaatcaaaagc

SEQ ID NO: 55906 - DNA, 4912 bp, Homo sapiens
attccctcataagcacattttccttttacctcaaaacaccgctctcagaccagaaacgtccacacccgccctccgatggcctgtcgccctggctaggttttagggtcagtgggatcctccttccactggacccgggagaagacgctcaacagccccctccttcccctccttcctctccttcctctccttcccccctccctgcgccgctccagagcgcaacaaccattttcccagccaggagcacaccgtgtccacgcgccacagcgatctcactgattggtcgggctcctggtaaacaaggaccgggcagccaatgggagggatgtgcacgagggcagcacgagcctccgggccagcgctcgcgtggctcttctggcccgggctactatatagagacgtttccgcctcctgcttgaaactaacccctctttttctccaaaggagtgcttgtggagatcggatcttttctccagcaattgggggaaagaaggctttttctctgacttcgcttagtgtaaccagcggcgtatattttttaggcgccttttcgaaaacctagtagttaatattcatttgtttaaatcttattttatttttaagctcaaactgcttaagaataccttaattccttaaagtgaaataattttttgcaaaggggtttcctcgatttggagctttttttttcttccaccgtcatttctaactcttaaaaccaactcagttccatcatggtgatgttcaagaagatcaagtcttttgaggtggtctttaacgaccctgaaaaggtgtacggcagtggcgagaaggtggctggccgggtgatagtggaggtgtgtgaagttactcgtgtcaaagccgttaggatcctggcttgcggagtggctaaagtgctttggatgcagggatcccagcagtgcaaacagacttcggagtacctgcgctatgaagacacgcttcttctggaagaccagccaacaggtaagcggcccaattcattgttggagggtgaaagctgattagagaagagaattgaatacacaaaacctgtacgaaatgttttaagttgctcagtttgagtggtttgaattacgtgttgttgcttccttttttctgttttaatttgcagacattctcctccccccccaaaaaaaagggtgatttgtacaattttttatggtgctgtgtcctaaaggggatcctgaggggcgttgcctcgggtagttaaagtcttatgtgtgcataagttgcttattctttgtctacttcctatttgagatgttagtagagaactgtcctgggtgaatctttcagtattgcagggcttggcaacttgctgcccgacaaaatacatcagaatttctctttaagaacaatatgggatggattaaaaaatatatatatgggatgaaattgggggtacttcaataccttgcatgccacccaagcattccttatcacacagatgcattttaagtgtaacagcaagcctaatggctactcgattttctttcccttcaggtgagaatgagatggtgatcatgagacctggaaacaaatatgagtacaagttcggctttgagcttcctcaggggtaaatatcagctaaatgcatctttgaacttttctgtctaaaatatcttgccctcctttgatcacttactgttcttggagagcgttttaaaattttcattttcttgacacaggcctctgggaacatccttcaaaggaaaatatgggtgtgtagactactgggtgaaggcttttcttgaccgcccgagccagccaactcaagagacaaagaaaaactttgaagtagtggatctggtggatgtcaatacccctgatttaatggtgagatccattttaaagattctattctcctgggtcatgaggatgataaatcagacgtcttgggcattagattgaagcatctcaaaacacctttttatccccttctatataggcacctgtgtctgctaaaaaagaaaagaaagtttcctgcatgttcattcctgatgggcgggtgtctgtctctgctcgaattgacagaaaaggattctgtgaaggtaaaatcctagtgcttatggcagttaaaacaggaactgggtttaggggcaagggcatgggactggggtagaggaagtgtcattaactatactgagtatcagtaagttttcatctttctcattgctaggtgatgagatttccatccatgctgactttgagaatacatgttcccgaattgtggtccccaaagctgccattgtggcccgccacacttaccttgccaatggccagaccaaggtgctgactcagaagttgtcatcagtcagaggcaatcatattatctcagggacatgcgcatcatggcgtggcaagagccttcgggttcagaagatcaggccttctatcctgggctgcaacatccttcgagttgaatattccttactggtgggtagatgcagggtggcttcagcagagaaattgttcatctgttaccacagctgtcttgtttctccagacctctggtgtaataaactgccatcttcctttctagatctatgttagcgttcctggatccaagaaggtcatccttgacctgcccctggtaattggcagcagatcaggtctaagcagcagaacatccagcatggccagccgaaccagctctgagatgagttgggtagatctgaacatccctgataccccagaaggtgagccagacctaatgtcttttctttgtttctggtctacctgggtttgtaaaattgtgatggtccagcatttcttgggcaggattcttatgtggccatattttcttttctagctcctccctgctatatggatgtcattcctgaagatcaccgattggagagcccaaccactcctctgctagatgacatggatggctctcaagacagccctatctttatgtatgcccctgagttcaagttcatgccaccaccgacttatactgaggtgaggattgtcatctttactgttaaatttgtcctaagctttctataagaagttgacttagacggattgctaaactggtttgttctttttgttcttacctgaactgaaatagtctgtttctttctttaggtggatccctgcatcctcaacaacaatgtgcagtgagcatgtggaagaaaagaagcagctttacctacttgtttctttttgtctctcttcctggacactcactttttcagagactcaacagtctctgcaatggagtgtgggtccaccttagcctctgacttcctaatgtaggaggtggtcagcaggcaatctcctgggccttaaaggatgcggactcatcctcagccagcgcccatgttgtgatacaggggtgtttgttggatgggtttaaaaataactagaaaaactcaggcccatccattttctcagatctccttgaaaattgaggccttttcgatagtttcgggtcaggtaaaaatggcctcctggcgtaagcttttcaaggttttttggaggctttttgtaaattgtgataggaactttggaccttgaacttatgtatcatgtggagaagagccaatttaacaaactaggaagatgaaaagggaaattgtggccaaaactttgggaaaaggaggttcttaaaatcagtgtttcccctttgtgcacttgtagaaaaaaaagaaaaaccttctagagctgatttgatggacaatggagagagctttccctgtgattataaaaaaggaagctagctgctctacggtcatctttgcttaagagtatactttaacctggcttttaaagcagtagtaactgccccaccaaaggtcttaaaagccatttttggagcctattgcactgtgttctcctactgcaaatattttcatatgggaggatggttttctcttcatgtaagtccttggaattgattctaaggtgatgttcttagcactttaattcctgtcaaattttttgttctccccttctgccatcttaaatgtaagctgaaactggtctactgtgtctctagggttaagccaaaagacaaaaaaaattttactacttttgagattgccccaatgtacagaattatataattctaacgcttaaatcatgtgaaagggttgctgctgtcagccttgcccactgtgacttcaaacccaaggaggaactcttgatcaagatgccgaaccctgtgttcagaacctccaaatactgccatgagaaactagagggcaggtcttcataaaagccctttgaacccccttcctgccctgtgttaggagatagggatattggcccctcactgcagctgccagcacttggtcagtcactctcagccatagcactttgttcactgtcctgtgtcagagcactgagctccacccttttctgagagttattacagccagaaagtgtgggctgaagatggttggtttcatgtttttgtattatgtatctttttgtatggtaaagactatattttgtacttaaccagatatatttttaccccagatggggatattctttgtaaaaaatgaaaataaagtttttttaatggaaaaaaaaatgtctgtgagatggctttggaaaagtttttggaaagaaggtgtgtctaaaggagttttcctctacttaacaatccacactaatgaaaaccttgtggagaaaacactccctatggaccctaaggaatgtcggcagagtgggggctagaaggtgaagagggaaaccgtttgaggcatgtttcagattcactgaacaactatactgggattttccggttgtctaaactagttttccaaatccataggtaatcattactaaattccttcagttttggagttcatgggttcttgaaatacagggagatgatgtttatgagggcatttgaaagaaaagagtggcggttccttttttt

SEQ ID NO: 55907 - DNA, 1063 bp, Homo sapiens
gacagtctctatcacttgatgctgtagggaattcagtcggcctgcctgaatgcagttggggaattttttgaaggttcttctataccccatcttacggctttcaaatgctcagcagggttgctatgatagcatgccttcttattcagttcctattctggacacgcagcttgcccgtgactgttgcatgtcaagtggctggaaccaatcagcttatctaaggcttcctcagaagccaatcagagcctcggaaagtgacctcacccaagggagagctctgtgggcgagaaagcatctctcagatctgtgagtgtccctaagtcactcccttcctccccaccctccttacttcctgtaaaacaacaccacaccgcctacctcccttcccccaaagaaagggagtgagaaaggctaactaaattccacaaagggaagaaccaaaagagaaactgcaactcagccacacactggtttctgtaactggagaacaggatatttagggggacttgctctgcacagacatacctttcaaagtggcatctccagagtctggaagaggagggagtatggtgaataagtcagctcctcctccctcctcatacctggttttcttgcctttccccacaaaaatagctgtaatcattttttgtaaataaggacaagatcaaggtcaagtgtgggaaagacaggacctatgtccttgtgaacatgtgtgaacagacacaatcatgtccttgtggcctgaggaccagaggctcagaagtcagctgtactgcagggggcgtaggctgttctctacaatttactttgcattgccctacagatgaggccttgaatattccttggctgggctcgattgtgaatatgtgtcccaccatgggggtagaagggaagggacaaaggacaagcgggctgtagggctgtaaccctccagtgtgtcacaccagacccggcttagttaagcatttccttcattcctccagccctctgtcaccaggcctcacccacaacagagagacagataaaaacactttatttaaaagtataaaaccaggcttactccttc

SEQ ID NO: 55908 - DNA, 1050 bp, Homo sapiens
agagacctcctgagccctggatccattccctctctcttggcccatgtgtgcctcaatttttcccttctgtgaactgaacctgagtttctattcctattcatccccacatgagaccctggagaagaaggaagaagaagtaacttcagaggaggatgaggagaaagaagaagaagaagagaaggaagaggaggaagaagaagagtatgatgaagaagaacatgaagaggtgaaggggactccttccaccttagtccccctccctttaccctctttatactagggttgctctcctcagagggttggcatgccaacagagatagtgccccccagggtaggggcttctctctacttcatctgccccccttctacaaactacagctggaagagatgtctcaggcctggaatggtgtgactgagaggaaaggggtctggtacacaggaaggaaggtgaatgccaaattgacttttacttttttttttttttccatttcaggaaactgattacatcatgtcatattttgacaatggagaggactttggtggtgacagtgatgacaatatggacgaggctatatactgaagaaggactctggaccctcgtgtctttctttaggatacagagagtaactgtacctattatttgtttcttcagacaagcaaatcatttggtcagagttcatataatctgtctgttccctggagatgggaatagaggatgatgacagtttattttctacacttcccctccttccacatttgtatcacctttgctatcttggggaaagtgcaaaggacaaacatctcaattgtatgaagggagaaaggagaattgaaagaagaactggggttgttagagctgagatgactgtacacatacccctgcccaatttatatagctctttgtggagataattaggggtgggagcagtttgaaggagtaagcctggttttatacttttaaataaagtgtttttatctgtctctctgttgtgggtgaggcctggtgacagagggctggaggaatgaaggaaatgcttaactaagccgggt

SEQ ID NO: 55909 - DNA, 1008 bp, Homo sapiens
aatgacattaacttttcatgtcccagagataaaagattgaatgtcttgtacctccttggcttcctgtccattctactacatttctttttctctttgtttttgtctttattaggtttattcactggatctctgaatacccaggccccctccaccatggccagccggggtgggggccggggtcgtggccggggccagttgaccttcaacgtggaggccgtgggcattgggaaaggggatgctttgcccccacccaccctgcagccttctccactcttccctgtgagtctctccactcccttcccagactctcatgtgcccctggctgactgtacatgattctgaattcctcctggaccatcataaaaccatcctcgctttggccctctctctatactcccaatgcacagggatgttttgcaggcaaagaagtgtccacctttacttctccccagctttcaaaataatatgttactccctcgattgtcatttggccctctgctcagtgggagtgttagactaaattgggaggaggggtcttcctaaatttgtactagcattttctccctgaactgaccactgcccctgcctctttagcccttggagttccgcccagtacctttgccctcaggcgaggaaggggaatatgtcctggcactgaagcaagagctacgaggagccatgaggcagctcccctacttcatccggccagctgtccccaagagaggtcagttggaatgctagcatcatattctgagtgccttccatggggagtgccctgtgctcagcaccactgggggccagaggggcacaggaagcatactatctaactggggagatcataatagttacccctgtatctgaaatgcattatagtattcatggtttgttttgagtctcatgatagtcttgggacagcaggaggttaaatattaaaatcccatttcacgtgtataagtagggggatgtattttctaaaaaattatatattttttatttttttgtaaaata

SEQ ID NO: 55910 - DNA, 1065 bp, Homo sapiens
tcatgcctgtaatctagcactttgggaggccgaggcggatggatcacctggtcgggaggtggagaccagcctgaccaacatggagaaaccccctctgtactaaaaaaagtataaaattagccaggcgtggtggcgcatgcctgtaatcccaggtactcagcaggctgaggcaggagaatcgcttgaacctgggaggcggaagttgcagtgagccgagatcgcgccattgcactccagccgggcaacaagagcgaaactccatctcaaaaaaaaaaaaaaaaaaaaaaaattgattcgtatatttgttacaattaatgaatgaatactgatacattattattaactaaggttgatacttgattgacatttctttggtttttacctattgctctttttctgtacatgaatcccatttaggattccacattatatttagttgtcacgtctccttaggctcctcttaagtgtgacgggtttctcagactttactgtttttgatgactgacagttttgaggagttgggtatattgtaggatgcctttctgctggaatttgatatttttctctttattagtgtggggttatgggtttttaggaggatgatcacagaggtgaagtaccattttatcatgtaattttaagggcacataccgaaaacatgatttatgagtactgatgctgaccttggtcatctggttgaagtagtgtttttctggtctctccactgtaaagatattcctcctgatttcctaaattattgaatgagggccgggtgcagtggctcacgcctgtaatcccagcactttgggaggccgaggcaggcggatcatgagatcaggagttcaagaccagactgaccaacatggtgaaaccccgtctctactaaaaatacaaaaattagccgggcgtagtggcgtgcgcccgtaatcccagctattcaggaggctgaggcaggagagtcgcttgcacccgggaggcagaggttgcagtgagctgagattgcgccactgcactccagcctgggtgacagagtgagactctgtctcaaaaaaaaaaaaaaaaaaa

SEQ ID NO: 55911 - DNA, 1017 bp, Homo sapiens
gagggcgaggtatcggtggtgatgatgatgacctccgtacccttggccttgcaggcgtccagcagtgtggcaagggtctcgcggtccccgcggtccagggcgtggacaagagccgaggcgcccgcgtgatctcggactgaggggtctgcgccgtgggcaaggagcagcgaggccaccgcggcgcccccacccccggcgcaagcgtgcatgagcgccgtgcgccctaatcggtctgcgatattggggtccgcgccttgctccaggaggtagcgtaccatgcgtgccttgttctgggggtcgtcgtagcgggcccgacaggctgccattagcgcagtctccccctgcgcatcaccctcattcacgtaggcgcctccctccagaagcaaacgggccaagcgtagcttaccctgacccaccgcccgaagaagagcgtggccctcggtgtgcaacatagctgcggctggggcgagggcacagatggagccgggactgagacctgccgaggatgactaggggtatggggagggggagtggctggcagaggcctgaggtctcagtgacgaagccgatccctgcaagagagacatctcattgatagattcggcaggaaaactgaggcacagatgcagggacccagcgtggggtggaggagaccttcacggcatacagtccttcctctaactcatgcctttgagccggcccttcccccgcagcgcatgcctgaggaggtgggaagggtgcacccgcactgaaggactagcgcgcgtgcaaatgcgttcgtgcacgcgcagggatgtccgcacccccaccctcaccccatggcttatcagacctttcctctgtcccccttgtcttatccacacttgggatccccctttctaggatgctgaacgccacccacccacatacatgcaccctacagtcacacatgtattctcattcctaacctgttttagcttgccacaaccccaaaaattgagtggggggagggaagcagcctgcatttgagacctaaaa

SEQ ID NO: 55912 - DNA, 1034 bp, Homo sapiens
atggttgtgaatattgaaagccttacctaagtaccctcttcattcctataatctttcctgtgtaaatattagctgtgattcttttgtctatcttgcttcccgtagcaggaagtgcctttaagaatctccttgaagaacttaggtgctgacctcagttaggtctctaaagctgagttcttagtcccagttgggtcagtgtggtatgatatgaacctttaccttctcaatgatgttcacattcccctcccctactaggaggtgttggctcattattcgcaccgggccctggatgatgatattcgccaccaaatggccttggactgggtgagccgggagcagagtgtgccgggggcactgtctagagagctggcctctactgagcgggagctggatgaagcccgactggcaggcaaggagctgcgcttccacaaggagaagaaagatattcttgtgctggctgctgggcagttgggcaatatgcattcttccaactgctaggcatccacccacataactccccaggctttccacagcctttttttatgtctcctttctaagatttaggatgattttttgtacatactttctcatttttatactttaaaaaatatatatgtgtataaattctacacctagattcctatttgctaagagatcccttttcttactaccagtttttggatgtagttttatttgaaacatcttcagtccactttacaacaaagagcagcttgtctttgcagctttgttagctcttaaacttccagattaactgtgtagccatttcagtagcactaaaagattaactctagtgttcatgtgtccttcttttcaaatatcaggtaacttgaataaggattatgtgccccacccttactctcattcctgcttcctcttggactcaaacagggtatgagtatgaagattttgcctttagttcctgaactgaacctgcttgctatccctttcctccccaccactaccttattccttctctgcctccaaattgccactttgttttgaggcttccttcc

SEQ ID NO: 55913 - DNA, 2999 bp, Homo sapiens
agcagctgccgcggttaagaggaagccacggccccctgtagtctgtacctcctaagatggatgatttagcttgcgatctgttcaagatggccacagaaacacttccggtatctttccgcactaggcccgccccaatttgcgtgtttttaccgtgcagagggagggatttagagttagcctttgattggtcagcttgactggcgacctttcccctctgcgacagtttcccgaggtacctagtgtctgagcggcacagacgagatctcgatcgaaggcgagatggcggacgtgctagatcttcacgaggctgggggcgaagatttcgccatggatgaggatggggacggtgaggacagtggagacggctggtgggaagcggggaaggtgcgagagaaggctataataggaaaatttactcttttttcctcggtcgtaaggatgggaatcgaggaaccgggtcttgggtggattagagattccgcccccttcaggagaagggagggcgtgaccgggaaggcactaagactggaggcggtgtgggtcggcttgctggtagtgtattgggaaagagacgattgttacaaatgactgtcatagttacttattcttttatcttctggggttccagagagcattcacaaactgaaagaaaaagcgaagaaacggaagggtcgcggctttggctccggtgagtgtggggaaaatggggtagagtggcctagtagggcaggagctacgggttttggagtccccacccacctcataggaacaatgggagaaaggaggagttttcggtgatctcgtgtatgtcccttatagaagaggggtcccgagcgcggatgcgtgaggattatgacagcgtggagcaggatggcgatgaacccggaccacaacgctgtgagtaataatggaacctgtgaggtatccgtgtctgtggtagtagttagaaaccaataaaatagttaaacgcagtaggaatgggttcagagatagcttaaacaatctgagtccgcactcactctattcctgtgagcctgcttaaagtgtctctcatgtactcatacaacttccccccgtcccccaacagctgttgaaggctggattctctttgtaactggagtccatgaggaagccaccgaagaagacatacacgacaaattcgcagaatatggggaaattaaaaacattcatctcaacctcgacaggcgaacaggatatctgaaggtatcctaagtgacactttattgcctcctttctttcataagccttaggtagcattcgtagttctgtgtttgctgtggttggccaagagcaaagttgaaataaaatgacattggaaatctatgttttgtcagacacgccaaagagacagaaacggagatgatgtatatatacagtagagatatatgatgtacattcattgtttaaagtgtgtagatttttctgagtttagatttgaggaaaaagatactcagtgatacttggggaaataggagggttttcatatctgtcttttcactttccccaggggtatactctagttgaatatgaaacatacaaggaagcccaggctgctatggagggactcaatggccaggatttgatgggacagcccatcagcgttgactggtgttttgttcggggtccaccaaaaggcaagaggaggtaaaatgaagagggcaaatactgtctgggtgaagggaatacgaacgaaacagaatgaggacttagtattatgtccctctaatggactcctctccctgcttctttttccctagaggtggccgaagacgcagcagaagtccagaccggagacgtcgctgacaggtcctctgttgtccaggtgttctcttcaagattccatttgaccatgcagccttggacaaataggactggggtggaacttgctgtgtttatatttaatctcttaccgtatatgcgtagtatttgagttgcgaataaatgttccatttttgttttctacatttaatgttactttcctgtcctaaaattgaaagttctaaagcatagcaaggctgtatggatcattgtgaagatacttctagggactgaactctatgtatttcttttttttcttttttttgagatagagtcttgctgtgttacccagggtggattgcagctgatcatagctcactgcagcttcaaactcttgggctcaagccatccttctgcctcactgtccctagtagttgggattacaggcacatgccaccatgcccagctaaatttttaatatttttgtagagatggggtcttgctgtgttacctgggctagttatgtgagtttctatattagacatagtctcaagtttcaggtagggtttaaagtagagacactggtcagtatttcttttttggggggaactaggagagcaggagtagaagtgagatgttaagatcttatggcactaaagacttactattctgttcctacatactctgttaggatcagatagatgttatagaaatgccttttgtttctcctgcccttcttgatgtcacagttttttgtacttccagctgtctaaaggcatgaatctcctcttggagcattctcccagacccttctttagaagagtctatactaagttcttggtgccctcttcggcagccaagggtgaaggccccatagaggagaggatccaaaggagcattgaggaggcccaagaggaaaaggatgtggctcaggctgggagggacttcagttagcatggtgggggagaaccagtaccacatacccagtaggtaataaggtgtccagcagaggatgaaggtcagcaagataagcagggccagtctcagggcccggagacgaacacggggacaattgtcaaaggagcgggggagggcaaattcaccagcaggggctaggaatttagaaaatatactgtaattcagacactcagcttctgatctgagtatagggtgaattgatggaggggcatagctagtgagacagagctcacctcctacaa

SEQ ID NO: 55914 - DNA, 1076 bp, Homo sapiens
agatgactcgtgaagttaataggatgtctctaatttctagatgtgcctgagcttctgttcttttcctctttctttgtgtctctcttgaatatatttactttgtgtctcttaactctgtttaaggttctgtgtctatgcatctctctctttcttttttcaaccttctcattctcctatccagggatttaatcagcagaattactttttgataggggaggtataaggtttggcctgtaaggttctaactgccttcttttttctcacagaggtggcttatggcagatttttcctccttcaaactccaaacataatttttaagactatgtgccagtggactcttcccttatatctctgcaccacaagttgttggatgtttcctcttcctcccttatgtctacctcaccaacctcgctcatcatttggcccttatccttccttgtacacctaccttcagatttctgcttacactttgatttcagagctttattccccagtctgttcttactcctttgtcgcttatccagaatgatgctatgtgtagcatcttgctgtaaatcctgtacaatgattctgtgtaaatagctgtggcctatgccaataatgaagagcaagcctttcaggtaagcaaattaaagttcagtttgctcatcgacatttggtctggtccctcattttttggtaatttgaggcccctattcctgtcactgtggtttgggtttttctcgggattagccactaacatcacccacattatttttcttgagcacctacagtatgtaaagcaacatacttagtgggcatccaaaaatctaagaagctccacactcccaactttaagaagtttataacctagctgaggagttggggtggcagaggagtggtctaatactaaagttattgtcctggctccacaaagcacatctcataccagttcagatataatccctctaagaagcagaatgccatatgacagcataggctaagagccaaggacagaaccaagtggagtggggctggtaaggatttggagctgtgtcttcacaagttgagactcccctgggtgggtagggaaatga

SEQ ID NO: 55915 - DNA, 1102 bp, Homo sapiens
atccccatctggactcagcccggcggtacgccgtgtccgggaagcgaccgagactgggtgccggggctcgggtgggcgccgacgacgtggcaggcacgagctgctgaggatgggagagaagtagctgagagcgaggaaggggctgcggcggggctccgggggcggggctgcggggcagatgtaggggtggggccgaggggaattgcagctgttgggggctgaggcgcagggggcggggacgaggggtagaagtcggatttagtagtaggggcggttgttggggtagggccagggggaaaaggtgctgtagaggcactgggggcgagtcgatcaaggccaagagatgcaacagtagggggcacatgcagggatgggaccgcggggcagacgtaggggaggctccgggggaaaggcagctgagaggatagggtctttggggtactctcgggatccgagctttgggaaataccagtaggctgctgagatgcagggggcggggctgtgcgggccgatacctcgaggggtggggcagaagcatcctggaggctcagaggaaggtcctgccgtagtgaatcgcggtgtttgggaagaggcagaggcatgtgaaactatgggatagaaaggtgggaagttataggggaagctaatggagaaaaaaagacaggacagaggagataaggatggggagaaagaggagcaagtttctcatcacattccataaaaggggtccaagacaaagcctcctatgagaagaattgtgtagggctagcaagccctgcacatgacaggatctcctagagattcacagaagggagtcttctaaggagagcgctcccctcctgctacatagagtttggagggtgaccacatctgaggacatctcatagaacctcaaactaccgagttcatccgcctgcctcctggttttcttctgccctttgaaatgggagctatggtcctgggaaggctggaggtctagccactgggcccagctaccttcaggggatttgcgattctgtgccctgactcagaggcttttccttcatccacccagggtctctgtttagagctctgccctctcctcttccacccctataggggg

SEQ ID NO: 55916 - DNA, 1146 bp, Homo sapiens
cggcgccccctcctggccgtgtcagcagcattgtggcccctgggggggccttgagggaggggcatggaggacccctgccctcaggtccctctttgactggctgtcggtcagacatcatttccctggactgagttccctggattatggaaacttcgctgtcccccaacactgagcaagtatgctgtggagtcccaaccccagctactctgatccctctgggggctctggccaagggccagacagaccttcacagatgcctacttttggcctcatctctgcctgacaaggccagcacccaaagggttaatatttaacctctttttaaggacactggggtctgtttctggaaatgttctttagatggtggcacattcctttgggtatgttaacctaggcagtgggaggcaaatgggatggtatgtgagctaggagaagggctgaaccctcagccttgactatgtctagagcctcttggggaaggggcacctctcttgaaccccaaatgctctctcttcttattacccaaacccatggctctatttcttcttcacatccattgtctcttcatgtctattccattcccttcggccaaacagacaggtggaaaaactgagacaggcagtttcagagatggacagagaactttattttggattgtggatgtggacttttttgtacataaataagaaaaaccaaaatactccaaagatgacttcccctgcctcctactccagtatgacagaggaggatgtaaggccttagccatgatctgcaggggtctgggagtcaggcccggcctattgcttgggtctctctccatttatatatctaagttcacagtgtttcttattcccccctaagcttctagaggctcatggccctgtagttaggcctggctcattctgcaccttgccagggaggtggaaggaccctgtgccctccttcccaatcttctttttcaggctcgccaaggcctaggacctatgttgtaattttactttttatttctaaagttgtagtgaagctctcacccataataaaggttgtgaatgttctgtgagtgtcatggagatgggctagggaggggattttacacttcactttccagacccctggtttgggggaagagggtccatgttccattct

SEQ ID NO: 55917 - DNA, 1924 bp, Homo sapiens
ttgcttgagccggaggtggaagttgcagtgagctgatatcacgccaccgcactccatcctaggtaacagagcaagacccagtctcaaaataaataaataaaataaacacaggtactgaatgactaggaaacaggaaagtgtaagtaaaaaggagggctaagtaactccaggtagaatgagtgtgtgctttgccagttctaaaacagtataatttctgctatttttctttctattggacaaataggaaattcccaaaacaccagaccatgccccatccaggaccttctatttatatactgtgaacatcctgtcagctgcccgaatgttgttgcacaggtgctacaaggtaactcaatctggaccttctccccatttcctccatacggtcaagtacccctcatgtgcccacttcgccctgagctgctgaaatagaactatgtgcattccttgtctgtcttctctttcctcagagcatagccaacttgatagaaaggaggcaatttgaaaccaaagagaataagtaagtaacattttcagttgagttatttacatctttcaagatcaagggcctcaggggaaatttcctctagaaataggaatcaatagacgctgggcctggcagggtggctcatgcctgtaatcccagcacttcgggaggctgaggcgggtggatcacttgaggtcaggagtttgagaccaacctggccaacatggtgaaaccctgtcttcactaaaaatacaaaaattagctgggcatggtggcgggcacctatagtcccagctactcgggaggctaaggcaggagaatcacttaaacccagtgagtggaggttgcagtgaaccaagatcacgccactgcactccagcctgggcgacaaagtgagactccatctcaaaaaaaaaaattttttttttgagaagtaggaaccagtagagatagcaaccagtctacttgcattgaatcattggcttagattagtgtaaatcatgcattagtctacacttttctaacatgctcccagtgaaataatttttcagattaaatttgtgagaaacgtacaaaagcaccaaacttttaagtgcaaatgagaggcaataagaatttcaggagtgaagttatatttccaaataagtttgtagaaaatgtccttagaaggtgacattatctactttgatcaggaaaatggtaaagggtggtgggtagtgcctcagacacacgtggtaagagaatctcccaggttagggaagatgtctcagagttgtgtttgtttgacaggcgtctactagaaaaatctcagagggtagaagccatcattgcatctatgcaggctactggtgcagaggaagcacagttacaagaaatagaggagatgatcacagctcctgaacgtcagcagctagagaccctgaaacgtaatgtcaacaagtaagcatcataaacttcagacctgcatttcagaataccatccagaaaatccattttgacctcctgtaaccctccagcttagcatgagcaaacctaaactcactgtctcctccagctcacttaacagaatttaatccacctatttttgtaaactagcaattctgaagatgttctgagcttcttctccatcaccatatacactctcttgttcatcaagtactgataaattttttttaagagacggggttttggctgtgttgcccagactggccttgaactcgtaggttcaaacagtcttcctgcctcagcctcccaagtagctgggactacaggcaagtgccactgcgctggcttaattttacttgagtcatgtgtctcaaatctggcctttcatcttggtccacacgcaggccttcatcacctctttcctagaccttcacatttcagtgcacaatttgtgcacctctttcattaaatttatttcttaagtattttttt

SEQ ID NO: 55918 - DNA, 1051 bp, Homo sapiens
gggatctgaaagaggaatctgtggatactgaggaaaggtagccagaaaggttcaaagtaacgccaagaaaaaatggtgtcggccaggcccagtggctcacacttgtaatcctaacactttggaaggccaaggcgggcagatcgcttgagcctaggaatttgagaccatcctgagcaacatggtgagaccgtctctacagaaaaatacaaaaattacccaagcgtggtggcacgcacctgtggtcccagctgcttgggaggctgagatgagaggatcacctgagcccagggaggtcaaggctgcagtgagctacaatcacaccactgcactccagcctgggtgacaaagaccctgtctttaaaaggaaaaaaaaaatggtgtcataaaaccaaggagccacataaagttttaagaaggaaaaaatgtccaaccatgtcatatgcttccaaaaggttaaataagatcagaagtggaaattattatttgaacttaacaacatagaatccttaaggacagttgtggaatttcactggaatgcgagtgacaattgacatttcagtacaatagtggaaatgggttgcgtaaatctaggtagagatacaactgagatggccaactgtttgagaagcttggctgtgacagtaaggaaaagaagagaaggcatagggttgaaagagaattctagagtagaaagagacttggacagggtaaaggctgataagaaggcggtagagaaggaaagcctgaagatgttagaggacagggtaaaatagagctggatccccaagaatgaatgagagagtaagatttggaataccaatatgggcattaaccttaggtaaaaggagcatttttcagctgtgataaaagtgagtgaaaatatgaatcaagaacaaaaaagaaatgtggtgaggatgtgcacagagctgagtgagttctggcctagtgtcttctattttctctgtgaaatgagaggcaaagtcatctgccgagagtgagaaggaagaagggtcaagttggagacttgaaagtaatggagaagagttaaaat

SEQ ID NO: 55919 - DNA, 1095 bp, Homo sapiens
tagagaaggggtttcactatattggccaggctggtctcaaactcctgacctcatgatacgcccacctcggtctcccaaagtgctaggattacaggcctgagccaccgcgccagcctattatgaataattttctacatgaatacgcatcgtactaaataactttaaatgttggtgtagtatgccattgtatgggtatggcatcatttattgttagacgttagattgtttccactaagtcggtattataaagagaactaatgacttcattattattagctttttctttctttggacacaatatccaaaaagaaattgttgtttcaaagatatgcaagatttttaaggctttttgatatgtattgtcaaattgccctccagaaagaatacatgaatttacactcagcagctctgcttccagcgtgaaagactttctattgtaccattttggtgttttttccctagctctcagactccccagtacaatgactcaagcagaaattaagctctgttctttgttgctgcaagagcattttggagagattgtagaaaaaattggagtccatctgataagaaccggcagccagccactaagagtaattgcccatgacacaggaacatcactggatcaggtatgtctaaatgacattcattttctctcatttctttcactaatttatttcacccacctttgaatattgttcttctcaccccagaaaaggaaaaatgaagaaagcctgcccttggagcagaacaatgttatttcggggagaaaaggatgagacttagacatcaacattttgtttctcaaagtgttcctagttcatcacagcttttaggcaaatctttgctcttcccatgccgtacctcatttattcacaataagtctattaatctcagtactgcctttaaggaatgagaatgatgaaagtaaattgtgttttgagagataaggatcagaggaaatatagcaaggaatcttcctgatttattgtattgatgtgtgattcttattagctcctccagtggagagaggaaataagtgcagaaattatctagccattttctgatgcttactaagctgttggacaaaaaatt

SEQ ID NO: 55920 - DNA, 1191 bp, Homo sapiens
tgcagctttctgggagggtaggggatgaaggagtagaggaggactcagggatttatgtggtctccagattacttcatttctggagtagtttacagtatgcccattatgaatgtgtctcatcctttatgtgtgtagtggagaaaaaaggttgagtttctgatcctcaaggtaaagtcgatattaatagttaactaaagtttcctacattctggcccctatctgcctgtctgcatatccacattcataccattcccttccaacctccatgcatgctgttttctatcatcatggtcctagacctagaatttcctttttcattggacaaatattttaggtctctgtttcagtcagagctttccctagttcccccaggcaaactctgtatttgtttctgtttctagtgttcattggttatagcaattattgtattaaatttgctgtttcttggtttgactgtctcctcaagaaactaatctttttgacatgagggattttttttttcttttaaaaaagcacttgagggccaggcatggtgggttttgcctgtaatcccagcactttgggaggatgacttgagcacaggagttcgaggctgccttgagccgtgattgtgccactgcactccagtctaggtgacagaatgagaccccatctctttagaaaaaaagtgtttcagtgtttgaattaccatcctgtctttctttgaagagccaaatacagcttacatcatcttcaggtaaaacaaaatttagggttcagaaactatatggcataagaaaatagttgaactgggcacagtgtttcatgcctgtaattccagcactttgggaggccaaggtgggcagattgcttgagctcaggagttctttcagaccagccagggcaacgtggcaagaccttatctctaccaaaaatacaaatagctggtcatggtatgtgcctgtggtcccagctgaggccggcaggattgcctgagccctggaggtcaaggctacagtgagccaaaactgtgccactgcactccagcctgggcaacagagtgagatcctgtctcaaaaaaataaataaataaaataaaataaaaaataaaaaagaaacaaaatggttgaaaatgtctttcccatgcctttggagtctaggatgaggtttaaaaaaaaatgtgtttctcaggtctattttaataggtagtta

SEQ ID NO: 55921 - DNA, 4537 bp, Homo sapiens
tacaataccaacactaaacgtgtaagattagcatgactgcaaaattagcaattttgtgtggatggcatgctaacttgggatagctttttgtttgtgccattataattgcatcaaataacttatttcaggcacttatgctctgcatgtgctaattaaaagatatattggttgtgggagaacaattaatgggcttatcttttgccaacttttcaagtagtaaccctggtttctttaggcagatagtacttttatgcaaatacagttataaatgagaatgattaactgtaggatgaatctttgtctagcagggaactgtggattctgtggtttttgttcttaattcttttatgtgtctttgtagatcaaaggttgtcttatataggtgctattggtagcaatttactcaaatacaaagactctgtggtttgaaagagattagtgttttaaatgaaagaagaaatctttttcttagaatccttgtcttagaggcagtatgatatttccttctataaagttcataaacatttgctgatttaaatacttagcaattgcagtggtaagtagtggagggtaaaaaccagtaagaggagggccttgcatgtaaatattagataatgggctccatctgctcttaaacttccatgtagaggagcaccttgtaagttttcttaagctttgtaacatttctcagaacaatgtggtggtttttattatcccttctctatgattagctctattattctttaaaggaattttaaggaaagggaacggtgaggtagcttcagggagagcagaaccccagaaaataagagttgcggtttcaattaccaaggatgtttgaatccctgaaactgtgtagtaaaggcaggaaggaagagtcttggaagcctgtctgggcttgagcaatcaaatggatacatagccactcaatgtagttttttatggtatgtggtagttcaattagctgtttatttagcatagatgtacaagtacttttgggcttgttatacatttggagtgatttttacaaaagcgtttttctgaaattaatgcaggtattaaatggtttcttatcagggaataaggcttgagaatggttgcataaagagtggcattagctttgctttttcacttttggtttcagactaactagggtgtgtttgtttcctcagtgagctcagcacaatgcctggattggtattgtaatcctacaaatgaaaactatttgtagtagtttgtgaacttaccattggggtgagtgtttgtatgtttgtgtgcttaagtgtgtctcttgaagtaaaagtggtatccagcagttcctgtgattctttccatcccctcttcccggatgtgttaacttgttttctttgttctttgcaaatttcatggggacaatgggatttaatatttctctccactcttcagggtctttgggaatagatagttattttatcattttcacatgtgattaattcaacaacttttgagtgtcaatataggatattgacattgcaggattttaaaaggtgatagtactgtgtaatgtctgacacttaaacactctacatgtatttgaggcattaataaattgcagtctttgccttctgaatttatattaatgaaggagggaaatgggttgaaatggatgtggcaaatcctagatatttataatacaaggtaggttttagaatcaaagtgagagtgcagaagggtgtggaagagtcttatttggttggtgagttcagaagggcttgatggaggaggtagcatttgagatgggtcctgaaaggtgggtagggggagaaatatttattgaatccttttataatgttttaaatacagtaccaggccccttacattactacatttaatcattcctaagaaatattaactattgtagcctcaaatgttgtgttcatctggtggttgaatggttttttagtgaaacattttgttttgttagcgttcttgaggataaatatttgtcttttgataggtcaaatccgaattgcattgctgcctgtgggtcctccttccttctctatggtggcttctccaatttttcactggatttagccttgaaaaccacttgattttgtggtttatgatacttttcatagattaattcacatgccagttattcataatttcctttaataggtgttgtgttgggatgagttatttttccttattgggctttgttctcattatgccattctatatttagcttctgggaggggagcttgttcctgggaatagaatcaccactcattccttttctctttagttttttaggtggtggcggcagtcggatagacaataccacaacaacacattttgcagaggtaagttttcctttagctgtaggaattctttaagaagtggttaggtgttaaaatcatggcagatactaactttccagtgtggcacaacatcagagtttaactgaatgtataagaaaaaatgtgggccgtagtaacccttgggaagatttgtgttttcagtagctggggcttgggcgtgttacctttgataaacccttgattaggagaaagtaatagcctcaaactgtattcttttaaactggtagtgtttttaattcttgttttctactttgttattgtatatacagtgtgagaataagaagcttttgctgtttttgaaataacagtgttgcagactctgctttagtggtgtgacaaccaggtaaagtgcaggccaggataagttgtcgaagtcacaatgaaatagtcttcaaccttgtacagaggtactgatttccagggcttacctctagtcaacacagtagtttggtgtagattaaggatgtttacttgcctttcagatcccaagatggggtctgtaaataatttctatatcttcttataatgtggcgtccatattttttgggaaaaacaaatcttaactgtgatttgaaaacagggcattagtcttcattcttgaataccattttatattgaatccagagtaattttcttttttcacttcgtccattggcctaaagtctctttagttgtgttttttttttttaaaaaaagaaaccattgtaactgttcttaagtgtataattcagtggcattaatactctttgtttttaatcatttagagactacaacccagaaggtaccagtcagcctataaaaaacactgacgtttttcttttgcttgtttgtatgtgtaccctatattgccgtacaacttgttcagctctagaaagctgacagatgctaaaaggaagaaataagttaaatcccataatcaggatttctttatgttttaggatcacattagccttttccagagatagccgaagtgcctagagagatagcaaaatatttcactgttttgtatgtaaattgaaattgtactagtagtatatttgaaaagtgatatttaataagaagcctgtaaaaccctaagcttctctcccttattatttgaaaattattttaagacctgtagcccccacattttgatgttgttagatttatcaacattgtctgggtaatggtcctgttctatttagggtggtttttctgcttatggtctgtgctacttcttaatatacagtattaagagttttggttaactctgaactgcccgggttgattagagtgattccagacagatcgtgttttgaacttgcatttttattttcccattttaatggattgaaaaacattatttaatatgtgttctgggccaggcacagtggctcacgcctgtaatcgcaacactttgggaggccgaggtgagcagatcacctgaggtctggagttcgagaccagcctagccaacatggtgaaaccccatctctactaaaaatacaataaattagctgggcatggtggcatgagcctgtaatcctagctacatggtaggctgagacacgagaatcgcttgaacccgggaggcagaggttgaagtgagtcgagatcgcactactgcactccagcctgggtgacagagcgagactccatctcaaaaaagtaaaatacaataaaatgtattctgtttgccagtcctggaagcctttatgatttcagtattctttcctcttgtgtgtgctatttgtgataacacagattgtcacttactgattaggcatatgcagaagaagaaatttcatttgatttttctttagtgttctcttttaggtaatggaaatagatcggtctgccaattttgtaggtatgactcaccagaaagagatgcattgagtaagaagaaaaacaaatatatgtagtcagtttcctaactttagtaatgctaaatccaacactgatggcatgagttatccttcaggtgttaaagtatttttgctgattcatagcttgtaacttcgtgttctttagatgttgccagggatttttaataaattagctaagaagtgtgtgtgtgtgtgtttttaagagatggggccttattgcccaggctggactcgaacttctgagcttaagtgatcctcccacctcaggttccctagtagctgggattacaggcaggtgtcactgtg

SEQ ID NO: 55922 - DNA, 1050 bp, Homo sapiens
aaattttctttttggcataggaccgaaacatgcattttaattaaacattcgtaatttttcttacacagcaaaaccaaaagccccacaatggaaaatcattttctgttcactgattgttaaaaactttttttaaaaaaagtcctgtgacatcaagtgcttgccaggatgtggcacagtagaaactcttaaacacttggtgggtgtttaaattgctacaaccagtttggaaaacaatttgtcattacccagtaaagttgaagatgtatagatcatgtaatagttttacagaccaaaaatatagaaactctggtacctctgcagaagaagacatacagtaatattcacagtggccatttgtaatataaaaaactgtaaacaatccaggtgtttattgattgatttttctaacatgtgacttatttctggtctttactagctttggggccatttggatcacacgatgttttttcaagattttagaccctttctaagtagcagtccactggaccaagataatagagccaatgaaaggggtcaccagactcacactgacttctggggagcaagacctccacggttgccattgggtcggagatacagatctcgaggaagttctcgtcctgacagatctccagctattgaagggtgagttgttttattttaagttctttttaaggtagtttcaatgaaggacaaattggtataatctaatctttataagggtctcatacttattacctttgtggacaagatggacatatgtagaaaggatgaaagtgaagctaaattgaatgttagtactcacccgatgataaaccagagagtgagaaatgctatgtctctgattaacatttttattaatggctcagattaatttatagatgatatgtgtctcagtccattttgtgcagctatagcagaatacctgagactgggtgatttataaagaacagagattcatttcttatatttctggaggctgggaagtccaaggttgagggatccacatctggcgagggccttcttgctgtgtcattccatgttggaagg

SEQ ID NO: 55923 - DNA, 1045 bp, Homo sapiens
tccagtgaaacaatttcttcaggtttttcttttgctgaggcatcactccagtatctctttgggtaacaaagactcattcgtgtaaagaactgtgtacctgtgccatcttaagtattcagagtgacaaatgctaagcatgtgtgtgtttatatgtgtttgtgttataatcatctgaaacaaccttaacatagaattattgcttaaacttttttttaaaggactctttaaatgatatcttattcagaaacccaatgtgtacaacatacaaaaatggaactacccttgttaaagggaggtgggtccagagttccactggctcggcatcccttttaacccttccttatgttgatgtcagatattcagggaacatagtttgaaaaactataccataccatcagatccctttccagcttaattcacaaaaatctattaatctgtaagatagcagagctcaggaagatagccataatagcaaaatagcacaccgctgtgtggcaggctgatttctgatgctgtctcttgtgtactagccaatgaaaagccattttggtttagggaattagttggtgattaggcagccatggatatctgtagagtacttttcattagtctgttgtcttatctaattttttcttctgtaacagaatactacaacacatctttgcaggattctttgcaaattctgccattcctggatctccacaccctttttcctggtaagtaactaattgttttctatcttactctattggagtgacatattttaggtgctgtcatttctgtgcagtagagaaaaagagctgcataggccgggtgcggtggctcatgcctctaatcccagcactttgggaggccgaggctggcggatcacgaggtcaggagatcgaggccatcctggctaacatggtgaaaccccgtctctactaaaaatataaaaaattagccaggcgtggtggcatgcttctgtagtcccagctactcggaggctgaggcaggagaatcacttgaacccgggaggtggaggttgcagtgagccgagatcgcg

SEQ ID NO: 55924 - DNA, 1247 bp, Homo sapiens
cagctaatctttgtatttttagtagagacagggtttttaccatcttggccaggctggtcttgaactcctgacctcgtgatccacccgccttcaccctcattaacagtttttacagaggactttaggacagccacactgaaataggatgcttcatcccatgctgaaaagagcatggtgaaagtggcaagtggcttgagacgctgcactgataagattgctgagatgaatcccttggctatggtggacagattcacagtagcaactgactgccagagggctgtcacacattgggaagatgtttttcctgttttactgagcagatcatctaagccccagtttatttcttccaactctttacatcaaaaaataggccttatatagttcctatataggcctttttggagtaggccccattcatcattccttcttttcatgtctctgtctactaccacctttaccctcattttgaaatacaagtcatgcctcttagctgcctgctacttgggtgtacattttcttttgtctcttgtgtcttttctttatgcattcgtagggttggtagagacattgggttagttttttcttctttccttttgcctgtttactttaaaaggcatttccttcttcaacagatatgggtttagagtgtccagtatgcaaagaagattacacagttgaagaggaagtccggcagttaccttgcaatcacttctttcacagcagttgtattgtgccgtggctagaactggtgagtacagcaagtcatggcttctttgggggatgattcagagtaaaggtatagttaacagttcctcgagatccaagtagatcagattttatcccataaatccctggcttactctgatactgttatttgtttggaacttttctgaccaagggttgcaaactatgttctacaggtcattgtgtcctgccacctgttattgtaaataaaattttattggaacacagctatgttcatttggttatagattgtggctacttttgtgctacgtcagcagagttgattagttgtaacagctgtggtgtggcctgcaaagcctaaaatacttattttctgtcccttatgtatttgttttgagacagagtctcactctgtcacccagactggagtgcagtggcgtgatctcagctcactgaaacctctacctcctggtttcaagtgattcttgtgtctcagtctccagagtagctaggattacaggcgtgcaccaccatgcccagcc

SEQ ID NO: 55925 - DNA, 1132 bp, Homo sapiens
ggttgtaatcttgagcaaatctgattctggtgggagtgggaagggggctagcctttgatcgctccttgctggaaggaacaatcaaagaagcaatagatgccactcaaaaagttgaaggtaggttttccacgtatagctctgaattgttggcacagtggtaagacaaggatattcactgaaactagttcatgagctgagagaggcacagaggtccaggaaactccctcctccttttccccacatgtaagcatgataacttgacctatgtggtgtttctggacctgaaaaagcatgtgtactattctactgaatactacctctttcaataattctactaagccttgagttggggaagaaggataaagaaaagaaagcttctaagtagtgtatattttctcgtttaatcaaatattgagctttggttttttcctttggttaactttaaagctacttgaattgaatataggagaaaacaaaaaattggattcaaaagctcattctcttcacctgagtggaaaaggaaaaaaaggccagagatgattttttttttttttttttttgctctaggatgacttgggaatcaaagatagtaactagtagtaggttgtatggctagactcaatttcccctttataatttttattctaaaataaaatttattttactggttacagtggcctaaccaagggaatttaaagtcaacaaaaaattatgtctaaaggtcagactgtttcatattcatgtttcctcctgaaaactggcataggcttaaatttggaagatccttaccaaggattacagataaggtctctgttttctttttgaaatctctgttttcttttgatgacttgcaaataagggactggaatagggaatgtttaggtggtcctgtttctggaaaggggaggagtcaatctcagaatgaatggggtggtgaaggatgtaagaggtgctttgcatatagtagatcattactgagtgtaaggttttagagtgagaaggatctgtattaattgctgtgacaggcaacaattaactctttttttttttttttttcctttgagaaagtgtctcaccctgtcacccaggctggagtacagtggcatgatcatggctcactgcaacctcaacc

SEQ ID NO: 55926 - DNA, 1004 bp, Homo sapiens
tctagagatcagacccctctggtggatagacacagaagaaatgaaggcctatggatttctagaatatcattagcagcaatcatttgaagttggagtccattaaatccagcaggctttgttccccagttcaaacagccaaaatacatggtggtacacatctttagtcccagctactcgggaggcttagttgggaggatggcttgaacctggaggcagagaggttgctgtgagccgagatcgcaccactgcactccagcctgggcaacagaatgagaccctgtttcaaaaaaagaaaaaaaaactggagatgaaagaaagctataaccattcctgagctcgggggggaaaaatcaatagttgacaacaaagttgtttatctgtgggaaagagaacaaagtgttggctggcagacaggaaccgctcgggggtgagagccaatgagattttttttttcaccaattttattgatgaaaaagctaattataccattaaattttgcttttttccaaaatgattagattattgctgccaggaaagagaataatgtggccgtggtcaagaagaaacattaaataccctttagaagttaggaaggcttggtaatgaaaaggagggtggtatgacctctggatctggcaaagtagaaagaactaaagccactggtctattttccataggaaagaaatagctggtgggacctaggggacttcttcccagcccaaggcaggccaaggactctcaggccccagacggccatcaacaggattgatatatgagatcctcagcaccaccctcaccaactcctctgcacagaaagctggaagtctgagctgggagctgttcctgagtgctctttgtgtaactcctatgagcttccaggtgttattttgaaaaggaattctgggcctggcatggtggctcacgcctgtaatcccagcactttgggatgccaaggtgggtggatcacctgaggtcaggagttagagaccagcctggcaaacatg

SEQ ID NO: 55927 - DNA, 1026 bp, Homo sapiens
tgcagtgagccgagatcacactgctgcactccagcctgggcaatagagtgagactctgcctcaaaaaaaaaggacaccaggccttagagctggtccaatatgttggagatgcactagaaaaggctgttctggcccctgaagtctctagccacagcagaaaagagatgctcgatagaaaagggattccagtggctaggttggggctctccctcccagacgctttgtcacccaggctgcagtgcagtggcgcaatcgcagctcactgcagcctcgaattcctgggcttaggcgatcctcccacctcagcctcctgaatagctggagctacaggcacatatcactatgccctgctaactaatttttttagagacagtgtcttgctttgttgcccaggctggtctcaaactcctgggctcaagtgatcttcatgcttcaggctcccaaagtgctggaattacagaatgagcccccatgcctggcctgaagcagcttctatttccattcatcctgcccctcctgttgccccattgcaggggcaaggtcctgagccataggaggaagacaggacaagtgtaaaaccgacagctagggctccggcacacagttattattaagggtaagacttctgccagtgccccgacacctgctggctgaaagctttttcttttataggagaataagaacaggggccagaacagcaagaggctgatacagaaggcagaaggctcacaacagagcactggagtctgctcttcacaccacctgcaaggcaagccctcaagttcctctcatcacagttccctacctacaaatcagaataaaccacctatcccttccctcctggagggacaagaacggatgaccacacaggatatgggggagggtgaagaataggccacaaagtgctccaggcaccctagaagccatggcatggtgattgaagatagccatccctgaccttcatgcccacagagacgtacagtacaaatcagacagagagcccccagctgcccaataccaggcctc

SEQ ID NO: 55928 - DNA, 2487 bp, Homo sapiens
attccaggtgtgatggagtaaagtgtgggattgttgttttgctgggatgcaaataactaaatgctttggtggttaattgctaagagtaaatactactttagccatccaaggccaccttctgcagcaaaaggcttttgtggagaaccttttatgttcccaaccactttttgaatggtgtgccatttaaaaatccaggccagatcctattataaccaactctcaggatttacagccttcagttgtactagaattttgtttttatccaatactcattaaataagtgggccacttaggaagattcaaaatcttggttattacatgaagtttgttatatttcttgtcaacagtattgaaatgtaatatgtatgtgttcatgtatgaaaatttttactccacacaggtgtttcagtagagtggggcaggaaaagagatctcttcgatttctttcaggcctgaggcttttgtgaaatgcgtcagccccctgtgacagtaggttttgatgctagtgatcttcagatctttctctctggaaatgtgcagagagtgtcagtttcccaagttctgaggtaactctcagcccagatgtgaaatgggagcctaccagctggtatagaagggaatgggtaggaggcactgggtgctgactcattcagcactgtcccttttctatactgctgatacatcccatggttctgagaagccttatctcagtctatttggaagagagggaggaagagaaggaagtaacccaaagtactactcatttatcattgtatattgattagttaaagggataattaatttaatgctgaggagagtttgacagattttgaaaatgagtaaaggcaaaaaaaatttttttagcctttattttgcttttgggaattttacagagtcaaagtaggcagaataagaaaatagttcttcaggagggccgacctttaaagaacttcaacatagtttcggaattgtggggaagagaagagtgactgagctgagaagtaataatagaataaagggttgagtaacttagaactgaaaatgatctcttttaaaaagaaattaaatcagacaccacatggtggtgtccttggatctcactgtacagaattagcagtgtataaccatcttctcttttcatcttgttccaattctctcctctttcctttccattctgctttaagctcatgtgtcaggcagactttaccagagtgtcagacattacctaaaacacatacgttagccatgctgctggtatggagaaattccacaccatgattattagcctcctttaagctgaatgggatttaaccattctaggcaacacccctgaagggcatacctaacctcaatagtgttggcttttaaaacgtatgtttgtatggtagagaaactttgtaaaagaagaatccaagagaagtttgtgaggatcctacaaacccaggcccactcactttgctctaattctttctagtatcttgtagatctaatgggtctgggataaaaactttgaaaagtgtcaatattccatgtatgctgctgaaatgaagttaagtttggaaagaagtgatacctctagactgggtttatattaatctgggatataaatgaagaagacatactaatagaactccttgcttttaattggggaaatagggctttaataattttgacctcaactaaaaatgatatgcaatagtctctgtgtgtgtttgaaatacattgtgttctcagagatttctacattctcacgttctagtgatttggggcatgggcttaatagcagatgtacagtgtattcctgcattattgtgattccccttaaagcccagttcttgctgtcttctaccaggggctgctgactccagttacccatggaatgcaggacctgggaggggtagccattagggtctttcaaaactctttggatctaagcatttgtctctccttaagtgccaatcacaattggatatggaaggactgtgatttctgcaatgaacccaaacttttagagtaaaaagccaaatttaaattataagaaagaagggaaaaaagagaaaaactcaagtctattacttgtagagtccaattcttagcaatggaatcgctctaggattctagtttgggctttgtctggatttgcttttctcagttgtgctttgaagtgaataagctttgttacaaattaattttttattagttccaatattagttggagttaacttgaattgattgtatgtagcacagcacttttgcagtaagattggtgtgaaatactaaacactatggattttgtaggtgtcaggttaaatggtcaagggatacctacattaagtcatatattaggtattgatgatcttacttcttttctgttcccctgtacaaaacacttacctaacccagcttgtggttttaggacagccaaagctcactgttgttggttagtcctaatcactacacgggtctcataaatgagacttgtttgaa

SEQ ID NO: 55929 - DNA, 1052 bp, Homo sapiens
agctactttcaggtgcctcattcatatatactcaggtgcttgcatctctcctatacactagttaaaggagagatgtgaccagatttgccctgtcccgtcaactctagagtcctccttggtttttctgctgctttagagtctgggttggaaatagccattctgttctgtcttgttatgtctttgtggtttggctattggaataaagttatatagctctgcagttatcaaaccaggctgattatcattagagtctcctggagaagattgtaaaaatacagattcagcagctccattcctagagattctgaataagtgcatctaggatgggccctataatttttttaagctgcttttacttggatatatagctggattcgggaaatcactgatatagctaacaaactatgtggtacaatataacacttaaaaatatattattgaatttaatttttataataacgttgtaagtatttttaactcctgttttatagataaagaaactaaggctcagagaaggtcaaattgccagtaagtaccagagacaggactgctgaggtccagtcctcctatgctgacttcatattctttcctatattatcattatgccaggtctttccaagtaggtttttctcaggtattcctcatttccacaaaacctgtggaagtgtaaaagtgaattgtttacctgccttgcttctgtcgtatttaggctttgtgtcagcatgactctggagtgttaacccgagaagcattcatggtggataatacagtacgggggaaggtagaaggatacacttgttcttaatcggatttgcttgggttctttgggatctgatggattttgcctcctgtaactgctccttggatgtcatttaatttgcctaggcttgccatctcctcctgtggtacatctgtagtctacaacacagcctgggaaatggtacctcttgctgtcttcttactggttctgactcaggtgaaggtgtttgattattgtggcttagcttggttctgacccattcctgattctctcatattgtttaggcagtttg

SEQ ID NO: 55930 - DNA, 1059 bp, Homo sapiens
aacacggtgaaacctcatctctactaaaaaatacgaaaaattagctgggtgtggtggcaggcgcctgtagtcccagctactcgggaggctgaggcaggagaatgacgtgaacccgggaggcggagcttgcagtgagctgagatctcgccactgcactccagcctgggcgacagagcgagactattattaatagtgtaatcatctgttgaggaaacttttgaaaatgttgttttcatcatataagctcagaaggttaaattgggcattatttttgactggtgggacagtaatttaaaagggttttaaaatgctgaattagattatgaggatacttgtgactaatttttgcattatataattctggcaaagtaaccaataaatagacatgtatcataattatatagagagaagacttgcatacttttgatatttccctttctcctaatttcccaatctattgaggtaacgcttataatccattttttactaggaatctacagataatggattttagtctgcactcatttactgtctatccatgtatgtaactttaggcaaataaccaatttgtatttatttttttctggtgaaaaggcaataaaaactattctgtgcacttcccaagggtattttgtggatcatgtgacgaaataacaaagcataatactttgtaaggtttcaagttccatatgttttaaagatattatttaatatcagagtattacttctgcttttttcttttgccttatatgtattttttatttttaattgacacataacaattgtacatatttatgagatacaatgtgatgtttcaatacattttatatgtgtaatgatcgagtcagggcaattagcatattcatctcaaacatttgtcgtttcttcgtggtgataacattcaaaatcctttcttctagctattttattttgttacattattgttacctatattcactctactgtgcaacggaacactggaacttagttcttacaatgaatttggtggctcacacctgtaatcctagcactttgggaggccgaagtgggaggatcact

SEQ ID NO: 55931 - DNA, 1060 bp, Homo sapiens
gaaggttggatggaagagatggatttgaaagagagattcaataattttttctattcactgtttcagcctgtggttaccagtcagcttggcacaattaacaatttgatccatgtcaagaaatctgattttgaggtgttcgatgctttaaagttagattctatggaaagttctgagacatcttgtagaggtaattttgtattatttactctctcttgctgtgtctttcttgtagttccttcctaaaagttgtttatgtgtgtatatacatatagagggagagagagagcagggggttggggggaggagagagagagacagagatttttctcctgtaaacatttaggtctcttatttgcagcaaacacaaacacacacattgtaacacaagtctcatgatacaatgtttaccttattacatgggatacactctattttccatgttatcttttataatcactaatgggctacagcctatagtttgaaaagctgtttctagtaatatttcaagttttccactgacctttgatgatattacccagcagaggcgatacatgtgtgtagtttgtttggtttgccccatcttaatcctgccagtttgagacctcagttagcagtttcatgattttatgaggtccaaaaaatgtggggaaaaaaatggtttaaaaaaccaacagcctgggcaatatggcaagacccatctctacaaaaaatttttaaaaattagccgagcgtaatggcacatgcctgtggtcccaacaatttgggaggctgaggcgtgaggattgcttgagcccaggaggtcgaggctgctgtgaagcatgtttgagcctcctcactccagcctgggcagcagagtgagatactgcctcaaaaacaagacaaccacccccctgccccctgacaattctgttgtaggtaattgaaattttgtaaatttttggttaaaaaaaaaaaagtctatggtagcggaaaatatctttacacttttatttcctctaatattatttgagccaaggccttcatctctgcttacaattgctatagtatcagagaatatttt

SEQ ID NO: 55932 - DNA, 1815 bp, Homo sapiens
ctcagatttctttaaatagtttttggaaaatttgaaacactttcaaagtagggggaaacagtataatgacatctatatacatgccacccagtttgaacaatgatcatatcttgaatgaacatataacatctataccccagtccactattctcccactagttattttgaagcaaattcccagatattatatcaagtattattttatctgtaacattttaggatgtacctctaaagatgagggttttttctttgttattttaacataatcacggtatatctgggaagctttttttcctttattttaacataatcacagtgttatctagaaagctttttaaaaataggttcccagatcttacatccgaatctgagggttattcttaggcatatgtcaaattcttgtaattctaacgcagccagttagtcaagagtgcattgttctgagaatatgtagttttctcttaagtcaattccttatgtgaaagtcctttcaattctctttctctatttactttggattatcctgctactgatatgctatactgtagttttgaggaatatcaagagaatgtatggagggaagctatgtcaaccattttgaaaagaaagcccaaatgaataagctagtcctttttttaaaaaaaaacccacattattcaatttagtaatatttaggcttaatactatacagtcttatttaccaaagtcacttaaaccagtctaaaataggggtcagcaatctttctgtaaagggccagatagtaaatagtttagactttgtagaccatacagtctctgttatagctacgcaattctgccactgtagcctgtaagcagctatagacaatataggtaagcaaggcaggtatgttggttcacacctctagtctcagcttctctggaagctgaggtgggaagatggcttgagcccaggagttcgaggctgcagtgagctatgattacaccactcactgcattccagcctgggtgacagagcaaggtcctttctcaatcaatcaatcagtaaaataataggtaaacaaatgggcagagctgttttcaaataacacttgataaaagcatctggcttactggctgtctgccaactcttggtccaaaggatagtaatgaaaagaaacaggagttactgtttttacaatcccataaacctcatttgataagagagctacttttgataaaggaaattgtatttttgatctcttgcttcttgaggttctagaatttttattcctactcctgaaataattagtataagcctgggataggggaataagtaagatttcatagccacttctcaagttttaagaaatcagtgatctagtttttgaatttttaatgtttcttctttttacttcttagctgaaatacagtttatgaattacttatgaattttgatatctctgacttccattacaactggtaattgagagctattcatatttgcctataaaaatatatggctgacttaattatcttttacagaaccatactttgttttcatttttttttcctctgaagaaagactcagaagcatatcataattgcctgcctatgagttaaactagtggtagggagttatttttttcttttttttttaagggagagtctaaggctctggaagggtaagtgacacaggtagactcaaaagttaggctatgatttaggcagtgcttgagcataggccatttgaccatttttggtcctagatgagttctttttctataatttgttcaaactctgatttagttgctaattttggggtttatatccttagccaaagcctagcacccttct

SEQ ID NO: 55933 - DNA, 1050 bp, Homo sapiens
gtggaagagatcgttttatttttagagtcagcacaagacctttttagatctgatccctctacctgttcacataggaactcgctctgaggttcaaccatttttttagataagattcagagccccaagactctggttgtaggacctcatgagttctgtacattgcaatcctcccatgaaatgtaattttccagatatgcacatcctgtcacatggatctagtatttatgtttatctacttcttttcttggattcagatttgctccaggtctttcctgtgtaacatatgcaggcgacaaggaggaaagagcctgccttcagcaagacctgaaacaggagtcacgttttcatgtgctactgactacctatgaggtattcattcgtttctctatagcgagaactcctaacctgtgaccttagaagttgtagagtctgctgaaattatatttaagttttgttgagagcacacacttttctgggcagggagtctaccttcatcagattctcaaaagagggctgtaaccaaaagaagtgaaggatcattgtgcttcagattagttcgatcttttcctttcttggtggatcaagggggaaggcttctcaaggaagtggcacttgagctgcctcttggttgatgaacagaagtcaggcaggcaggcaggggaaagggttttgtggactgaggaatcacgtctgttactggaggataggaatggaagacagctccggccttattttaaatccttgtttttcagtctaagacagtgtgtgccactgaccttccacttaatcaggcttttctctttgtttttaagatggcgctacttagaaattattctcagaacttttttttacttagtgaacaaatgagacttagataaatcctatagtttaagagagttcacagaaaactagcttatcaatatcagagtttatcaatgccagcctttatacgtgtcttcctaatttttcagatttgcttgaaagatgcatcatttctaaaatcgtgagtaggttgtactatttaagaacttgggttgaatgtattatgaa

SEQ ID NO: 55934 - DNA, 1108 bp, Homo sapiens
ccattttttgctgttttaaataatacaacttgaaacattcccacatatatctttttctgtattttgaatttttcttaaatagcttctcagtagtatctgtcaaagtatttgcttttatgactgaaacttcttgagaaattgctgatgtgacacagtatgctacaaaatgtgctctggcaacagccactaatgacttccatgtcaacaaattcagtggatatatcttcctggacatctctgtgagatttgactctgctcaccacttacccattttaaagtcacacttcttaagttcctacaacaccactgtctatcttgatttttttcttctgtttgaacatcagctctgtctttatgaccttcaccaagtcacctaacctttctgagctttagtgtctttattagtaaaatgagcacaattgtctgcttgctatactcttttagactaaataacacataaagccctgaggttagtgtctggcacaaagtaggagatcataaatgtttccttttcctttctgtctctggcttcttcctttctgcataggtctttcccattttgttaaaaaaaaaaatcccttggttttactaccttatccagatattgtattatgcacatgtagcctctcaggaaggtaatttggtggcatttgtaatagaaggggcttactgttaagtctttttaataacagtcacagttttgtagtaagacttttgattgtgaaatatgtgtttaaattacacaaaactgaaagcttgggttttctctcacagattcccttggagtgttcttgttgtggatgaagctcacaggttgaaaaaccaaagctccctgctgcataagaccttgtcagaggtaaacttacagtgtagccttagtttttatataaccccttctttttaaatatacattatattttagagtaattttagattcacaacaaaattgaacagaaactacagatgtttcccatgcatatgtccccacacatgtacagctgtcccctgtccccacacttgtacagcttcacccattatcaacataccccaccagagtggcacagttgttgcaactgatgaacctacattgatacatcgctatcaccca

SEQ ID NO: 55935 - DNA, 1024 bp, Homo sapiens
ctactccctcctcagttttgtggagcctgatctcttttccaaggaagaggtgggagattttattcaacgctaccaggatattgagaaagaatctgagtcaggcaagttcctttcctgcaaatcatccccaagaagccttggcacagaaaccatcctcatgcataatggttataggtagaaaagaaggagaattgatgaccagaggacaccttccagggagacagaccgctgatattagggagatgttaagtcacacatgttgttcccagttgtctgctgttcatgcctctcttaattgtttgctatttgattctgcagtagggcttctttagttcatttttggaagaaatagaaagtgcctgctgatttgcagacttttttttccaacttgtaatttctataaaggctttgttaactttataagtcacttcctgagggagaaaagaatgtgggtgctgtagtcccaaactactgttcagcatactacagcactggtatttcttttaatgctgcaccaaaaccagaattctgggatgggaacccttcctcattcatacagccaagagttgtagtcttctgttcttgtacctttgcccctctgtgttgtaggattatccatctatccctgtgatattatcctgggatgatttttcaaaacaggtaggaggtatgccaactaatgagtttgtatgtgttgggtaagtatgagtttgagggggcttctcatagcaaaaatctccagaccatagactgaagatcacctggcgaacctgctctgattactcccatgttttgggttacctgacaaaatataagacttctagtcaaatgcatgacatacttgtattacatgggacacacttgtgttaaaaagttattcattatttatttgaaattcaagtttaactgggcatctgtatttccatttgcatatctggcaatcctacaggtagtataattctaatttagaataatttttgaaattcaagacatctggggaaagaagggattttaagtcaaagag

SEQ ID NO: 55936 - DNA, 1030 bp, Homo sapiens
ctcagctgcaagagactccaccattatcactgtcatcttggaattccaaagacaatataataaaatgacctttcctacccctcccagcaaggacacatatcctacccctcccagtgaggactcataaagggaaaaaaaaattaaatacctttttagcagatctctggttgtgctattaaaatctgactggtttagtgatatcaaagatagaatgttttttctctctctctctctcttcctcctatttgtggcctttcttggaaagaatatagtgtctggttgaaatgccagtcatttccacggaggcagatttgtgttaatgttggcatcaccattttctacatcgtgtctttctctagtactcagtggagtgttgtcttcagtgttgtcaatccatctttttttttaagattaatttaatagtttttttagaagacagacatgcccacccacacataaatcataggttcgatgcctatactttgggaacccacacataatgtgtggttaagtcgtgtcatgagaaaaataagagtcatttctacatacccagcattgttacacagggatgtgcccagcccacattgtagcaacaacctaaaccggagcttgccagcttgctgtggtctgcatttggcacctgtggccaacgcctcctcctctgagcggtatgcacttcatttgcaagtctttgatcacttccgacatactctcccccaccccaagtgtgttactcaccggggagctgcctcttggggaggcagtctgagttggcattggaagagtaatctaagaagaggagtaatccaagtggggagttgaggagtgagtaaaacgaggatctggtcagaggaaagatttaacagaactggagagccagacagcagtgataacaggtcatctttaactctgggggaagaaaactgaagactgttatgacattttaaaggtgcaatgtgtaggtactctgcataaataaaaattctagagtctctagtcctgctgaaagtaaaaccaacacaacatgcag

SEQ ID NO: 55937 - DNA, 1051 bp, Homo sapiens
ttgtttttcatgtttcccactcttggaccttgtgatttcctacaactttattttttacgtcaaagaatcacagatgataaatgagttagttaagtttgcctatcttacctgctatttattaatatttaggtagtagctaaagaagagaagtttcttctagctcagaaacaggaaaaatcagagatctttgaggaagtctggacaatcagagaatagaaggtgaatgcctgacttccaggaatctgcagttgtgaccatctgaaacaaagaaggagtcactgtaatttaactttcattttctaaaaaaggttttaagtgctaaaccctctagaaaagggcttctggttgcaaaggactgactcactcaggtttcctctagaaaagtgacattcatcgtgaagatgctcacagatagagcctgcaatcaagactcggaaaccttttaggtgctgaggcagctctggggacaaccttctctttcatatcagtctgattctctccctctgtgtttgctttcctcaggctcttttgctactcactgctttgatcttctagcttttttctgagtaaccactctcaatctcataggtttttaattacacccctaattgttgcttctttgacttgtcaagagccccatgtccagaatctactctctctactcttcccacttcatggcttttcctcatggtttctttccttacattctttcagctgcaattttccctgataattgcttccttctctcagaattccctaatttagattcccaagaaaggatccagttaacccaactcatctttttcactgccatgctttataggttcttagccagcttaaggttggagctgtccgtgagccagaaggtcacctctagtctaggatgttgtggtaaagggagatgggtaggggtagagcggttgtcacttggtataaaactggactgtcttttagtacgaaccatggaagggccatcttcccttccacgtaactggcaatgaatatatttgacacagctaatataagcccattatggaagtctaggaaatta

SEQ ID NO: 55938 - DNA, 1044 bp, Homo sapiens
aagtgactgatacacattacctgatatgtaaaaggcactcaatcagctgtagcaattattctagaacataaggaggaaggaaatgttgacagaacaatgtgctgggtaaaattccactttttgtatcatttattccttataacaatcctgagggacttgtattattatttctactttataaatgaggagacaataataataattgagtatttgctatgtgccacacactgagctaaactcttccaggcattgtctcattcaaactgcgataggtgctattaataccttcatctcatagttgaggacactgcggtctagagagtataacttgcccaacatcatccaattagtaagtgacaactagagtgtaagtctatctaaagctgggtcagtctgaccgcaaaggatttccaaagtcatataattgctaagtgactgagtcaaggctcaggtcttgttaagggcagtacttcttcagtgcacagccaaaggtacatgctgattgaatgaaggatagtggcaggcacacacctattagggtctctgactctgagtgccatggttagtcaaggataagttttggatagggtactgttatggttcagctgttccctccataacttatgttcaaatttaattgccattatgacagtattaacaggtaagacctttaagaggcggagaggtcataagggcttcatcctcatgaatggattagcactgttatcttgggagtgggttagttatcaagggagtgggctcccgataaaaggatgaatttggcccccattttccctctgccatgcccacatgttcactcaccatgtgatgccttctgctatggagtgaccctcacaagatgtggccccttaatcttggactttccagactctagcaaataaatttcttttctttataaatgacgcagtctgtggtatcctgttacagcagcagaaaatggactaaggtatagacttttaaaagttttaataatttaaatatgtcaaaataaggtctctgagacctgaggaagtgatttaacaa

SEQ ID NO: 55939 - DNA, 1901 bp, Homo sapiens
tccagcctgggcaaaaagagtgaaactctgtctcaaaaaataaaacaaacaaacaaacgaaaagattaacagataataatgcttttaaagattagtttccttgagtgaaagcagagaaatatccactcttactaaccataagactatattggcattttcctagtctgtacttacccagagttctgttgaaggaatcacacaatgaaataccctgttctacgctttctaggtttgggttctagagttgaacagcaatctaacaagggcctataaatccctggtgtgaccatatgggacactagtgtgagttcttgtgcagtacaaaggagtactaaggtactgacagatgggtcatttattcatctactctttgagattttagtctgcagttgggaatttccaattttttttttttttacatacaataccaggctttctggatttggtggtttttttggagacagtcctaatttaaaacattctgccttgtctccataagtatattcatgattagtagtcagtatattctggtggttgtttcaggttgttcagttacattgagtttctacatccgaatcctgtttaaagagggcctagtagacatcttctgcattatggactttgttcacttgctgtgacaaagtgcatactgactggtctttacactgtaaggtagaacctcagctaagctctcttattctgttttggtttggttctttacttagcttctcttttcccaaactctgcagatggacattagactcattcttatttcaaggactggctcaaatgtcacattctgcacggtctttttcaattcctagagccagaggactcttgcatccatgctatattctactttgcttagaatgatcatattagctatatgtgttcactatcacaaatcccttaatagagagtaaaccagagggtaaggatttaggtcctgttcacctctgcatctccaagagtatccagcagagttcctctccttacaagtggttgtgctcagagatgtttattgaactcaactgaattgaattcttggcttcattggatttgctttgagtatggtaacattgatgtctgtgccctagttcccttttggaaaagaaatgctgccttaaaaataaaaagcatcttaagtgattttgggatgaaagacaccatgtaatataagcagtaattgtaattattattaataagcatcattaaaatagtatgaactgataggattacttcctttgcttgcttttgccagcagagttggcaggtttgataaactaactggtcttttccatcttcaatatctatgattctttgaaattttatgtagacaagtgcaaactaatgtacactggaaggaacaattgaaacagctcatactcactgatgggctctgaattactctacttgtaagtgctcaggaaaaagatcttggattcattgtggattgctcaatggagacatctgctcactgtgcaccagcagtcagaagaatgaatgagatataataggctgtattaactttgagaatgggataaagaataatgcagaaaataatatagtgtgcataatttgccattgactatttctgtaattacaataaaacattttaatgatatacactgatgttacgattcaccttaaaatcagaaatcagcattgggtcctttcatttcaaagaaaacaaagcagaaatacaaaggttccagggaagaacaacagacagtctcaaagacatacagggatttatctgtaatgagaaactgaaaagagaaggacattttaattttgggtaaagggaaagatgacattgtataaatttatttaaaattaatgaaaatttcagaaaattgctggagctggcttctgtttatccttagtaatggaggtcagag

SEQ ID NO: 55940 - DNA, 1023 bp, Homo sapiens
cctcagtgaccattgactgactagctaactgaccataccaacaaaaacaaagcttggctttgccactgcacatcctcaggcagggtaccaagcagcaatctactgtctagaagttgagcaagggggagagagacagagacagatctagcaaatgaatttctaatattgctgcaagataagatgatatataccattaaatagttttaaaatgtaaggcagctataaagaagatgactttgtagtaatatgtaattaacctgggtaactcactagcacaaaataacagtgacacaacttgcttgataacattttataatggactagatacattcttatgtgaggaaaaaaatcctcatttacaaccataatatctgagcacaaaaagtctttctggtgattatgttcaaggccagccagatcaagaaaaaatttcccttacagatatatccttgcagctttgagtttattatatgcttcttgtgacaaagtaaagcatcttgtattgagcaccagtagaggaaagaagtcagatctggaggatattcagcttgacaagacatctgtggtaagtgactggtttggaagataagggtagaggcttggtgatcgcagggatatcctccttcctaagataaagcaggcaaacacatttagccttgtgctcaataaatgaatttcacgttgaactaaaatatactgagcaagcagagttggaaagttgtagaatatttaccctaccataggaaatgggatgagaaaaaatatatatacatgtatattttatatatgcatgtctataaaagaaataatcttccataggatcccatgggtgcaaactttctcattaattttccacattggaaatctgtaggcttcttccaattattaattatttagaacctccctgttcctcaagaggttgtgaagcagttgtctaaaacaggaaggatgaaattaacattgtactgagtactcactgtgtgtcagccattatgctaattatttaatatatgtcaccatatt

SEQ ID NO: 55941 - DNA, 1108 bp, Homo sapiens
taaaaacaaggttgaggccgggagcggtggctcactcctataatcccagcactttgggaggaccatgtgggtggatcatctgaggtcaggagttcaagaccagcccgactaacatggtgaaaccccatctccactaaaaatacaaaaaaattaccctggcgtggtggcacatgcctgtaatcccagctactcgggaggctgaggcaggagaatcacttgaacccaggaggcggaggttgcagtgagctgagatcatgccactgcactgcagactgggcaacaggagtgaaactctgtctcaaaaaaaaagaataaggttgaaaggctcacccttgaagatgttttctctagttccttcagttacaaaagggagtggaagcaactcggtgggacagtgattgagaggataggctccggagtgagaccggggttcaatttctgaccctgtcatttaatagaagtgagggtttgttttgttttgttttaaattatttatttatttaggtctcaatttccttatctctaaaatggggagcattgctgtaaaggttaggtcagaaaattcatgtactacatttaacacaatgcctggttcactatatgcagtgaatattgttattttccaggaaggagaagtgacttctttaagtcacacagctggttagttagagataacctgaacttaactaggtttcctaactctcagtcatgtgtttttttcccactgtcactgcattatgccacaaaagagtagcaagacagataaaatgtggagcttagttcagaggtggatattatggtgccttgaagggaaaaaaaaaatcctagtgagggctcattgagggctactatgtgccaagtactatcctgcattatatatatgttacctctttaatcctcacagaatcactatatgacattgttattatccctactctagagacagaaaactgaggcttaggcagactagtttacataaacctaggcttgtctgaccctcaaacccatcactctatcctgtgatgactgtggtaagaatattgaggtcttataaatataactgcaaggcaaaaggcactctggacaaggctgtgtgggggtcagcttt

SEQ ID NO: 55942 - DNA, 1048 bp, Homo sapiens
tttagaatttattgagccctgcacatgctcggctctggagaaaacttggtggcctgtgaactgatagtcttcagttatttatcatctcattttgcttatcaaagacttgcctacagtccctgtggcttttcttttcaccaagggcttgccttggatggagacagactctcatgctcttctcttatgactatggaaggcactcatgtctgagtagagtgtgattttcttctggaatgtgtctttggcaaacaaaaggacgaatgccgtggaatgttctggaggtatcatctaagaccacagtaacctttagtctctattttaagtactctgttccattgtgttcacttgtattttgtgtctcaatttttggcttagaaaatataaccactagagctggaacaaagtgtctctagagttgggcccaactctttttgctttccttagtggaaagataattttgtgttttgtttttctggacctggatcattccattgtaatgatatgttggatcaattgattcctaaggccccttctgtctttgccattctccgagtctaccatccaagctttggagcagtgcttctaaagtttttctaccaatgtgtgtgtgtgtgtgtgtgtgtgtgtgtgtgtgtgtgtgtgtataaatgtcttcatgatatcaagctctgaatgaatgtggctataattgatatgacaaatgaagacattatgtctgtaaagacaaattccaattagttttgatatatgagttaattgattatttccccttttattcagcttaaatgtagaaaaccttcccctctgaaaccttaatacgatttgagttttccctctcaaggaatagctcttcatgggccagcttctatttgccatcacggcatttccaaaagtctgcctttctcctgctggcgaatgactgtgtgactgacttcaattattcccctttccccattaatttagtcagtactgctttcttttacagcaggaaccatgtgatactcatcttattggacttcctcctcccatgtcaagtgtttgcatatac

SEQ ID NO: 55943 - DNA, 1034 bp, Homo sapiens
gtattttgagttttagtggttttgccttccttctccctttttgacctaactgttttcttactgtttcttcttccaaagattgctttggctgcagagcactggggaatgggtggttttccttggaatcagcatgaattggagtatgaacttttctttttccttatctgtataggactgaatgtgggcccagttggcgtcattctgctttgacctaaacattcccatctgattgggtggcagagatcatttttggaaagttcttccgtgtcccgatgtagaagaaatagcaaattggacatattgaaaggtaaagaatatcctgataagtcagttccttttgtgattcaatctgaatatgttggatttttgtttctgtttctatagggcctcttgtaagttaaaactacgtttattcattattctaagaattctcaaggcaaaagtcatcaaactaaatgcaagtcaaaaatataagagcagttacacctttctgtgagcagggacttgtacaataactcatttcatagggccaaggataaaggcaggtggtgagaagttaaacaggtatttatcataccatcgttgtgtgtgaatgcaaggtaaaggtagcaatacacaagccccaagctcattataatacatggatcaaacagcattgattgagtttcttccaggtatcaggtgctgagaggaggaatgacagtgccctcagagagttccgtgtctacacatacagttttgtgttataacagtttgtgattataatgccgggggccatggaggacatacagaggagagttggtaatcaaggagaatttcacagagaagggacatctgtgctgaaataatattttgggtagccattattccagatggtgatagttgaaattcattttgaatgcttgaattttgtcaaaaatctttagcttgatataaaatttaatttgcttaaagttagctattaaaaggtgacagaggtatttttaccccatgagtactaaaatgtacattaatattttgcttggaccaaggtt

SEQ ID NO: 55944 - DNA, 1003 bp, Homo sapiens
ctccacatgttggggaaagattggtttttcctattgtgtactttttctgagaggaagccttttagtagtcggtatgccagaagttaagaatgagctaggaatggaatcctgaggctttttagttccacattctaagtttgatactatgccttttatggagtagtggtcatagcatagaaatgaaatttgttaaacatgacatcgttctaataaactggacttcttagagcagggaaatgggaaagcatcattgaaagagttgaaattggaatcatagaggtgattctgagcttggttagattaatttgtgaatttaacaacttaatggcatgcttctctaggaatccttctaaagattcctaaataatttagccctaagacagtctgcaacttgcttctcccttgccacttcaaaactataaattctgggcaaagagggaggctcagtgtcataattctagtttacaaggactaatggtggaaattgttctgcttggccagtacttagtgttttattgacttagccagctcaattcagtaccgcactttgcacacagtaggcactgaataaaaggaagtcatctggccacattattcagctcttaagttccccacaagtatatgaaaataaatgttcttgctggatgtagagttatggtggagagcagggagaactgtgaatgatcttcactttgtaaattcagagacatatctggaattttgtctcttctcacctttacagtcagctttcaaatctctatactaataaggaatggaaagaagcaaaattatgaggagtttctttctactaaattcccagaattctaaaaagtagaaaacttgatttgcagtttatatttctccagcctctgaaaataaaatgtgcagttgggaaggaggaaaagccacaagagccttgaactggctacagatcagatataatccttcaaaaattgggagttgattctatttgtgtgggggatgacagcttcgtcttaaactg

SEQ ID NO: 55945 - DNA, 1035 bp, Homo sapiens
cagatagtcactatggatctgcggtacctaggggtttcaaagcattgttttgaaaaaagaaagacacaagtttttgagggttttgtattcaaaactacagaaatgtaagggagaatacatagctaaagagaaaactgcctttctcacctgctcacccttgcctggtccatgctgcttgcgggggaggcttgcatgcttggcaggaagtcctagtcaccctccagctggtgtggcccctgagcctttgtccacaatgggagcatcaccctttcaccctgatggaagtggaggcatggtctagctgcttcgctgagttggctagtgctttcaccttgatcctgttgtgagggtgttttatgtctctgtttttgctcccaactttttttgggtggccttttcctgtagtatgccctggagatgcgagattttcctctggcagcaggaggcacgcacccagagaatgctggagctgcaaggggaaaggacccacttccacagcagagaaaaacaaagaggaaaaaggcatacaggcagcgagcgctaagggacgcacccagcaagcagtgggccagtgccactgcccccagcagctgtttctgctgcaacccgagaggaactcggtgagcctgtcccgtttgtgactgcaagctcaggatttcaatcaatgcattccagtaaccctaaagtgaggagctctccatcaggaaacacacagaggtaagggctgggctggggcctcttcctgcagccccttggggatgccataggcacaccatgaacactcattggtgaaacagtatgttgaattagaaataaatgaaacccaaatgggaaaggaagagaaaatagactagtaaatagtaatataacagtaagcaggatacagtgtaatcaaagcttatgttagagttttcctttgttattcttttgtccatcattccctgacctctccccgcacctccctgccaaagcacaaacgaaaggaccatagagaccaaccagtacagtttgcctaagtttgcaaacaaggaaact

SEQ ID NO: 55946 - DNA, 1489 bp, Homo sapiens
gtgttcctgagggaaggcctctgacattcgacagaggccagagagcctaatatcagacaagtggggagagtaggtatcagattcatgagttctcacagtttatgatggaactatttcttctcattttgttactaactgaagaattgtttggaacctcctagttgaggagttcttgcccttaaggatgcaacggtttaggggttatggtaggatgtttcacaggcctatccctgttcgtacacgtttctggcctctatgctgtttgtactttagtttcaagccagtagctctagtttgtctgtgccagtggcccccactggggtagtttttctggtatccccttctcttctccatcagagcaatcctccaaggcttgggtcttgtgttctctagttgccattttgccagacttcagacacaagaggaagccttaatggccctggcagtagtccagatttgttacagctgattttagtgtagcaggaatgagtggctaccagatgtgtagagatttggcaggcaccaaaatggagtgagccaagaagggtatgggaccaacagctgtggttttaggctttttcctcctagtataagaccaaaagtcttaactgtaggccagaacatgaagttagtattcaaggaatggaagtatgattttccaacccaaattagaaatggaaacttgggtgattgtttctcccctccttcctcccctcctccctcaagtgttttggcaggcctgctatgagtgccagcactatgctggggggccatggtcagcaagatagatacagctgttgtcctcaaagatttgaatgcacctagaaagctgattattagacagttacagtaaaatatgataaatgctgaaataagagaagttagagggctgtgagatccatccccagttaagtctaggaggtttcaaaaaggttaccagaagaagggacatttacactaatatatgaaggaggtgtaatagagaggtaaggaagctggggaagactgctttatggttagtcatttgagagagaagagtatttgaaattttataagtagaagaggtttcctcttagcaaggtggtacttccttgaaattctcaaggtgggtttgtgttgtgatgctatatatgctggcagaagaaaggaaattttattctttctgtgacgagtcattttattcttttagaatgtaattctgctgaccacataaagtcccaggattcccagcacacaccacactcgatgaccccatcaaatgctacagcccccaggtcttctaccccctcccatggccaaactactgccacagagcccacacctgctcagaagactccagccaaagtggtgtacgtgttttctactgagatggccaataagtaagttgatggctgtgtcttgctgttgggcagggcttgtctggggacctaaattcttattcccattgcagattgatcttttattatcacctaaagttaacagtacagat

SEQ ID NO: 55947 - DNA, 1024 bp, Homo sapiens
atgacccctagtgaaggctgggcacctgggggtacagagccattttctgatggtatcaacatgccacattctctgcccccgaggggcatggctccccaccccaacatgccagggagccagatgcgcctccctggatttgcaggcatgataaactctgaaatggaagggccgaatgtccccaaccctgcatctagaccaggtctttctggagtcagttggccagatgatgtgccaaaaatcccagatggtcgaaattttcctcctggccagggcattttcagcggtcctggccgaggggaacgcttcccaaacccccaaggattgtctgaagagatgtttcagcagcagctggcagagaaacagctgggtctccccccagggatggccatggaaggcatcaggcccagcatggagatgaacaggatgattccaggctcccagcgccacatggagcctgggaataaccccattttccctcgaataccagttgagggccctctgagtccttctaggggtgactttccaaaaggaattcccccacagatgggccctggtcgggaacttgagtttgggatggttcctagtgggatgaagggagatgtcaatctaaatgtcaacatgggatccaactctcagatgatacctcagaagatgagagaggctggggcgggccctgaggagatgctgaaattacgcccaggtggctcagacatgctgcctgctcagcagaagatggtgccactgccatttggtgagcacccccagcaggagtatggcatgggccccagaccattccttcccatgtctcagggtccaggcagcaacagtggcttgcggaatctcagagaaccaattgggcccgaccagaggactaacagccggctcagtcatatgccaccactacctctcaacccttccagtaaccccaccagcctcaacacagctcctccagttcagcgcggcctggggcggaagcccttggatatatctgtggcaggcagccaggtgcattccccaggcatta

SEQ ID NO: 55948 - DNA, 1769 bp, Homo sapiens
ggcatggctgctgacgtgggcatgggtggatttagccaaggacctggcaacccaggaaacatgatgttttaagctgctaagatgggatgtgccgatccttgtcaaaatgagattccaggtcctgagagctgctttgaggcagttccaggagtacttactattggtcatgcaataggagaacagagacccgagggctgctttgggggaggggggaactcgagaatgtatggatttacctgaaaacaaattattcatttaatcaacaggtgtgttttttttaagatttattttttaaaaattatttttgtggacttgggtatcaatgatggcacctacttttgggaatctgtagctgtgctttgagaattgccatcggtcatgtgttgcaccgttctctgtatgtttacgtcctttggactggcttctcccaggattcttttctgtttttgtttttttgatttgggctttatttttttctgtgtactgtactatattgtaaaagggattttagcagagactttagtctttggggcaagaggagaacaggaatgctgggctgtttactttaggtggagaatccatcttcagacctttggactattttctttcaactgcagtgtatagaaaaaccaaactacgacctcagagcagagtattaatgaaaagcacaaaaaaaggaactaagttcagcgaggggtggggggaggggggagatttttcttttgaaaaataatgactcttaggacatttgtttttcagttcaagtgctcttcagcactgtcttgtctcccaatataccaacccactggcacatttttctcttgttttctctctccgattttgctctgtctcctcagttaagtgtttccttcctttgtgccccccgctggtgaccctctgcttccctctctctttccctttggcagctgcaatacacagtgttattctggggaaataaatctagcaaagcctcgccttccatgccgagcgtcctcttggctctgagagggaaaggtctgtccttgggatgctctctggtcttttttccccctaagtctttctctttcccatcatacccttccctgcccaccttgttttctgttctccttttattaggaattcccaagtgaattttattaatgtgggagtggaacagatgctaaaagctatccaggattttgtttctgtttgttttaaattttgtggttccttccctttcctccccctcccatgcgtaagacgttctgtgtaacctccattaaatttggtacaaaaccactcgccagagctgtggtgtcagaaaaataaaatatattgtttcttacaaaattgaactgccttttttgttcatttggattcctgattgtttagtattgggcataccggttgccatgtgacccagaagcgtagactctttgtattggagttgatcagtaaggtgatggttagggaaaccacataaaagtaccttctcaaagcatattccatgctgttaaggaataactactcatgtaggtttattctgtactgttcctatctcagtcatgaaatcctagttataagcagaagagcaaccctggtcccattgctgaactttacctttagggcaattaatggtctttattaggaatgtttgtgagagccagtttagtggtatgaagtaattaagaaggccaaaggttgtatgtttagttatttgaataagctatgagatgtcccttggtcttgttaaggtagaatattattactatacctgcaaattatgggtt

SEQ ID NO: 55949 - DNA, 1041 bp, Homo sapiens
ggaaccaattgagtgggaaggattgaggacacaaaagaagtcctgccatctttggcaggaagatcacaagaagcgggacaggaactgaagcacaggtagcggtaagctttggggaaagaaagataccagaagtgaaaggagaaaggtgccatgtgtgatgaagcagataaagcaaagagacaaagggacacatcccggaagccagatgtgcagatatggaaggaaaacatgctgatcctcaggtcaaaggtgaaagtttgagtcctgcctctgcctctccctggatatttgactttgatctctttgagctggctgcttcacatttggatgtcataggctttttgtgaaactgttatcagacaacatgtgtgtatgcctagtatgagttatcagagcatttttgagagatgccttaggctgtaatgcaaaaagatatgaaatggctgctctggtaaattagaaagctcacaagatacaccagctgggcagtaagagggttctagctgaagcagaaaatcatgattcttctttcagaagggacacccagggacccctcttgctgccctcctgggcactgaaaggtagcacagaaaagccatagagaaagaagcaccacagtggaaattccatgatgggatggtggtggccacagcaggaaggcattttcaagagctactggagtccccaggcccagccagcccaaggtggggataacagcaacactttaataaggttacactggggtcaccagattctcaagcacttctctcctcctgcttttaaagttcagaatcatctaattagaggaccaaactccatccctgaccacatgaaaagcaaaatgaggcctgactctgactcaaactgttcacagagaatgaaggatgctgtggaatcctagaacttcagattctcatggtaggcagggactggcccgtgtgtgaccctctacaatactttgcctaatgccagtgtaagcttataaaagaaccctctaaggtagcccaattcatccatggtcagctctgattatttcaaagg

SEQ ID NO: 55950 - DNA, 2027 bp, Homo sapiens
gattaaaatggcattcttattacagattaaagccatttggagaatgtgctgagggccaaatgggcttgtgaatattattttgaaataaacttaataccccaaaacttcaagcttccccaacaaggagccctactaaactcatcccatggctgagagtaggaagggcattcatgtaggctggcaggacccaaagagagaagagaggtagggtctaagccacacacgctcagtttcttctttgaaactcaccagggaggagtgagtaggtggcaaggaggaggccaggagaatttctctggcggggaccctcctcatgaagacacggggagtgggaacaagggttcttcccacgatctactgcaaaggacttttataccaggctcagctgatttctagatgtcacctagtttctgaggcaagtgtgtcttacgtaaaggaggcaggccacatcctgaccttcagagtcctgaggcagagaattgtggagagctgtttcctcttgcagaaagctgtatctctatgcggctcatgatgtgaccttcataccgctcttaatgaccctggggatttttgaccacaaatggccaccgtttgctgttgacctgaccatggaactttaccagcacctggaatctaaggagtggtttgtgcagctctattaccacgggaaggtaatacccctgaggtggggttgggtggtggtgaggcaccctcctgcaaaacccacctacctgagttagcaccaagtctccctcctcaggcccagtggagtctctcttggcacagtcagctctctgaatcctatagggcaactcctggctatggcccaggggtcaggcagaacttgacagatggtggcaggatggggcttgagccttatcccagttctgttacagactcctaggaacagggtccccctcctcttctcctgagcgtccctgtcaggatgtcgcctcctggctgtgagacctgttttggagattgttggtggtatctttgggaggtgatgtgtgctgctgttagcacccgtggtgttggctgcttcatcagggctggggtccagggcagaggccagagcacgccccagggatgagcctgttggttctcccagctcggggatgtaactcgactctttcttcccagtcaattcaacactttttgagtgacttttacaagcagagcatagtgcttttattctggaagctcaccgggtagtggggccttcctgtctgtaatatgtatgcacatgtataccacatggatcagagcctctcagatctctgggcttagctggaaatagcagaaggacaggttcctcggcggacctgctgagttatgtttcttctgcaggagcaggtgccgagaggttgccctgatgggctctgcccgctggacatgttcttgaatgccatgtcagtttataccttaagcccagaaaaataccacgcactctgctctcaaactcaggtgatggaagttggaaatgaagagtaactgatttataaaagcaggatgtgttgattttaaaataaagtgcctttatacaatgcctcctgctttgtgtgtttgggaagaggagagagcaaggggtaatgtactttaatataatgtaaggatatttcctttctgtgggtttactaagatttcttcctgaacggaaaaggggtataatattgagaccaaaaggatatttctctattttgtgagttggtttctaaggttagaagcatctttgtgtgacacgggctggggacatcatgaccctgtagaattgtgtcggttttggactttagttcttttctcctatattaatttcacatgtattgagctacctactaagtagtgatcattataaaggtgaaaacactctgccctcaagttgttgcagtccagtgggagaggcagccgagtaaatcagtgatacagtgctgtatgttttatgctgtaataggtatttgaggggctatttgggtatagagaagaaacttcctgctcacatggcaggggatgtggggaacagtcaagga

SEQ ID NO: 55951 - DNA, 1049 bp, Homo sapiens
aaaaattagccgggcgtggtggcgggcacctgtagtcccagctactcaggaggctgagacaggaaaatggcgtgaacccaggaggtggagcttgcagtgagccgagatcgtgccactgcactccagcctgggcgacagagcgggactccgtctcaaaaaaaaccaaaaaaacaacaaaaatgcttttcatttttgagtggatggggagtcatcagaaagggaagaaaccctttctttttttttttttttcctggccttcaggtatctagtaatagctttggaagagctttagagacatagcttcttgacctgttaacagacatagctgttcttgagcctgtcttctcttccccaggagaagatgggctcctgcaggttccatggaagctgatcagctgccagaatcagtaggtaagaagcatttttttctaaaactacatgtggccctttcaggcacacaacctcccaagctgccccatgctgaagagatttgcaaggatgatcgaacagagagctgtggacacatccttgtacatactgcccaaggaagacaggtgaggggctctcactgctggcatgaagtcacgcttggtcagacatccaagtgtatggggaagaggagttcatcaggcccactcacacctgacagctgatgtctcctcgtgtaaggaggctgaaccccattctgcccacctaccagtaggccctaggtcctcgcacttctacagctgggactggtggcctagtgcttctgttccctgttatgcagaaccaggagccaccaccctcatgactttatcacttgccttttccttttgctttaaggtttaaaggatttgggtggggggagctgaagaaagaatattcatttctgtctttagtcatcatgttacaatttgcaaaccattttcacattctcactgtgaggtgagagagatacctttctccctggctttatagataaagaaactgaggctgggagatattgcctacctggtctaggcccagctagcaagtgatggagccagaacttggacccagatccactg

SEQ ID NO: 55952 - DNA, 1237 bp, Homo sapiens
gggctagcgagatgatacatacagccacgagtgggcctttgccatttacaaagtatgatccttctgacaaccccggtctctcaggtggggcaaatgagaaaaccaacaggttaaataaaagatgattgagactgtctttaaccggcaaatccagttgtacaagcccaacaagacacagatttttcttctcttaccaatatgtttctatgtaagatagatcggtttgggctgatgacacttttcaggtatctctaggctgcactaagactatatggtatttattccgtaaagaaaagaaaatgctgttttcagacagacctgggccatgcttgcatcatttttgatgcaatgcaaatgctagagtgagatttggaaaatttcatcctgttatcctaaccctggtacttgctaacttaacgttataagtcatttgaccttatagagccttagtttattcatctataaaattgggataataccagctaaccccattgggttgtggggattaaatgatatcccaaatgataacccaagtgtgaagcacactttgtaaactgttaatcactatagaatataaggctttactttttattttttgtcagaggccggaggcagactgcctctttacagccaggaatctcagaggatttgaaaaaggtgaaggacaggatgggcattgacagtagtgataaagtggacttcttcatcctcctggacaacgtggctgccgagcaggtgagtcctggggttggggagcctgggataatagccttggtgggctggctccggagttagaaccgggtggagagaagtgggtggaggcctcctggtttgaaggcaactgtgataagacctacagatagaatgggtgtggggactgagggatagggagcaatcgaggaagactccttacccaggtaggaacacagacactgaactctagaccagagcttcttgaggcatgttccccagaacacccaatatgcagtttgtgtttgggcaggcaggggcaatgggtagggagggatgagtagggtctaaaaattttggaatccttatttattgcatcacttcttgagagtactatatgtacatcagcatattaaaaaaatctgagatgcccttcataaagaaagctggttaatctttaaatctgttttccttaagcttatttagccataggatctttttttctgtaataaatacataaagaagactaacaatgggaaaggtttct

SEQ ID NO: 55953 - DNA, 1177 bp, Homo sapiens
ggcagctgaccaaggtgggcatgcagcaaatgtttgccttgggagagagactgaggaagaactatgtggaagacattccctttctttcaccaaccttcaacccacaggaggtcttgtgagtcacttgaaaggggatgttgcacttaatttaaggtcttgaacatgaggatacctgtcctgactccccaagatggttcccactgtcacccaaggtagtttgggggacaacttgtcatgctgcatacccttatgtcacaggatctggtgaacaggtcgttcctggaggtcgcattcattgcacttcgagtctctcaggggctgacatcccacagaaaagtgaagcattcttcctagttccatagctctccttatgtactcttgaaagacccctggagcgtatgtggaataaaatagagtgtatataattaaatattccttttatgagtgtcactattttctcatttttttcagtattcgttccactaacatttttcggaatctggagtccacccgttgtttgctggctgggcttttccagtgtcagaaagaaggttcgtatttggggtcccagtcagtccctgtccctgaggggtcttgcttctcacttccgaagcccctatctctttcttggtgcctgttcccttgactttttttctcctgcatgtgtgacttccagtgtgtacctagtccagtgggtctttccctgtctggccttatggtgcccctgccagcctgacctccacagcagcagcagtgtagcagctgctctgatctgcctctggctcctggcttctcccctcaagcttctacacaagctgcacaaggcagtcctaaccatgttttgtgaacaatcgagggggctttttatttaggtgagacattgctggaaaggaaggacactgggacccaacactgctgctactgccctaatcttggtgataatccacagcatgaacactgttccgtctagcctttcctagttgagaaagtccatcgagtttgggttttgatacattcagcccctgaatggttgcagtcagtggttcccaaccttttcatccccaaggactgcattaattattttccctcatggatcccatgtgttgagagcctttggccatcacatgaagctgcattttgtcatttgttattggctcaaatttacatttaattactg

SEQ ID NO: 55954 - DNA, 2840 bp, Homo sapiens
tttgacaatatagatgagctgggaagcataatgtaagaatcttttattgcttagtacctttccaaaactcagctaaaagaagcggtattcaagaagcattacatgaggtccacccattcttcaggatcgatggttcttaaccgtggtgaacattggagtcaactggaaagctttaaaaaatacacatgccagggtctccctccgaaggattctaatttaattggtccggggtatccagataatgtaaaagactctctggtgaagcttgagaattatctggactgaagagcattaaaaaagtggaggccccacttttttgggggataatccaaatgcggttatcccaggttgggactcaggcatcagtaacttttaaaaaatgtcctggtaataccagtatacagacaaggtttaatatgattgctttattttaaaatctacacctgggaggtttttgtttacttttatgtagatttgttcttttacctggaatgtagtatatcaatcccagtacagaattgccttcgctgaaatgtgctttggtaagaggttatctttctgtgttgagagaactaggagaaacaatcccacagaactcattgctgtgactgctgaaaagatgttcattatattactctatcctctttatgaggacccttgggaggaatttgtctgttagcattaggaatggtgtgcttctcctgaacaattggcttgcttttttctttaaactagtctagctgatcaagtttgtttctttatgtaaaagtcaggaagctgggtgccaagtctgtggcccacctatagtaagtaaacagatcttcatggtgtacatattttagtaaccgtgttactgcatccatttctttgtccctacatttgtttgcttttgtctttcttgcctactttgaattggttgtcttactatattttaatttttgctatatctactttattaccccttgaagaggggtatacacaaaataagtaaaattatcaagttagtctttgccactaactgggaagcttaagagcaggaatgagaatgagagtgtgtatgtggggtggacactattatatgaaactgatgtatcatccattcttgaaaatctgaaaactgtactttagacttgatgtgacctggactccagactcctaggagacgccaagggtcctctcttggtgaatgtgcctaacagatttcttagtgaggctgaatggccctgtggagctttgtgtcaggccctgtggtggacactggaactacaaggatggataattcagtcttgcctttaaaggagtttcaatgtgataaagcagagacaacagatatcaattaaggcaatatgctgggagcactgggaacacaaaggaggtgtctccaaatgtccaaaactgaaatcagctttccacctgtttttctgtcttggtcttagttttagtcaaggaatatctccattacaaggctcaaaaatcaaagtagtctcttttttgttcttctgtgtttacctaccaacacagtccccacataaagcttttatttactcacttgccaagtctaactcaaatgtcttacatctacctcctctattgttaactggcttagatgaggccttaggctctcatgtggactattgctaacatctcaaaatgggcttttctgcatctagtcttcccattccaattgtgatgtatgctgccaggtttcagatttattctgtggagcctgtgggctaagaggatgttgagcggctggggctgtgggattccctcctacttcaactagagaaattcgagtttttgcctttatacatacaaatctaaagttaaactttatgtggtattttctgatttaaaaattggaaaaccattcccaggttgaggcaaaccaaaccacttctttgccatacacattctttaccatctctgctttgcgcaagctttctagttatttttggaattctgaatgtcaccctttataagtacaggtatttgcttgtctaaatactattcatttaaaatgctattccctcaatgaaacttctcctgaatccccagccagaagagaaggtctgtcttgcctttgaactgctatggccttcatatggtttcttgcagcacatgtcagcttctattatggtattgctgtcatttacattcacagctggccttttttctttactaacttgaacacccaggaaaggcagggtcaagttttctcaagatgggtatcttccacaggagctggcaaattgttggagctattaattgtacctactgtgtgtgaggccctttgctgggaaacagaagtcaatagatgaccgagtctctgttctcaggaagccaggacagaccagtaaaggagctcgtttaatacactttggtaaaggctactaaagagagccactgaagctactgtgaaagcataaggccatgaccaaggtttctgggaacacttaagctaagtcttaaggaatgaacaaaagtctttctaaatgaatgaggagagaaaattccaggcataagaaacatgatactgaaaggccatgaaatatgagaaaggaaaggaagttgcgtggctagtgagtaagtatgtagaatagggaagaagtggtaagggggctgctagagaggaggtggggccacatgagccatgaaccctcgaagggttttttttatccagaggggttagagggtcagaaagagggagcagtgattaactgtgaaagaaggaagaaggcctctctgtgaacacctggtcctctgatgtgtcagaaggaggttcaggtgttggagaccaggtgccagtgggactgacacatgcctttgggaagaatgga

SEQ ID NO: 55955 - DNA, 1030 bp, Homo sapiens
atgaaaatcaggggtgaaccaactctctttcaatttaggctatgagcaaatattagcctcttaaaacttgtttctggatagtctctgtccagtgttcatttcaagatccaatttgatagaggttgttattgggattttttttttttgagacagaatcttgttctgttgcaaggctggagtgcagtgacgcgatctcggctcactgcaacctccgcctctcgggtttaagcaattctcttgcctcagcctcccgagtagctgagactataggtgcacaccaccaggcccgactaatttttgtatttttactagagacgaggtttcatcatgttggccaggatggtctcgatatcttgatctcatgatccgcctgcttcaagtctcccaaagtgctgggattacaggcgtgagccagcacccggccgttattgggattttttaatcttcttggttctgctattaattatagtcagaagggactgcctggcaaaaattttttgtctttggtacatgtttcctgatttctgactggtttatagattaatatatgtgacaagtcacttcattcagccatctcacaaattctcagaaagtagcatgatttaaaactagatgttttggctgggtgtggtggctcatgcctgtaatcccagcactttgggaggctgaggcaggtggatcaagaggtcaggagttcgagatcagcccggccaaaatggtgaaaccccatctctactaaaaatacaaaaattagcccggtgtggtggtgggcgcctgtaatcccagctactcgggaggctgaggcaggagaattgcttgaacccgggaggcggaggttgcagtgagccaagattgggtcactgcactctaccctgggtgatagagcaagactccatctcaaaaacaaaaaacaaaaaactagtgttttattgggttgttttcttatggcttgaatggctgttggtttaacctgttttgctaaaagattgtgctttggaaataaaaatatagaacttgattggccattttt

SEQ ID NO: 55956 - DNA, 1071 bp, Homo sapiens
actcttaactgagattacagtggataagaggtcgttgcctttggaaacaaactttataactgctttttctcagggtttgctggaggccatttgagatctcctgaagttttttttttgtaacaagtgttgtattctagggttctccttttctatttaaggttactaaacctatagtgggagggatctgaggtcggaacaaatttaaaatgggctagtctgtggcagtaatgttttaaaaatctgtctggttttgtcaggataattatgactaaagcacaaatagtttaaaaaaaaaatgattatctttcctggatgtgactttttatagcagaaaggcctagtgaagaggaacaggcaacctgaaatccccaaactcccaggtattacacctgtggagtgcttttgtatcgttggtcttccaggttgatgttggaggaggtcgaaaagattgtccaaaattgatgttaggtatactcttcataataacagttgctttctagaaaccttcaggattgtgtctttacattgtacaactggaaacccatttttcaaggttggccgcacatgaaattaaacttctaaagcattttccacataaataaatacatttggaaggcacttaattctattaccaggtttctagttagccttactctggctttaccacttgctctctggaaccgggatttcttctttcattttgattctttgatttttttttcagtctcttactttgcctttttatattagatcactaaattttccttatgattttgtatacagcccatctctgatgctccccttcccccaattcttctctatttattcttggtacagaaggactggggaatcacatgtaggaatatatattatattcacgtagaagacaaaaaattatcagtggtaatggagagtaaaactttgaatgtgtaggcctagacctagtatgtaccatatatatatatatatatatcctgaaggcactaggaaaagatttagattcttttagggctttatccctaagggagagtgggtgtgtgatggatatcttctgcctttatggttgaaagg

SEQ ID NO: 55957 - DNA, 1220 bp, Homo sapiens
accacccagttctactcctgcgctcgcgatcctcctgcctggcaaactccatggcccgacagattcactaccactccactgccggaccaggcacgtccgtgggccatccacgcctggaaaacggctggctgggccggaggggcgaggcccgcaggcgaggggggcgggtacaagccacttcttgggagccgcggtacgcgcagccttgtgggagttgtagtttccgcagctctgagtctccaggcgaggtgtcaccacaggactcgttttcccgtgctcctgtgcgcgggtccacttgggacgggtccctgagtaggtgaggaggtgggtaggagcttgcttatagaaaagtggaatcgagtagtccttgctggtggagccgctgccgccagggaactcagggccggctcctgttccttcaagagtgctggaggccaaacttgaaatacaagtttaatgttcctcgtcgggcaaaagataaggatccgatctcccccggcccggtgtgcagcaggagcgaccaaccccgacccgggttaaaactcccagggactcttcgctgctgccacctcttgttctctcccccgttcccactcggggtctccctcagggccgggaggcacagcggtccctgcttgctgaagggctggatgtacgcatccgcaggttcccgcggacttgggggcgcccgctgagccccggcgcccgcagaagacttgtgtttgcctcctgcagcctcaacccggagggcagcgagggcctaccaccatgatcactggtgtgttcagcatgcgcttgtggaccccagtgggcgtcctgacctcgctggcgtactgcctgcaccagcggcgggtggccctggccgagctgcaggaggccgatggccagtgtccggtcgaccgcagcctgctgaagttgaaaatggtgcaggtcgtgtttcgacacggggctcggagtcctctcaagccgctcccgctggaggagcaggtgagaggtcggcccgggctggggctggtggggcgaggaccgtgtgccaggccaggagtctcgccctgacacacatcttcagagctttactcgcgcggagcggggctcgggttgggtccagaagaagggaaaacagcagtagccagtgactccccaggctcttgagcaaaggacctgctggggttaggacagccccggaacttccagttttgccctgatggcgcagccatcag

SEQ ID NO: 55958 - DNA, 1029 bp, Homo sapiens
tgggattctggagattttcttctgcccaatactttaagacctcccgaggaaggttccagaactgatccaggatctgcagagtgttgaagaacccctttaaacattaaccattatgtacgaatctgtcagttttttgtcagtatgcatcaggaattctaagtgctacctatgaccctgtcacttcatcttcttgtcctcaaaattcttcatccacaggaggatgctggtaatagtgactcaagattcagaagtgccacctatattgatctttttctttagctccaggcaagttgctgttgtggccctacttccaatgacttgagaatttcctcaaaataagttttctgccttgtaaccagaaggaggttatcagttcagtttttaaacaaggaaataacttctagtctctgtttggcttttaacagatacgtcagtatgttgtacaggtgatcttctccgtgacgtttgcattttcttgcaccatgtttgagctcatcatctttgaaatcttaggagtattgaatagcaggtgagtaagagtactgaaaactcctcttgaagagttctgtgctacattctttacagtggaaaagctattggatctcataactgaaaaaaaaaaaaacactgtgttaatagttcagtttcagtaactgcaatgatcacaacagatatgggtcacagccacctaatagctggtttgataaagattatgagataccaggaaacaaaagatctgaccgttaactctgaagaactcattggagtgaggctgtgaagctgcagtctaggcttcactcctagaagctttatttttccaggactgctcgctgactgaatcccagtaacagcccttcacattgttctgctgattgaaaatctctacctgaaaagattagaattcctcagagctactttaatgatctctctgaagactgaaactccagttcttacttaacttagttatttttattgattttacagtcatggtcaagtttggttgaatttaaagtgtttcttaaaacactt

SEQ ID NO: 55959 - DNA, 2016 bp, Homo sapiens
gactgggactcgtatctagaatatataaagaattcttacagtttaataatataatacaattaaaaaatgaataaaggatctgaataggcatttctccaaagatgatatacaaatggccagtaagcacatatgaatagatgcccaataccattagccatcaaggaaatgcaaatcaaaaccacaatgagataccacttcacaccaactaaaatggctataaccaaaaaaaaaacagaaaataacaagtgttggcgaggctgaggagaaactggaactctcatacactcctgaggaaaatgtaaaatgatgcagccacattgggaaacagtgggagtgcctaaaagattaaatatagatttatcatatgacccaacaattccactccatttctacctaaagagaaatgaaaacatacgtccacaccaaaatgtatacacacacattcctagcgtctctatttataatagctaaaaacaatccaaatgtcctcaattaatgaatgcagaaacaaaatataatatatccatataatgggatgaatattgttcaaccataaaaggaattattgatagatactacaacatggatgaaccttgcaaacattatggtaagtaaaagaagccagtcacaaaagattacatattggtggtttcctagaaacagaaagtatattggtggtttcctagagctgaggagattggggagaaacagggagtgactgctaatgggtacagggtttctttatggcgtaatgaaaatgttctaaaattgatttaggtgatggttgcacaactcttgagtatacaaaaaccattgaattgtacactttaaatgggtaaattatatctcattaaaactgttataaaaagtgctaacaaaaagttttaataaatgaagtacatcttataaactaataaaagtaattcatgcaaatcaggtgtttatatcaagagtacaaaagaaatatttttgagtataacatatattactgttaacatttattttcctttaattcttacattggaatgagattcctaggggtgggtaaaacaatagtcattctaccagcaatggcatatgttgatacatgttaatggtatatgttgcctatgaatatatcaaaaacataaacattcttattttaatatatgaaattcttaagatgttaagatggtcatacatacctttcaaaaatttgtattttttaatctctacaaatgagtagattttaagagcctagtaggctgattagataggatatattcaatattgagtccaagagcaaaaggaccctttggaagactaaagagaaagaaagttgctgccctctcttcctcccagtgacagtctttgacatttatttcagctcccgttattttcactggaaaatgaacctgtgtgtaattctgctgatcctggttttcatggtgcctttttacattggctattttattgtgagcaatatccgactacgtaagtattttaccctctcagtcagcgtatagattgagatgagtatttgaggggacttaaattgtggatagcttcatttctacattaactttcagtatctaccgctatttgaggatacctcacacacaacatcttaaaaataaatataaaataaatattgaatgaattggcacaaaataaatattgaatgaatgattaggttatttgttctgccacagctttatttttctacctattaataatgtctccgttagttcatcccacaccttaaattcagctaaatttctcttacgatggtaaggatgctttcactaaaaattatgctgttcatcagtcatttgccaagtgaattagcagccaaatattagttagcattatcttatatttttaaatagagcaagctctttaacctatatctgtttttcctaacagttttgtctcctctgtctcagtgcataaacaacgactgcttttttcctgtctcttatggctgacctttatgtatttcttctggaaactaggagatccctttcccattctcag

SEQ ID NO: 55960 - DNA, 1019 bp, Homo sapiens
ccaagttaaaagtgtgcttaaacatacatcctaaatgtcactgagctgagatcatgccactgcactccagcctcggcgacagagctagactctttcataaataaatgacgggttgatgggtgcagcaaaccatcatggcacgtgtatacctatgtaacaaacctgcatgttctacacatgtatcccagaacttaaagtataataaaaaataaaataaaaatatttaaatatatattttatatatatatataaatgtaactggatcaaagctaagaaaaactgtaagagagctgggtgaattccatttccctgagatcccagaggattagctataagaaatgagagcaaaggcattttagtttattatggtcattttactattttctagaaaaaagtagtaggtaacagttgaagtctatgtttgtctccagataccctgtatcatgcccaagagtgggaccccaaaacattttgctagcagtttgtgctttttgtaggaatgtgactgacacggatattctagccctggaacggcgactgctgcaaaccatggatatgatcataagcaaaaagaaaaggtaagatatcaacactgtaatacatttggactcttacaatttctcaacaagaaaatttgactgtgaattggtgctggcagggaattttatcttattcatttttactataaggtaaagtaccagatttagtgttggctggacacagtggctcacacctgtgatcccagcactttgggaggccacgacggggggatcatttgagcccagaagttcgagactagcctgggtaacatagtgagaccccacccctttaaaataacaataaaattaaaaatataaaaaatttttttaaaaagatttagtgttttgtgtgaaagaaaattcaatctcatttcttgaatttagatcattctccttagataaattattagaatttttttgtttaattttttaaattgtaaattgacaaattatggttgtatatatttgtggcatacaaag

SEQ ID NO: 55961 - DNA, 1107 bp, Homo sapiens
tcaacttccttcgttccaactacttaaaatcatttaagtcctctatatcatctttgttatttaaaaagtacttttaaaatgtgtattttcaaggtgggatttcatagaaatctatatcacagtgtataaaagcataggctctgaaatcagactgtgtatgaatttgaatccttgatctacaacttaatggtgtgaccttgaactagttactttatgtctttgtgcctcatttgtaaaatagaggtaataataatgagttaagacttagaaaaacaagttagagcccttagaacaatgacccacatatagctaaggacaactactgaaattattaatagtctctacagtacaatcatttgcttttcatgctttgccttcatttattcattcatagattcattcacttaataattttagaaaacctagtttacgccagacactgtactagatgctagggatagaatgatgaacaagataatcatttcttaccttcatgaagcttattagtctactctctttattaaagttattattacccataagtaaatggtaacaggttttgaattgcatgagtattttcacatttcatatttccttcttcaacacttttctatagtaagacccatagtcaagttaaagaagccttaatgtaagagataacattagacataaaggccaggcgcagtggctcacgcctgtaatcccagcactttgggaggccgagtcgggcagatcacaaggtcaggagatcaagaccatcctggctaatacggtgaaaccccatctctactaaagatacaaaaaagtagccgggcgtggtggtgggcgcctgtagtcccagctactcgggagactgaggcaggagaacggtgtgaacccaggaggcggagcttgcggtaagcccacatcgcgccactgcactccagcctgggtgatggagtgagactccgtctcaaaaaagaaaaaaaaaaagaatgataaagaaggctcaggttcactgactaattatttgtctctatttctgcatgtcagtaaagacagtcagtaaagactaggctattgaaggtagacacgtgtataatttattttatttacatttattgttta

SEQ ID NO: 55962 - DNA, 1107 bp, Homo sapiens; identical to SEQ ID NO: 55961

SEQ ID NO: 55963 - DNA, 1107 bp, Homo sapiens; identical to SEQ ID NO: 55961

SEQ ID NO: 55964 - DNA, 1107 bp, Homo sapiens; identical to SEQ ID NO: 55961

SEQ ID NO: 55965 - DNA, 1010 bp, Homo sapiens
ctcctttttagattacatagataaggaaggttgcatttttcttctgtcagaaattgttaataaggccttagtttatgaaatatctaaattgaggccgggcatggtggctcatgcctataatcccagcactttcggaggccaaggcaggcatatcacctgaggtcaggaattcgagaacagcctggccaacatggtgaaaccccatctctactaaaaatacaaaaattagctgggtgtggtggtgggctgcctgtaatcccagctactcaggaggctgaggcaggagaatcgcttgaacccgagaggcggacgttgcagtgagctaagatcacgccactgcactccagcctggggagagggtgagactccatctctctctctctctctctctctctctctctctctctctctctatctctctctctctctctctatctctctctctctctatatatatatagaatgtgaacatttcttattttgcattctgctttctgtgttacccatgagtacataactgtatatataacttcaacttctaccttcagctcagaagttacttgtcctttttaattatgtgtatacctaaaaaattaagttcacaataaattctaaaatgtatttccatagataaattcatttgctgtacatatagctctaattcttttgtggttttctcataatattttttatgtacagtatttgtctttacctctgactcaggtattaatggatttcaatgtgattacagaaaaggctgatttgacttcctagtttgatgactttcctactgggtttgtgtttgtgcacagaggagctttgtcagcttgttagttaattttgatcaatgtagatgaatgaggattttcattatataaaggatctagtgttacaataaattgatgtcaataatactcagatgacattttaaaatctggattcattcagtgggagataatgaatgaagatagtatgttcagttagcaaagctactaaaaggtattttccta

SEQ ID NO: 55966 - DNA, 1010 bp, Homo sapiens; identical to SEQ ID NO: 55965

SEQ ID NO: 55967 - DNA, 1010 bp, Homo sapiens; identical to SEQ ID NO: 55965

SEQ ID NO: 55968 - DNA, 1010 bp, Homo sapiens; identical to SEQ ID NO: 55965

SEQ ID NO: 55969 - DNA, 1457 bp, Homo sapiens
ttgggaatttttcattattccatttgatatcgtttgttgacttattagctataactcctttttctgttattttagtatttgctgttagagcattcagaaaataaccacaaggaattaccctgggatttcttgattctcttaatctgacttcatctaccaaaatgttacctttttggctcctgataaattaaggcataatgccgtagctttattcccattgactctttacagaaaagaaagatggaggacatagggacttttgtttgcctatatatgagtatccgaaatagatttcctatatatgatttggattaagagtagaattgcatttttaggaacattgacctgtaagatatgttatagtgattaattcattagtttcagtcactttttgaaatagtaagtgattgttaagatgctccaaggtaaaaatctgcatctttgcaggctaccatcaatattgtttttgatcgagttgggaaaacggatcctgtcacaagaggcattgagatcactgtgaattatctgggaatccaatttgatgtaagtgttatatcaagatcctggtttgtcatgtttctgttttatctgctataacttatcattgttaagattctaatttgtatactttaggtacttgcttctgcttttgttcttcccactctgtatattttgacgtattcacatggaaaatttttatattttgatgtattcacatggaaaatttgtaaaaggccaagattctctctcttaacataaagccagaagtaatgactgatacttaatattgtcacggatgctgattatttctacagctgctcctctgcttctctataggcagctaccagtttaccattttctccccaccaaagtattcaaatacttctctctgtgattcttattgagctcttcaaacacacaactcagctttgatgctccagtggaaaattagctactaattagtgttctgtgttagagctgaaatgatttctgctgtaagaaatgatctttatctattaatgtggaccttgggctaaagatggtaactgtcacctatgcacaaaatttttttttaaattgtctttttactgtttcataataccactgtcataaatacacccttgtcctaattgaagttcagtgtctttattcataaaccagagccaatgactctggctgaatagcactttaatagtaagaccaatgtcatattcttagtcccagtgtaggccatttagctgtgctgtcaacctagacgcagactgcgtgctacccccagccatccatcccagccagacgtgcccctaatctcaaaaggacttggatgaaatgaaaatgaacaagagcaaattgagccccaatccttgagaaacagctcaatgtacatgtttcttgatgctagatcaatagtgtatcctctttgagtgtgaaggaacatgatatcttttcttcaagtg

SEQ ID NO: 55970 - DNA, 1106 bp, Homo sapiens
gatttcgagatacgtcccatcaatacctaatttattgagtttttagcatgaagggctgttgaattttgtcaaaggccttttctgcatctattgagataaccatgtggtttttgtctttggttctgtttatatgctggattatgtttattgatttgcatatgttgaaccagccttgcatcccagggatgaagcccacttgatcatggcagataagctttttgatgtgccgctggattcagtttgccagtattttattgaggatttttgcatcgatgttcatcagggtctaaaattctctttttttgttgtgtctctgccaggttttggtatcaggatgataccctaactcattttatgaggccagcatcatcctgataccaaagcctgaattcaactattttctaatcaacgtaggaagacttcacggaggtggaaagtgagtcctctctggtaggaaaggtagggatttaaaaatccaggagcttttgaatgaaagagaagtggctgggacaggaagggatctgcaggcatctagcacagttttagaaagagcgtgggagcctactaacaattacaaccgcttggagtgggctggagtgatctgacttaatgttttatagtgatgttaagtcatatgtatcacatagtttctgaagtttgatagcaataggaatcctttcatatgttatgtaattaaattacccccagggggaaagtataactttttcagcagtctattttaagtctcttctttatagtcttaatcatatgaattgttctatacaggattgtggcatggaagagacacttttaatcaaatgttaaccatatttcttactgttcgtgacacaggaatctaacagtactgcataaatttatctccctctttcttgacagttcttttatgccatctctagcagtaagtcctccaatgtcattgtcctgctattagcacagataatggtaagtttaattagttacctttatgttgacagctgtaaaatatcagaaatgtgcttgatacttttaagaattttaataatttcctttgtcctgttcctcactacattcagagtcacttctggattaattcatttgacttacag

SEQ ID NO: 55971 - DNA, 1106 bp, Homo sapiens; identical to SEQ ID NO: 55970

SEQ ID NO: 55972 - DNA, 1106 bp, Homo sapiens; identical to SEQ ID NO: 55970

SEQ ID NO: 55973 - DNA, 1106 bp, Homo sapiens; identical to SEQ ID NO: 55970

SEQ ID NO: 55974 - DNA, 1027 bp, Homo sapiens
ggcaccagagaagcaaatggcaccttgaacttaagcctactacagactgttagaggccagtggtttcaaaatttagatataagaggggggaaaaatggaaccagggcctgacattttataaacaaacaaaatgctatggtagcatttttcaccttcatagcatactccttccccctcaggtgatactatgaccatgagtagcatcagccagaacatgagagggagaactaactcaagacaatactcagcagagagcatcccgtgtggatatgaggctggtgtagaggcggagaggagccaagaaactaaaggtgaaaaatacactggaactctggggcaagagatgtctatggtagctgagccaaacacgtaggatttccgttttaaggttcacatggaaaaggttatagctttgccttgagattgactcattaaaatcagagactgtaacacttttgccttacgttcattttatcaagcatagcttggtatttattatgcttgtgtgatctaacatgagttagcatcccacacctcctcttctgatcctgccccattaaaataaccaagaggttatctgttcttttccgggaaaggggtggtatgcacctgaaatagattttaccaaaagagagatttcagttatgtcattttttcttgatttcctgtgaacttagtattataccctactttcaattcggtagtgatgtttcctttttttttctatctgcccctcacgctgtggggtgaaaccgtgaataacttaactgggggaataagtcacttgtgaaagggaaatgttgaaaaatttttagaacactcagacatgcaatttaagaaaattctgaattttattactaaggtcttattctgtactttattgtgttttgggtttctagaggcaaatgaaggttaaagcataaaaagtgaatccaaaacaaaagcactatcaagcatactcaaaaggcatttgttaatggtatttattctagcaaccacaacattgttacaaaagcacaattttaat

SEQ ID NO: 55975 - DNA, 1909 bp, Homo sapiens
ccttgtcattgccttcttaaagtgaagttcttgaaaccggacacaatattgattgaacaaatagaacatttagatgtgtgaggcattattctacatgctctgaatattccaattcaaccctcatagccacccttcactgtagctactacccctctcttacaactaaggaaactgaagcacagagagaggtggtaactatattaccaggaattccaagtatggtctgaccaagtaagtacagtaagatggtcatctctagaagccaagtgtcagttaatttttaaattaccatatttggatgggacaaccacttggactatcaagtttctggtctttttctgtagtcctcaaatcaggtctcaccatgtggtattcatacaatttacttttaggttagtatagtacatctgaaatttattcttatttctttagttttcattctttctatcctaactaaatattttgagtattaattacaccatccagcaaatgaattatctagtgccactttaagtatgttaatatattttccatatctcctttcaactttaagcacataaacggttaggaacaagtagcatgccattagagacttctattcaagttgatattcaggttgatatcaagtattttctaggtatgattgttcaagtagctaaaaaaaaagccattaatctaattaattgtttaatcctgcttacaagattatcttgaaaaaatgtgctggggagtatggtataatgaattacaggtccaagaatttgggttcagataccaccttcagtctttactaagctgcgtgactttagcaaagtgcttagtctctctaagcttcggtttcctaatctatgaggagggcctaagatatcaccacccatcatattcccccctctgtaccgcttattttagattctactatcattgtatatcacagaggacatttatcttgttcatctttacaatcaacacttagcaagacagatggtacttagaaggccccccaggtatctgttaaactagacaacctcagttcttgtgttaaaagtaaaaaaaaaaaaaaaaaaaacaacaacaaaaaaaccttaaaacatgcagtagtgggtgttatgataaagagctgttaagagaaaataaagttagtttgattcaggttggtcttggtctatctgtgtttcttttttatttgctaagggcttacaagttgtttaataatcctttctaggcttttatgtgcagttgatagcacttaactgacctaaagcttaaaatctaattgtttcctattttgggaacaattttatttccaggcttatattctccatagattttctcagatcaccaagagtaagcctgcagttatattcacaaattctttcaaaatcttaagaccaaggacttaaaactcatttatcaatcatttggcattctcttatcactaccaatttgagttgagcttcagtttagccttaatgatgattgttatgcctcttccagtttgaggaacaaagtcctaactcagtgcaaaagttgaggtcatgagtgaatgggcccagccttaatgcatgaatatatggccttgtattacttaccagtctgtacatgttgtccgtctctttgtctaccaccaacagtgaagtctgatctccaccctttctaatcatttctaccacactgtcatgatccagggtttccacagactcgccgttgacagcaactaccagatcattgttcttcaagccagcctcctctgctggacttccagaatctatgtccttgatgatttgacctaccctcccccaaccccaaaaaataaaattatcagtaagtcccctaaaaaaataaaacagattttctgctggagcccaaagccctgatgaaatagataaaaaaggcatgctgagtacaacta

SEQ ID NO: 55976 - DNA, 2048 bp, Homo sapiens
tggtagactccttgactaaagaattcctgtctgcttcatatgatattctttctccaaggcactgaggatgtttttacaaaacacaaaccaaattaatatttgataaattaatgtaaacagagagtgaaaagaaaataacaacttatgggcgaatagcagtttatacggcctgaactcatgttcttttatgtatttaccttccctgaaagaacctagtgttcttcctattgagttgcaaggaaggaggactcctggttctgagtcccaaatcctcacccacacctcggcctcaggtccagcggtgtgctatactggctcacaccggctcacaaaagccaattctgtgcaacacttcattgtgttcagtgacatcgtgttagtaagttgaaattggacatgggaggagtatttacatcacaaaatactaccaatttggtaccaaaaacaaacgctaccaatttggatttccccctacccccgccccagagagctaacttaccaggataccgttgcccagatcccaaattctgccttatcataatgctgtggaaacttttgatgcccaacatcagaccctcatgtgacatagacgctgacccagctgtgccttctatgctatgccgctcatgcatctggctgggagttgggaacctaatggaactctggagtcagaatgggatgaggaatttgctggttactgccaagtttcctgctcttgtaccttacctttctgttctgagcctgccctcagatagaaaccatagccattgcttcctttcttcatctccacaattcggggctggtggggtaacagtttcaaactggctgtttctcttttgaattgtatcttctgctcaacatgacgcttgtcagtttctttgtccaccagcaggaacatgacacggcttcctgacttcttcacctgtaacaacacacacagatgaggaatgacatcaacccccaagaacaatgctggggaataagaaagtttctgtataaaggcacacagtctctaggttcaacaaaagataggggatgaaaggcctgagtttaagctgttacactatgccctaccagctaactgatatgtatttatcgccttttttttttttttgagatggagtgtcactctttcgcccaggctggagtgcagtggcactatctcagctcactgcaagctctgcctcccgggttcacgccattctcctgcctcagcctcccgagtacctgggactacaggcgcccgccaccgcacctggctaatttttttttttttttgtatttttagtagagacggtgtttcaccgtgttagccaggatggtctcgatctcctgacctcgtgatccacccgcctcggcctcccaaagtgctgggattacaggcgtgagccaccgcgcccggcccctatctccacttctatagttgttttcccttatttaagtatgacctacccacataggtgctaactgagcccaagtaggagctggaattcagaaaacccataaaggtacctagataaaagctagaaagggagtttggaaaagaaaagaaagtaagggtccacgtcaaaaaatcattctacaaagagaaggttggtcaatttttaaggttccatatgacctcaaaggaaaatctcggttatctcccacttcctattaaagcatttcagtattaacggctcaacagtgaacttattgtaaattcagagggcgcagtggcacacgcccataatcccagcactttgggaggccaaggcgggcagatcacttgagctcaggagttcaagaccagcctggccaacatagtgagaccctatctctacaaaacacacacacacacacacacacacacacacacacacacataaaaattagccaggtgcggtggtgcacacctgtagtcccagctactcaggaagctgaggtagaagaatcatctgagcccaggaggccgagactgcaatgagccgagattgtgccactacactccagcctgggtaacagagtgagaccctgtctcaatcaaacagttcagagggggctcccaa

SEQ ID NO: 55977 - DNA, 1276 bp, Homo sapiens
ccaagtagctgggattacaggcgcctgccaccatgcctggctaatttttgtatttttagtagagacgagggtttcaccatgttggccaggttggatctcttcacagcctgctgagcaataaatgagatagcctagagcagtggttttcaatttcaggtagttttgtttcccagggaacatttggcaaagtctgtagacaattttttatcttttttttggagacagagtctgactttgttgcccaggttggagtgcagtggcgtgatcacggctcactgcggcttccacctcctgggctcaagcaatcctcccacctcagcctcccaactagctgtaccaccacacccggctaattttttaattttttttagagacagagtctcactgtgttgcctaggctggtgtcaaactcctggcctcaagcagtcctgcttcggcctcccaaagtactgggatggtaggtgtgagccaccacacccagcctgtagacatttttgatttttgtaactaggggctagaggagggttgctactgtcatgcagtgggtggaggccagagatgctgctgaacatgctgcagtgcacaggatagacccctcaaaacaaagaattatattgggcccaaaaaggtaagagggctgaggttgagaaaccctgggatagatagagggatagtcagtgtcatcttgtgctaattgtgtttaaggttttgttttggtgtaggtttgatttttaattttgggatcccagtgaattttcagtaagaaaattgagaccgtataattttaggcaaacctctgatgggagagagggtttagaacaggaactagggctcagttagtggctgcaattccattatagcagtatctattggagttactttctgtctttggaattactgagaccagaggaattggattacccctcgcaagttacatactgtaagggcaacttataaaagaaaactatccacatttttttgtcagttgggaattaattgagatagaaacactgcatgtaatttagtaagacagctggaaatcccagtttgaaaacaaaatgaaaagcagacaacaagcctaacttttagttttactttctgtgtttctcttatacctctcagaagtttcataagctccagaaattttgtgtttaaccttttagtttcttcaaattcttggttgagagggtatattggagttattaatctttgttctaaaattcttcgggtgacttctcgctgagtcatctgaccgtctcagtttacctaagtatat

SEQ ID NO: 55978 - DNA, 1276 bp, Homo sapiens; identical to SEQ ID NO: 55977

SEQ ID NO: 55979 - DNA, 1117 bp, Homo sapiens
cctcccgtgtccttaattttttttttttcttagcaagtttccctctgataactctcccctcaattttcttgcattcttttatacctggtctttttcctacgatgacctccccccacacttcttccactgtgtcttctcaccttcctctgtgttcttttccacttttcaccccccaccgcccccgccacctcccttgtcagtgaagcgaaatagcggattgctgaggattgtcactcttcggttttttctagggaaggaagcacagaaagggggttggaaggtatctgtggggcgaaaagggggattttgctcttcagtggtttccagggtccttgtgaaagtgaagacagcagcgtactaatgacttgcagacggtctgcactcctatcactgttgaaggaaatggctttaggaagaaggcaggacgtactgtttcaacttcgtttattttggttgccatgctgccagtgtctttaatatcattgttccgccccccgccctgtccctttcttcacctaagaaaaagagccgggacagaatgttggggatgcttcctctgacgtgaaattggttttcacgagtttctgccagagtgttagccccttgagaggcagtgctgtggttgggaagaaaacacttttgtaggtcaggcgcggtggcttaggtctgtaatcccagtgctttgggaggacgaggcaggaggattgcttgaggccaggagtttgagaccagcctgggcaacagagtgagacccctctctacaaaaacaaacaacatttatgcagcatactagccagcaccagcatcacaaacccagaagctgttttgggttgggttgtagctactacgaggagctcccccagggtgaatgtcaatcctgtccttggccaactgtctttacggttgttcctttccttacaagtgtccaggttcagtcttgtgatagagtggcaacataatgtatgtttctatttatggtgtctcagatacagtgtaggagaaaaccttctgaagtgagtctgtatatcttatttcttagaaacacaaatggagtccagtgaataagtgcttaaagggtgttttatagtcttctctcactcaaaagttttgtttaagg

SEQ ID NO: 55980 - DNA, 1117 bp, Homo sapiens; identical to SEQ ID NO: 55979

SEQ ID NO: 55981 - DNA, 2641 bp, Homo sapiens
gctcatagaagggcatgcttgaattcggggaaaaaaaaaatctctgttaaaatgggatgcaaaacactttatacattgcttttacaaaagttagactaatttaaaggaaagtcttcaaaaacaatccgtgatcgataaaattacagaaaaaaatcaggaaagggggaaataataagggaagaaagattagcagaacaatcttccgccccagtaaagaggattgaattttaaccaatgagatcacaagtttgaaaatttccttttcaggcccaatcaagaggagactatgtctataaatatgactgcctagaccctctcctatcaatgagacagcatggcccgtactaagcagactgcccgcaagtcgaccggcggcaaggccccgaggaagcagctggctaccaaagcggcccgcaagagcgcgccggccacgggcggggtgaagaagccgcaccgctaccggcccggcaccgtggctctgcgggagatccggcgctaccagaagtctacggagctgctgatccgcaagctgcccttccagcggctggtacgcgagatcgcgcaggactttaagacggacctgcgcttccagagctcggccgtgatggcgctgcaggaggccagcgaggcctacctggtggggctgttcgaagacacgaacctgtgcgccatccatgccaagcgcgtgaccatcatgcccaaggacatccagttggcccgccgcatccgcggggagcgggcctaaggcatatttttaagtggtcgatctaaaggctcttttcagagccactgccgttttcatcaagagcagctgtaccggctctccatctgatgtgcgtctgccttgcgcagcggtcaggggccaggggcactcgtggtgggtgacgttacagaacccaaagcccagccgtgagttggccggcagtagagaaagccgcagaggcatggtccttgtggttccggccgagcgttttcacgctggtttaaggctagaggtccggctcccaattctgtgggtaaagttttgcatgggggcaagagactatggggagtttctagatgtggaagatcctgagtgtaagggtggggcgagtcccttaaaaattataaacccgtttcctggtttatttaggaactataagcttaattaaagctcagcatcttcctcattgcatactacaggcggtgtccaagccagaatagtaatttaagcgggcgggagtaaatatctggcgatttttaaaaatgggtgaggtagtatttcaaggaagagaaaaaaatttccacaaagtatagaataaaaatgcaaaaacgaggcaagagagttaacttgtctagctggcgttaagatttcttccgtatgcaagtctaatggaaagtgaaaaccaagaaaaaaccccaagccgtagaaactatcgcttcacctagcttaaaactggttagtgtgaaatggaccattctgataggataacaagacttttgttacagtgaccattaaggaagcaagactagaatctattatttacatagactccaccccctctgacgacaccgttgtaagttaaccaatgaaagcgcagcactttgcgagtcttcatttgcatacgggctctataagtagcgcataaccagcccgttttgcggtagttcggattacttctttaagtctcttttctcttttttcgcgcaaaaatgccggatccagcgaaatccgctcctgctcccaagaagggctccaaaaaggctgttacgaaagtgcagaagaaggacggcaagaagcgcaagcgcagccgcaaggagagctactccgtttacgtgtacaaggtgctgaagcaggtccaccccgacaccggcatctcgtccaaggccatgggcatcatgaactccttcgtcaacgacatcttcgagcgcatcgcgggagaggcgtcccgcctggcgcactacaacaagcgctccaccatcacatcccgcgagatccagacggccgtgcgcctgctgctgcccggcgagctggccaagcacgccgtgtccgagggcaccaaggcggtcaccaagtacaccagctcgaagtaagagtgtgcaagggacgcaatagatcaaccacctaaccccaaaggctcttttcagagccacttcagtaatcgagaaagcagctgtaaacacttgtcagagcgtttgatagcttttggtcaggtagggagtgttaccatggtcacggatgcattcgggtttaggactaaggagtttcctgtagtcctgtaatgagttggccctcagtcatccccgtccagtcttactgagttgcttgttatctgtgctacgagattcgaaaggtttgactcgttctgggatatttgggagggatggagggaaggaggcggggggtggttctacaccccttcggcctttaacctgtatctttaaagtcgttttcctttttgtttctgaaagtaatgaacgagatgagatttcccatacagatgagaaaccctcggtccgacctcttactatttcttagtgttttaatctgttttccttaccatatacctacaggcgtctgtcacaaactttgtctaatatagccatgtgctttcgtcccttagcctttttgcaagtcctgacttagccatcctcccctaac

SEQ ID NO: 55982 - DNA, 1586 bp, Homo sapiens
ggagcccttcttgggagccggcgcgaactttgcaggctcaggcatggccagacccaagaccgacaccgacccccgagaacgcaagcagagcggtaggctcggggtctaccggaaacgactgtgtacttacagaggctgtgcgcatgacgctgcgttatggttcgcgagttttccgcggcgcgcaatgcgagggagacgagattatgtaaatgagtggattctggctgagctatcctattggctatcgggacaaaatttgcttgagccaatcaaagtgctccgtggacaatcgccgttctgtctataaaaaggtgaagcagcggcgttttcggcgactttcccgatcgccaggcaggagtttctctcggtgactactatcgctgtcatgtctggtcgtggcaagcaaggaggcaaggcccgcgccaaggccaagtcgcgctcgtcccgcgctggccttcagttcccggtagggcgagtgcatcgcttgctgcgcaaaggcaactacgcggagcgagtgggggccggcgcgcccgtctacatggctgcggtcctcgagtatctgaccgccgagatcctggagctggcgggcaacgcggctcgggacaacaagaagacgcgcatcatccctcgtcacctccagctggccatccgcaacgacgaggaactgaacaagctgctgggcaaagtcaccatcgcccagggcggcgtcttgcctaacatccaggccgtactgctccctaagaagacggagagtcaccacaaggcaaagggcaagtgaggctgacgtccggcccaagtgggcccagcccggcccgcgtctcgaaggggcacctgtgaactcaaaaggctcttttcagagccacccacgttttcaaataaaagagttgttaatgctggccactctcagtccagcgttcctcagtagtgaatagcgaacctggagctgacgggacgggacgggacgggacgggacggggcggggcggggcggggtgtgtgtgtgtgcgcgccgtcttccatctggagcacgtaactgccttggctcttcgatgagtgggtccccagtcctaggacttcccagggcaggtgcaggcaccaaacgtcctgggcgccgccacggtccgctccacacagtcacaaacaccagcgccgcgggcagtacccaacgcgctgaagtgttgcgcgcggagcgcgcgcttccctagtggtttccgcaggctatggccggacacttagacctagtctggcaccagcgggacgtgctcctcgtccccacccccgatggggagggccctgagcgggtagtgctcgctagtgtggcggagctgggtcttggcttcactgagctgacttaagtcttagtttctgttttgttttccaaagcgccctggcggcggagagtaagggcctcggaggcggaatcttgcgtcctgggggcgggcacctctcccacccaaaaggcacccgacaggcgaaaaacgatccgccaagtagcaactgggggcggggggcaaatggaagaatgaggttccacgcgggagctgtagggcgcagcaagaaagggggggtattgcgggcagtgtgttc

SEQ ID NO: 55983 - DNA, 1113 bp, Homo sapiens
acagtgcctctcagtaaaacaaaaccagtattttgtttgaaagcctgctctctttaaagatcctggcatgcaaataaggggctttaatgtggctctcagcgattggtagatacttacaaaatccgtcatttcctttcagtgcaggacgcaaaccaagaggcggctttctgcttttctattggctgttagatacggctccgcttttagccaatcaaacgacttcccttcacccctcccggtagctcttataaattacatcaaattggttattctttccacattcttctccttgtaaaagaagctgtaactgcaattttagccgtaatgtcaggacgcggaaagcagggaggcaaggcccgcgctaaggccaagtcgcgctcgtcccgcgctggtctccagttcccggtggggcgagtgcaccgcttgctgcgcaaaggcaactacgcggagcgggtcggggcaggcgccccggtgtacctggcggcggtcctcgagtacctgaccgcggaaattctggagctggcgggcaacgcggctcgggacaacaagaagacgcgcatcatccctcgccatctgcaactagccgtgaggaatgacgaagagctcaacaagttactcgggggtgtcaccattgcccagggcggcgtcttgcccaatatccaggctgtcctgttgcccaagaaaacggagagtcacaagcctggcaagaacaagtaattaagaggcttgacaccatactcattcaccccaaaggctcttttaagagccaccaaagtgtcaaatgaagggctgatcacgaaatagcgcattagctctttttttgaaaacttgggtggctctaaaaagagcctttggtcttggtttgtttgtctgcatttatttgcttttggctttgtggctttcggttttctttggtaacagaacggcctggatgttaggcaaaacgccgccctgggcgatggtgactttgcccagcagcttgttcagttcctcgtcgttgcggatggccagctggaggtgacgagggatgatgcgcgtcttcttgttgtcccgagccgcgttgcccgccagctccaggatctcggcggtcaggtactcgaggaccgccgccat

SEQ ID NO: 55984 - DNA, 1089 bp, Homo sapiens
cgtggggttagggcggatgcggggatcgcggggcgggtgttgacattgtgctctcaccaggcggatcgccccgaccctcactcctggcgtctgagtctctggcgtagcccatgctgagtgggcggctggtcctgggtctggtctccatggctggccgcgtttgtttgtgccagggcagcgcgggatccggggccatcggtccggtggaggccgccattcgcacgaagttggaggaggccctgagccccgaggtgctagagcttcgcaacgagagcggtggccacgcggtcccgcctggcagtgagactcacttccgcgtggctgtggtgagctctcgtttcgagggactgagccccctacaacgacaccggctggtccacgcagcgctggccgaggagctgggaggtccggtccatgcgctggccatccaggcacggacccccgcccagtggagagagaactctcagctggacactagccccccatgcctgggtgggaacaagaaaactctaggaaccccctgaaccccaagagagggaggaccaggatccgaatgggctgggtgagcacgaattaccgaggccttccctttgatacagtccaggatttgtaagggatgaagacccctgggccccattctgttggggtccatacatactctccgaagatagcaacttgcttcaggtcaaagtgaacccgagaaaagagaagaatcactcactactgctcttgccctggactattcaggaagggcagcccggatgttccatgttaaatcgtgacagaattgcaccagacctgatgagttggaaacaatcctatacattaaaagaaattacactatgaggctgtgttcttaatggactgctgaatcagtgccacaggtgttcttgggagaagaaagatacttgtagactagtcgggaagggctttatgagggaagtgatctagttggatctttaaaggaaagcacaaaattaaccagaaaggagaggataggtgctgcaggcagggagaagaacctgagcaaagacatagacgctggactgagaagtgagttaatggacaagacaggggatataggcaggg

SEQ ID NO: 55985 - DNA, 1023 bp, Homo sapiens
cctcctcaagaagcagaggcctcctctggagtgagaggctccacccactacagcacaggcgggaatagcacagctgccctcccatgctccctacctgtcccctcacagggaggggagcaggggagggaaagaaaccaggcatctggtcaaaccagcagatcaaaaagcacaaagagctggggcagaggcaggaagcaggggccctcctggcagctcctctgagtggggagaggttgggcagtgagtgagggacccctaatgcagggactagaagcctcagtttccccattttacccttccacacaatagcctctgtaggttaggctgccccatcccaccctactctgtgtggctgctttctttggtgccctcccctcaccccactgtagctgtgacgtgttgtagtttttagatgtttgtaaaatgtttaaaaaaatgttaaaaggaaaaaagtgaaaataacaaaaaagaaaatcaaaattcaccttcgtcatgctgcgtccagtgccccaaccctgtggtcactctccccattttgtaacactgtaccaggtggtgactgtttaactctttggtgtctgtgctcaaaagactgccttctccagtgcccagtgtatgagtgtgtgccctgtgcccttgtccctcactccccacatgctggacgtagccctcttcctcgcacccctgggagggacccatccatctcccttgctctcctggggaaccctaaacccaactctgttgatgtgaaaaatgcagtgaaaaatattgacgaaaaataaaacggaaacaaatcctcaaaatacaaaatggctatacctgcttctgtgactctccacctacatccaattctcctaacagccttggagggtaaaatggtgagatggactgaaggtcagaataacatggtgtaccagatttacttcctaaattggcctctctaccttgatctttcccctacagatggagggccctctaagtctcccagatttgaaaactttgggagtaatgtttcataagaat

SEQ ID NO: 55986 - DNA, 1622 bp, Homo sapiens
gcacaggctttgaggttatgggttttgaatctcagctccaccacctgcctctggcctctggcaaattacctctatgagcctggttgtttcctctgcaaaatggaggtgataatagtacctgtgtcatagggttgatgtgctagatcaatgcatgtaaagcatcaattgccttggcccatggctggcattgaataaatgatggttactgatattattaataaacaattataagggaggttgaggaggagtgaaaagccttccttttggataccttggttggataccttcggaacaagtctcatcctgggctatctgaaagccagctgatgggacagggtgggctgtgggtgggtttcactgtggccaggctcatgttgctctctcctctcctggctccagctggctccagcgtgatgtcctgtgtctcctgcttcttcctgtcttttgggaacagtgagtcggccatgatcgctctgctctgcctttttggcggggtcagcattgcatcctggaatgcgctggacgtgttgactgttgaactctacccctcagacaagaggtagttggaatgtgttggaggcagggcagtggattcaggggaggggtggggtgaggaaggagggctgaatgggaagagcatccttaggggtgagaggatatacatttccattttctcctctaaaatctggtagctttggccgggcacggtgactcatgcctgtaatcccagtgctttgggaggccgaggcaggcagatcacctgaggtcaggagtttgagaccagcctggccaacatggtgaaaccctgtctgtactaaaaatacaaaaagttagctgggtgcctgtaatcgcagctactcaggaggctaaggcaggagaattgcttgaacccgggaggtggagctttcagtgagccgagatcgcaccactgcactccagcctgggcaacagagcaagactccgtctcaaaaaaaaaaaaaaaggaaaaaaaaatctggtagcttttgtatctactcctcaaagtcttaactgttaacctcaatttttggtctcctttccctttgtctctcaatttatttacattcctggtgtacatcctttacctctctgatctctccaaccttctctctccctcttggacactgcctgcatcttcctggacttcacttccctgccctccactcttcctttgcctccctcctgtaccttgcgccgtgctgcactgggggactcctgagcaggaccacagcttttggcttcctgaatgccctgtgtaagctggcagctgtgctggggatcagcatcttcacatccttcgtgggaatcaccaaggctgcacccatcctctttgcctcagctgcccttgcccttggcagctctctggccctgaagctgcctgagacccgggggcaggtgctgcagtgaaggggtctctagggctttgggattggcaggcacactgtgagaccaacaactccttccttcccctccctgccctgccatcctgacctccagagccctcactccccactccccgtgtttggtgtcttagctgtgtgtgcgtgtgcgtgtgcatgtgtgtaaaccccgtgggcagggactacagggaaggctccttcatc

SEQ ID NO: 55987 - DNA, 1071 bp, Homo sapiens
cctcgtctgcgcctttccttctgtgtttgccattggggctctgaccacgcagcctgagagcccccgtttcttcctagaggtgatggggctgagctgcatggggtggggtggggtgcgggctgtggagtgtggacggcagcaggggcttctgtgttcaaacaccaactggagtttgatttgatcctgtttgactgcctgccttcctcacagagtccactctccaggggactttatcttgcattctttgccttggaatgtgtccctgaggggttcttgggtggagaaaccaggggacctcttcacccatggatgacttaagattttgcagggaagggccttggccctgtcctgcatttacagctcaagagacattcccaccccctataccttcccctcctaaccccagcaggattaggtctttgactacatgcttgcccatcatttcccttacctttggtttttacattcctctgtactatggaattcccaagacctgtgcttgcctttttcccctggacaacactccccacccccaacccgcagctcttgcccaagtctgattgtcttgctatacctcagcttggggctctttcagagtggtgagtgcatgcccataggtcagggcttggtggtggggttgagggctgggaaccatttagtgtcctgtgactacagaagccaggtgggagggagggggtctataactctgggtcaggtaggggctgacttggatgtggggattgtgtctttggctctagaatggaaagcatgatgaggcctggatggtgctgaagcaggtccatgataccaacatgcgagccaaaggacatcctgagcgagtgttctcagtaagccacagccctcccgactcagacctccacgccctgcagccccagcccctacctggcccctctctgagtaccccccacctcagaccacactctaccgtaaggagattttcagggtatcatatccacctcctgcctcccattttgctaatgcaggggaaactgaggcgcctggccgatgttgggaaacacagagtgtgtgactgcccaccccttctcttga

SEQ ID NO: 55988 - DNA, 1703 bp, Homo sapiens
cctccctcatctgcacttatcatgttcttacagcttcctgtaggcacaccccttgtcccgtgcccttactaacttttcttttactctttgcaggtcacccaggtcctatgcctccgcatggtatgcgtggacctcctccactgatgcccccccatggatacactggccctccacgacccccaccctatggctaccagcgggggcctctccctccacccagacccactccccggccaccagttccccctcgaggcccacttcgaggccctctccctcagtaaattcacattttccttcctcctgttacattttcccaatatcttttctattccttggaccaatcagagatgctgtagctccttggggcaaaggtactaatccctttcagcacccccactccattcccctttttaatgtaactttttccacaggaggtatttcttttttatgttggtcctgagtattttgcaaatgcacagagaaaataaaactaaactccttgtttatttgtggtgttttccttgacaacagtaacttttctctttttcttttaagaagagatgtcagtatcatgaaaagaatggtaaggtaggagtaggagcaagggtgcttactccacattttaaaggcttattctgtaatgtgctgttgcagttgctgagctttgctgtgcactagagtaattgtttccttacgtagagcttatcttctagtttggaagatagggacccaatatatatagcataggatcgtcattttttttgtttcttttttttatttggagacacggtcttgctctgttgcctaggctggggtgcagtggcacgatcatggctcactgcagccccaacctcccaggctcaggtgattctcccaccacagcctcccaagtagctgggaccacaggtgtgtgccaccacacccagctaatttttgtattttttgtagaggtgagatttcggcatattgcccagactggttttgaactcctgggctcaagcgatcacccctgcctcagcctcccaaagtgctgggattacagacgtgagccacctcacccagccggactattgttttaaagtgaacagatgtatctggagatagtctggcaaaaatgaagtaacatgcactatgcaattcattgcagcactgttataatggcagtagattggaaactcacatctccatcagtaaagggacggttgaataaactgataaattcatgcagcagagtactgtgcagctgtaaaaaggaatgtaaaaaaagctttaaaaaggatctccaagtgaagatctctacgtactgctgtggagagatctccaagtgaagaaaataatgtgtgtagtgtgctaccttctctaagggtagcatatatatatatatatgtattaacgtttttaaaaatgggtaaaccagctactcaggaggctgaggcaggagaatcacttgaacctgggaggcggaggctgcagtgagccgagatcacgccattgcactccagcctgggcgacagagcgagactctgtctcaaaaaaaaaaaaaaaaaaaaaggataaaccaaatactaatggaaattgataacactggggagggagtggatattgagggaagctggattctctgagtatactgtgttaatgtgtttttcatttggaacaatatagatgtcttacataattacaaaacaaaatgagtaaatgga

SEQ ID NO: 55989 - DNA, 1075 bp, Homo sapiens
gcctgccaccatgcctggctaatttttgtatttttagtagagacgaggtttcaccatgttccccgtgttagactaggctggtctcaaactcctcagatgatccacccaccaaggcctcctaaagcgctgggattacaggcacaagccgtcgtgcccggccagtgagactgttttctactcacctcccacctctcccacctctcccacagactcactggtttcctgtcttcttgaccccaatttattctttaaacagctttattgagacataatgtacataccataaaatttacccttcactgaagtatacaattcagtgagttttattatatttacaatgttgtacaaccatcaccacagtttaattttagaaaccatcctggccatttacaattacttttcattcctgttcttaacccagcaggctatcaacctgaatcctgaatcctgagttctaatctcttgcccttctgatctttctaccctctatcagattcatctgtagctgaggataaatggctttcagccctggaaggaacacgatggctggactatgtcaggtactccctcgcttcttctagccatcatttataattcaaccttcctcaaccttctgttaacttggggtcctaaatggcctttctttagttcttctcctcggtttcccaagaagactgccattttctgctctttagaaggaggaggggtaggatttggagtcggccttattccatcccatgacccatcaaaatcactccattcccctaggcttatcattcttcctccctcttcctcacctgctcctccagggcttgtcttcgaaaggccagtgacatttcagtattagtgacatccagggttcgttctgtaatacttcaaggtgagttccttggttaagcccattccattccttgcctcttttctttacccacctgaccagattgcattcagggagggagacccataaggcttcttcctctcctgttcctgggaactacctgcgagctctactctcatccttcagtgctacctctgcctccccatcacaacttgtggtccctgacactaggatggt

SEQ ID NO: 55990 - DNA, 1048 bp, Homo sapiens
gcagtatttaaaaaaattaatgcaaaaaatttatgttggataaaatagcgaaatcttacaggatctgacaggactgagattaggaggagggaagtgaggctgaattgaataagtatggggatgaatccttcttatttaaatttttgatacattgtccatcatagactttttacattaattgtgattttttaaaaatgttgcattaaaatagtatttatcttggttactgggttttttggcactccttaaattttgtgcccaaggtgagtgctttgctcacctcaccctagttacgtccctgtttctgtgatttgaacactagcgagaacaccactgtgtgcgcctccacccccatcacacaccaaacaacaggtggctcagacaccctgaatttgcacagctcacctagctttcctaatttaggccttcatatcatagaatggtggcctggaccaataggaatgaaaacagaccaggggttttcccagagaataaagccggaaaagttttgattctccactggactgctgtgtttggatttgatctgttgttagattctagttaacacttttgtttttaaaaactaaggacaaatgaacaaaaaaccttgtatcatgtttgtttttatttataagttagccaatcccaattccgtttgctttattttcaaataaaaaaagatggaaattttgaggggtggtctaggggtgaatatggtaaaatggggctttaggccttatagctttttattaagaaataaattattttttttatttgggagggtaactatttattgaggcattgaaaaacctctccattctaaggatgagagaccctgagacaatggatattttttataggagatagtgaagtttgttttgcttcattctttcggggagggttttggtgggatggggggaggtgaaggaataatgcctgggaaattaatatagattcagcttggtttgtggtattttgggaagatgagggaatagaagaggcaagcccatgtcgttactgggttggggagaaggaaagaaggggcata

SEQ ID NO: 55991 - DNA, 1814 bp, Homo sapiens
cggggccttcccccaactcagaccaaatgcaaacaaccgaactgcagcttctatggacaccctgagacaaacaacttctgttcctgttgttacagggaagaactgaggaggagggagcgggaaccggatggggagctcctggtgcacaggttctgaacgggtggaacactgaagggcaaggaggctaaacaaagttaagctcaactaattggctcatcaagaacacagtccccatgttgagggggaaaatgcagtaatgtttgtgggagcctggctggaaacttttaagtgtgtgcacacaggagtgctgccaggctggcaagagcaggtcggggctggatggcacctcaggggctgtactattcctctgcagagcttgacttgatgaggtttgaggtacaaggggaaaagatggcgattctgtcttataacctcctgggtcccatccagggacctaagagaaagtagcaggggaaggtttggtgtgtgggggtgggaggtgggcagaagtcttggggaggaatgggcaaaggaggttctcagtcaataaaaccaaagttctttaggttgggaaaaagcacatggtggagtgagaagtgtggaggggaagtgggaaattggacacatttgctattgatttgaattaagctagaaattaaggttggataaattcttccccttgaaggatctggaaagacaaggcagtaatgtgtcctcatgggtgcctgttaggaggtgggggtagtttaaatccgtttgtttagatgggaaagggaggaacttaagagggaaatccttttcctcttaaggtttatttccttccaagcagtcatatgtcatctgttacagtttgagaagagattgctgattaccccctgtcttttcctcatctaagtctttaattgtatttgtttaaagggaagagtgtggtgagaacagccgtcatgtgtgttgcattttctccaggtgaattggggcagagctgatctattttttaaccacagcaataaccatacgttggggtttgagtgcaccttgggaggggtgggaggacagacattttagccagaggctgtttcaaacaaaaccaaaaacctaagtagagcattacaggcctctgtggctgctgcgtttctgtagaaagcaacttattttattgacttttttttttaaggaaaagaaataaaaagaccccagcaagcaaaaacatttaaaaaatgatttttttccctcctacttaagtggttctttctccctttgctctacttttggagaatgaacttaacatcccggcttcttttgttaagccatagctgaccttaatctgtggttagtttattaaaataattaaaaatactttctaagaagagatatttttgatattaggactgatgttgaaacatataggggcaatttataaaaaggtagttagagaaatatattttagtgaactataaccacagagcacagatgactcccaatgagctgatctgtctttaggtttctccctttccctgacccttccctgttctctaggggctgggagtggggatgcggacacagtagggggagctccttcgcattttgcacaaagcacaagtctgaacagcctatgctctggccagagccatttctaagagctttaaaccggaagacctatcctgggccaattttcctttttctttatatttttttccgggaaaaaaagtcaactatgcaattgtatacactcccgggtgcatgtgaagaaggggaataagtgtacttatgtgtccagagtattaactggggctgtttttctgtgtttggatttc

SEQ ID NO: 55992 - DNA, 1024 bp, Homo sapiens
ttccaggctcctctggcccagcctgagtcccccaccgcctcagctggagatgagccccggtccactcctgagtctggagactcagacaaggagtcagttggcagcagttccaccagcaacgagggcggccggcggaaggagaagtcaaagcgagatcgggagaaggacaagaagagagcagattctgtggctaacaaactgggcagctttggcaaaaccttgggcagcaagctcaagaagaacatggggggcctgatgcacagcaagggttcaaagcctggaggggtggggacagggttgggaggaagcagcggcactgagacactggagaagaagaagaaaaactcactgaagagctggaagggtggcaaggaggaggcagctggggatgggcctgtgtctgagaagcccccagctgagtctgttggtaacggagggagcaagtatagccaggaggtgatgcagagcctgagcattctgaggactgccatgcaaggggaggggaagtttatttttgttggaaccctgaagatgggtcaccgtcaccagtatcaggaggaaatgatccagcgctacctttctgatgctgaggagagattcctggcagaacagaagcagaaggaggcagagaggaagatcatgaatggaggaatagggggtggccctcctccagccaaaaagccagagccagatgctagggaagagcagccgaccggtcccccagcagagtccagggcaatggcattttccactggctaccctggggactttactatccctcggccgtctgggggcggagtccactgccaggaaccccggaggcagttggcagggggtccatgtgtcgggggcctaccaccatatgccaccttccccagacagtgccctcctgggcgaccctacccccaccaggacagcatcccttctctggagccaggcagccactctaaggatggacttcacaggggtgccttgttaccacccccctaccgagtggctgattcctatagcaatggctacagag

SEQ ID NO: 55993 - DNA, 1027 bp, Homo sapiens
agctactcgagaggctgaggcaggagaagcatttgaacccgggaggtgaagtttgcagtgagccgagattgtgccattgcactccagcctgggtgactctgtctcaaaaaaaaaaaaaaaaaaaaaaaaaaaaggaaagaaagaaaaagaaaagaaattaagaaatctgggctggagatagatggtatataccatacagatggtagtggatgagattatggcagtagaagagatcacccagagggaaccaaggtgaaaatcattgacacaccactagtattttgggggcagacagaatttagaggaatagaaagtaattttatggacgctaatggcaaagaaaatttaaagaggaaaataacccatgtgaaggctaagatgggaaccagggtccactgaatgtggcaattagaaggtcattgttctttgccaaaatcaggtaggtgaaatgttatgtggcaggtgggtgagcaggatggagggcagaaatgggacagattgcagtaggtcaaaaagaatggatgataaagaagtttaatagtcatagactattagttcatggatcttgactgtaaaagagataagagatttgactttgtagtacaatttgtaaaccaagtgctaagggattagggagtaagtaacagtgaataaggtggaataggtattgcctcttagaacccagcctctaattgcccaatgtcccctgcctgtccttcacacagtcagggctggtatacacagaagatgaatggcagaaggagtggaatgaactgatcaagcttgcctcaagtgaaccccgaatgcatctaggtaccaatggagccaactgtggtgggtaagtatggctaagtaggggaggaggaaacctgcatagagtcctcactgggcttccacagcccagtgtctagagagctctgtgctaagaggatattagaaggaaagaggggaactatgctaagggcacaaaagtgtgtaacaacatgatatgtttaggaactacaggtagttcggtattgaactggaa

SEQ ID NO: 55994 - DNA, 1050 bp, Homo sapiens
ttgctaaatgaatgggtccctatcacactgggaaatatggaagtggaggaagacagtcagagggaggggaagatcaggcaaattccaaacaagggcagaaagaggaatgaataatttggtgctaatgtgagtgcctacaaaaatactgtctctatttctccaattgtatttggcttcagaaaaagggttctgaaattcagtagtcagttagacttagtttttctctgactgtaaaccctgttgagaggtaactatcaccacatcagtgtagagttctccaagtgggctgtgtatgttctaaggtgactccatttctcattgcagaaaaacgcctgtctaggggcatctcccacgccagctccagcattgtttccctggcccggtcccatgtctcctccaatggtgggggtggggggagcaatgagcaccccctggaaatgcccatctgtgccttccagcttccagatctcactgtatacaatgaagacttccgcagcttcatagagagagacctcattgagcagtccatgctggttgccttggaacaggcaggtcagtgagtgcttcctctcccacactcttccctctactctccacctacaggcagccttgtggaggggctggacttgatcgctagcttccagtttaagtgtgttatctgattgcaaagtcaggagtcagtgggataaacttgtgctgtcaaagaatggatacagattagatactttactctgggaatttcctggttgatggaagagaaaccagatacacatgtgaaaaggcctaggaatcaatacctcgaaatcaatacatgaaaaaaatacaactaattataattggccctggaacacccttgtgaacagaaatgaccaatgctgtagatgatgcacagtagtgaacctatccccccaaatgtatttacgtttgtaattgtgtttatcttaaattattgttaaaattaattcttatcatagggtgaggcagctgggaattttggaaaagctaatcaggcattaaaatgcttgtgtgggataagaactggagttagat

SEQ ID NO: 55995 - DNA, 1020 bp, Homo sapiens
aaaccccgtctctgctaaaataaaaaaaaaaattagctgggtgtggtggcgtgtgcctgtaatcctagctactcagaaggctgaggcaggagaatcccttgaacctgggaggcagaggttgcagtgagccgagactgcagcactgcactccagcctgagcgacagagcgagactctgtctcaaagaacaaaaacaaacaaaactaaaaaatatttgaaaaataacatcactataagataactttagacaactcagtttattttgtgtatcatatctggcaaatgttgtattaagaacagcccaacatgcttttgaaattttgccccctttggatcatcattaaatcattacataattgaagccatacaaatgaactgtaatactacattgagcaaattataatcacagtggaatatctgcttgggaattacaagtgtcatgtattcaaaacaaatgaaatgatgtggggtactatctacattattgttctctatagactgttaagaattgactgtccctataaatttctgataaatatgggtattgagagtagttgtagtaagcaatataaattaatgttattgatgtaggaagaaagttcccaaatgtgtaagatttgttgttgattgtcttttttttttttttttttgaaacggggtcttgctctgttgtcaggcaggagtgcagtggcacaatcttggctcactgcagcctccgcctcccaggttcaagcaattctcccacctcagcctcccgagtagctgggattataggggcacaccaccatgcccggctaatttttgtatttttagtagagacagtgtttcaccacgttggtcaggctgctcttgaacacctgacctcaggtgatccacctgccttggcctcccaaaggattttcttttctataatggatttcttttataatctttctagaatgaaaataccctttagaaaaggtatttcccaagaccctgagaattaccagagaggttatttgactaactctagtctagtgaa

SEQ ID NO: 55996 - DNA, 1041 bp, Homo sapiens
cggcctcccaaagtgctgagattaaaggcgtgagccaccgcacctggcctaatactgtattttgagtaattttagctatcagtttactcctctgctagcatcaaaacactagtcaactctgaaattatccagtgtatagtaattgttcattcactcaacaaatatttattgagggccagtgtgcctagcactgtgccaagtgatacgtgcaggggatacattagtgaaggagacatacaagtttcctgctttcaagaaacatatattagaggagatggctagacagcaactaattaaaataatttgagagtattcaagtgccagtaaggaaatacacaaaggtgccatgttagagactattgcaggtggggagttctttagggtggtagcctgttgcttccttctttagtttgggtaagcaaactcatggtagaaaagcagtactcaggaaaagtacaggaaaagcatttttcagagtggtattacaggttcctggttaatgtagatgttgagatgttaatgaagagttaggaaataaaatgttactcttcataattttaaagtgctgtattttaaaattcaactgaaatgaatgagctaggatagtttccccatttggttaggaagctgctgacatgggactgtgattatcctgttccagtgtaatttgagccttatgtatttatttattcctcaggtggaggcctgaattttgatctatgttctacctacatccagctggctgaaagtacttgaggatcacatgaccctggacatggatgctgttctgtcagattttgtccgttccacaggagcagagccagggctagcgcgagatctcctagaaggtgaggagttgtaggggagaatgagaaaagagaaagtaaaatgtggtatttatcattaggatgatttggaccatttaaggtgatcaggaagatactttgtgtaggttaggccctatagttaattctaatgatatactttgtgtataacccgtcataattagaaattttaaaatccctttttcaccttgaactt

SEQ ID NO: 55997 - DNA, 1011 bp, Homo sapiens
atgtattagtaattctttctgataattatgatgttgaaactcaggtaaatttaaaattgacaatatctagaatgatagtcaaagatcatagatcatgaggctatagtgaactgaagaagtttattttttaaaccttgaaagtatcttatgagtcatctaatacaagtctagattatagaagagacaactgaaaccctgtaagtaatttgaccaaagtcacctagttaatacatataggtgtatgtaggtaaactcatgtagtgtgagggaggtaagagttgtgacagcatggttgatgtccctttggaaaggagagtttttaaaacttagaaatagaatggtgataagaagtgccgtagaatttctgatctgctaagcttcaaattggttggtttgttggtagctgatgtggaaattggcttagtcattgaatcatttattcatcaggcatttgactacctaccatattatagatgctacactagatgttggagttacaaaaatgaagaaatcgtgtccctgcgctcatggatctcttgtactattagaacaggacaagagagaaaaatttctattttgccatctttctctgtctcaaaaaaaaaaaaaaaatccagtgttagcaagttagtgacctgctggttttataacccacaaatcttttttgtttatttgccttgccactttttgccttcaacaattatgctttgacctttcccaaaaggcaggggattggtgggtatggtagggcaagtgtacctggcaacttaatgaatgagtcttctatagaaagctgtaaacttggcagaatttgatcagagattgttctttactctgttattgcttccctctgacttttaacctcagaggaatgttggattggtgccaggctgtcaggttagggacatagtttctgccaaagtctgaaagaagagatctttttcagttgaacttatttgacagtcatctgtcctgtgtggagaaagacgtgtttggagtagatgtgtttcc

SEQ ID NO: 55998 - DNA, 1040 bp, Homo sapiens
actgcaagctccgcctcccgggttcacgtcattctcctgcctcagcctcccgggtagctgggactacaggcgtccgccaccacgcccggctaattttttgtatttgtagtagagacagggtttcaccgtgttagccaggatggtctcgatctcctgaccttgcgatccacctgcctcggcctcccaaagtgctgggattacagtcgtgagccactgtgcctggccgagtaagagtgtttttagaagtgcttaactaatattaacttgttagtttttattcttgactgcgtcattacttcaagatggtctggaagtggaagtaggggtgagaggcaaagatagcagaagcgaattttgaacaacataatttattcagcctgttaagtttatacaatgaggtcagcacaaatatttatgaatgaatataggtacaagcaagtactgatataagacaggattttgtaaaataaggccactgtttggctcataacaacatcatgatgctgatctacaacaaatgtttatgtaaagaaatgctttgtctaacaattttgcatgaaaattccatcatccttgggaagtagattttattgtcctggagaacagaatcaaaaccggtatgtgaaagttatagttggggtgtgaggctggtgatagcttttgttttagtttagaaaagcattttctaacagttaaagctgtccagtaataaagtagacattatagcaaagtaatgaggtccctgtcagaccttgtatccaagtggagactatgtgatttgtcagagatgtaatagaaggattcttgcatgggggcaggtatttggattacgtaattgctaaagtccctttcagttggaagatgatgccaggtgagagctgtctttacaccattcagttaacaaatagttgaaaacctcctctgttttatttgaaaggttgaaagccactgcttttcttcttctccccctccccctcctcctcctcttcctcctcctcttcctcctcctcctcctccctgagacagagccaaaaactgtg

SEQ ID NO: 55999 - DNA, 1050 bp, Homo sapiens
gggaatgaatgagctatgtagctgtgtacatctaggaagggacagacacttttcttttgctgttatttttgagagaccatctggtggaaggtacaactaagggaccccctttagggtattttcttgaaggcttgagttgaaagacactggattggaaatgatgggctgggcactgtgtgtatgtgtcaagactctgttttggaaatggtcgtgggactgaagggtttgtttgggaggggtagaggaagcttttaaaggaaagatacagggagggggctatgttgggcaccagtggagtgagagtgtatggaaatgaattgggcagaaagaaggcaactgacaattgttgaggatttattgtatatcaataagctgccctaaggcttcacgtatgttatttaatcctaacaggagggctgaaatgcatacatttcccccattttatacatgaagaatctgaggcacaaaatggttatattacttacctatgattacacagcccttaaatagtagctctgggattggaaccaagatctgtctgaatccagagccagttctttcttctgatgtggagttgagaggagttgaagcagtgagggtggacttccacatggtggactgcccgtgttttcttagtcctcctccctggacaaaatgtggcattgtatgtgagcgtatgttctctggagtcagctgggctgggttgataaaaatcctgggtctgccacttttacctgtgttgccttgggcatattacctaacctctgtgagctttagtatcttcatctgtgatgtggagtaacaataccaagttctcagagttgtttggaagtttaaatgaaataatatctaaagctttaaaacatattactttctttctcttcttactttgagactcatcttgttacttctggattgtaacatttagtgttatatagatccctttagagtaggattggtctggattcaggactagatccacagataaaagaaaaaagaaaaaatatagtaaaattggtcatattttctaagaaggttatattttgtttc

SEQ ID NO: 56000 - DNA, 2256 bp, Homo sapiens
acctgaaagggagagtaaatactataaatcaattgagtatttttgctaataggagattttttacagcgttgaatagccttagatcttttgtatttgcttttaaaatacatagtcaggcatatttaagatgtgactcgttcctaccccttttcttgttttcttcttttgccagacttttatctatgtgataacagatacttgaggattgaaaatacaattttctgaatcagctaacacttgttatgcacctaccgtaagggactggcactgttatttaatttcgtctgccaagactaaatattctcggattttttgactaggaactcagctgcttcctggaactcagctccttgctgtcacagttttaagcatttttaaatgttttctgctaggtaatgctcacaagaaatccttgtgcctgttattaagcttctaactccagaataagcaccagtcatcctaggtatggcccatgatgatagtaataaacatcttctaatgcttggcttcttccatgcttatcctatcttattcgtggccacagctcgtctgtcataacttctgacctggctggagaataaagggaagaaaactttactctttagtagcaagatcctagcctgagttatactaaacattttatataacacctcatttatactcatagcaatgccataaaatagatactgttatgcaaccttacagattaattcattcaaagtatgtattagtgtgatttaggcactgtttaaggtcctgaggatgctatagtgaatgtcagatgaagtatctgctaagcaatagagacgttaaataatttacccaaggtcacaaatcaagaaagtaacaggtaggatttagatatagctctaacggattccaaaaggaatgtctgcaaccattgttacattatgccactgtttacatatattggatgttctctgtgaatatataaaggcataaaaataggtggaaccccagtttttttttgttgttgttgttaaaaatggtcttgatgaatccaagaaagaaatgtgtcttggtgctgaaaagcatacttgcacaataatgcttttcctctcttccccttgcctctcccttctccctctccactcacttgtacctgggtataaactggacagtgtgacctgctttggcatttgaatgagtttgtgctttgagaactaggagaatgttgtttgcttgtttctttttggcttcctgaaagttcgtgcctgcttgcaggttctttcttgtagcacaatggtgagtaatgtgttgttaacattgtaatgtggtcatgcgagttggaattttttttgttttccctcagttctctctgatgagtatgcaggtagggactcttgagtcaaacttgcctgctcaattcattcaaatagaaaaagctttctgtattcagaggactagaaaagagttttgaggttggaaacaataccaagatccaatgtcttttgcccagctgaaattcagttttgttagcattctaggtttattctttagcttgtgctatctaagagaggacttgttttagattacggccactattaccgtgtgccatacctgggatgtgtggtctttactctggagttagcatcttcagaacaggtgcaaggatttattttgagcattatctcgtagaaagcataaaaaaaatgctgaagacttagagcgagtagctgagttccagtaggaattgagttccagttaagttctaaggattaattaggtgggatcaaggttgccagtgttttttttttgttttgttttgtttttttgaggtggaggtttgctttgtcacccaggctggagtgcagtggcacgatcttggctcactgcaacccctgcctcccaggttcaagcgattcccctggctcagccttcctagtagttgggattacaggcacgcactaccatgcctggctaatttttgtatttttagtagagacagggtttccccatgttggccaggctagtctctaactcctgacctcaagtgatccacctgctcagccttccaaagtgctgggattacaggcatgagccactgcgcccggccaaggttgccagtattagaactgtctggtattggaaagctaatcaatttagtattggggatccaggagtatctgggcatagttgatgaggttagcgagatgatttatgtggatgtatctaacccacaagtaatgcatggtacttggattaggtgcacaataaacgttaaatcttcaaaag

SEQ ID NO: 56001 - DNA, 1012 bp, Homo sapiens
aggctggtctcgaactcctgaccccaagtgatctgcctgcctcagtctcccaaagtgttggattacaggcgtgagccaccatgcccagctcccacttgccctgttttgttttgttttgtttttaaacttacccattcttaaagtcccagtgtaaactatctcttccacaaaaacgttcctgattttcttttttctccagcaggatataatctttcccacaactggcttagaattctttataagccttttatattaactaatcaaagttgtatccaggctacactctacagatacctacttagagaatattatagatagaatgcagctttgaaagtgccagtgctgtgttctaaaatagttctttgaaaagtcagggtcattttaaatgagttagtctactagtgccttttgaatcattaacagctaacatcaaaagaaaaggaagagcgaattcctctgaggctttagtgttaattaatattgatatttacatgaaggtagtcgcatgtgaagaattaagacacgacagtgggaaaatacaatgatgctaactaacaaaaatgtagtttgtttatttatttattagggacagggtctcactatgttgcccaggctggtcttgaactcctgggctcaagccatcctcctacctcagccttgtgagtagctgggactataggtgtgtgccaccatgcctagctccaacaaaaatatattttagaaacttatctcctcttatgtgttccattgtgagcatctgcttttgcctcccttgaactggtagctcacctggctaagtatgaaaccatcaatttcctgaaaatttctatcagttctaagggacaggattctctgacatgaacaatacttggtccctgttgtttactgacatgaatagagactttccataccccttcttagaactctgaaaatagaatttgagagttagacttaagagtttctgtgtcctagcttctttgcttgcctaaaataaattcctggctatttggca

SEQ ID NO: 56002 - DNA, 1044 bp, Homo sapiens
aagcttaaaggaatgaaggccagacttcttcaggtaacttttacttaatcattatggctggaggatgggatggagggcaggctgaagaggtaggcaacgctggatcatacagagttttatcttttttttttttttttttgagacagagtcttgctctgtcacccaggctggagtgcagtggcacaatctcagctcactgcaagctccgcctcccgggttcacgccattctcctgcctcagcctcccgagttgctgggactacaggcgcccgccaccatgcccggctaattttttgtatttttagtggaggcggggtttcaccatgttagccaggatggtcttgatctcctgacctcgcgatccgcccgcctcggcctcccaaagtgctgggattacaggcgagagccaccacgcccggcctggagctttatcttatactgcagtatatcaggagccatttaatacgtttcacatcctagaaagattatgtcagtggtgtgtagggtggattggagatggagaaagcagaattcctttcaataacttcattatactgaacacatttattgagagtgatcatatttacagattcatggaatcagacaactggcggggctgcgatgctttcttagttttcctcattcattttcaaatagaatacctgaggtttactcaggatcacagaagtggttctgtgatagcttagtctagaattcagtcttcagcatgtactaggtgattaataaaggtgaattcacctctctcttctctcccaagtcccatttcagtgtttgtgtcattctgccacattgcattgtactagcagatagaaggacttaacatcattccattctaccgtctttttttaaccagtccaaagtgaatagaggtattttcctaggtctgactgagaaagatgttccctgagagtaccattgggaagaggggcagttcggtgccctggactgggctgaatgaggtgttaggatttttcagctgtagtgattcagatgtagaagaatgtcaaggtatttgttttgttgc

SEQ ID NO: 56003 - DNA, 1710 bp, Homo sapiens
gtgctatggaggattaggaaaaatgacaactttgtgtccttgaagagtttacagtccagttgggagtaagaagaataaaaaggaatgaatacttgctgagcctcttaatatgccacacaaaattttaaaatgtgaaactatattgttagttgcatagtgcagacctcataccgtaggtatttggggagaggagtactcaggtagttatgtcacagaggaattataactcatttcagatcttaataaaaaaataggccaggcacagtggctcacgcctgtaatcccagctactcaggaggctgaggcaggagaatcacttgaacccaggagatggaggttgcaaacagccgagatagcaccactgcactccagcctgggtgacagagcaagactctgtctccaaaataaataaaaaaataaatgaataagtgttattgtattaggtacaagggatgaagatgaagaggataacaaaacatttcatattggagctgaaagggatcaagcgaaagcctggaaacaggactatacctgagatgttcttggggcggtgaggagactaacctgagtggcagtgagcagtagtgaaatgaaggtgggtaggttggtttggagctatgtttatagagggtgttaaaaagctaggcttataagtttatatatatatataaaatttatttatttatttatttatgtatttatttatttatttttttgagacagggtcttgctctgttgtccagctcaggctggagtgcagtgacacaatcttggctgactgcaacctccgcctcctgggttcaagtgattctcgtgcctcagcctcctgagtagctgggattacaggcgtgcaccagcatgcccagctaatttttgtatttttagtagagacaggatttcaccatgttggccaggctggtctcaaactcctgacctcaagtgatccgcccaccttagcttcccaaagtgctgggatgacaggcatgagccaccgtgcccggtcaactttatattttaaatggtagaagatttttgaatagaatagcagtatgatgatactaatacacaggttggctgggagggaatggagattgacactgggggtgtgtgaagtgatgaggcccgagttagagttgtggagggtaggctaaggagaggaaagagtgaaaaagagactgtgaaggaaaaatggaaattaatgaggggtggatgtgggagatgaagaagggtgatgagtcaactacaactgtgacacgttgtgcctgggtgtctgagacattgagtgaaataaagaagttaggaagctttcctcattttggggaaatatgatgagtataatttgcgatgtgttggatttaaagtggcaatgaaatgtccaaatgaaggctgtcctgggtgtgagctggagtaaagatgggggtaggtttggaaatgcagttttgcaattcatggcctagatgtggtagctgtagccaagagaattaataagctctctgaggactaaagtttagggaaagagcagaagggcaaagaaaatggtactgataaacctaaacacgtctaaacctaaacatgtctcctatcttgtaaacaccatcctaggcactgagatggaggtaagggagacaaggaacccacgaggagcgtatgggtctagtgggaggagacagatatgtaaatatatagatagaatgaagtgtgatagatgct

SEQ ID NO: 56004 - DNA, 2736 bp, Homo sapiens
atgttgctcctctgcaggctgaatacccccgaccgttctaatttccactattgacccagcttgcctcagagcacctccctgacaaagtggccagttactatgtacttagagattgcaaatcaatgcaaatattagctcatactaggaataattaagaaggtaaatatgctgaaaacatatattccaaaaccaaaatagattttttcgattttaccctcatttttgattatcaccacctttctgccaataattatccgttaacatgaataatttagaattgaacagatatctgctttggacattacactttcaagatagaaggaaagatggaaggaagatagtgccaaactaattttttattgtcattgccttatttgacttattccttgcttttaatactgaagactccctcggaaaaaaatgtaaaactttgccaaagcaagagctggctatctactgacttgtataaggcccggtgactggtaatgaatgctaatcattaggtggcctttagtggccttatgttgccaacaacttggaaaatttcccaaagctttatttgtttaatctttcttttgagacccctatttaaaaaacgacttaatttggagacgaaaatctaatttttaaaaaccacatacacctttcccagaatctgttgatgatcaataattgttttgatctgtgtgagttgattggtgccaatattagtgatgatatctgggtaaattctatttatatctgcatctagcaactccctaagttgaactgcatactttattccagggcatggggatcaaaggggttgaagaagcctaggaatgagtggagagctgcctggtagtccaccactattcctagttctcaggaggctttatttgcaattttgagattcaatgtatgtaaccaaaataagtattctgattgttatgagggcactaagtgccacttgtcaaagttttggagctcctgagtatcttaagcatgctaaaagacactggccattatagtgtgggtgtatgtgtgtatgagtagcactctccttaccctaaacactcatcccaccaaagggaaaatccttaaacagcgctttgaaatgtgacctcagcagtatctttcctatgggaacttaggagctgtggaatagcagactgtggaatcttttttgtagcctctgataaattcaggtaattaaaaatttgtgtaactggaagatagatacagggcagtttttctcatgaatgcctgaattcagttgactttttaatataatagaagagagttgtttgtttgtttttaaataagacatccttgctgagtaatgattgaacacttctctggataaagcagtctccatgctccagtgacaggctttagggaggtataaaagatgtaaagacatgtgtctttgctcttggggttgagggtggatgggaaaggtggtgtataaatatgggaaggcagactattatgagctttaacatttaggaaacaacatatagacaaaagcaaatttaacgtgctgataagtatgtaagggctgagaagacttaaagtaacaaagtaagaatcagtgaaataaattggggagatttctgagtcagtaaattttgaaatggacttgggaggctatggatgagtcataaagaggtatgggctattgagttagatgggtcttcgttcagaccttgcggctattttttaccatgtgaccttggacaagttaacttcttttccttatctgtaaaatgtgagcattcaagtaaatgaaatagttactgtgttgggaataaaagaaaagaaaggatcttccaaacagaaagtatagaatgtacagtgtgcaatgatgatatgaatgactaagttgtgagtggggggaatatatgagagtgactgtagagaatgtgggttgggcaagtcatgagtagagcaggcaagagggtggaggggactcagaagccagactctgttgggtgttgatagaagggtcaatagaatcattgtaggtccttgaacaaaggacggatttaatgagaaatattgagccctttggttcaggaactcagggacaaggaatcaggcaggcatccgtacattgtgactcttattttctgtaccatcctaacctgaagggatacagccaggaggcataagattccttgtagaagtttttgtgtttacacaccttactatgctgagcctgcttgttcctgtctcgtagtgcaccaacctgtggggaagtctcaagactatggccggattctcctcaagagcttatagtaaggacagcattatgtttcaagtgcatttaactctcagttgtctctgctaatgtagggagcactgttgtaggtaattcagaacttaacaaagacatttcctggttattttcaactgtgttttttttaggattataccttatccctttatttcctctaagaaatagttttagataagaaaaattactaaactgttatttgtagtgacccactatgagtttaattctttgctaggtgctatggaggtttaggaaaaatgacaactttgctcccagactgaagtacagtggcgcaatctcagcttactgcaagctctgcctcccaggttcatgccattgtcctgcctcagcctcccgagtagctgggactacaggcgcccaccaccacgcccggttaattttttgtatttttagtagagacggggtttcaccgtgttagccaggatggtcttgatctc

SEQ ID NO: 56005 - DNA, 1033 bp, Homo sapiens
ctttctcctttctgaatctgtttcacccgaagccatctcccctcggcactcctttctcgccctgactgctccttgcttcgtcccgatctttcctcctccctttcacctgcgtcctgcgttcctaccccgcgctctccagctcccggcctcccttcctgagctgtgctggccagtttggacggtccccccttgtcagctagactttcgggagggatggtggagttttaaggtgattaagatgcagtgtattatccccacagtaggataaagttcatttaaaatctcaatataatactaaaatgaaaagcaaataagcttattcttcctattgatagccaaactaaggtgcatacagtaatggaggaaaggcgagaaaaaggtgtgtgtgtgtgtttgtgtgtgtgtgtgagagagggagagagacggaggttgacggattctagggcagtcttaagaactttagaaaaaagaaaagttgccatgagccgatggaaactttagaagctgatgatgagtaagccgggggctgcgtgatctcactcttctcataattactaggttaacggtgtggctccggtcgggatggaatgggatttgtttactgggccggcgtatttttagcttgtcggctcacaaggaccagcgctcagagtctctttctccccgctcgtggtagtctttcttgtctaacctaggtggcttctctgggcacaataaagatgtaaaaatttgaaattagaaactgactggtggaattttatggaagaagttccccacaaacttttcaggcagcttttcacgaatgcaaagcctagaattagcaggacgttgacttttattttccttatctttttatacgtactacgtaacgctttgcttagaaattcacatgctgctaatttttcagtctttggcctctagtactgtatatttaggagatttttgaggaggctggatccctttgtctttcagaatctatttcaaaggtggaaaaggacagagtagagaaagaggtggcggtaagactggctcc

SEQ ID NO: 56006 - DNA, 1029 bp, Homo sapiens
ctccgatggagtcttcctctatcgcccaggctggagtgcagtggcctgatctgggctcactgcaagctctgcctcctgggttcatgctattctcctgtctcagcctcccgagtagctgggactacaggcgtccgccaccacgcccagctaattttttttttgtatttttagtagagacggggtttcaccgtgttagccaggatggtctcgatctcctgacctcatgatccacctgcctcagcctcccaaagtgctgggattacaggtgtgagccaccgcgcctggccagtccttttaaaatatatatatatatatatatataaaattatgaatttgtggattaaatatatttttgctacccattccaatttgaaggtcacttattcattaggctttaactatcaggcccttttacatatattgcagcagaaattatctcctttgagtcaaccccaactcatgtgtttcagatttcagtaatgtgatcagcaagagtgacgtgaagtcattggctgaagctgatgaacaggaagttgtggctgaggttcaggtaaacatattggtcctgtaacacatctcgtatgttggccctttttaaatatttgagtctaaaaataaaaaataaggaaaggtctgtctcaaaagaagttttattatgaatacttgaatatgtttatcacataaatgaggaatattgttttcagaggcagcaaataaactagttttgaatttttcagaaggatgtgataggtgataaatgaataaaaagaatacctgttttaaattatattctctctcatgacaacacattggacagcaaagttcttttttatctgagtagaacattgtatctcctattagcagtattttatttttactaattgataagtatgcatagaggtctccagaaatataatgtgtataaccttacaacctttatttgttagatttattattattgctactgttttgtaattattttaattctcccacgttgactgttgttacccaattattaattgaacaatt

SEQ ID NO: 56007 - DNA, 3256 bp, Homo sapiens
ggtctccaactcctgaccttaagtgatccgcctggctcggcctcccaaggtattggaattactggcgtgagccaccttacctggccaattttcttctgccattaacgtttttttttttttttttttttggagacaaagttttgctcggttgcccaggctggagtgcagtggcgcaatcttggctcactggaacctctgccttccaggttcatggaattcttccttagcctctggagtagctgggattacaggcacccgccaccatgcctggctaattttttgtatttttagtagagatggggtttcaccttgttggccaggcctcaagtgatccatccacctcagcctcccaaagtgctgggattacaggtgtgagccaccgtgctaggccttgccattaacttttcactaagattcaaaaatgtaaccaatcctcatttgttaaaattaagcactttgcatttttctttccactctttaagaagaaggaggtcttcgaggggagaagaggaaacgagatgctgaagacgatggagaggaagaagatgactagatcattctaagaccagattctctaatgtttctgggtgtgcaatagagtgatcacatctttgtttcttcatgtacgatagctatccctacagaagataatgtgtaactttttataggaaaagtgtggttttactatttttgccttatcattccaaataagaactagtctgttaatgatcatattgtatgtagagaaaaattttcattgactcccattgtggaattccctagcaatttatttagacttaattttttaaattcaagcttactgtattagtcatttttagcccataattaaaacatgatcacttttacacaggtgtagtatggtgcatttcattccttatttataaattaactgaaattacagtttgctataatataaaatgacaatagtctcttgagtggtaagttggttatttttttagaggtgatccaggaatctttagtttgaaggcagttaccttttttttttttttttttttttgactaagagtgtttggttgcttttttgtcacaagtaacttggaaaatagaagcagaatagtaaaggttctattcagcaacatagttcatggattttgtggaggttctattcagtaatatggttcatggatttagtggtgactgataagattttatttttgaaggaaaaattgcttatactaagtccagagacatgcaggtgagcccttttgtcaggctgcaaatcatgacatgccgatggttgtttattttgtttttaggtgtgcattctttttcttcttagcaattcctttatgatcaccttcccttcttgtttcactccctcccgctctctcaaaaggaacttgggaaacttgtgaaacccaggaaaacctttagtcttatacctcaactacctttcagtcctgtctgggttttaaataagtgaagtagaagaaattgagtattttctgacataagaatatattatcaatacagttttatgcagtaagctctccttaccataaatgtttcttggttgacaacatctaagacaatattagtgggatgaagaaagaaaagcaggggtgcttttggaagcagtgttagtgttcctcaaaagtcggaacaattgcctgttgatatattaataagacattaaagtcaaattttaatgttggcctctcaaatgatttggataccactctgcaaagtatttctaacctttaattcccagttttaaaacagatataataatagcatttaattggaatatactaggcagctggaaaagtatttgaaactaaattgacattaaaattaagatttgttttcaagtggatgtccattaaaagtagaaaaatatttgggataagtgagtgtgtgtttccttacatggctactaaataaaatataatgagtatacaagtatatctcctcttttgctatggaggctccatgttcaaggcaatggctttttaaatcttggctatctaaaattttttccctttgttttgaatatttgtaagtttttaagaagttagtgtcagcaaattaattgaagttatgcttctatactgggacatatttaaatactgagtatagtactgctgctactgcttctacaatgtaaaatgtatgacttggtgttttaaagtaaaaattatgatgttacttgtggagaaactaaaaatgttgtacaactgaccgaaagaaaacccttggggataagtttagtgaggggattggaatccccaaaaagataacatttttcttctgcttttaaaaactgaaattccctgttctagttcctaacaattctcattacatactatgccagattacaaaatacttatttttaaaatgaaatctatatattgactttcttatcaatcatcttactgtgcaatcaaaattagagtactttggtttgaaaacaacacttagagcctccagataacttttaagacttatttagctttgtgggtggtattttcatgcaaataagtaagggtgggttttatattttgtagaagttttcggtcctattttaatgctctttgtatggcagtatgtatatattgtgttaagttcctcaagaatctccttaaaaactttgaagttaatacttttgtgcaactgtgttttgaataaagccatgacagtgttaaaaacaaacaaaaaaatttgcagtactcctgattattcttttattgtttttgactgttccctgtttttttctgtgactgctgtaacttaaagtttttgaaactgaattgcttcaaataaattgaagatttgttataatgattagtttcagtgtatagcattcactttttcaacaataccattagcggctttgaaggtctttttaaaaactaacagcttgaaagttaactgatttaaatacttggatgtgatataaggcattacaatttatttatttattttttgagatggaatcttgctctatcgccatgctggagtgcaatggcgccatctcgactcactgcaacctctgcctcccgggttcaagcgattcccctgtcttagcctcctgagtagctgggactacaggcatgcaccaccatgcctggctaattttttgtattttagtagagacagggtttcaccatgttggccaggatggtctcgatctcctgacctcatgatctgcctgcctcagcctcccaaagtactgggattacaggcatgagccactgctcccagctggcattac

SEQ ID NO: 56008 - DNA, 1149 bp, Homo sapiens
ttggtagaatgatttactttcctttgggtatatacccagtaatgggattgctgggtcgaatggtagttgtattttagttctttgagaaatttccaaactgcttttcatagtggctgaactaatttacattcccaccaacagtgtacaagcattcccttttctctgcagcctctccaacatctcacaagcaaagttttgaagtgttcacaaagtaaaacaaactttagtgcatgcaatattttcatgagaatctagatatatattggataccagtatttagaagccatacttctcgcatttggtttgtaggaataactaggaatgttgtgaaacagaaatcttaaaaaaaaaaaagtatcgctgtgagttactttccacctattggcttacaagtttgaagtgattgggcaagggtaaaaagcatcaacatcctaggaagaaacatttacccagtcatttactcatctttaaatgattttttaaagatggcgatgaagatgatgaagaggaagaggaaaatgaagctggtccaccggaaggatatgaggaagaggaggaggaagaggaagaggaggatgaggatgaggatgaagatgaagatgaagcaggttcagagttgggagagggagaagaggaagtgggcctctcatacttaatgaaagaagaaattcaggtgaatacacacttcttacctgcactgaaaattaatttctaggcataggagtaagtactatataaagtgtgttttgtagcaatctgagagttgtttctaagttgtgggtgtgcatatgtctatccacctgtcttttttttcattgtcctccaccccaaactatatccagataatcataaacacctattgattttacctcccagataactttcaaatctgttacagcctcaatggcatggtatggtggaaacattttacaaatgtctgtgaacctcaatttctgcatttataaaacagattaggccgggcatggtggctcacacctgtaatcccagtacttttggaggctgaggcaagtggatcatgaggtcaggagttcgagaccagcctgaccaacatgagtggggaaaccccgtatctactaaaaatacaaaaattagctgggcatgatggcacacacctgtagtcccagctaa

SEQ ID NO: 56009 - DNA, 1069 bp, Homo sapiens
gtctctaataaaaatacaaaattagctgcgtgtggaggcgcatgcctgtaatcccagcgactcgggaggctgaggcaggagaatcgcttgaacccgggaggcggaggtgtggtgagctgagatcatgccattgcactccagcctgggcaacaagagcaaaaagtccgtctcaacaaaacagaacaaaacaaaaacacaaaaattagcggggcatggtggtgcgcacctgtagtcccagctactcgggaggctgaggcaagagaatcgcttgaacccgggaggcggaggttgcagtgagcagagatcgtggcgctgaattccagctggcaacagagctagactccgtctcaaaaaaaaaaaaaaaaaaaaagaaaaaagaaataacatggtattttaaatcttgaatgtaagttttaactttacttttccagcaaaatcttaaaaatttgaaaagtcttgacctgtttaactgtgagatcacaaacctggaagattatagagaaagtatttttgaactactgcagcaaatcacatacttagatggatttgatcaggaggataatgaagcgccggactctgaagaggaggatgatgagggtaatcgttcttaatactcataagtgtgtcataattatagcctctgctgtagctgtgcaaattagattgggcctggaaatttaggtgtgaaaaaaaaaatccacaacaagatattagtaagacaagaaaaaattaaaaacccatagctctagccagtatttcttctttcagatttcccatagtttcagggaatttaatgactattataacatgaagctctgtgaaattttatatctgtagaaagttgtacacccagtaaaagtggcaacctcttaaatagtatttttttaaaaaagcaaccacttataatagccagaaagtagaaacaacccaagtgtctatcaactgatgaacggaatttttttttttttttttatgttgagagggagttttgctcttattgcccaggctagagtgcagtggcacaatctcggctcactgcaacctctgccttctggtttcaagcagttct

SEQ ID NO: 56010 - DNA, 1050 bp, Homo sapiens
gatagtttcttgaagccagagagaatgacagttttttttcttcaaattgatatactttaaaaatctttgatatgccaggctcagtggttcatgcctgtaatcccagcactttgggaggccgaggcgggtggatcacctgaggtcaggagttcgagaccagcctggctaacatggtgaaaccccatctgtaccaaaaatacaaaagttagctgggtgtggtggtgggcacctgtaatcccagctacttgggaggctgaggcaggagaatttgcttgaacccaggaggcggaggttgcagtgagtggagatcgcaccactgcactccagcctgggcgacagagtgagactacatttcaaaaaaaaaaaaaaagtttgatatgatacctttaccattctttgtttttttcctttgttgaatgtatagttggagcttagtgataatataatttctggaggcttggaagtcctggcagagaaatgtccaaatcttacctacctcaatctgagtggaaacaaaataaaagatctcagtacagtagaagctctggtaagtggaacagttttgtctctggacttgctttttttggttaaattttctgagatttgtttgtgtctattaatttctatttaactcttaaaacttaagaattttttgtatgttgtgatctaggcagttactgcttttgtttcttttagactaaaatattcagatgaatttttaaatcaatgagaaatttattttatcatcaacttcaggagttgactatctggttttaacatttccagtatttttttttaaccttctttcattctttttctttgcttcttgattattttttgagttttttattatttgtccccttctttcctggtttgagggaaggaaaagaaaaactgacatgctgaaaattattgctctgattttgaaaaaagattggaggctgggcacagtggtttatgtctgtaatcccagcacttggagaggcagaggtgggaggatcgcttgagtccaggagtttgagaccaacctgggcaacatagtgagaccct

SEQ ID NO: 56011 - DNA, 1733 bp, Homo sapiens
tgcccttcgcccggcggaatctgggtcagcggcgggttctccgaccgcgggcgagtttggggactcgtcgcagtgaccggaggtggagaggggacgggaggcgtaatccgcttcttcccccgccgtgtaacgatatgtggcacgtcgtgtggccgcaactctgaatttgatccctggagacggtttcacaaaactcaacataagggacgtagtagtttcgtgctttaaagatgggttcgccgaaactaaatgatgcgctctcactgctgtcgccttaaagagacggggttgggaggggccatgtgaggcggggtcgcggtcaacttttcgggggtcgggtaggaggcgtttccgcctccttttcgcggttgccttctcggcctcacctacccagggcgaaggcgcgaggacaacgcgggttgggaggcgacccgttttttccttggggagtccccgccccgtgtggggtttcccgtcagtcggagcggcaggtcgcgagagcagggctggtggccagcggggagcctcgcagaggaaagcatcagtcttgctgaaataagcctagaattggaacgtaagggagttgtctgtagctgaatcgaccgatcgatagaaggatataactggggtggtgtctgtgcagatcggcatagaggatgagcagggtctgtctgggctttcgcgtccggcgtgtggagtggcaactaagattttttttttttttttttaagtgcctgttttctgaaattggcaggggccagggagaggaaacagttgcttgctatcagggtcatcccggagataacttgaagtttctagagcttattcttagaggcttcaggaaaaaaataaaaaaaaccaaaatcaaactttaaaagctgtctctcacaagcacacgtttagaatactttttggtggcttgggttggaaaattgaatcccgcccccgcctcccccgccaggattctttcacttagtgattgtagtaatttctttgccagttttggggtgtgcaagacgttgccttttttcaacttcttccgctgtgttgtaataacggtctcttatatttgtatagacagtttacaaagcactttacccgtttgttatttactttcctccttacgtacttgtaaggtggattgtgttgttctagaatccaaattagcagacagtctcagggcagtgaaatgatttacagaagtggaggaactggttttctgacaccaaatctagtagcccccactcctcagctaaacggggagtctgaagacagaaccaattcacagtccttcggcaaaccaactgtgactctaggcaagccattcttcatctctgggccatagtttcctcttctccaaaacggagctcaagatgctctttctggccacagaaataattatgtcaaaatcatattcaaatagagaaggtggcattccttgttgccaaattttagccctcggatacctcaaacaggttttcacattgggtatagagaaccaggatcttcaacctttcccttaaagattaagtccattcaggcccacaccaggaagtttgttactacaactcttacctaatagggaattcagccccactccttgaggaatggggaaaagtgcacagaaatgctattataccagagtggtagggagaagtaacattttgttaagaatgtattgttctgggtgataccgtttggcctggatgtgagaaccaataacaccctctggg

SEQ ID NO: 56012 - DNA, 1277 bp, Homo sapiens
aattctcagtatcgcaagttgggcacggaaggatgctttctccctctttaacactaacaacagaataaaaaaccaaaaactaaaaaccaaatccaacagacaacgaaactgtccgagtgcctagggaaagcgcgccaactacataaagaaaagtagggggggtactgggattcaaaatcatttctccgggacgtacaccctcctggacctatcaaaattaactgcgcgcttgatcgtagccaataggtacggaatttctggtccagggcctccctgaagactgatagacctttacctagcccaatgaagtaatgtgacgctgaagaatcaaccaacacgtttgggaggtgggtggagtgtaggccagggggttggcggtgccgtgtcatggaggctcagtctctgagcagccattgaaggggaaggaactgcgggtgtgtgtgtgtatgtgtgtgtgtatgtgtgtgcgcgcgtgcgtgcgtgtgtgtgcgcgcgctagtgtgtggacaaggaggtgggggcagctgagttagagtcccaactcttggactccatttgctattctcttctttctcccccacacctatctggtggtggtagtgggcgtttatatttgcgttccttttcattcatttctaaatctcttaaaaattttgggttgggggtattggggaaggcaggaaagggaaaaggagagtagtagctgaagagcaagaggaggacatggagatgaagaagaagattaacctggagttaaggaacagatccccggaggaggtgagatgactcagcccccaccgcttccccatcagtccagtattctgaggatcggatttctggtggtcctgggtgggtgtgcggggatggagtaataagttagcccccatccccccgggttagggttggggaaatgtttaattttaagttttaaatcattaaaatcttctacttaaaatggcgaagggttgaagtttctaggggcgtttttgtgtgtgcatgggggcttagctcctttcggctttcatcgagtcgggcgtcctgacctcgtgggggcgggaagcgggctggtgggggcgctccgccgcttcgctcccggcactcctcctcctgggggccggcggcgtgggcgcgaccccccagtcccactcagcccctgccgcagccataggcgcctgagaagttagtccaacttttctgcagtgcggccaactcatctttttagggggtgggcttccccggcctcgaggccctgggcgtccgacgtcgcgacgggcgcg

SEQ ID NO: 56013 - DNA, 1048 bp, Homo sapiens
gcaattttttaaagcaaaggaataatctccccttctcccctcagtagcaccccccaacacacacacactctaaactcctttctcctccccgctttctagtccctatccttccaaccctctgcccacaccctcaccccacccaccccaatcttctaagtgttagattgacttggcacaggttacagaaaagaaagggttgggccaatcgcacatttggatccaggttaattttagtctctgggctttacctcttttccttcctcctccccttttactcggcaggcaccaacacagcctggctggtgattttaaataggccccccgacctttccacagaggtgtccggtttcagggcttcctttgcaaagtgctggagcagagggaggagagactgcagagagggaggtggagcagtacagaatgccagagggaggggagtgtggaggccagggttctgccccaggctgcgctggctgtaacccaaactattctgccttgcaggtcaacactggacgtatgagggtgagcagatctcaaggcctcccgacaaccctttcacactgggacctcctcacctggcaggaagacacactgtgcgggtgggaggagacttcctttaccttctcaccctagctcctcccttctggatctcctcctgccttgagtttcacatatatggctcctagatcctgctctaatcatcaaatcctacacctcctgatttggcagaaaagctagttaagtcctcagtaaatcgtgtaggagtgagggagctggggtggaaaggaagctgggtgggaactctgagcttagctgccaggtctccttctggctccgtctatcctaatccatcctacccctaacctgcatctgaaattgggacagagctggaggtcaggggtgaggaagaggctggcaggatagtttctgaccctgggggaggtggaactcagttcctatgaactactgattaatgacttaaccaaactcaagttcatgataaacggtcagtgtgagagcaagaagtgaatgatgagaagtcaggata

SEQ ID NO: 56014 - DNA, 1085 bp, Homo sapiens
ctgtctctgtccttctacaggaggtgttccgctttgcctactacaagctgcttaagtaagaagatggagtggtctggaggggagaggggcaaaggactgcactatgggaagtggggcagcccctgggtgctggtttggaagaggaggcactaagggaggacattagagggaaaggagcatccctgccctccctcatgtttcccctaccccaccccaccccaggaaggcagatgaggggttagcatcgctgagtgaggacggaagatcacccatctccatccgccagatggcctatggtgagccaagggagagggactggaggagggagttggacagccccctcctctagggaagtctctaaatatccacatgttctaagtggcttcttactttccttcatccgtcacttccaaagaaagttggtctggagggagagtagatgtgaaagaattgtaaccgggaatggggaggggtcagtggtgaacaggcaatagtgtgatctctgacattgatgagatcctcccttcccccagtttctggtctctccttcggtatcatcagtggtgtcttctctgttatcaatattttggctgatgcacttgggccaggtgtggttgggatccatggagactcaccctattacttcctgacttcaggtaagatccaccttctatctagcctttaccccccatccatccttgtccctgatctgatttattggccttccctgagagacttctttggctcaacatctcaggagcctgggagaagatcagggatgtatctcctccccatctccctccctgcagcctttctgacagcagccattatcctgctccataccttttggggagttgtgttctttgatgcctgtgagaggagacggtactgggctttgggcctggtggttgggagtcacctactgacatcgggactggtgagttggagacaggggcctgagttagggagaaaagcatttaatggtgagtgggatgtgggggaaagggtatcctcacttcttaacatttttaacttacctgggaggaggaggaaaggtgagtctttcaaggtctctcacctcagca

SEQ ID NO: 56015 - DNA, 1077 bp, Homo sapiens
ttcctgtcagatcatctgaaaccttttcttgatgattctactctccgatttgtggacaaactgtttgaggctgtggaggaaggccgaagctctaggcattccaagtctagcagtgacaggagcagaaaacgagagctaaaggtaggttacaatttactgtctaatgagctcaggactgttttgaatggtaacagagttgctgagcttaccagttcacacgttgatatcctctatttagagcagcaaatgttcaagagaggtacttagacattagagtaggagagatgaattagtgtcatcaccatctgaactacctctaagttcatgggttgaaatatccaaagaaataattggcagctttgtctttttttagataacaggagttttgattctcatgtttctccatatttcctttttttccttcttactgttacttataaactgattgctctaagattttatctttgatttatttgaggcctaataagttgttttagaatgtgactccactggtacctgagctgtacacctcattgttgcctctttgtagaagtttctctgcaatgcacttgtagatagaataccaaaaaataactattatttattatattcttgagagcttaccatttgctctatggcatattgctggtcctctgctgccatgagtgaaacacttggaggagttgtcagtacccccttaactactacactttttattctgtagttgccgactgatcctggcctctttcagtattagcagtatcaagtagcctatttttctactcatttcccagtatctctctttaggagaaaaaaaaaagttctgtgactcctatcaaaccttccaaagttcttctgataccttggctatcccattacttttcctgagggaaaagagtgaataagtaatgtctgcttggtcccctggccaggctatggaactaaagaaaaaaagcagagagatttgtgccctttgtgtttggagcattgtagggtggtcagagaaggagagatagtccttgccttaaaacaatttgtaatttgtcaggcagtgtggcatgtgcctgtaatcctagc

SEQ ID NO: 56016 - DNA, 1008 bp, Homo sapiens
taattttaaattttttgttgagatgcagtctccttgtgttggccagactggtctttaactcctggtctcaagtgatccctctgccttggcctcccaaaatgctgtggttccaggcttgagccaccacgcctggctttattttgttttttgcttgccttaatgttccatacaggatttatttctttgcgggctatttttcaggaaggtggagttaaaagaccaaacgaaacctacaccactgatcctggatgagcaagggcgcactgtagatgcaacaggcaaggagattgagctgacacaccgcatgcctactctgaaagccaatattcgtgctgtgaagagggaacaattcaagcaacaactaaaggaaaagccatcagaagacatggaatccaataccttttttgacccccgagtctccattgccccttcccagcgccagagacgcacttttaaattccatgacaagggcaaatttgagaagattgctcagcgattacggacaaaggtatctggcttagagtataacacagaatttggaaaaagttaagaagctgacaagaaaacattgttaaatctctgtgttctaggaaattagataaataggtcatttaaagcagcagtcctcaacctttttggcaccagggacttgtttcatggaagataatttttcccctggagtaaggatggtttcgtgatggttcaagcacatagcatttattgtgtactttattattattatttttttcgagatggagtgtcgctcttgttgcccaggctggagtgcaatggggcgatctcggcttgctgcaacctttgcctcccaggttcaagtgattctcctgcctcagcctcccgagtagctgggatcacaggcatgtgccaccacgcctggctaattttgtatttttggtggagacggggtttctccatgttggtcaggctggtctcgaactcctgacctcaggtgatctgcccactttgtcctcccaaagtgctgggattaca

SEQ ID NO: 56017 - DNA, 1002 bp, Homo sapiens
ccagctactcgggaggctgagtcaggagaatggcgtgaacccgggaggtggagcttacactgcactgcactgcagcctgggtgacagagtgagactccgtctcaaaaaaaaaaaaaaaaaatttgggattctggccgggcacagtggctcatgcctgtaatcccatcactttgggaggccgaggcgggcagatcacctgaggtcgggagtttgagaccaggctgagcaacgtggagaaaccccatctctactaaaaatacaaaattagctgagggtggtggcacatgcctgtaatcccagctactgaggaggcttaggcaggagaatcgcttaaacctggaaggtagaggttgctgttagccaagaccatgccattgcactccagcctgggcaagaagaacgaaactccgtctcaaaaaaaaaaaaaaaattgagattctacacattctgttttctatgactccaatttatctttctgtcttggattatcttgtttttaggctcaactggagaagctacaggcagagatttcacaagcagctcgaaaaacaggcatccatacttcgactaggcttgccctcattgctcctaagaaggagctaaaggaaggagatattcctgaaattgagtggtgggactcttacataatccccaatggctttgatctgtgagtttgttttagtacctttttaaaaaaacagtttttaatcagctgagtttaagactcaagttaataccttttagtaaagctatggttttagtgggaaggatggtactcattcattaattaaaatttttaaatccaagagagataagtaactgtacacaaggtcctgtatttttttttttttttttttttgagagggagtctcgctctgtcacccaggctggagtgcagtggcacgagctcagctcactgcaacctccacctcccgggttcaagagattctccttgaattctccttgaatctcagcccctcaagtagctgggactacaggtgt

SEQ ID NO: 56018 - DNA, 2117 bp, Homo sapiens
agttgggtctcacttggttgtccaggctggtctcgaactcttgggctcacgccatcctcccaccttggcctatcaaagtgctagaattacaggcataagccactgtgtccagcctaaagtttcttttaatgatattgatatttacctaggtttctttaatatttttattgctgtccgggcctggtggctcatgcctggccaacatggtgaaaccccatctctactaaaaatacaaacattagccaggcatggtggcgtgtgcctgtaatcctagctactcgggaggctgaggcaggagaattacttgaacccaggaggcagaggctacagtgagctgagatcgtgccattgcactccaacctgggtgacagagtgagagagagaaaaaaaaaaaatatatatatatatatatgtattcttactgctttggtatactaatatctctgcctgacagttgacaatgacacaccagttactctgggagtatatcttaccaagaaggaacagaaaaaacttcggagacaaacaaggagggaagcacagaaggaactacaagaaaaagtcaggctgggcctgatgcctcctccagaacccaaaggtgcatttctcagtggcctcttctgttaaaaagagtggcaagtttatgtctttaatcctggaggaactttaacatctctgtgtttgagtgatttctgtttctaagaattattcttggggtcctttttctccaagttttctaccatcttttcatattaagataggtcaacacattcattatagaggccatttatggcttatttttaagcatactgatcatacaacactctggttttcctggaagaatacaggtcttgaaattcatggagatagtagttgcagtatttgcgtagactttttatgtacataattcttaatgttttaatttttacaatgaaagtacaggataaaaaacttgaccctgtagttacattctcgttcagcagtattttgactgagcactattatttataagctctttcactagatgctgtgatcagtgtgaaaaatatgaaaggaattaagttccacgtccttcataaattttcagataatgtaaatgcataccaatcttcaacttaattgtgtgaacttctgcaaatgctgaagtgattggatgggattttcaagataggagttattggaggaagtgagtttagagcagagatttgaaataggtaaataatatgaattggtatggaagaaataacaagttactccagctggagaagtgacttcaaagactgattgttgtcctctcttcactgcagtgagaatttctaatttgatgcgagtattaggaacagaagctgttcaagaccccacgaaggtagaagcccacgtcagagctcagatggcaaaaagacagaagtaagtgccatgggattgggtggaaacctcgggcaagtacctttcccaaactcttctggggggtccatatttggagggaggggagagttctccgttgctctctctttccctcagccctgcctctgatcttcaatgcctttctcacttgtggatgtccttcctgtcacgacagagcgcatgaagaggccaacgctgcccgaaaactcacagcagaacagagaaaggtcaagaaaattaaaaagcttaaagaagacatttcacagggggtacacatatctgtatataggtaggtgtccatactgggccaaacttccccttagaattactaaaacattttccaagtgcttgaggcagaatcattgtggcctaaaagcatacctaacaccagttcctactctcttttaatgaccctagtgtggatcaagagctagtaaatcttgtaaaatagcgagagttaatgacttatgtttatggttacccagttcttccctctcaagtcttctttttttttttaccagaatattagttctgaacaagtcaatatacttgttcaggccaagatgtgaactaaagattgtatgtcctttgagaactataaaatatcatcctatttcttttttttttcatctttttttttttaaatggtctgagtttgcttccaacatccatggaagcattacaaattttctttcctccgtagtcatatcctt

SEQ ID NO: 56019 - DNA, 1039 bp, Homo sapiens
ttggatgatagtaaatacctctccctgactcttagagtaaactttggttagtaatgtaatggttaatgtaaagtgctagactttgaagaaatgtaagagtgtggaaatatttctagactcatcaactctaccttttaagcattcatctatttgtttactccagaggcctttgtttatagagaggaaaccattttggattcatctttttacttgccactccattcaggcagctgctgatgctaaaatggaagacataactaaactttcccttctccagagttcgaaatttgagcaacccagccaagaagttcaagattgaagccaatgctgggcaactgtacctgacaggggtggtggtactgcacaaggatgtcaacgtggtagtagtggaagggggtgagtctgaaaaacttgagggagactgtccccagacaaccctaggcttagagtgattagcattgtggggagaaaggagaaaaagatcgtattttagtgccatacctgatataatatgctaggtctctgcttctgtgttttttggagtagaaggccctaagatgtggttcctgagattgcttcaactaccacattaatgtctgagctcagaggttctttctaccccatcatcttccacagttctggcaaaattattcttctctgtttccaggccccaaggcccagaagaaatttaagcgtcttatgctgcatcggataaagtgggatgaacagacatctaacacaaagggagatggtgaatgggggttagaggggattaagggggagagctatgggaggtggggatggtgcatctgtccgttcatcttatttcctccctgtgacactcttgataacactagatagtgttcaggaattttagaaagacccgtttagactttgagcctcctagacattcatacaatatttactacatgattatatgcatgaatggtaaagctatttttttgcctatcatttaaggcttttctaccagctggtttctgtgtctgtcctggatctgagtaccggttacatgaattta

SEQ ID NO: 56020 - DNA, 1189 bp, Homo sapiens
actttgggaggctgaggcgggaggatcacgaggtcaggagatcgagaccatcctggctaacacggtgaaaccccgtctctactagaaatacaaaaaatcagctgggcgtggtagcgggcgcctgtagtcccagctactccagaggctgaggcaggagaatggtgtgaacccgggaggcggagcttgcagtgagccgagatcgtgccactgcactccagcctgggcgacagagcgagactctgtctcagaaaaacacaaatatccaaggaaatggaggtcacaatttttttttaaccataaaatcacgttcagctgggcacatgtctcacaaatgttactaggtcttcttataaaagaatattatctgatttaaataagaaattgaagtgtttttattatatatctcttttctagggtacagccaaagaccggagctttggagagatgaagtttaaacagtgtcctacagagaacatggctcgtgagcatttcaaaaagcatggggctgaacactactgggaccttgcgctgagtgaatctgtgttagagtccactgattgagactactgcaagcccttgcctctcctcccttgcctttgtctcttcagtcctctcacttattctatttcccaaccccctcccacttgtttgtgtgatctcagaactgtgccaagcagacactgggacaaagggagaatatcttgctcccctcctgagtcagcctggtgttgccctttattccccttatgtgcatatgattaaagagttatttttaaacttggtgtgatatttttcacacattcgtaagtattagagtttgggtctacaggtgatcttttttccggacttttagcaattgctgtggaaaaaaacattttttgtcattgacatttatttatatatataaatggatgaatggatggatggatagatggatgtgtatttttgaagtctagtggaaatgtttgatctcatcctggagctagaatgataaatactgttttcctggagcagaatgaagcagggagatgtgtaaagtggtaagggaggaaggagggacaaatgagtatccatcccttaaccaagagaatcaccaggttagacagattacctcaggacttggctaagtagtctttccaggaaatcagttcctctaagggatgcatatgtgggaatgtgtgttgtgggt

SEQ ID NO: 56021 - DNA, 1648 bp, Homo sapiens
gcgttttgaaaggctttgcaggtcctgttttctgcgtaatttttccgtgattactgactggtttaaacacgaccccttgaacaatattgataaaacctccgagacccgcagcccctccttgcagcgtgtaggagctgccagcgtgcccagcagctggtgttcccgtccgtacctccagaagagcccagcgcgtgcaccatccccaccccctagcttccctccccacctacggctttcacgcactcgcagtgattgttttgcccgctcccgccgccgccgccgccgccgccgccagaggagcagcagcgcttgtgcaaaccgggaagatggcggccggcggcggcggaggcagcagtaaggcctcctcctcgtcggcctcttcggcaggggctctggagtcctcgttggatcgaaaattccagtcggtaaccaacaccatggagtccattcaaggcttgtcgtcttggtgtatagagaacaaaaaacaccacagtactatcgtctatcattggatgaagtggctccggagatgtgagtgttgggggtgactagggaagggaagactggggaaatggaaggaagtgtggcctgaaacgcttggggttttcccacggagccgcagcatttggttggggttgttcacattaaaggtttgaccccagtggtcccaaacccagactccattcctagccaggattgtcctgaattgcaggagactcatttcttgggttttttagccattgaattgttgtgaccttgggccgttgggcccagatccatggagatttacgtatattgtttttaatatttcagagccttgtaaggtgtattgatttttccgaaccttcgcggaaattgtagcgtctgtttatttcttacaggccttgacgtgttaatgatttctggctttcctgatggtaggcgagctgtggttttaagcagtagtaaatccagtgatgtttaatgaggagtgccttgtctggatgaatgtatctaaaacttgtgatgtgtagtaaggagagccttacctggatgaatgttaagaagcagcatgagctctacatagatctgaggcaccaccgggttttccctgtacctgtgtttgctgcaataaaatacaggtttcttggatactgaccagaaacaactgcgatacagtagtcagtatcatcgttaataccttcaaatataaagcgtgtccagttcctctttttttttgagacggagttttgctcttgtcgcccaggctggagtgcagtggcgcgatctcggctcactgcaacctccacctcccgggttcaagcgattctcctgtctcagcctcgcgagtagtcgggattacaggcgcccgccaccatgtccggctaattatttgtatttttagtagagacggggtttcatcattgtggcctggctggtctcgaactcccgacctcaggtgatccacctgcctcggcctcccaaagtgcagggattacagacgtgagccccccgtgcccggccccgttactttttaattacctgaaatacctttttacacaattgagttgatctcatgggtaatgtgcacaggaaatgtgctttttgaatatgtagtacctttttctccagttatgttttttttgtctttatcctggagatttttcca

SEQ ID NO: 56022 - DNA, 1047 bp, Homo sapiens
tttctttgcttcctgcctgcggcatttcaccagtgagacccatcatccagttattctgccttattccacttctgccattgctcctgtagtgttttgatttgtttaccttttagagaacagatagataaaacttgcaaaattataggccccatgcttcgaactatttgtgtttaaagttttgggagggatgttttgtggttctttgaataataatgcagagaaattagtagataccggacagaattacctgtgtttaccaataaccgatcaaagagttattttcttgcccagaggtaaaattataacgtgcaaaaacatcaaatatgataacagtcatcattgaagactcacatgttaagtatctgctatgtgcccagtcatctcattgtaccttaaaatcgtctgagaagtagattttttaatcactgatttacaaacgaggaaactaagactcggaaattaagttgcttaaggttactcagtaaaatggtggggttagggtttgacttcatcattaactttgtaaaataatgtttaacgttcttggtataccagtgatatattgcaaacagttctaatgtgagtgagagaacctcttctccaccctattttaaaacatttttactgacctatgcaagcattttacatttcctcaccttgggctctggggctttaactgtatggttacatcatttgcaagaataagttggtccctgtcccgtctctgctgtgtgggatcacaagcgacaattacagttttttttctagtcagcaataatgagataaaatgaagccagaattttttacctcagctgttgttgctattgtgcctgagcttatttcctttattgatatcttaagagtgaaaaaatgaatgctccaggagggcagtgtgtcagttgaagtgcattgtgtatagtttatatagttaagtgcttttggctaaatatgatgttgtttttctagtggaatggaatttaactttctaaaatgattaagggtaattttagtcgttttgtatttacatttaatgaacttcactggtct

SEQ ID NO: 56023 - DNA, 1075 bp, Homo sapiens
ttcagtgtgtaatgagacttttgttcatataaaaggaaataatttagagaaataggctatctaaggatatgttccagagatatttttattttatccttctttacttttttttttttgagatggagtctcgctctgtcgtccagactggagtgcagtggcgcgatctcagctcactgcaacctccacctccagggttcaagcaattctcctgcctcagcctcccaagtagctgggattacaggcacgcaccaccacgtccagctaatttttgtatttttagtagagacagggttttaccatgttggccagggtggtctcgaactcctgacctcagaccatcattttctaaggtgatctttctgtagcataaacaaatgtcattcctctgctttaaaaccctgcagtgatatcccattgcaacaagttgaaggtctgaatttcttttacattgatctgtaagtcctgtaccatctgctctgcctacctcgggcttcttcacatcctgcctccttctcattgtttagatcaaatctcaactattacctcctcagaaagacctactttgatcaccttatttcttgtttttttttttttttttttaatacggagtcttaatagatttttttaaattacatgtatctgttttttatttattttaaattaatttaatttaatttaatttttttgagatggaatttcgctttgtcgtccagtctggagtgcggtggcgtgatctcagctcactgcaacctcttcctcccaggtcaaagtgattctcttgcctcagcctcctgagtagctgggattacaggcgtgcaccactaagcccagctaatttttttttttttttttttttgagacagagtttcactcttttcacccatgctggagtataatggcacgatctcagctcactgcaacctccgcctcccaggttcaagtgattctcctgcctcagcctcccaagtagctggaattacaggcatgcgccaccatgcctggctaatttttgtatttttagtagacgcagggtttcaccatgttggccaggctggtcttgaactctggacctcag

SEQ ID NO: 56024 - DNA, 1182 bp, Homo sapiens
tggtaattattttaagtttaagttaaaataatcttaaagtttaagatttctttagtcctggatattatagaaaaaaggttttgaaataaacatcagaagaaatttggaaaataattttattgataactttattttcagatttctagtttggagtagaagtcaaggtttttatagtctgtattactttttctttgttttcagggatccatctgtctctaagtctgtagaacgaatctttaaaatctgggaagatagaaatgtatacccagaagaaatgattgtggcattgagagaagctttgagtaagtgtctttttctctcctaaaagaaaatttttgagtcagtctttacaattacataattttatagatctggtcatgttgtataatagtgaaaaattaagttttgaatctagccctatttgtttaaagttaaatatttatgaaaaatctagatctgtttgaattaaaatgtaagtagaattggttttagggatggggtcggattttgttttttagtgactacaaaagtcaagcatgttaagtggtaatagccatctggttattttcctgcatttgcgttgagtgtttcaaatggttcattgtttgtgttaataaatactgccctgtgcccttactgttggagaatttttgcacagggtgtcagttcttactaagctgtttggtagtaagcatatatcagcagtctttagactgtcttttgatttagatttacagtaagtggtgtactgttttgttaaaaggaattatgtattatatgcatgtaattaagttattgaacagaagtttgtgataatctgctaccatgaccgtcattttactagaaatttgctttaaaaatggcatcttctaagaagctgttaaattcttcattttaatttgttaattggtatttttaagcctcctcccctattcttttcagaattggtaatttcgctgatgataaaaatcgtgtttatttgacagcttcttagatcgggtaggaatttctattttttcataaaaatgaaagaaaaggaaagaaagaaacaacacacagtctcggattgccttttttcatgctgcaactttggcactgaagtggacagacagaacagcttcccataatgccagattgcaaaaactgaaatgttttccaggtaccactttcaaaactcagaag

SEQ ID NO: 56025 - DNA, 1095 bp, Homo sapiens
tctgaagaggagactaggcattaagaagcatttctgtgggaaccatgaaatctccagatttgggggatatactctaccaaattagacatggacctcagatcctggccagaagctcattctgtaatgggagctcctgttatatttatcgtatttacccagcatgagatcaagggaatggaatactgcatgtgataggctgctgtgggcaaactgaggaatattgagagagacttgaaggtgtggagggaacaaagtaaaagacagtgagaattgggaggtgaaacgagatacttgggatggttttgctccagcgagcatatgatatccatcatgattaagggagtcctcagacatcttcttggtcataagttgcatgcttaggaacaacaggagtcgtcatttcagccaaagttccaccacagtattaatatacctagaagtttccttgcctatttttgctatgaattgagtcagcagaaaaagaaattcaaaggataaatttataggaatagagttatttgtcaccaattttcttcagccagtgctcaggattaattggatgtcctgttcctgaacactcttaatttgaggtatttagatcctgttacacccagactaggaaaaaaaggtacttgatgtatctcggtgtctccaaatcaataattctaggactttatgacctgaagggtctgttggaggtaagtaggttaggtctgtctaaatagcgtatttttacattgaccacatttaggaatgtttaaatttcctagtccattatttattttaggaattatgacttaaatgtgcatgtttgccatatgttcagagtatatctttaactatagagctaaaatttttcctgttagtcaactttttgtgtctgtattcttaatgaccttttgtttaattccaacagcatctacaaatccaaaagctgctctcaagtctaagatagttgctgaatttcgagtaagttacagaatttgtttaatatagcaaagtattattcaccccttttgtattatagtttcctgtatagtccaataagatttatctgtattcaattacacatgtcatgttttaaacatgcatgaa

SEQ ID NO: 56026 - DNA, 1020 bp, Homo sapiens
tcctcataatttcttcttctattttttttgagacgggtctcactcttgttggccaggctggggtgcagtggcgtgatcacagctcattgaagcctgagatcacactcagataatttctgtacttttttgctagacacatggtttcaccatggtgcccaggctggtctcaaagtcctgggctcaagcaatcctcctgcctcagcctcccaaagtgctgggattacaggtgtgtaccacagcacctatcccaaaagtaatttcatctgcgataaggagataaaaatgcatatcctaacagagttagataatgcatgttaacaatctctgaaatatagtaacaagcattcagtataagacagctttaattattacttacattagccaccacttttacttctttgtattgtgcttcatagaaaattccagcattttccagtgcttctgttaatgagggtccgtttttcacctgcttatctaatccattcacaaattcttccagcttggagcttgcctcttcaaattctttggagaacttcttcccacctgttttatctaaaatgacatgggaaatattcatttcaggataaaataaaaaataaaaaaatttagtcttttgacttttgaagaaaacctctctttgtgaacatactcttgctgccttactgtgcagtactctaatactcttagtttctttctttttttttttttttgagacggagtctcactctgtcgcccaggctagagtgcagtggcgcgatctcagctgactgcaagctccgcttcccgggttcacgccactctcctgcctcagcctcccgagtggctgggactacaggcgcctgccaccacgcccagctaattttttgtatttttagcggagatggggtttcactgtgttagccaggatggtctcgagctcctgacctcgtgatccgcctgcctgggcctcccaaagtgctgggattacagttgtgagccaccgtgcccggcctcacaattttatcttaaacaagtttctcc

SEQ ID NO: 56027 - DNA, 1303 bp, Homo sapiens
gttaatggaaaagaaaaacacaggacaatttatgaaaaatatcatttccaaaagacagaacacaaatgtgtaccaaataataacatgcttcttgaattgtacagatttaatacacaaatactaagaaaatgcaaaggaatcattgaaaagtaagatacaagataaattctggaaattgcttgcttttttttttttttttgagacgggagtctcgctttgttgcccaggctggaatgcagtggcacaatctcggctcattgcaacctctgcctcctgggttcaagcgattctcgtgtctcagcctctgtagtagctgggattatagacgcctgccaccacacctagctaattttttgtattttttgtggaggcaggatttcaccatgttgaccaggctggtctcgaaatcctgacctcacatgagccattgtccccagctggaaattgcttttaagcagatattaaaggtgggaattatcataaattatgaagagtatgactttttcaaaaaagcatgaagtgagtcgttgttttctctaaagtagtgccttttcccccaagtccggaaatattaggacatgttatttcatataggaagcaaagtctggaaagtagtaggatgtaatatctcttttctttgttgaaacagtcgaggacaggaaggaaaaacctgcagagaagtcagctgtatccacttctgtacctacaaagccaacagaaaatatctcaaaggcctcttcatgtaccccagtgcctgtgaccatgacagcaactccacctcttccaaagcctgtgaatacttctctttccccttccccagcattggctttgccaaacctggctaatgtggatctggcaaagatcagttccatccttagcagtttaacatcagtcatgaaaaatactggtaagtaagcccagtaaggaggataaaaagttaatttccatctttttaaattgaatcattaatctgtttttgggggggttgttgttgttgttgttgttgttgtttagacagagtttcgctctgtctcccaggcaggagtgcagtggtgcaatcttggctcactgcaacctctgcctcccgggttcaagtgttctgctgcttcagcctcccaagtagctgggattacaggcacctgctaccacgcccggctaatttttgtatttttagtagagatggggtttcaccatgttggccaggctggtcttgaacttctgacctcaggtgatacacccacctcggcctcccaaagtgctgggattataggcgtgagtcaccgtgcccagtctgttgttgatt

SEQ ID NO: 56028 - DNA, 1053 bp, Homo sapiens
cccttccagagagagccagtggggccatcatctgccccacctgtccctcctaaggatcatggtggtatcttctctcgagatgcacccactcatctaccctctgtggatctttcgaaccccttcacaaaggaggcagccctggcccatgctgccccaccccctcctcctggagagcacagtggaattcctttccctaccccacctcctcctccccctcctggggaacatagcagcagtggtgggagtggtgtccccttttctactccaccccctcctccaccccctgttgaccactctggagttgtacccttcccagccccaccactggcagagcacggagtggcaggggctgtggcagtatttcccaaggaccatagttccctccttcaagggaccctggctgagcattttggggtactcccaggacccagggaccacgggggccccacccaacgggacctcaacggccctggccttagccgtgtacgagagagcctcaccctaccctcccattctctggaacacctgggcccaccccatggaggaggaggtgggggaggcagcaacagcagcagtggcccccccttgggtccctcacacagagacaccatcagccggagtggtataatcttacggagtccccggccagactttcggcctagggaaccttttctcagcagagacccatttcacagtttaaagagacccaggccaccttttgctaggggccctccgttctttgcaccaaaacgcccattcttccctcccaggtactgatggaaaccaagggaaaggcattttgaacagtctagagaacattggaagtaggagtttggtttattgttgttgtttttatttgttttctctttctcgattttttttttattataacaaagggcctctcttccaaagtaagaaatcacatacgcttacgttttactattcaattcaatcctccctcccattgcacttatctaccttccccaagttgtttgtattaaaaaaaaaaaaaaaaaaaaaaagtaaagaaacacaaccaaagccatttcattt

SEQ ID NO: 56029 - DNA, 2076 bp, Homo sapiens
taattttaccatggtgcctccctaatgtaagtgatatttattggtggttttcaacaaaggttaactattaaagaaagaaatatttgtctttatcttccttttccccttgcctcagtcgtgttattcacccctattcttgatattttaaaggaggagattcagtagcattttcctttatattatacacatgtgtctatcccatttcaaggctcaagtcttacccccacctctcgctcccaataggaaataaagaccatttctgcccttagttgttttacatgcaagataagtgctttccttctccctggactgaaagacttgtttgtatttctacatctagtacttgggaaatagacaatcactgtactttgagtgtttatatctttatatctagggacactgaaaagtaaatgttgctttactacaatttttttttaatttagtgtcttaccccaaggcatactcaactgataatctccagctagatgagtaaaacagtatgtgtttagttttccagagaattctggcaagtttcatattttcttccaagttagtatagaactaactataggaagtatggggttgctttttcctccagtagaatattaaagatgggggagggtgggcaatgtagtgacagaaaatgattctctcagaatgaacttttcagagaaagagcagcataaaccaggtgcacatcatgatttgggagtttttgcgtaatttattctgttatttatttgggctcgccatgtgttctggggttaggatgctgcaggtcattcatcttcttaatgcctgtctggtcttaagccaactgttctttctttcctcgaccctctctgccctgtagctctccccacaaaaatgcatgataccatgaccttacgtgtgggatggggtatgtagtgtagcaaagaaaagaaagtatagttatattgagtcctaagacatttgttagggaaaagcataagagaaaatggggtgggaggtggggaaatgatatttgactttcaaaattgaaataggttttttttttgcagaaattaaatgggatgtttttcattctagaataaaagaatgtgaattctctttgctgctcttgtttaagctaaaagtagtgtttacttgataaggctctctgaccatttaatttttatcagaaaatgtggggatgtcaggaaagtggcttcctgaacgttggggcgggataattgtcctcaaaagtatgatggttaatacatgaaaggaagactttgttggacagtttcgaaggtgggcttttaaggagttgggtttttgtggggtacttttttgttttttaagccacaaaatcctcaatatgtttgttttaggatggaagtgaggatttgtatgagactgtcagctattaattttaaggaaatcttaaaatttacatttacatcagtaaatgaagatgacagtgtgtatatatgtgataaatagtgaaacagaaaagacagttctggtattcataacgtgaaagaaaggggttttattctttctgtgtctgtgatttaaaactccgtgaccatgctctgacttttgtatttcaacctgagtttaaacaaataaacaagatattttttaaagaaagcataacatagtgtgtcttagcaaggacatgattcatatggaagcagaatgtgagaagttgtaaggtccttggtactcactgtaaaatcacagacagagaattggtaggggttgtgaatacactagtaccacttaaagttcagtgatacagttcagaaatagggtccttaagtattttgaaagagtttactcttcagtcagcttagatgagagctctctccctgctcccctctaccctctcaaaagttgagagtaaatagaatttggtttgattccagggaggggaaaataagcagagaataggacttttatactttccaataccaggaataaaatgtttgtgatatatatgggtccagcaaacctatcgagataatgtgaatacgataaacttcctaatggcaggatattcactctcaatcctgaagttaccggttcctgcagaattgagcttcagct

SEQ ID NO: 56030 - DNA, 1092 bp, Homo sapiens
ccttgacttgcccacctgatttctatatctacccctaaagaagcaacagctttgagacttcctcataaggttttctgggcatgttattcataatttcctctgcctaatttttttttttaatgtaagccaatcttgtgtagcagggatgagttattccttcatgtatgtagacgtagcaatgcaaacacaatcagaatgggttttggggtattggggcgtttctcatacttgtttatgagtaactgtatggacaagtccggtcagctgctgttcacaattgctaagtaataactcactgaggctgcataggcaaggctacgagagggtcatcagtaagagagatattggcccttaagtaaacatcctgttctgtcttccccatgtagaaggaaatagaagcactctaaagcaaagaagcaagtgcagtgtaaaactatcagttacttttaattaattgctggggaaagaaaggagaagcctttgcttagttacaagtttgaggggaagaggataagaaggccaacatctatgtaaaagttgatcattgcagttacagtcaaccctcctcggtatccatgaaggataccaggttccaggacccccatggataccaaaatccacagatgctcaagtcccctacatacaatggcatagtatttgcatataacctacacacatcatccagtaaattttaaatcatctctagattactaatacctaatacaatgtgagtgctatgtacatagttgtatacagtatgttttgaaatttgtgttacttttaatttttttattaccttttcctgaatacttttgtggttggtcgaatccatagatgcagaacccccagacagagccaactgtacatttccttttttaaatgttacgtttttctatcctttgttcacacctagggaagaatcaaaaattgagaatacagatatgggtggaggggctagtgaattcttcagtgccaactgaggaaacacaaatacagactaggcgtggtggctcacgcttgtaatcccagcacttagggaggctaaggcgggcagatcgcttgagatcaggagttcaagaccaacctggacaa

SEQ ID NO: 56031 - DNA, 1051 bp, Homo sapiens
tctcccacactcttgtctctttctctttgtatttcagggtgtctaccagaagatggacccaagatccatggaggctcctgtgactcagatcaactgccctgcccgggaaacctggtctctccggaaaccttgattaaactgctttttctgacacctcttcctctacaacccttgattctatcaccattgaaacttcagaaccaactctaaccatccccacctccaggtgaggggactaatgagaattactgacagcctgatggctacccccaagtcagtttcccttcatactttactacaaatctgaccatgttcccatatttactgagtaaatttgatgaaatttacctagtcctgtgtcctagatgtatcagggagagggaagagaaaggataaaggaagttgagagctgggataggaattagaggcaaagggcttatgtagggagcagagagctaaaattctagtcaggcacctctttctgaggtgatgggggagtatactgggagcaaactcttctagagaaagcatggtgtggtaaaagaaaaccaagcttggattcagaaatcaccatcagcacttgctgtttgaccttaaattcctcatctgtcagattaaaaggtctcggccgggcatggtggctcacgcctgtaatcccagcactttgggaggctgaggcaggcggatcacctgatgctgggagttcgggaccagcctgaccaacatggagaaaccctgtctctactaaaaatacaaaattagctgggcctggggtggcacatgcctgtaatcccagctactcgggaggctgaggcaggagaagcgcttgaacctggggaggcggaggttgcggtaagccgagatcacgccactgcactccagcctgggcaacaagagtgaaactccatctcaaaaaaaaaaaaaaaagattaaaaggtctataaagtccctattaagcaccatgagtataaagggactcaaactgacctctgcagattcttgattccagcttttttgtttttgttttgttttgagatgaagtctcgctctt

SEQ ID NO: 56032 - DNA, 1050 bp, Homo sapiens
agcaactttctccccactgtggattgtaaccctgtctgttttaaatcattaatttactttttaataattgatacataataattgaacatatgaatgggtatatgtgatattttgatatatgcatacaatatgtaatgatcaaatcagggtgttcaggatatctgttaccccaaacatttatcatttctttgtgttgggactatttcaaatcttctagctattttgaaatatacaataaattattattaactgtattcacccaactctgctatggaacattagagcatattccttctgtctaactctatttttgtacccattagccaacctcttcatctcccctcccccatcctttccagcctctggtaactatcactctattctctaccactgtgagatcaactttttaaactctcatataggaatcagaacatgtgatattttcctttttgtgccttgtaaccctgtctttttcttcatccccaccttccactgctgaagttcaacactggcagatactgcagtggctgctcaagtgaatggagaaccttatgatctggagcggcccttggagacagattctgacctcagatttctgacattcgattccccagaggggaaagcagtaagtttctttcttatcaggaatacagtgactactaaaccaagagatattgaagcaggaaattctaacattttattcttttgccgcagtttctccatttgcagttgggagggagacctaccacagactgtcttgactatttctggttaggaaacttatggtgaaagtttttaacttagcttcgatctattaagcaaacatttgtgctagtgagagggagagagatgatatgttgaaaaaacgaaaggataaatatgtaaattcagccccctcaactcttgagcacgtacattataagtcatctgtagtgtatattcaattctaacatggcttatacagctgagcaaacaacctggtcacctccccaccttgtcttcttcatgtcagctcaggtagcacagaccttgcctattaggatccagaaa

SEQ ID NO: 56033 - DNA, 1187 bp, Homo sapiens
agtgcagtggcgcgatcttggttcactgcaacttccacctcccgggttcaagtgattctcctgcctcagcctcctgagtagctgggattacagacacacgccaccatgcctggctagttttgtatgttttagcagagacagggtttcaccatgttggccagactggcctcgaactcctgacctcagatgatccgcctgccttgacctcctgaagtgttggggttacaggcatgagctgctgtgcccagcctttttttttaagcttgttactttttagtggtcacccccaaaatctaggatccccattttgtggtagttattcctagaagaaccataccggctttcctaccagcttttgtgaggaagagctcagagatctaggggttaagggagaagtttatgaacttgtgaaccccttttttgtgaacccaggtgttctggcactccagcacccatgtcctgggggcagcagctgaacaattcctaggtgctgttctctgcagaggtccaagtacagaatatggcttttaccatgatttcttcctgggaaaggagaggtgagtaatgaaaggaaggaggagaatgattctgggatggtttctgaggctcttttcaggggccttgggcatgctccatttggatgaggaagctggaggagaagggtttctctaggtctcaactatgacattagtatctccttctgtgctagtccatgtccctcttctaactttgcttgaaatttaccttcttggctggtgcacatgtagtcccagctacttgggaggctgaggtggaaggatcacttgagcctgggaggttgaggctgtggtgagccatgatcttaaccactgcacccaacttgtgtgacacagcaagacactttctcaaaaaaaaaacaaaaagaaaaagaagaaacaacttactttgttacttgttagctttcataaattcaagttttacttaatcgccctcattactattgttctaactttgtctatccagatttcctgcattcaacttttaacttcatgcatagagctttttctccagctgtaatatctgttacctgatatcctatttatattttctctgagtttgtctgtctttgcctataactctagatttctcttgaaggacaggaccttacccgctagccaacaggtgtgtcacccaggtgattgatgcac

SEQ ID NO: 56034 - DNA, 1099 bp, Homo sapiens
atgagcaggagaatcggaaggtgatactttctgtcggcaccccccttttttttttttgagaccaagtctctcggtcgcccaggctggagtgcagtggcgcgatcttggctcactgcaagcttcgcctcctggattcaagcaattctcctgcttcagcctcccgagtagctgggataataggtgtgcaccaccatgcccagctactttttgtatttttagtagagacagggtttcaccatgttggccagggtgatctcaagtgatcttcccttctcagcctcccaaagtgctgggattacaggcatgagccactgagcctggccctgtactctcataagctgagcggggaatacaggagaaagaaactttgtccccacattctaaaaacccgtttgatggcacacactggacagcctgctagggcccagaagccaattcagatgccctaatatgatgtcagtattaaggggggtggaggggtggagcaggagggtgtgagcaagctggatgggtcatacagggaagggttgtagagagagggggcgtggtccaggaggaagatgaacaccatttgacaggcacagggaaaatacctttagtaaagggcatgctttttatgaaaataccgttctgcatggtggctcacgcctataatcccagcactttgggaagccgaggtgggtggaccacctgaggtcgggagttcaagaccggcctgaccaacatggagaaaccccgtctctactaaaaatacaaaattaactgggcgtggtggcacatgcctgtaatcccagctacttgtgaggctgaggcaggagaatcacttgaacctgggaggtggaggttgtggcgatccaagatcgtgccattgcactctagcctgggcaacaagagcaaaactccgtctcaaaaaaaaaaaaaagaaaagaaaatactgttctggacaagaagagttactagatggaatgggatgagttacaagggagcaaggggaaatgcagatgtgtagagcaaaaagctctgaacttagactgggcatggtggctcatgcctataatcccagcactttgggaggccaaggtgggtggatcacttgaga

SEQ ID NO: 56035 - DNA, 1066 bp, Homo sapiens
tgttaaaggagagagcaggcagaggcttttggatttcatgtggccaggaatgggatatggtatagaagactgacttttctagcagctgtataggatattgataaatggaggaatagactgacatttgaccagagcttatggttattcctctaagcagtcattgattagaatgggaaggaactaagtaaaggggtaatgagaatggggagaaaaagagatggcaaggtaaggttaggcctgaccaggttgtatgtaggaattaagagtcaggcaatttcaacactttaatctagaagaatggtgtctagaggatggaggtgttcatcctactggtgggattgttgtcaagaggcatacctgtgacacttaacactgagagtatcatttgagtcttgaaaaaggtgggggccttcagtcctcatctttcctttgatcccctatgtcctcacacagaactcatcatccttatggaggtcttcaggggccccagagacactgcagagagtgtcagggatttccttccccacaacagaattgctgagggtctgggaagcatggagggaggaagcagaattgcgggaccaccggcgcattgggaaggtacaggaattgggaagatagggagggatggtgataagggttggagagagatgacagaacctgattatgaaattgggagcagattcagtcacacagactgagcagctccgtcagttgttctgagttccaaagccacctccttgcccttgaggtgacccaatattgctattcctgaccccaggaacaggagctcttcttcttccatgaactgagccctgggagctgcttcttcctgccacgagggacaagggtgtataatgcactagtggcgtttatcagggtaaggggacccaggtctagaggaaagaagaccagggaggggctgagggactagaagaagctaaggtgtttgtgttaaaagatgggggttggggccgggcacagtggctcacatctataatcctagcactttcggaggctgagccgtgcagatcacctgaggtcaggagttcgagaccagcctggc

SEQ ID NO: 56036 - DNA, 1030 bp, Homo sapiens
ccgagatcgcgccactgcactccagcctgggtgacacagcgagactccatctcaaaaaaaaaaaaaaaaagaaagcaccttggaaagagtattgggacaccgatttgagcctacagtcttccccctagctaaccatgtaaatttgggaaactcattttacctctttaggtctcagtctccttaaagttgctatctaaggctcctccttcagctcagtgaccatcacagaacagggaaatggtaaacgatgtctgttattgtgttactgagaaatccacttttgaacctcagggctcagactgtgatgagtgggattgacaggactcagtgggaggatgtgctgaggctggagagggttatagcagatggtgcagagaaagtaggcaagcagattgggtggaggagcagtcttcgggggctagtcctccctatggccctgacccctctgcaccccaacctcagcctgatgttcgcccaccggcccagatcctggcgggaactgcccctgcgactagctgactttggggctctacaccgggccgaagcctctggtggtctggggggactgacccgactgcggtgcttccagcaggatgacgctcacatcttctgtacaacagatcaggtggcctttccctggctccaccaaagcttttctaaaccacctttctttctccctatgaacctgcaaacccctgatctttatttgccccctgtatgtactataattcagctacattctacccccagcttgcttccgcttcctctctgtttttgccctttgttttcctcaaactgccagcatccctgatctctagcgggctcacagctcactgacccttatttcctgcccctagctggaagcagagatccaaagctgtcttgatttcctccgttccgtctatgccgttcttggcttctccttccgcctggcactgtccacccggccatctggcttcctgggggacccttgcctttgggaccaggccgaacaggtgagtaggaggtagagaaatagaggcagataaac

SEQ ID NO: 56037 - DNA, 1053 bp, Homo sapiens
tcactctggctctggccagaagtgtgcttgtatggagcagacttgagaaggaaagaggctggcatatgaagggggacaggatctggagcataactatccggtttggggccagaacagaaatccaggtcagaggtctcaccatttccccccgcagctttctgccagcactcccaacagtctttccacagaaccgagcactgctcggtgaatgaggactggacgctccagggcacccgcctgccttgaaaggaaaaaggggggggtggatggaatggtggaagtatcacgaattgtgtacccaagatcaccttccagtttttaagaaatattcagctctggcaggagagggtgtggagggtttagtttttagggccaaaggcagaaggacttattccatgcactgtcaagggaaaagaggatagggcaaggttttataccccttatactggaggtcaaatctcaggggcagttggaagtcaagctgaattgtcccacactgatgtggccggcccagggcatcgtggaggtgcacgtcaatctacaggaaacagatgggaaggcacgagataagccagaagcactatccagaaccactatcctccattacctgtgccatcccaccctttaacctaccctcatcccgggctactaccttcatcatgtcacctagctctatcatacgctacccctccagttcactctactcaactcactctggcagtagttctcagcagctctctccatctaataatggtgttataatattacctgatgtccacaccctggcctctcaattccttgagctcctcatctcagagatcttcaccaccacccatctatggctacaccctttatcctgtcatctcccccaatggctgtacctctgaaactgtccatcagacaccctactctgattactgtctcttggtcagccagctctgagaattattccttttttttttttttttttgagacagagtctcactctgtcaccctgacaggagtgcagtggcacgatttcagctcactgcagcctccgcctcccgggttcaa

SEQ ID NO: 56038 - DNA, 1083 bp, Homo sapiens
gggtgtctgatggacagtttcagaggtacagccattgggggagatgacaggataaagggtgtagccatagatgggtggtggtgaagatctctgagatgaggagctcaaggaattgagaggccagggtgtggacatcaggtaatattataacaccattattagatggagagagctgctgagaactactgccagagtgagttgagtagagtgaactggaggggtagcgtatgatagagctaggtgacatgatgaaggtagtagcccgggatgagggtaggttaaagggtgggatggcacaggtaatggaggatagtggttctggatagtgcttctggcttatctcgtgccttcccatctgtttcctgtagattgacgtgcacctccacgatgccctgggccggccacatcagtgtgggacaattcagcttgacttccaactgcccctgagatttgacctccagtataaggggtataaaaccttgccctatcctcttttcccttgacagtgcatggaataagtccttctgcctttggccctaaaaactaaaccctccacaccctctcctgccagagctgaatatttcttaaaaactggaaggtgatcttgggtacacaattcgtgatacttccaccattccatccacccccccctttttcctttcaaggcaggcgggtgccctggagcgtccagtcctcattcaccgagcagtgctcggttctgtggaaagactgttgggagtgctggcagaaagctgcggggggaaatggtgagacctctgacctggatttctgttctggccccaaaccggatagttatgctccagatcctgtcccccttcatatgccagcctctttccttctcaagtctgctccatacaagcacacttctggccagagccagagtgactaatttgccatcacctgttctttccctaccaggccactgtggctgtccccgttccaggtggtggtcatccctgtggggagtgagcaagaggaatacgccaaagaggtaaggagttgaggtaagggagggggcagaagcaggtccagtagagagtctggtgccctgcagtgggcagg

SEQ ID NO: 56039 - DNA, 1022 bp, Homo sapiens
cagcctcccgagtagtttggattataggtgggcaccaccacgcctggctaattcagtaaagatggggtttcaccatgttggtcgggctgatctcgaactcctaacctcaagtgatccgcccgcctcggccttccaaaatgctgggattacagcgtgagccagtgcgtccggcctagacattcttaaaaggcaaattggaacacatcctccgcttgaaaacgccagtgccccctgggccagggcaccaagatccacttaaaaccctgcgggtgaggcattagtgatgagctcctgcttatcattccagccatatcagagaggaaggccaccaaagagtcaggtcctttcagccttgacccttgtgcgcactctgcccgctcacaccctctacttctttactggagaaactctgacctcaacgcccctcctgtgcacctgtgctgcccccagccccactcccacctcgggacgttcctgtcatgctcagagcacgctgggggccctgtaccacaacacttgtcacacctgctaggctcagggacagtgaacaacctcagggcaggggctgtgtgtgttctggatgtgtatccccaagtctagcagagtgtgcatagataggggttcaataaatggatattggccaggcacagtggctcacgcctgtaatcccagcactttgggagcctggccaacatggtgaaaacccgtctctactaaaaatacaaaaattagctgggtgtgctggtgcacgcctgtaatcccagctactcgggaggctgaggcaggagaatcgcttgaacccaggagggttgcaagttgcagtgagccaagatcgtgccactgcacttcagcctgggcgatagagcgagactgtgtctcaagaaaaaaaaaaaaaggatattgaatgaatgaaggcatgaattctaaggatcaaaagtgaagctttaaaaatgttaggctgggctgtggcattttgggggctcaccaaggccaagaaccatatcttctttgagtcctgatag

SEQ ID NO: 56040 - DNA, 1086 bp, Homo sapiens
tcctgaccccatggcactgcacccaattcccaggacaattgtagatgctgaattaagagcaagaaatagtacattttgtctcaaataaggaaggtgagagaaacccagtttccttccccaaagaggctcctccgagaacataaacatccaaccatgatggccccaaattgcaatctgtcgccccagtccaaaagtaaatgaagaatttttttccagcagagcagagccttacagagaggtgagctctgggggtgagaagggccctagtcatactttgaggagggcctgtctctctctgtcaagagcagggcacagggttggaggtggggcgggcgggtgcaagaccctgagcgagctgtttccctccagacagggcctccccctccagggtgctatcccggcctgggtcgggtcaaggatccaaccccaggactgccttgaggaaggggccatgagcattttccccaaaggaatcttgttcttgtgcctagaagttttccttgaatttccagagaaagccaatttggtatcaaattaatcttgacacattgggctgaaggcctgagaaaggcagacataaaagggtaggaacaagggacaaaactgtaactgcagccagggaggcaggcagggcggccagaggagaggcaggaatttcatacgtaccaaggacttgaagtcagaggcaggagagcccgggcctgctgggaaggaaatgcaagttgaggcaggaggtgctcacccctcccaccacaggcccagctcatctcagtggacaaagggtggacgggaaggtgtgtatctgctttttgttttgtttttttttttttgagatggagtctcgctctgttgcccaggctggagtgtggtggcatgatctcagctcactgcaacctccgcctcctgggttcaagtgattttcctgcctcagaaaggcctcccgtccctgctcacagcgccccctgtcccgtcagcttcaggatctggccctggccccttgctcagccgcaaagcctgtgccctccggcctccactgcctctccagcttcagcccctctgcccagggccaccctccctcccctgccc

SEQ ID NO: 56041 - DNA, 1062 bp, Homo sapiens
ctgtctgtctttaggtttgtggtcatagcaaccattttcggaaagcctggtgtttgcttttctgcctctccgaatcatggttgctcaactcctttgttccaaaacagacaccccattcccaattgctgcgcgccaggctggcttccagccgttgagtccgtgtcctgtcatgctgtctccactgttttgtctcactgatgctgttcttctgaccattccgctttggcttgacgcagccgcccatactaggcagctgctatgagagcagccagtggtgacctgtgctcttccagggactggagggtgagaccaccttgctgtgtttacctttgtattcaccacctcactctgcacacagtaggcatttaatgaatgtgtgtggggtgagcactgcctcagctctggccacattccagcattttctggttgttgtcctgccccatcacggcccaactgccttgcacctgatgaaatgatgaagaaacaggatgtgatccatttggtacgatgaggaccaagacatgaatgggatattctggtctcccagtcaccgctatgtagactttatttctttatttattttcttttttaaaaaagatatactcggtcaggcgcggtggctcacgcctgtaattccagcactttgggaggccaaggcgggtggatcacgaggtcaggagttcaggaccagcctggccaacatagtgaaacctcgtctctactaaaaatacaaaaattagctgggcatggttgagggcatctatagtcccagctactcgggaggctgaggcaagagaattgcttgaacctgggaggcggaggttgcagtgagccgagatcacgccactatactccagcctgggcaacagagcgagactccatctcaaaacaaaaaacaaaaacaacaaaaaaagatatactcctatatttttttcttttttttttttgagatggagtctcgctctgtcgcccaggttggagtgcaatggcaggatctcggctcactgcaacctcgcctcccaggttcaagcaattctcccgcctcagcctcccaaatatgtg

SEQ ID NO: 56042 - DNA, 1021 bp, Homo sapiens
tctcctgacccagccccagggagaagaaagaaggcatggcgcaggggaagcagaggggctggaagtcattcagggctgggagtaagcaggtatctcctctccccttcatccccaattccaagccaccactgcccaggggtgagcaagaaacctcaccttcagtgaagggctcccactgatacagctggcccatgaattcctgggagttaaaggctgcgcactgcagggcccgggggtctggctgctcaggggggcagggctgcggtgaggggtacaaaggagtcagagctggggagcaaaatgagggtaggggcagggctgaacctggggagcaggtgggaggctcaggtcagcggaagagctccaagacccctgccctgaggtggtcagatgccaaggcccttctccctcaggtgccaagcggaagctgaagacccagcttcagggcagggaagccacactggaggtcggggttgggaggggaggcccgaggagactcaccgcttggctgcaggctcttagctgttcactctccccagaacatcttggaatagggctactgggagcaaagaggctccagagggagctggcatgggggccgttgctcagcaggggcagccaggcgcccgggtgctgagggtcaggctccaggcggggcccgtgaggagtcccccccgttccccaaggcccttggccctgctggcctcggccccgagggaccgaaggaaaaggatcagggcgtctccctgctacctggggactggcccaaccctgggaacttggccttcgtggctgaggggatgcacggaagaagccaccttctcctaaggagtgcgtgggtgaggggggctctgtgccagaggcctgggctctggggtgatgccgtaggggggcaggcctggttctgggggccacctctgtctgagcagtttcagggcttagaggttctgcttggggggatggggtgtggacagacagttctgtgggagggagctcagtttgggggctgccgtttgcggag

SEQ ID NO: 56043 - DNA, 1106 bp, Homo sapiens
ctgccccgagccagccctgcagcctctccctcctccttccaagtgcaggggtcagagtcttacccggctgaagctgggggacagggggctctggggtggggttctcaaggattggaggaggtgaagagatgacatactgataaaaaacgcctgggttttcctcctgaaagatcatctggggagaagagaagataatgaatatgtgggggtggccagaagaggatgccaccagctctctctcccatcttgacaaccacagctctgcccagagggaacagcctccctccccagcattcagctgcccctggccccaggctcacatagacatccacaggctgggtggtggggccttcagccgacagactctcccctttgccctcctccctgggaggacggttatatcgaaagacggtcccgccggccctgtaggacccagggggatccacagcccagttcccattgatgatggaccggcccccagggccacgaagtgctgcgggtcagaggtgagagatcgggaaattccagggtgataataccttcctcctcccacaccgtgtccttagcctatagaagctcccaccagaacctaagatccccccaagccctctcagcttcctcactccttccacgaggggaggggctaggccctggacttccccctgtttggcttgctcactgctctgagtaggggtatggagggccgaacagagacggaagtggaaggggaggcagctgggtgctcacccaggtagttggagctaggccggagctgggcaatctggagccgcaaggctcccgctggaatccacaagatcttctgatagcccagggggccccctcggtcagtgaggttccccgaaacaaggcgacaggtagaatcatcacccccacagactccacagccatcaggacgcctgccagagccaaggatcccatcacagccggggctctggagagagtgaggtgaggcagtggccacagaacgccagacaccacctcaaccccaccccggtcccctcgggagcctcagctcactaccctgctttttgtgccacaagtgagagcacaaaaacagccccaccatccccagccagacccaggga

SEQ ID NO: 56044 - DNA, 1073 bp, Homo sapiens
aacacagcgaacctgccggcttctctggccccggccgcaccgcacggagcactgagggggcgaggggaatccagggagctgggcttcccagaccttctcagccagcttccagctctaggcttcagaaccaggctctgccttcgatccccagcccagcagtcacatggcttcgtgggctgaggaggaggctgagccctagggccctgggcccccagtccctggttcagtcccttatctgacttctatattgggggtccatatgaaaccctgtttgtaaatagtttctgctgatgaaaaagaagttgaaaaaccactgctgttgttcacctgtgcccattcccctccccagcacctccttgcctgggcaaactcacctggctccaaggagagccaacttcccaatggccacagaggcgcagctggcaagactgggtgatgttgggccgggggagatgtccacagcgctccgggggcaccgaggagccaccccccccaaattcctgccggcactgcagctggcggtgctgggtgccggggccacaggagcggctgcaggatgtccactcgccagcctcccagctgcaggcaccagcagggcagggaagaggcggagacatagatgagatgtgtggggctgccgtggcagcagagatggaagacacactggacgtgggggcctcagaggagagtgggcacgtttggcgtttggagtctgggttcctggggggctcagcctgccatggctttcttgctgcctaccgaatgtctgcctttctaatctaatgttgtctctctgcagccaggagatgttgcgttgagtgcagagttcaggtaagattctgggggcaactgctgtgtttccagtaccctaaccctccccgtgggctcccccatactcactatggggggcatggggtgccgtggcagggttcaggggaggctgggggcctggcacccgcggcacagctgcgttcatccagttcctctcccgactcacgggagatgcagaggaaaatggggcgccagacacctgagtgggtgagaaggcagccagggaggcaggaggctagagc

SEQ ID NO: 56045 - DNA, 1033 bp, Homo sapiens
tttccttgtggccccctttcctcgctccctgccctgggctgacgtcagttttatcttccttctccattcccttttgcctccttccccactcgctctcctcttaagatgtccaaattcttccttctcagccactttcaacccagagaaagcccgagtcccaaagcaacaggaagatgtgcgggggaccgcgagtgtggggacatcctgccgcctcgggcaactctgtcgtcccccacagggttcaggtgctcagaaaacagcagccactgagttcactgtttccgcaggccccgtattcccggccgtgctcagctgggcttgtggagtcgcgagcgggggcgctcctgcggcaccgcccctcctgggcagcccggcttccaggagagactcggcctcagtctccgaatggcaggggtctgggagaggatgtgatggcaaaggcctgcccctctcaggccgcctctagcaagttctctaccttgagagaagcgagtaggaggaggaaggaggccaggctgagccatctctgaggaatgtggctttggcaggacatccagtgctgccccgctcctccctcagccccgcccagggccctggagccgggccgggctcctcctcctccaggggaagggctcggggcaggaatcccttccctttccccaccccagaagaagccccagagcgtagggatatgcgtacggcagaaagggagacagaaggcagggctagagaaagggaacaggaaaaaagagcttcgacaagccaactgcccttcgctcaggccccagcggaaaggcgcagatacccggagacttcccagagagactcgacccaccaaaaagcgcaccgcggccgcgcagcccttccttcagctctggaacccagcgccccacacctcaaatgggagaactggtgacctctagtggcccatgaccagcctgcagggcctggggctggcggggattctctgacccaaactctcctgggctctaatgctgttcccctgcccaccctaccttctgccttcacactg

SEQ ID NO: 56046 - DNA, 1036 bp, Homo sapiens
cccagggcagggagcgaggaaagggggccacaaggaaagcccagttccaacgtctctgctgagcctaaagaggcctcagcagggaatcacagatgtggggggccagggaaacgggatccgagcccgcccagtaggtatagaaggccgaaggcagagtcctgagacccagggaggggtggggtggaggctggggccctcccagcgattcctggaagcccagagctgggcggtgccggctcagctgacttccccgaagctcccctccctctgctcagggctgttgctgggcaggtttggcgtttgccctgagcctgagaaccaatcgcaggtggaggtgcggtcgcagcccctcgcagggctccccggcttcagcaccccctttctctttctgcccgcccatgagctccctctcggcctccagcctctgacctctcaggaggtgggctctcctctgggggtctgctccctttcccctcttattttagagctaggactcagtgcagcccctaaggattccttcctctggtcactgaggtcattatggggtcaatgcggaagttctcaggaaagggaacccgaccccaagcaatcccttttcttggccccgtagaggggagtagtgtggccagacacctgttcgctgacctctgaaaccctctggggggacttgggagagcagaagctgcagcctgagggcagaggaatgtggggagggcccctgggtttggtgcactagtgggaatttagggaaggactcagaggaactggacccctgagaattgagatgagggtggggtggtgataggaacaaacttgatatgcacaagagagatcaagcatgcaaaaggcctgcaaattgttgaggatgcctcctttctgagggtgtgctgggggagggggttgtggtttgagtatcagtgacactaggggtgatctgtgctctcacaagttcagctgggtcaggattcctctcccctccccctcccagcttccccagggtaaatacccacccaatttaagttgcagcttttggact

SEQ ID NO: 56047 - DNA, 5753 bp, Homo sapiens
gttagtcaatggttgaaattttgatttggtaaaaaacctctggcgaaaaccagcaaaaagggctcacaaatcaggtctcagggaagcacagaggtagccacgagaaggcccgaggtgctcatggaaagagctcgagcccaggagctctgggaggaccccaggcgctcggagccgccgttacgtaaccggcactcagagcctccgaagaccggaaggccccgctcaggccccggctcaggccccggccccggccccggccccggccccgccccggcccggccgggcagctggtaggtgccgtgcgcaaccctccggaagctgccgcccctttccccttttatgggaatactttttttaaaaaaaaagagttcgctggcgccaccccgtaggactggccgccctaaaaccgtgataaaggagctgctcgccacttctcacttccgcttccttccagtaaggagtcggggtcttccccagttttctcagccaggcggcggcggcgactggcaatgtttggcctcaaaagaaacgcggtaatcggactcaacctctactgtgggggggccggcttgggggccggcagcggcggcgccacccgcccgggagggcgacttttggctacggagaaggaggcctcggcccggcgagagatagggggaggggaggccggcgcggtgattggcggaagcgccggcgcaagccccccgtccaccctcacgccagactcccggagggtcgcgcggccgccgcccattggcgccgaggtccccgacgtcaccgcgacccccgcgaggctgcttttcttcgcgcccacccgccgcgcggcgccgcttgaggagatggaagccccggccgctgacgccatcatgtcgcccgaagaggagctggacgggtacgagccggagcctctcgggaagcggccggctgtcctgccgctgctggagttggtcggggaatctggtaataacaccagtacggacgggtcactaccctcgacgccgccgccagcagaggaggaggaggacgagttgtaccggcagtcgctggagattatctctcggtaccttcgggagcaggccaccggcgccaaggacacaaagccaatgggcaggtctggggccaccagcaggaaggcgctggagaccttacgacgggttggggatggcgtgcagcgcaaccacgagacggccttccaaggtaagggggttcattaatcgccaaggcctcactcccttttttccatctctccccggactcacccgccaagggtgggttggaaaccgaaacgagtcagtgttgaaacgtgtctcatcctattcctgaagccagaatattctggccatgagtcattgtttccgcccatcttgattcttttggaaatggcagctcttgttcaaagaccggaaagggtgggatgtcaatttcaagtggggtcaacctgagttctgtaaatcccagtagcgattttcccgccgcgggtgggcaggcgaatcttgcgccggtttagacaaaggaggccgtgaggacctgcatgcttttctttctcaggcatgcttcggaaactggacatcaaaaacgaagacgatgtgaaatcgttgtctcgagtgatgatccatgttttcagcgacggcgtaacaaactggggcaggattgtgactctcatttcttttggtgcctttgtggctaaacacttgaagaccataaaccaagaaagctgcatcgaaccattagcagaaagtatcacagacgttctcgtaaggacaaaacgggactggctagttaaacaaagaggctgggtaagtttgccttaaggatgaaaggggccttggagtggaagtagaatgaaggattttttttagagaggtggggatatctaaaggtttttatgacgcacggctgtttgcaggctctaactaaaggaccattgtttatttgatgttgatttaagtagtggatccttagagatagtggtatggcggtcttgaattgtatcaaaaatcttggttttctctaggcaattttttgttccaattcagttgaatactcttcagtggattcaaaccatgaaaaaataagtcaccaggggaggatagctgaaataattcctaaggcggtgcctgttttaatggagaagatatggggtggagcctgcgttttaaacaaacccagatctgatgcaggatgtacttaactacgttgagaaaaactgatctgcgcaattgaggcgttactgaaatattaggtggtggagatttgagaataagggttttcgtcttttacctcatgggaactctggaagtccttttgttaggataaatcctaataagaccaagatagtactgtaaaatgaagtttaattatcatgggtccccgcttaagaaactgaagaacttattttctttttttgccccggggtgaataataattggtttactattgctttagggggaaaccttagatattttaatttaccttctctctggatagtagtgttgtaagagagcagaaacccatacttgaaaatgtgcttttcttttttgttttctaggatgggtttgtggagttcttccatgtagaggacctagaaggtggcatcaggaatgtgctgctggcttttgcaggtgttgctggagtaggagctggtttggcatatctaataagatagccttactgtaagtgcaatagttgacttttaaccaaccaccaccaccaccaaaaccagtttatgcagttggactccaagctgtaacttcctagagttgcaccctagcaacctagccagaaaagcaagtggcaagaggattatggctaacaagaataaatacatgggaagagtgctccccattgattgaagagtcactgtctgaaagaagcaaagttcagtttcagcaacaaacaaactttgtttgggaagctatggaggaggacttttagatttagtgaagatggtagggtggaaagacttaatttccttgttgagaacaggaaagtggccagtagccaggcaagtcatagaattgattacccgccgaattcattaatttactgtagtgttaagagaagcactaagaatgccagtgacctgtgtaaaagttacaagtaatagaactatgactgtaagcctcagtactgtacaagggaagcttttcctctctctaattagctttcccagtatacttcttagaaagtccaagtgttcaggacttttatacctgttatactttggcttggtttccatgattcttactttattagcctagtttatcaccaataatacttgacggaaggctcagtaattagttatgaatatggatatcctcaattcttaagacagcttgtaaatgtatttgtaaaaattgtatatatttttacagaaagtctatttctttgaaacgaaggaagtatcgaatttacattagtttttttcatacccttttgaactttgcaacttccgtaattaggaacctgtttcttacagcttttctatgctaaactttgttctgttcagttctagagtgtatacagaacgaattgatgtgtaactgtatgcagactggttgtagtggaacaaatctgataactatgcaggtttaaattttcttatctgattttggtaagtattccttaggtttttctttgaaaacctgggattgagaggttgatgaatggaaattctttcacttcattatatgcaagttttcaataattaggtctaagtggagttttaaggttactgatgacttacaaataatgggctctgattgggcaatactcatttgagttccttccatttgacctaatttaactggtgaaatttaaagtgaattcatgggctcatctttaaagcttttactaaaagattttcagctgaatggaactcattagctgtgtgcatataaaaagatcacatcaggtggatggagagacatttgatcccttgtttgcttaataaattataaaatgatggcttggaaaagcaggctagtctaaccatggtgctattattaggcttgcttgttacacacacaggtctaagcctagtatgtcaataaagcaaatacttactgttttgtttctattaatgattcccaaaccttgttgcaagtttttgcattggcatctttggatttcagtcttgatgtttgttctatcagacttaaccttttatttcctgtccttccttgaaattgctgattgttctgctccctctacagatatttatatcaattcctacagctttcccctgccatccctgaactctttctagcccttttagattttggcactgtgaaacccctgctggaaacctgagtgaccctccctccccaccaagagtccacagacctttcatctttcacgaacttgatcctgttagcaggtggtaataccatgggtgctgtgacactaacagtcattgagaggtgggaggaagtcccttttccttggactggtatcttttcaactattgttttatcctgtctttgggggcaatgtgtcaaaagtcccctcaggaattttcagaggaaagaacattttatgaggctttctctaaagtttcctttgtataggagtatgctcacttaaatttacagaaagaggtgagctgtgttaaacctcagagtttaaaagctactgataaactgaagaaagtgtctatattggaactagggtcatttgaaagcttcagtctcggaacatgacctttagtctgtggactccatttaaaaataggtatgaataagatgactaagaatgtaatggggaagaactgccctgcctgcccatctcagagccataaggtcatctttgctagagctatttttacctatgtatttatcgttcttgatcataagccgcttatttatatcatgtatctctaaggacctaaaagcactttatgtagtttttaattaatcttaagatctggttacggtaactaaaaaagcctgtctgccaaatccagtggaaacaagtgcatagatgtgaattggtttttaggggccccacttcccaattcattaggtatgactgtggaaatacagacaaggatcttagttgatattttgggcttggggcagtgagggcttaggacaccccaagtggtttgggaaaggaggaggggagtggtgggtttatagggggaggaggaggcaggtggtctaagtgctgactggctacgtagttcgggcaaatcctccaaaagggaaagggaggatttgcttagaaggatggcgctcccagtgactactttttgacttctgtttgtcttacgcttctctcagggaaaaacatgcagtcctctagtgtttcatgtacattctgtggggggtgaacaccttggttctggttaaacagctgtacttttgatagctgtgccaggaagggttaggaccaactacaaattaatgttggttgtcaaatgtagtgtgtttccctaactttctgtttttcctgagaaaaaaaaataaatcttttattcaaatacagggtgtgatatgggtcttttctcatcgacgcctctttttccttccctctcttaggcaaaccttttagagaagtcagctgagcaaatatgtacaggtgaattcaaagcaaaagcctcacaaagttgatttgccttagagcaaaggacagttcctttcttcaattctaattagaggtgttgggtttttaattaaatatattactgctgtacttagaggagttcttaaacctccaagtaaaatcaaaaacctctttaaaatcaaaatttc

SEQ ID NO: 56048 - DNA, 1091 bp, Homo sapiens
gctcagtcacccagaatggagtgcagggtgcaaacactcactgtagcctcaacctcctgggctcaagtaatcttcccatctcagcctcccaagtagctgggactacaagcacacaccaccacacctggctaattattttttgtagagatgaggattcaccatgttgtccaggtgagtctcagaacacaggcttaagcactcttcccatctcagcctcccaaagtgctgggattacaggcataagccactgcgcctggctgagaatatattttcatcctttcttttgtagagaggatctcgttttgttgtgtaggctgctcctgaactcctggcctcaagcagtctttccacctcagcctcccaaagtgcagggattacaggtgtgaaccactacacccagcagttagtgcaatttcattttaatacaagtgaggaaattaaggtatagagataagttacttgtaaagtagaaaagctagttagctgaagagcttgagttagtatcttaggcttttatattatttcttcccactattcctggcttccctggtcctcaattttaatttgtggccttaagaagcctggggtgccaaaaatgtttggggctatctgtatttcatgttactccttagccttttttttttccttttagttcttcaccactgcacacttggcaggatgtatcccattttaaaacttgacagtccatctccttcactcccatactgtagggctaggcaagcaaagcaaactgattctgcaatgcttctaatagttattcctgctcattattttagctagatgtattctaaagtctttatcccaaagagttgaatcaaaggttcttccactcctccaacctgattgtgctgacaagccactaagctgagccatctaatatacagggtggcagggatgaagtcaccgttactgtccaacagcttttattttaagctggtgtgggctgggcatatcaaagacaggcaaagaaaaataacttggagagttgccattgaggatatatccacagtgagccaacagcacccacacaagcagccctcgtctgtataatgccctctactgggtcttga

SEQ ID NO: 56049 - DNA, 4969 bp, Homo sapiens
ccatagtgaaaccccgtctctattaataatacaaacacttagccgggtgtggtggcgggcgcctgtagtcccagctactcgggaggctgaagcaggagaatggcgtgaacccgggaggcggagcttgcagtgagccgagatcgtgccactgcactccagcctgggcaacatagcgaggctccatctcaaaaaaaaatttttttattttccttactctcctctgcaatgactgtaggattataaatcattacattggagtgtgcttctctgtgcggatgaaatggtgggtgaaacatccctgtggaggatcccagttattgagtcttagtcacagatgataatgtgatgctgatttgcatttaccttgctggaggcaaggcaggcgtgggcaggctgtcacagtcatggaacatgtgtgggagctgtgagagtcagaaggaaaatacattatcctcatgaacaggcccagtttctattcctggtctgggagaataatcattttgaggttgttggcttgtggttgatctcctggtggctaggatagccccatatttatccttctctatatcttattcatttctgtttctccagttccaggctattgccctgtacccagtaaggtcctcagttaccctttatgaataagtgattttggtggaacgatcctctactgagtggagtacaaaggatggcaggggctatcccttgactccaaaactatatactctagctgggaaattgcttatgtacctgaaaaagtcagaacacactggggagaagacataagtacatgtaattaatgttaaactgtgtatgcatgaggttaatcaaggaagacttcttgaaagatccgagtgtgcatgagggtttataatggatgtgagatgtgagtctccttgtttttgaggaaggccagagtcctcactcacctaaacctccctcttatctcttagcaaaagtactttgactcaggagactacaacatggccaaagccaagatgaagaataagcagctgccaagtgcaggaccagacaagaacctggtgactggtgatcacatccccaccccacaggatctgccccagagaaagtcctcgctcgtcaccagcaagcttgcggggtaacctgagcccccctctcctccccttcctcaaccactggacgtttatatattataggcagggatgaaatgggcacctagtcagatcttctcagcttgctagccagaaatgactgtgattctgctgggggctgctgagaaggtaatgtaggttgaaaaggggctctaagtttatttatttcgttagattgacacttccacacactccctgtagtccaggtagggcccagaaataggaaaggctaggattggataatgctgcaaatgctttttttgtgtgagaaactggagagatgtgatttctccttttgggagagaatgtcccaaaattgattaggctgagccttgggaatagtttggcaggtttaacatcccaaggctaacctaacgtagttgggaaaggtagattgaatgagacatgttttctgtgcttctaagtgttctgtcccttaggctgctattgcttcatgtttccattatggcaggtttagagaatccttaaaaagaaaaattgacttgcttgcctaaaactacagtgcccccttagcctccattacttagtatctcttacagtttgctctggctctcaaataatataaagattgatgaacattattcacagaaaatgggcaccttctctctctcttccagcatgttgcttttgaaagtatcatgggatagtgggacgagcactggtttaggagtcaagatatctgggttctcactctactcagtcccagcagagctgttgtataaccttgattaagtcatttagcctctctggatttctatttcctcatctgtaaaatagagttaaatgtatgtaagattgattctgattctgaagtcttaactgccagcagaaaaactccatactgttcattgtaaaactaaaagtgaggaaggctcgtgggtggtgaacctctgctctgtaatactgggaaagtactacagaggggaaccatttgagggatacatgaggagagagtaaattgaggtttggggattataaattcaggcaagagaaccttatagatatcacagtcttgagggtcaaaaaaaaatacttaggaagctagccatggaagcttcttgcctctgacccagcccactttcccagcctacctctgggccttagctgctaaaaagcttctctggcagcggagctgcaggcctgaggaaacatgctcagtcatgcacatgtgttgacccatgtttcagatgcagtctgatgccaggtatattgttagggaaagaggaagaagggtaaactgagctagcccctggggctgagtactcctgcagggctggaggaacaggttcttagaagatgattcaccttggaggaagctggggaaagtggttagggagggagaggaggaagactgagaaatctctgcatccccagaactcagcaacccagctcttttatcatgaggagaggtagccatgctgactcatgaacaggtggaggaaaggggttgcaggtgaccagcatcttcaatctagttaccaccagcttggctagaattttattgaacgcaacttgctagttatgacagagaggaccagggtgagaactaatgctcaagagagcaagattctgtaatcctcttgccctctcacatcacaaattctgatatgccaaacatttggcccaatgagaatgactgatagacttgctgatgtgcatgtggggggatgaggtgtgtatatgcctttctcctgactggccattcagtgttcaggctgtcattcaaattggataggagaaagttggtgaggaaggaatggagagagcaggatccctggactccctggtccccaaactccttgactgtcacttgtaattgtatataatttttgtgtttcttgctccatttcctcatgctgtcatccttaaagtccatctgggaaggggaaaatgctgaacaccattgtatagtttcttcaactgtcccagccatgttgtacatagatatgtcatgttattatatatataaatatatatataattttgtacgttttcttcatctccgatcttctcaaattctgtactttttttcttttctgtctgagctgccttctctatcattcagcttgagtcctcaagactactggtcacaatgagtctgatttttaggaaggaataggaggagcagggaaatcagaaaaactgttggtctcactctgtctctctacctggtcatcttcaaggctaagaaaacaaacaagctacattctgtatttgccagtttccacagcatgaagtacatagcttccttagcaaggagtggtcattccaaaatccaaatgcaaattgctttgattaaacctagattattaaatccattcagaacagcatgtgtgtggtctggttctggcctccacacagtcaccacctcatctctgtgctacctcagtctttgcaagtagctgtggccatgcctctgaaacagcctgctctgagccaggcagcttacccacctggaaacctccagttattttgatcttatctaaagaattatttttctatgtttgttatccatggatatcccagaaaggcagataacgttgtttcgtggataggaaaagactgaaattctattttttgattttttttgcaactcccttatggataggattgagacatgccaggtagcctaatggttgttaaatgtggaggaatcatggggtagagactgggttggagttcagggtttttttcccctattacttgacagtgttgttttttttttttttcttctgtgttcgtccgcagtggccaagttgaatgatgctgcccggggctctgccagatcctgagacgcttcccctccctgccccacccgggtcctgtgctggctcctgccccttcctgcttttgcagccaggggtcaggaggtggctcgggtgtgggctggagaggcagaagccctttcctgttggtgtcccagcacatggagccccttgggctgagcaccaagaccttgaaccttttttgttttaccttttttccaaataacagttgggagaaatatcaatgaaattctgggggtgggggtggggttgaaagggtggggtgggagatatggaggagtatgaattagggcttggagttggtaaaaacattcctgactatccttcttaaccacgtggctgatgtggggtaggtatgaggggaaggaagtggagtagcctaatgaaaaggggttctagttgagctctgtagataaatgccttgtttcagtgtggttggagacctggtgtcagataaaagaaactccatccgcacagacagatgcaaacagctcctctagttctgcagagctagttgagaactcaacattaatcattttaaaaagtactgtccttgaaatagatttgctgtgggaagaagggcagtgagtgtgggagaaaggagccgtgagcgtggggaaccccacagagcccaaaggactttttcagtattcgaaataaacaaaacaaaaacccatgaaaaaacccaacccagaaatattctgaagcagttggtgtgttttattggggtttgggagggggaagaaaacaatactgaagacattgttaatgtgagatgcggctgagttccccaataccatcacttaggaaagggagcaggaatgttggcataaaccttgcccatccctttgtttctgtaaccaatgtagaaggtgcatcaacctcagtttgtggctcacaaaatgaggcatttaagatatttgatctaaatggtttcttgacacctaagcctagtccaggtttagcagaaaaggaggcccagtctccttttccctctgtcttccattccttttcaagttcccatgtttg

SEQ ID NO: 56050 - DNA, 1029 bp, Homo sapiens
cctgcctcagcctcccaaagtgctgggattacaggcatgagtcactgctcccagccccaaactattttttttttaatttctcatgtgacatgtaggatagcctagggaaccctgctactcatcctctatcaccagaagccctgcttttttctctttgtctttcttagcatttgtgctgagtgatatggcccactctgtgattaaagtattgtgtttagtattacctttagcccaatacgcacaggtccctggctggttccttgggtgaagtgtgagaagcagcttgtctttttctctcacaatagtcatcttgagctttagggattttaacaaaggtctagctttaacagcagagtagagatagcgtatttacaagtgggtggatttccaggagaagttgatagtatagttgttatcagatgtgagaagctgttgtttctcagtctttaattttatttggctcatttgttttctccaggacacgcaggagaaagaaggtattctgcctgagagagctgaagaggcaaagctaaaggccaaatacccaagcctaggacaaaagcctggaggctccgacttcctcatgaagagactccagaaaggggtatggggcatagtctcttaccctctttctttggagctaaaggaggttcttcgaatgaagtctgtagaggttctactggatccttttctggaggttttgttgttgaacagaagtagaggcgaatttgaaatttgaaaagagcaagtcaaattaatgtaaatccctgatgtggtatcaattccctcctgatttcccatgtaggaaattaaggcctaaattggagcatttgggtgtgtggggaaatgagggaaagatgttagaaactgaaatgcagactgcccccaggcatttgcctgtttgaatgttggaggttttaggattgtgcactttttaagcattagagataaattttgggatgcatcatttcagaagaagatcaaaccatctctcctacagaaataaatcctcaacttgaaatgaatcag

SEQ ID NO: 56051 - DNA, 1024 bp, Homo sapiens
acactagcactcctggtgctagcccactcctctgatgtgctagagaatgtcttctcctctctgacagatgacaagtatgatgtggcaatgaatcgagccaaggacttagtagaactggaccctgaagtggaagggacaaagcctagtgccacagaaatgatctgggctgtgctggcagccttcaataaatcttaaagccggcaggtggatttctccttttcccctgctggctggtgactgtcagagaccccatcactgagttttgtgtgatgagatgttttcatcatttttgtttccttttcttgaatcagacttgtgatttggggagagcaacttcagggcttctccatagaccttgaccattataagcagaccttatttctccctacacttccactccataggtaaataaactgggtgaagccacacacacccaatgaacattttctcccatttggtggtttagtttcacccagtgtgcttttggataagcagaaatatctaaatgggattttgagttctccagctatagaatgtgaatgagataaaaagtgaactatctattatatttttctgagtttgttttctatcataaatacatgttttcacagcctttgtctctcagactctgctaaataatgtagcttattgaaataactgtcgctgaataaggagcaatgagaaacaaaactaatttttggagcagatggtctctggaattgcatatcctgctagtgattttctcatctttccttttctaacctaatgagaatgtcccagattcaattacctggatgtcaaagtcctagagccagaaatatattctctcatccctcttagcattctcttgctccctcattcactagggcaaatgtctaaatgaagaaaagtctctctcaacacctcgttcatgcaatcagcattagaatttgtaaggaaggaaggggggtggcatgaaaatttccattcttggggtatatgactgtcctgtttcccccaggccactttttttttttttttcttt

SEQ ID NO: 56052 - DNA, 1126 bp, Homo sapiens
agctgactgaaacctccgcctcctgggttttcctgcctaagcctccaagtagctgggactacaggcgtgtaccaccacacccggctattattattatttttaagcttagctttctaggagttgcctctgagttagggtagcttattgttcagccagtgttggttcagtggttgtgctttagcccttggtgccagtgaagcatccacccttttttgatagatctatgtgtggtctggggaatactctcaagtcaagccccacgtcctgctctgattgctcctgagtgggtgcagcctggtgcaagcacacagtcttcccaacccccagtgttggtcatgattccagaaggacttttcttggctttctgtttctctggttctgcctgttaaacttctggaggctttgccatttgggtttgtcataccagtgccatagagctagcagcaccttgtaattgctctccaccaagatctctatggttttcaacacccttaggcatagaattctccacactgtgttccaaataaagtcagtcctctcaggcagagctttggagctcttcattcttcaggccttccttccctcctgggcagaacttctgcacaagggcccacttctcctacagtgatacccacctgctgtatgagtaggtgctgggggaaagaggtgttagcccctggtcttcttgacttgccttttctgttgcagaatctctaatctacgaacaagctggaatgggagcaattgaagtctaaatattgtcagcctaccaggcctgggatagagcttctgctctacaaatagggtagggaacctcagtcctcttagcttcaccagcaaatagaacttccacaatatagagtagaaatcatctgggagagactggtgtcctaaatagaatttgaaaaatacataaataattacagtgtcacagaggtcacataagaacagaaataaagtctataagctctagcaatatggaagtccttggtgacattttttgaagctggtttaatgtgaaatgtggttggagtcaaagccagattataaaggactaaggattaaatgaattgaggaatgaagattatgcttttaaacattttagccattcaagtttccaaacaac

SEQ ID NO: 56053 - DNA, 1036 bp, Homo sapiens
actgactcagcagttccattgtctaaacaggttaattaccctattgcaagagggagaaatcaaagtatccatagtccaaagagttataggaagctcctggttttgtcttccttttttatgcagaaaaatcatactcaggatgctgttgattaaattcctcctatatctatagctataacattatgaaatagccgggcacagtggctcacgcttgtaatcccagcactttgagaggccgaggcgggcggatcatgaggtcaggcgattgagaccatcctggctaacacggtgaaatcccatctctacgagaaatatttaaaaaaaaaattagcggggcattgtggcgggcgcctgtagtcacagctactcgggaggctgaagcaggagaatggcgtgaacccggaaggtggagcttgcagtgagccaagatcccgccactgcactccagcctgggggacagtgcaagactccgtctctaaaaaaaaaaaattacgaaatagagtatgatgtagggagagggactcatatgggtcaggtcagtcattgattaaccctggttattctccaataatattctgtttccttccatttactgcaagtcctttccaaccatactcctgtatccattttcttactgaatttttccactcacaacttctttatcatcctaagcactccacttaaactacattcttaggtatcaccagcttcttttcagtctttgatttatttttctcttttaacctatatgtgtcatttgacactttttatcactttgaaactttcttcattattggcctttgttattatcttattctcttgcttctctgactatacactgtttccttacttctccatttcttaacatccaagtctcagtttgtatcacttgagtgatcttctgtcctttcagagatatcatttacctttatagcttcgtctgtcaccttcatgagattaattttcaaatttctaggcaggtcttgtttttccacctccagaaacatatttaactattggctagaaatttcaactt

SEQ ID NO: 56054 - DNA, 1027 bp, Homo sapiens
ccagacatggtggcgcacacctgtaatcccaactactcaggaggctgaggcacaagaatcacttgaacctgggaagcggaggttgcagtgagccaacatcgcaccactgcactcccagcctgggcaacagagcaagactccctctcaagaaaagaagaagaaaaagaaaaaaagaagtcaacaggcttgaaagatgagcatttctactggactttagaattactcatttgatcttttgtcagtgccatctgtgaagtccaagctattgtactttggaaaagatactgtattacccacccatttttttctggtcattactccttcctttctttctatatttaaatctgtaaatatttcctatttgtatggatgtttagtatgcatgtatgaatatatgatttatttacataagcatacatatggattttttttttcaccactccctccagaaacaggtgagaatgaccactttaactcaccgggcccgtcgcactgaaataagcaagaactctgaaaagaagatggaaagtgaggaagacagtaattgggagaaaagtccagacaatgaagattctggagactctaaggatatccgccttactcttatggaagaagtattgcttctgggactaaaagataaagaggtaatgcagttaggtttgctaggctatctcaaagactattaaatattggaatgttttaggaagtaacctaatggaatatatttaataataaattggtcttagaattgtgctctaaccatctggaagatggaggagttgggacagtgaccgatacttggagggtaaaaatccagaagtagaattacgtgaagtgtatttaattacaaaattactccaaaattttagaagatacaggagaggaggatatagtataaagttttgtacttgtagtttcccaagttagattaaaggcgaaataataccgtttattaaagtaagaacaagggcccacacactgaagtcttcttcagctttgaggagaaatagtcttttacatgaaaaga

SEQ ID NO: 56055 - DNA, 1068 bp, Homo sapiens
aagtttttcacctactaggacgggggtggggtggggagaacaggtgtccttctaaaatacagcacaagctacagcctgcgtccagccataacccaggagtaacatcaggtaagcaacgagaaaattacatttcctaacgtcccttccccccaccaaaaaaaacctctattttttaaaattattattttatgggagggaaaggtttgtattcatttgggccatttgttttctttcaagtaggatttttaactagtaaatgtgcagatgaaactaatttctcaaagaaaccgccccctctccccctccccccctgccccgcgaaggtttaaagtttcttggattggtttaggaaatagtccctattcacagtgccagataggcttagtgcgcttaagaatttatttcatggttctcttcctccttcacttttcttcccacctcccataacaaattatatttgaaatatacccttgtacaaaaaaacttttgtagctcacttcatttgtatttctattttaaatgttcacatgcacttctgagtattcattttaatcaatataaatttatcgagcaataacaatgttaaagacagtgctagttgctatggagaatatataaacccaagaagacaatatccctgttcttaagaagtttacagttgagagacagctataccaagagaaagactataataaatactttaaaggaagtgagtataaataaagctctgtgaaacagctgagggagtggccatgagacacataggtaatagaaaagaggaggtcacttaaaggccttcacaaggcctttaaagaatgggtagaatgtaaagaggaagagaaaagggtgaagaccccagcaagtacagaggagcagaagcagaaagaaagcatgagacatttttgagaaaaagtctggcaacactacttattaggagcaatgggaaatattgctagaggagtagaaacgagtccagtcatagcaactcttaaataccattattttgatcttgaaaaagatactcctttatataattgctgatttaaaatatttgttatatattatctt

SEQ ID NO: 56056 - DNA, 1033 bp, Homo sapiens
cagcctcaaacttctgggctcaagcgatcctctcacctcagcctcaggtgacagaaacatgccaccacacctggctaatttttaaaattttttcatagagacgaggtctcatcatattgcccaggctaatctggaactactagtctcaagcaatcctccctccatggccttccaaagtgctagtaatacaagcatgagccaccatgcccggccagtagttttatattgtatttagccttcacatgaaacaaatttgttcataaatgctttctgctcagttgttttagttcctttttgaaatgtgtcaatttttttcttcacataattatgtaggatgatttggacattgaaactaaaatggaagaacaggaaaaaaaccctgcatcttctgaacttgaaggtaagaagttaatgaaaatgtacattaactcacttccaactcaattttatacccgggtaactttttttttttttttttacagaaccaagtttagtttgtgaggaagatgaaattatgaggtctaaagaaagtccagatctttctatttctcattctcaggtataaacttgatagtttcatctcacttttgttttgttcacaggacagttgcttatgcgctaattttttatttttcagattttcttattccaggtcttttagaataaaattcaatatttagaatgcttgttattaactaaatctggaaattatatgttgatgaattttgagtatattactggtggatttgtttagtaataaacctaaatactattggtagaatctgagaatttcagagctagatagaatcttatgcagttatttattccaccctgctttgtatttataagtggaatatataatacatttgtgttgccttggagcatacatgttttattctgcttttcaaatacagtaaaatcctgaaataagagatttaggtaatatgaacttggaaaaaatatgattgatgattgattgtctgtcttcctctgcccagcccatttctcaaataagtagactaaatttcttgtc

SEQ ID NO: 56057 - DNA, 1034 bp, Homo sapiens
actgcggggacatccccaattaaccatcaagatgtggctatgcaaaatggagtggtggcttgcagtagcttcaagccaggattctgtggctaataataagcaattttaattgtggaaagagaacttaggtgattagaaatatagaaatataattttaaaacataatgtgctttctttaaacacttcatataaaatgcacttaagtaaaattaagttattatttctagcagatattaatattaaaattttataatagtgacattaaaacacatggtaactttcaagttaacagcttaatgctataatagaaataagaatctcaaatagttaaaatgtaaagttatgatattagaagccacaggttttataaaataaattaatatgtgattctcttctagtaaaaaccaaagcaacgaatctagcatgttgtctactgacaccaagaaagcaagcattctcctcattcgcaagatttatatcctaatgcaaaatctggggcctttacctaatgatgtttgtttgaccatgaaacttttttactatgatgaaggtactatttgcaatacatcctgtttcagttggtacatatgttttatcattattgaaacaattggtttccattccaaatatttttagcacctaaattttttgaaattataaaatttacacttaatatcactattcaagaaagaaagatttacaaaattaagctttaaaatagatgcttctctagtgataggaacatatccatgtgaagtataacctcactcaaatttaacaatgagttaacagttttcacttatcagattggtaaaacgtgttaatccattattgataaggatgtggggaaacaggaacttttttttgtttgagacagagtcttgctctgtctcccaggctggagtgcagtggcataatctcagctcactgcagcctccacctcctgggttcaagcaattctcctgtctcagcctcctgagtaactgggactacaggcactcgccaccatgcctggctaatttttgtatttttag

SEQ ID NO: 56058 - DNA, 1031 bp, Homo sapiens
aaaggagagaagggagaacgtgaaagggaaaaccagaagataagaaacaagggggaaagatctactgagtgcttactttatattaggctctgttctttggggctttatgtgcattatctcatttattcatcccaaccttcatgaggtaaccactattagcatctccgctttacagatgaggaaatctaagtacaaggggtttcttgcctaaggtcatagtggctgaagtggcagaaccaggtttttgaacctaggaaggccagttcacaatttgggtgtttacccattacgctatagctgttacaatataacgtttcattcagtcaaggagaggtagatttaaactggtgttaaaaatagacgtttaaaaacatcactatgtaagcaatgaaatataaagaaagcaatagaagtattcaggcttcaggagggctgagaatgtgtcttttctttgatactcacacctgcgattaatgcttaatatgtatccatgctgacaaagcagatcatttgggtaaaggctgtgaattaatagattgtgttcagaaaactaattgattgttcagaaaatgttcatttattttcatatgttatatagttgtgcattttttctatcagtaaattagcaaccttgttgatacaataataatatttattgaatgtttactatatgtcaggtactttataaagtaccctgtataaattatcccatttgtgaatatttattcacaactatcaatgagatatgtactgtctttaatctcttttttagctggggaaactaatacttaaactaaggcttaagtggcttgcctgtggttacagtatagcaaagatttatgccctgtgttagccactctgctgaggtatgttgcctcccttatctgcctgctaaggagttccttccatgtggtataaataactgaaggggtggcctgcccctccacacctgtgggtatttctagtcgggtgggacgagagactgagaaaagaaataagacacagagacaaagtatagagaaacaatagta

SEQ ID NO: 56059 - DNA, 1563 bp, Homo sapiens
tgtttggttgggggtatatgtgagaagacagagagggataaatgtagggatcactgtcagttattgaaaagattgcagaagctagatgcagtggtgcttgtgtatatgatgtcagccccttagaaggctgaagcaggggatcacttgaggccatgagttcaaagccaggctgagcaactagcctgatcctgtccctgtcaaacaaacaaaaaaggagtatgaattgagtgtgatacataccatttaaccagaacagacaaatttagcaccataggaagatgccaaagaaagttactttagctcattcaaatagctccatatacccaagtcacagtagctttgggtttaaaagagacagaatgattaaaaataaaaagtagtgctcgcttcagcagcatatatactaaaattggaatgaatatagagaagattagcatggcccctgcgtaaggatgacacacaaattcatgaagtgttccatttaaaaaattataaaaagtaaatgaaatagaacataatgattatagccataatggtctatttacacaagtcctgagggactgcaagagtgaatggagtaatcttaggcaggacaaaggaagagctggtttaaagcaaagattgaaagaaagcaaaacaggtcttggtggaaaacaaataggataagagactccatatatgtctatagggggttatatgaaatacagcaagcagatttttctccctttgaaaatattgagaactaggaaaaggaaaaaggtggaactgtaggaggaagacagaagggattaggaaaaaaggctgcgatctaaaggagtcaaagttgttggaagtaaggaaggctaagagctcagcacagcaaagactcggggtcagggatggtagtgcaggggaatggtggagtagaacttggtaagtgtaagagatcaaggtgtgtgacccaaacttaatctttttcttttatcaggagatgctgtccatgctgggagatcagagcaacagctacaacaatgaagaattccctgatctaactatgtttccccccttttcagaatagaactattggggtgaggataaggggtgggggagaaaaaatcactgtttgtttttaaaaagcaaatctttctgtaaacagaataaaagttcctctcccttcccttccctcacccctgacatgtaccccctttcccttctggctgttcccctgctctgttgcctctctaaggtaacatttatagaagaaatggaatgaatctccaaggcttttaggactgtctgaaaatttgaggctgggtgaagttaaaacacctttccttatgtctcctgacctgaaattgtatagtgttgatttgtgctgagatcaagaggcaggttagaagaacctgacatccactgtttgccttggatagtatggcttgtttttggaaagaaattctgaagagagtggaggagaggagaaatgtcctcatatttgaggaccatgaaacattgtaggtatatatggggctttagcaagtttgagcataggctctttttgctgcctgtgagcagtccctctggaaa

SEQ ID NO: 56060 - DNA, 1046 bp, Homo sapiens
attcagctgctgaatccaaattttattcttcccttgctttctctggttacttcagaaaaagcagtgaagcttgtagggcctagcgtgaggcaaacaagctgcttttcttcctcctatttctttgcacctgtcctattgccatgttctaggctccatctctgtgtgtcctggtcagtgtgtgactgtcagtctttcttgtcttttccaaattgttatcaaattttccttaacctgcaggaagtcaaggggatctagggatagcactagattgtcctttgattcctagcttctgtgataaatctatccttttaatcttttacctcatttattcactcctaggaatagtggcctagcccctcctgtaaccattgtccagccatcagcttctgcaggacagatgttggcccagatttcccgccactccaaccccacccaaggagcaaccccaacttggacccctactacccgctcaggcttttctgcccaggtaaaacttatcatctgtgtgttccctgtgtattattttttgtttgtttgggcttttttccgtatgtaaaatcagtgttttctattttaaataccttctccccaacccctgttctccggtttccaatttccatctttgttgagagtagctaattaaaaatcacagataataaaaaaaaatctcagtagagtctgtggttttcaccttaaatcagaattgctcacttggaacgttttgagcacgtctgattttcagatttgttttggagtaaattctaagatgtttcctctttgtttaggactccataaggcaggagcaaaggagaaaattaatgactaacttacagtgatgtctgtttacaaaaaagttgaaaaattctttttttttttttttttgagacagagtcttgctctgtcgcccaggctagagtgcagtggtgcgatcttggctcactgcaagctctgcctcccgggttcacgccattctcctgcctcagccttccaagtagctgggacttgtacaggcgcccgccactgcgcctaattttttttttttgtat

SEQ ID NO: 56061 - DNA, 1050 bp, Homo sapiens
caccctgcctcagcctcccaaagtgccaggattacaggtgtaagccaccgtgcctggccagtattttatttttaaataaatattctttatagaaaatgtggaaagtattgaaaaatacaaagagaaggaataaaattctcacactccagatagtctttgttgatgtacagtgtatgtactttcatttttttacctatgcttttaaaaaataccttatatgaatatatacacacattcacaataaccaggttttgaatacctagaaggagttagaacccaacaagatgacccctgtgtcatagaacatggtttctgtttgctgaaactgacaccctagattaactataggataggactttaatgaaggatttattgattgttccacctacagatgaatctatagagctttacatacagaatcttattcttctctttctctctctctccccccttcctccctctccaccccctctttactgtctactctggtttcctaggaactctagccaagaaccacggcctacactctccaacacaatccagaggccacaactaggtcccacagctaatttacccctggagatgggctcaggacagctggcacccaggtaaaaaagggtgaaataatcatctgttgagcagtcacccagggggtggtcatttgcaatcccatatattttttgttcggttggttaattttttttttttttttttgagaaggagttttgctctcattgctcaggctggatggaatacaatggcacgatctaggctcactgtgacctctgtctcctgggttcaagtgattcacctgcctcagcctcccaaatagctgggattacaggtgcctgccaccacccccggctaattttttgtatttttagtagagacggggttttgccatgttggccaggctggtgtcgaactcctgacctcaggtgatccacctgcttcggcctcccaaagtgttgggattacaggcatgagccaccatgcccggcctgtttaatttgttttaaggttctttctccagattcttttttaaaaaaa

SEQ ID NO: 56062 - DNA, 1092 bp, Homo sapiens
cttgggaggctgaggcaggagaatcgcttgaaccagggagtcggaggttgtagtgagccgagattgcgccactgcactctagcctggtgacagagcgagactccgtctcaaaaaaaaaaaagtctgggcacggtggctcacacttgtaatcccagcactttgggaggccgaggcgggcggatcacaaggtcaggagatcaagaccatcctggctaacatggtgaaaccccgtctctactaaaaatacaaaaaattagctgggcgtggtggcacgcgcctgtagtcccagccactcgggaggctgaggcaagaaaatcgcttgaacccgaggggtggtggttgcagtgagcagagatcgtgccactgcactccagcctgggcgacagagggagactccgtctcaaaaaaaaaaaaaaaagcttaagtctctgaaaggaagcatgagaaatatgcttccatgtttaatcacttagtttttactctcattttgttttaatattgaaaaatattggtgcctcaaggacaatgacaagagttttagggttatagaaattggaaaatttttatttatttttgtaatgaaaattttctatgagttccactgatggcatgaaaactttttcaggtagtgaaattaaaaggccaagtgctgtctgtcatgttccggttccggtctaagaaccaagaatggctctggatgagaaccagctcctttactttccagaacccttactcagatgaaattgagtacatcatctgtaccaacaccaatgtgaagtatgtattatacaggagtgtgaaaaaactgtttttcctctgttctcacaacagaaaacacttctgatgccctatgtggggggtaaacaatcaagcaacaacacaaaaatttagccgggcgtggtggcatgtgcctgtagtcccagctactctggaggctgagacaggagaatcacttgaacctgagaggtggaggttgcagtgagctgggatcatgccactgcactccagcctgggctacagagcgagactccatttcaaaaaaagaaaaagaaaaaagaaatcaagcaatcagtagtggacaccagctgggtg

SEQ ID NO: 56063 - DNA, 1054 bp, Homo sapiens
attcattttatatagtttttttttttttttagaaggagtctagctctgtcgccagggtggagtgtagtgtgcaatctcagctcattgtaacctctgcctcttaggttcaagcgattctcctgtttcagccccccgagtagctgggattataggcacatgctgccacgcccagctaatttttgtatttttagtagaggcggggtttcaccacgttggccaggatggtctcgatctcctgacctcgtgatccacccacctcagcctcccaaggtgctaggattacaggcatgagccattgcgcccagcctagactgttcttttatggatgagtgagagtcgtaatgaattatataagctgactgttaattgtcattctcaggctccagctcctgaaaatatctggtgaattttatagacatggcttttgataacggtttttactttgtattagacaagttaattaacctctttaagtctcagtagtgtcgttattgatacaatgaatatattaatagtacctaaattcagacggttgttgggaagattaaataaggtaatgaatataaaacacatcacccagtatttgatacgtagtattacaaaataagtggttagcttctaatactgtttatttttatttttttaatttttaggaatatagagttaaaagattattttctattccatgagactagtatctaaaataacctaaaattggctgggcatggtcgctcatgcctgtaatcccagcactttgggaggctgaggcaggtgatcacttgaagccaggagtttgaaccagcctggccaacatcttgaaaccctgtctctactaaaaatacaaaaattagccgggtatggtggctcatgcctgtagtcccagctacttgggaggctgaggcatgagaattgcttgaacccaggaggcagaggttgcagtgacccaagattgccccactgcactccagcctgggcgatagagcaagactgtctaaaaataaaataaaataaaaaataaaataactaaaattacttttaaaaaataaaagcaaaa

SEQ ID NO: 56064 - DNA, 1028 bp, Homo sapiens
aatcatgtagttcctaagacagccaaaacatatcaacctcagttaagaaaaagagatcatcatattctgttagtacctaacattattttcagcttcctattaggactgtcatctcatgtagagaaatatggcttgtcaaaccaggtgggagcagcaggtacaaatatgtatttattttttgttgttgatattaatacagatgattcaaaggtactcatattaattagttataccagtatagctacatttagataattcatgtaattacctaaatgaataatggcccataaaacatgcagatttagcaccagttattataatttactcatgcaacagaccagttagccatctctgaattgacgcatcatataaacttttaaaactgttgtgggtcggaaggacttctggctgtggctatgtgaaagaggttggtgaaaaagaggtcttgaaaacaaagaacaaagagaatttacactacctgattcaacactaactataaagctattaccaagacactgtggtgttggtgtaaggatagatatatagatcaatagaccagaataaggtctattcttatacttgtcaactaattttcagcaaaggtgacaagacaattcaatggataaaataaatatttctaacaaatggaacaattggatatctgtatgcaaaaaaaaaaaaaaacaaaaaaaaaaccacacccaaaaatgaaaacacatagatcttacctcatacaatttacaaaaatcagcttagaggcctaaatgtgtaagagctaaagttacaaataaactcctaggagaaaatctttgtgattttgagttaggcaaaagatttcttacactaaaagcatgattcacagaagaaaaaaaattataaattggatttaattgtaattaaaatttgccctctttaaaggatattattaagaaaatgaaaagaccagacataaatggagagaaaatagttacaagtcatatacctgaaagaggatttgtaccaggaatatataaacaactcattaagac

SEQ ID NO: 56065 - DNA, 1044 bp, Homo sapiens
agatcctaaaaagagaccagagaggatggaattaagaagtcaattattgttcatggtaagcctttttttttttgagacagggtctcttgctctgtcgctcaggctggagtgtggtggtatgatctcggctcactgcaacctctgcttcccaggctcaggtgatcctcccacctcagcctccggagtagctgggactacaggcgtgtgccaccacacctggctagttttgtttttgtttttgttttgttttgttttgtttgtttgtaaagatggagtttcgccccattgcctaggctggtcttgaactcctggactcagtgaccctcccactttgacctcccaaagtgctgggattaccggcgggagccgctgtgcctagcccaagcctttttattcttcttgaatcctgagatagagaggaagaggtggatagtgacatagagaaagtgaggaaacatgtattagaaaaaactttcttatcgatgaactacatttagggtggaaacctgtggctgtggatcaggtgtgaaccagcagttgcttacggagagatgcatgtggcctgaagtgtcttacttcttcctgtgaatagaaatacttgttttttcagagtaaaatattaacttctatttctttttcttgcgcaggaactgaaacatttgatcttggaggcagcagatggctttctgtttattgtctcatgtgagacaggcagggtggtgtatgtgtctgactccgtgactcctgttttgaaccagccacagtctgaatggtttggcagcacactctatgatcaggtgcacccagatgatgtggataaacttcgtgagcagctttccacttcagaaaatgccctgacaggtgagagttatgtgtatgggaaatgaatgagaagtcctttcttgtttttttcctgagacttaagagatgttttagctgttaaattggtttgttgactctggcaaggcttcaagaattttctactttaatgaatatagtcagttctttttatccatatgagattatctactttgtggctcagcc

SEQ ID NO: 56066 - DNA, 2006 bp, Homo sapiens
gtatttgtcatttttaatagctaaataatcttttagcttgttaacctgtcatacttagacattttattcagggcctctttatctatataaatatatttaaaatggaattgacacattcctgacacaatggcctgccaacaccttgctatttcctcagttgccacccatcattacagtatctcagttttctagaaaaatttagtgatggttctttgtatccttctccagtggagagggaattgttacttttgatccattcctgtgtggctatactgcagagaaatggcaaaaggaccgaatcaaagttaataattattttaggaacaaatcaataatagaagatatgccagaaacctacctcttagagttatttatataatttctccagtgaaatctggttggttattttgtcattgtgtggcacgtgcatgtgttgtttgtgtgagagggagagagattatatttgtcatcacttgtttgatagtatcatctttaatgtactctgtctttaatttcttcattatagaatagcacatgtggatatcattttctttccagattgggagcagtgcatgaaaatggtattcctgaattcccttggttggttcttgttcagactctgtatatctttggtccctacagagatcgattggcaaaatgctttctgtgtttagatcatgttaatttactatatattggctttgcttttatgttgacctttatcttgtaagttactttttctttatcctaacagatggctttgtagagttacaggcaaggttcctgcctataattccatttccctcctctcttctctgcatctgtttagttctatatccttttctctcttctttctccttttctttttttttctccctccatttcctctccctccctccttccttttttcccttcctccctccccccttccttccttcttttttattttaattttagcttagttcattaattctatttttaggtcggatgatgagcagagctctgcggataaagagagacttgccaggtaggagaacagtgtcttttagcatgatgaagcagatgatgctgctttttctatcctttttcttactctttcttttcttcccctttctctttgtatttttccttatctgtggcaagagaggacaagattttttagaagtttgagtgtaacaggaactttggcttcccccatcagaaagtgggtgagttgagggaactttgcttagggatttaagaaattgctattagttttaagtttttttttctttttctctttatgtcagtactaagtttcacagaacaaaaagctcttagaaggaatgcaaccgtgccagttggtgctttaacagggaaatactctttttatcagaaaaccaataaatatatctgtatttgtgattagttcccagtatttaggcctcagcatttactccacacctctaggaaactcacacctattttcctatgaagactcacagcctagattattctcacaacagaactagtgttgctttggtgaccgaatcctttcttgcggtagttttctagaaaagttttagtttccttgatgtggctatttaaaagaccaggtttctgtacttacgtgtcagaaatctgtcagatactaggaagatgagtgctttatgtttgagaatagaattttatgtcttaggcaaagtgtaactaaatatgggcctatgtggtgagaccctttttgccatttagaaaggagactctagaattctcttgggagactgttgtttgtaatgtagaaatgctgcagaagaaatatgcatagacttttctgttttctagtatctgtgatttgggggtgacttaggaaatagatcattgatgccaatacccatttttactatattcccccttttttctactatttcctctttaatctgggtcacaaactcattttgctgccagtttaactcgagcttcttactaaccctttcactgttcagaaaatggatttggcatgatgtggt

SEQ ID NO: 56067 - DNA, 1019 bp, Homo sapiens
ggtggttgctaggggttggggtgaaggagaaatgagaaaatggtgtttgatgagtatagagtttcagttttgcaagatgaaaaagttctagatatctgttgcacaacaatgtgaatatggttagcactactcaactgtacacttaaaaatggtatacagtaaattttatgtgttttttaccagaattaaaaaaaaacccaaaactaaccccttactttagaattgtgctgacaggccagtcagctgtgttgtcattagatcatcatctttttttggtgtgtctggtaagggtaatggaaataccagaaacctgacaaataatagttgtgggtcttttaagttctatggggtgctgctgttatttctatcactttgtgatgcttttccattggctttttttctattgaatattttcacccctttctagtttacttttcagagtgaaatagatataacaagtgtaatgctttgaaacaatcctttttctctccttcaggtgtgatgatgatcagatgtctaacgataaggagcggtttgccaggtaatattgtagtaggtaatatattgtaatatataatatgatccatgttgtagaaccagacagtcctagcatattgacttaattttttctggatgagacggaatttctctgtttaatatctttcctatttggaagtatgtgaaacttagtattataactatcatttatgttcaggtgacatggcttcaaactggcggtatattttatacagtgtttttctgtgtatgtgataactaaagcaatgtgcttgcaaggtttccataggagcacaaattatggattttgtgcttgcatttattattaaatggatctacaaaaataggaatacagataatggttctgtaattaatttatttattttgagacagagtcttgctctgttgcccaggctggagtgcaatggcgccatctcggctcactgcaaccttcacctcctgggttcaagcgattctcctgcctcagcctcctgagtagctgg

SEQ ID NO: 56068 - DNA, 1031 bp, Homo sapiens
tttttttttttgagatggagtcttgcagttgtcgcccaggcttgagtgcaatggtgcgatcttggctcactgaaacctccacctcccgggttccagcaattctcctgcctcagcctcctgagtagctgagattacaggcacccgccaccatgcccagctaatttttgtatttttagtagagatggggtttcagcatgttggccaggctgatctcgaactcctgacctcaggtgatccacccacctcagccttccaaagtgctgggattacaggcgtgagccaccactcctggccccagttttgtacttctttgcctagtttgggactatgaacaagaggaaatgtagctttgtttgacttctgccacttcctctttccattcttccatttgggtgggtgttccggtagcttgtgttgagaaattttaacttcttaatgttttgtattatcagcaggcttaaagtatttattgttggctttcctcaggctggattttgatgatgatggagaagggaacagtaaatttttgaggtaagagactgaaaaactttccttagatgtctgatattaaaaattagtttatgatctttatacttctgacttgtaaatttttgtccttaggtctaaggagagtacttcatcctaaaactataaatattcatatatctcagaaaatttttaagcattccgttaatatctctagagaaaggacctcagtgaggagaggacggcatttacaaaccctctgtatcagttctctgctacttcatagcctaaaaagaacaacagttcgttatttctcaattctgtggattgactgcatgtttattctgcttatctcacctagactcactcataagactgcattctcagctggtcagctgagaactggactcagctgggatggctgggtatttctgtctatgtgtttttttatcctcaaggaggccagactgaattttttcatgtggtgatggctacaatctacagcacaaatcccagtgtgcaagtgcttatcaagcctctgctta

SEQ ID NO: 56069 - DNA, 1052 bp, Homo sapiens
tatcaagaccccatctctaaaaaaaaaaaaaaaaattaactgggtgtggtagtgcgggcctatagtcctagctattccagaagctgaggtgggaggattgcttgagcccaggagtttgaggctgtagtgacctataccagtgattataccagtgcactctagcccaggcaacagagtgagacctggtctcaaaaaaaaaaaaaaaaatcaagaagagcaatctggatatgagcatttgggatttttagcaaactgctgagattttgtctatagcttgaacctttcttttagctaacttgatgatactgatgataagcaaggactgtctttttaaaaatgtttacttcattattttcctgacagaaatgacatcagatgtaccatcactgggtccagccattgcctctggaaactctggacctggaattcaaggtggaggagccattgtccagagggctattaagcggcgaccagggtgagtttgagtgtagtgtgttatgaatatctctcctataaaccaactttagttgctgaatttatttagttgctgaactcacttcgctattcctgaccatctcacttcaacttgattacttactacactactgtcatataagtctccttagtccctgtatttttgtttatgaagaatttgtttttatccaagtttcccgtaagcagttctttttttaaaccaaaatttccgtaagataaaggactgtagctaagcccagagattttactatgcctgagaaaactgtttgctgctttcattaagctttgtttctgttttcccaaaatcattttggtaggctgcttttctgaatttagagaatgctgagctctagaatagctgtcttctaagttattgatatgttgcttggtttggaatgcagagtccattcagctccaaaagtatttattaaattcctaattagtgttatggcattgtgctgattccaagtaggatacaaagatgaataagacacagtccttgtttctaagttggttgtgttctgatagaaataattattatacacatgaatatatga

SEQ ID NO: 56070 - DNA, 1005 bp, Homo sapiens
cctccctcccggttcggtggcggcggctcctcccactgggggggggggtggcgcggcggcggtggcatctgcggccatggcggcgactactgccaaccccggtgaggagacggaggactggggcgcctctaaaggggaggggccgaaggggctgacaactaaggagacccagggctgaggggacgcagctggagctgaaggcgccggggcggggcgggggccgcgagagacggtgggggagcggtgacctggggaggggcccgatcccggggacttgggtagactcgagtatacccaagggagcgagggggcaggtgggagttgaggggggctccctgtcctgacctccgttggagcggcagccagtgcggggctggcccgccctcactcctcggtcggcgtctggtctgtgatgtggtcctcttttaaccctctgcccgctggagccgcttgatgccgaaaactgtaggcagagtgtctcggtttactttaagagtagtttggattcataaaccctggaccacactgctctttagttgaggcgttgcttccaaacatttaaaggtttagattttaatttaaaaaataaaaaatggacattctttgatatatacgacgtttctttaggctgttacctcccacccgcaacccccgtccccgtctccgtccccggactatactttgaaacttagatcttgtgttaagagggcctgtaggtctttgcctgctgagggcaggggtttgtgtaatggttatggttccggacaggtctttagttccacagccccaggtttaaatcttgttaggcctacgtcgaggcaatttccaaactctttcagaaaagtttgattccacaccatttctcaatttcaaaaaataatcaaatatcaaaaaggtttggtctgttttgtctaagagatggagtagggtgtagtgcagttctagagagatcagatcttcaaattactagtcccagccctctttcctctatgttacagttattcc

SEQ ID NO: 56071 - DNA, 1042 bp, Homo sapiens
ataattttaaaatttgtgtgtatctcctctactttaatccttttaagttggcaaaagcatcattcccaatcacaaatacatagcagttctacagttttatgtttctgaatggctgtttaaagactatcctaaattataacttagtttgacaagcattcaagagtgaagtttaacttgctactattttaaaagcatgtgaccttatagatcatttataaaatgtgagaaatgctaaataatctttgatattacacataaaacacactaaaatgtctttcaataagtaaaaggaaccattttaaatacagggaattctaattagattggcatagttaaggccaaaaatataaagtagacattactaccttatttatcttcaacccttgcctttatggacacaaaacacaggtgaatcttgcttggttctgagacagtgaaggaatttctccagtattcaaatatattcacataaccagttatataaatctaaatataaaaccaatctccagtaagtttgaagatggtactcaccatctttgtgaaaagtttaacattactaacaaagtctaatcatatctttagaaggggtaaacagtgatagcatttactgaattggaattactattaaaattcaaaaactgaacatattcatttaaccacaagccagtcttagttttaaatcaggactgtccgacaaaatattctgtcagtcattcatgatctgaattctggtgtataagctctgttaaagtatggtacacatgaaaaattcatgagacatttgttttgtaataaataaggcagtggccaattattactcattagtagcttttttgagataagctgtcaagtcggccttttctgccttctttttaatgccggcaaagatcatttttgttccagggatgtacttcttgggattttccaaatactccatcagcgtatcctctccccagatgatgcctttgttcttattggcatctgtgtaagagaatccaacagcctgacctgtcttctgactgaagagaccatggagattagg

SEQ ID NO: 56072 - DNA, 1144 bp, Homo sapiens
ggttgcagtgagccgagatcatgccactgcactccagcctgggcaacagaacgagactccatctcaaaaaaaaaaaaaaaaattggccgggcacagtggctcatgcctataatcccagcactttgggagaccgaggcaggcggatcatgaggtcaaaagatagagaccatcctggctaacatggtgaaaccccgtctctactaaaaatataaaaattagctgggtgtagtggtgccaccttgcgtgcctgtagtcccagctactcgggaggctgaggcaggagaatcgctggaacccagggaggcggaggttccagtgagccaagatcgcaccactgcactccagcctggtgacagagtgagactccatctcaaaaaaaaaaaaaaaattaccccactttccctaattaccatactaccctctttaccttcccgttctctaccgaatctatgtcataactcttgagaataactttgcttcttctataggaaccttgagtcagatgtctggagaactaagcaaagatggtgacctgatagtcagcatgcgaattctgggcaagaagagaactaagacttggcacaaaggcacccttattgccatccagacagttggtatgtgcaaacttggaggaaccactcctgaaaggcaacctgcaccctccactgctgattgtttcttttccccataaccttcccatttgtctctcacatagcagcctggatttatacagaaactggcagtgtttaaaaagatttatctttcccttttactcagggccagggaagaaatacaaggtgaaatttgacaacaaaggaaagagtctactgtcggggaaccatattgcctatgattaccaccctcctgctgacaagctgtatgtgggcagtcgggtggtcgccaaatacaaagatgggaatcaggtctggctctatgctggcattgtagctgagacaccaaacgtcaaaaacaagctcaggtacctggacagaggactgtaaaggggtagaggctgggagcacagcacctgccctgttcgtgccatagaccagataccacaattagcttttgtcttcttagtccccagtggactgaaacccttactctttctttaccacaggagtcatgtgggtgattctttctt

SEQ ID NO: 56073 - DNA, 1875 bp, Homo sapiens
ggttaaattaagggagaactcctaactctcaagttgagaagaaagaaaaacaggaagaaagtagtggactggattgtcttccctggagtgcatcgtgttgtgatccagagaagtagaagctatgataaaataatttctgtggatcatgttaaatatcataacccccagatctttctgctgtcactcttcttttataggtttctcattttctttgatgatggctatgcttcctatgtcacacagtcggaactgtatcccatttgccggccacgtgagtgtttctcccttattccttagctcagttttctcctctaccttgtatttcttcttaggacatccagttgaaaagccctagtgtttttggtatttcagtctcaaagagcataagtttggttgatgtcttttgctcccaaaggtcagtttgctcccaaaagagatacagttttattgttcatctccaggactgggtctttgtagacaaagagtgagacactagaagatcatgaatggccttgagtagactgctcacgttatagatgtgcttcaatttcatttctaagtgagttacgttggaaaaggtgttacttctttcctagtgtcatactgcacctaacatttgtataaatgtgtagtctgcataatgctttccacagaagctgtgttagatggaacctcatagtgtccactatatttgttaccctggcttgggagcagactcctatggaaacaatcatttttaactgcagaagaatcaactaacacttttgtttacacataacatgacagtaaacacattctgagtctcttaaaaacctgatagagaatgagaaggaaggactaatttttttcatttcatgatgccacctgatctttttaaatttaccactagactgatcaacaagtgagcaagaatttccacttgaattttccagaggagaaacatccatttgtgtaaaataagtgaatcacctatattgtacatttcttatttagtatttacttgatttgtaagtatgtacagtttgtacattaggtttattacttaggtggtcttggctttgcttcccttgaggttctgattttactttttctctccttttcaacttaaaaagtatcaaatgtctcctggccaagtcttttccctatcaagacatgccctacctgccctctcagttctacttcttccttgaaacagtgaaaaagacttgggaggacatagaagacatctcctgccgtgacttcatagaggagtatgtcactgcctaccccaaccgccccatggtactgctcaagagtggccagcttatcaagactgagtgggaaggcacgtggtggaagtcccgagttgaggaggtggatggcagcctagtcaggatcctcttcctggtactgttcttctctacaattttggaggcagaggttggtggggggggaacttaagaagcagtaatgaggatggttttatagctattccatagccttcctctttcttatcctcgtatgtgttctcactgtttttggtcaaattttactttgccctttttgttgttcctctgcaggtcattgttgaaaataaattatctgaattataatacgaatctgcatggttttgatttatttattttttttctttaggagtattcacattgtgtgtaggtacagaaagggcagccaattccatttttccagggttaaggttttagtaggatagtgggacgaagaagagggatcaaggagtcctgattatctttcaaggctcagtttaactcttaggtattttgtactcatccttttctcccttctctctcccttcttagaatcatatttcttatttttaaaagttttaaaaacattttttaatactgctgcttgcag

SEQ ID NO: 56074 - DNA, 1536 bp, Homo sapiens
tgcctgtaatcccagcactttgggaggccgaggcgggtggatcacctgaggtcgggagttcgagaccagcctggccaacatggagaaaccctgtctctactaaaaaatacaaaattagccaggcgtggtggcgcatgcctgtaatcccagctactcaggacgctgaggcaggagaatcgcttgaacccaggaggcagaggttgtggtgagccaagatcgtgccattgtactccagcctaggcaaaaagagcgaaacttgtctcaaaaaaaaaaagagaaatagagatgttatcagtcagtgaagagtaaccagggagtttcattgtccaggtttggtagggcaagggaagatctttcttgaatcatctttagcttcaggagcacagctgtttgaaagatgagagaaatggcttagctacctggagggttaattataaaacagaggtcctgttgccttccgatctgatcacttgcatctcatttgcagatcacctttaggctccacagcctctgccccagcaccctcagcactcccggcccctccagcacccccagtcttccatggcatgctggagcgggccccagcagagccctcctaccgtgctcccatggagaagcttttctacttacctcatgtctgcagctatacctgtctgtctcgagtcagacctatgaggaatgagcagtaccggggcaagaaccctctgctggtcccgttactatatgacttccggcggatgacagcccggcgtcgagttaaccgcaagatgggctttcatgttatctataagacaccttgtggtctctgccttcggacaatgcaggagatagaacgctaccttttcgagactggctgtgacttcctcttcctggagatgttctgtttggatccatatgttcttgtggaccgaaagtttcagccctataagcctttttactatattttggacatcacttatgggaaggaagatgttcccctatcctgtgtcaatgagattgacacaacccctccaccccaggtggcctacagcaaggaacgtatcccgggcaagggtgttttcattaacacaggccctgaatttctggttggctgtgactgcaaggatgggtgtcgggacaagtgagttggtggggggaattgctgcccctgcttccaactttgttatggtgtctgtttcacctcttcctttgccttgtatctgtactgctttccccatcttcctttacctcctccctcacctggaactcctgctataaggcctccatgaaagctatgaggtagggaggctggagtctgacatggccacactgagcaaccttgggtacatgtgtattgtgttatttttgttctctgatccccccgctcctttcctttatttccctctgtcatataggtccaagtgtgcctgccatcaactaactatccaggctacagcctgtaccccaggaggccaaatcaaccctaactctggctaccagtacaagagactagaagagtgtctacccacagggtaagtggtcaaggaatggcacagt

SEQ ID NO: 56075 - DNA, 1070 bp, Homo sapiens
ctcagagtttttcatcattccccttctcagaaagtttctggaaatatttgcaaaaatgagagggaaaggcaggaaaggggaagacaggtgacagtgcagtgaaagaggcttccaggctgacagctgtgtactaggcatagagaagagccactgcaggagcaggtcagatgctgtaggagcgacttcttcaggaaaattggtttaacagaaaacctgaggtgcctgaatacattcagaggagatcgagactactggggagatcataggatgaatttgtactgataacattgaaaaactaaacaaaggaatagacagttgtttagttgcattgctgtatcatgtatgttttaattattaacaaaattttgaatctaacaatagcgtttagatttgataatgctgggtggtacatgagtgttcatatcttttttacacgtttgaaatgtttcataaaaatattttcaaataatcacaaataatatatcactcccctgcttaactctataatatagtccctctgctgtttggattttattctgactcttaaccttaggttatatatttggccctttcctgtctccctccaaagtcattccaaccacactgatatttttcagttcctggatccagttcaaccagtgttttccagcctgcctctggagacttgcacatgctgtgccttcttcttggcatccttccacttttctttgtgtggctatcttctttaaccttgagctttcagctgtaaagtcacctcctcagagagaccttccctgaccactttaaaactaggtcattttactcccttaattctctcattgagcaccatgtttgtgttctttatagcatttatgacaacttttgttgacttgtttttctttttttctattatataagctccttcatgagggcaaggatcttatctgtctctttgtcttgctaaccattgtatcaccagtttacccaatgcctggcacatagtaatcacttaggccaggtgcagtggctgatgcctgtaatcccagcactttgggaggccaaggcgggcagatcacttgaggtcaggagtt

SEQ ID NO: 56076 - DNA, 1011 bp, Homo sapiens
gggaggccgagacaggtggattacgaggtcaggaattcaagatcagcctggccaagatgttgaaaccccgtctctactaaaaatacaaaaattagccatgtgcggtggcaggcgcctgtaatcccagctactccagaggctgaggcaggagaatcacttgaacccgcgaggtggaggttgcagtgagccaagatcccaccactgcactccggcctaggcaatagagtgagactccgcctcaaaaaaaaaaaaaaaagtaaccacttaaattttgtggaatgaatgaatgatagtatagctactgtaaaggtttcatgtggtaataatgacacctgagttcaaattccagccctgcccctactgagctgatcttttttgatcagctgtaaacagaggatattaacataaacacccccatgtccccagtggggttttaagggacctaacaaagttgtttcttgatctggtgcaggttacatggtatgctgagtttgtaaaattcattgatctgtatagacttacgtgtactttcctctgtgtatattacgtttcaataatcttttatttccccctacccactagaccaccagggaaataatctcttttttttttttgctatggagtcttgctcccaaagtgctgggattaccgacatgggaaataatcttttttaaagttagaaaaaaaagctagacatggtggctcacacctgtaatcccagcactttgggaggccgtggtggggggatggcttgagttcagtagttccagacttgcctgggcaatgtgatgagaccttgtctctacaaaaaaagttttaaaaattagctgggcatgtggcatgcagctgtggtcccagctacttaggagactgaggcaggaggatcacttgagcccaggaggtcaaggctgcagtgagctgtgtttgtgccgctgcactatggtctgggtgacagagcaagaccatgactcaaaaaaaaaaaaaatgggaggtcgaagcaggtggatcacc

SEQ ID NO: 56077 - DNA, 1410 bp, Homo sapiens
gtattgatggaataatccttattctttctaataggtccccgtggccgggtgcggtggctaacacctgtaatcccaacactgtgggaggctgaggcgggcagatcacctgaggtcaggagttcgagaccaacctggccaacatggtgaaacgccatctctaccaaaaatacaaaaaaaattagccaggcatggtggcgtgcacctgtagtcctatctactcaggaggctaaggcaggagaatcacttgaacctgggaggcagaggttgcagtgagccgagatcgcgccactgcactccagcctgggtgacagagcaagactccatctggaaaaaaaaaaaaaaaaaagcaaacaaaaaaaaaaactaataggtccccataaccctagaaggcctttaattctcttcattctcaggcaaaatcctgacagatgactttgcagacaaggagggtctggaaatgggtgatgagtactttgcaaatctggaccatatcgagagcgtggagaacttcaaagaaggatatgagagtgatgccccctgttcctctgacagcagtggtgtagacttgaaggaccaggaagatggcaacagcggtacagaggaccctgaagagtccaatgatgatagctcagatgataacttctgtaaggatgaggacttcagcaccagttcagtgtggcggagctatgctacccggaggcagacccggggccagaaagagaacggactctctgagacaacttccaaggactcccaccccccagatcttggacccccacatattcctgttcctccctcaatccctgtaggtggctgcaatccaccttcctccgaagagacacccaagaacaaggtggcctcatggttgagctgcaatagtgtcagtgaaggtggttttgctgactctgatagccattcatccttcaagactaatgaaggtggggagggccgggctgggggaagccgaatggaggctgagaaggcctccacctcaggactaggcatcaaggatgagggagacatcaaacaggccaagaaagaggtaagcagtggcagaacactctgagagctatggctttaactttggtgcagtaacaatgcagtctcaccatgagtctttgcatgtagattattctacttgatggatatttctgtggccacctcgttatctctccccctaactagcacattcctagtgtttgtttaaagaaccaaattattgaccgggcacagtggctcacacctgtaatcccaacactttgggaggccgaggcaggtggataacttgaagttcaggagttggagaccatcctggccaacatggtgaaaccccgtctctactaaaaaatacaaaaattagccgggcgtggtggtgcatgcctgtatttccagctacttgggaggctgagg

SEQ ID NO: 56078 - DNA, 2430 bp, Homo sapiens
gcttcttgcatgtgaatttttttagatggagttctcgctctgtcacccaggctggagtgcaatggtgcaatctcgactcactgcagcctccgcctcccgggttcaggtgattctcctgcctcagcctcctaagtagctgagattacagtcgcccgccaccacacccagctagatgtatttttagtagagatggggtttcgccatgttggccaggctggtctcaaactcctgacctctagtgatccaccctccttggcccctcaaagtgctcaaattacatgcatgtgaaatttaaaaaagaaaatattacataactgcaaggaaggcataagaaagactctcttcgtttatttagttgatcccccttctcaattcctaatagtctgacacttattgccatgttttatttaatattttttatttaatcttttaatttttaaaaaaaacccattaacagtacattttggtctaaaatggtccctctgctgaaatgctaggtgctagccgtaattctggctttaaaaccaaaaccccaaatatttaataaataaaaattagaattagttgccattctactccaaaccagctagcctagctgaagagaagagggaagggggaagaggccagagaaaggaggaggcagtcagatcttagacctgtcgctacagggacagctgaaagaagtagcactaagaaagatcatccgagcagtccccagtacagcccccactttttggcagaggtagggtaagggttatgtgcaccctcctcctaccctcaattcatttgtgtcatagagggagaaagttaaaagctcagctttggtttctggcccaagttagggagcttagaaaggttagccttggtccagctttggcagaatgaggcccacagatgggacaataaggcacaaccctggctctggaggtcagggagtcaaaggcaaacagctggggccaaattctcagaataaggaatgtgaattgtaacccctacccacagagagctgagggagggcctcaaaagcagtagaaaggatgacttggcgggtagggaggaaaatacgaccgtccccctctaacagaatataaccaacgtccccctacctggggataggctggttagaatttggtttaaaggcaactgggtgacaagcaaggagggaggatgcagagaactctcctctcactttctcctttttccccagagcttaaagtgaccctatagcgcagggagcggggtagttccttggctttatgcattaatctgggaggcagctggagtaatggttcagtcattcttacgatggttgttattgaggatggggtggccattggctaggggccggctctttgctcctcccccagctgcagcctcctccccctctgagctctctgtttcttcccggtcactgcgttcatcttctaccagctgtggaaaagggacaagaagggttattacatgagatcctcaaacccctaagtactgcttctctctgagggcttgttcctgttatacccagggctccacactagttttttagagagttactggcaagatgggagttcaggaagttgtagagagtagtaaggcctacacaatgggaacagggcttcacctttccagttatgaacttgtgggccatgcgcaaaatgaggtaggcccagaagatatgcagcagctgtagaactcccatcatggaattgaagaagtaatagccaaagaaggcaggatagagctccagtgggtacaccagggtgcaatgcaggatcctgaggattcaaggagagagagaacgtggacaagagcaggtcagacaccggggagatacaggaggggaagaaaggcaaggctcctgatttcttcagaacaggagtgtagcctagctgcctactcaccagaagggcaggatgaccagtcgggtgatgataaaaacaatggcgaagacgatgaagatgttgttgcaggtgttcttccatcccgcgtagttaaacatcttggctgactgcatagagagcccccatccatcatcatgggctcctgactccctcgagtacattcatatgtacactccagttaggagcactgactctgtgccctcctccttggtcccaggaatgtcatcctccaaattcccaccccgcacctccctcccaaagaaaaccaaagggacagaagaacctgcaccagggtctctagatttgaggaagcctgacctccagcaggtaatcggaagagtcatgcagagccatgattagagtcccagctcggatgtaattggcaaaccaggaaaagctgatgagaatgatggtggccacatggtggatgatctgttccttgaaatcctgcagagatgatgcaggccccagggcctttttttattccccagctctcactatgccttcttaccccttgcctttggttccccat

SEQ ID NO: 56079 - DNA, 4634 bp, Homo sapiens
ttttttttttttgagacagtctcgctgtcacctaggctagagtgcaatggcgtgattccggctcactgcaacctctgcctcctgggttcaagcgattctcctgcctcagcctcctgagtagctgggactataggcgcccgccaccacacccagctagttttttgtatttttagtagagatgaggtttcgccatgttggccaggctggtctcgaactcctgacctcgtgatctgccagcctcggcctcccaaagtgctgggaccacaggcatgagccatcacggccggcctaacagtaaatgttaaaactggaaagccaccgtattacagatgaggaaactgatttgcccaaggctacatagccaggatagggatctagagttcgactctctgcccccttctccttttgatacatcctgaaaacttttattcatctatctcttcctccatagctactccctcttgatgccctcccctttgcccctcactcaggatgctccagaccttgtatgattacttctggtgggaacgtctgtggctgcctgtgaacttgacctgggccgatctagaagaccgagatggacgtgtctacgccaaagcctcagatctctatatcacgctgcccctggccttgctcttcctcatcgttcgatacttctttgagctgtaagcatgccagcctaccctcatgccttcccctgttgccagttgcagtttcttggacttcaagtttgttccttgctgtttaattagcccttgaccctgatgttctggctactcaggttcctgcccactgtgcaccccctcccctgaaggcaccattgtcttcctgaaggctcagcacccccaggccctttccatcaatggttatttgttctcaccctctacccgccgcccgcctggccactagtgaacacacaggcagctttgtcagctgtgggcagccctggaggctagagaaaagggggttgccaggaagctggggaaactgaggccagggtaaagttgccttagcttgcagccctttcccttcccagcaagctagataccttactcatatcccttccccaggtacgtggctacaccactggctgccctcttgaacataaaggagaaaactcggctgcgggcacctcccaacgccaccttggaacatttctacctgaccagtggcaagcagcccaagcaggtatgagccgcatgctgctctggctctgggaatcactgagtttggtggtggggggacagggtttgaatgttagctctggcaggtgaagagatggggaagcagtggtgctgactgaggttgttactgggagaggctggggatgctgctgagttccgaaggtaaacataacaatgggcttcttcactgtgcccaggtggaagtagagcttttgtcccggcagagcgggctctctggccgccaggtagagcgttggttccgtcgccgccgcaaccaggaccggcccagtctcctcaagaagttccgagaagccaggtgggggaggctggggcagaagctgggtgacaaggaatatcctgatgtgtcttgctgggagggataggcggtggctatacgcagggagatgtgaggaggtgaattcagttattaatggtatcttgtgagggtatctgcaggtatttgggggctgctgggggactgtgctatcctctgacctagccatttctgcttcctctgccagctggagattcacattttacctgattgccttcattgccggcatggccgtcattgtggatgtgagtggggattactgggaggtgggagtaggttctctggcaaggtcaggtgaggccatggaatttgggttcctcctcttttaacttctcaccatctctctgcagaaaccctggttctatgacatgaagaaagtttgggagggatatcccatacaggtatgagttctgcttcctcatgtgggggtggactaagacacaccctagtgaagagacggtttgtggaatccatggcagagggattagagtgatggaatgaagaacctcaggggctagggggtttgtggagtggggacacccttgcggctggttgctcttacctctctctcctctcccagagcactatcccttcccagtattggtactacatgattgaactttccttctactggtccctgctcttcagcattgcctctgatgtcaagcgaaaggtgggtgaaggggttgtgcaattaagcctcagagccaaaatgaggccctgggatgaacaccctctcctttgacttctgggtactctgaatggagctgttggtatatggggaaccaaaggcaaggggtaagaaggcatagtgagagctggggaataaaaaaaggccctggggcctgcatcatctctgcaggatttcaaggaacagatcatccaccatgtggccaccatcattctcatcagcttttcctggtttgccaattacatccgagctgggactctaatcatggctctgcatgactcttccgattacctgctggaggtcaggcttcctcaaatctagagaccctggtgcaggttcttctgtccctttggttttctttgggagggaggtgcggggtgggaatttggaggatgacattcctgggaccaaggaggagggcacagagtcagtgctcctaactggagtgtacatatgaatgtactcgagggagtcaggagcccatgatgatggatgggggctctctatgcagtcagccaagatgtttaactacgcgggatggaagaacacctgcaacaacatcttcatcgtcttcgccattgtttttatcatcacccgactggtcatcctgcccttctggtgagtaggcagctaggctacactcctgttctgaagaaatcaggagccttgcctttcttcccctcctgtatctccccggtgtctgacctgctcttgtccacgttctctctctccttgaatcctcaggatcctgcattgcaccctggtgtacccactggagctctatcctgccttctttggctattacttcttcaattccatgatgggagttctacagctgctgcatatcttctgggcctacctcattttgcgcatggcccacaagttcataactggaaaggtgaagccctgttcccattgtgtaggccttactactctctacaacttcctgaactcccatcttgccagtaactctctaaaaaactagtgtggagccctgggtataacaggaacaagccctcagagagaagcagtacttaggggtttgaggatctcatgtaataacccttcttgtcccttttccacagctggtagaagatgaacgcagtgaccgggaagaaacagagagctcagagggggaggaggctgcagctgggggaggagcaaagagccggcccctagccaatggccaccccatcctcaataacaaccatcgtaagaatgactgaaccattactccagctgcctcccagattaatgcataaagccaaggaactaccccgctccctgcgctatagggtcactttaagctctggggaaaaaggagaaagtgagaggagagttctctgcatcctccctccttgcttgtcacccagttgcctttaaaccaaattctaaccagcctatccccaggtagggggacgttggttatattctgttagagggggacggtcgtattttcctccctacccgccaagtcatcctttctactgcttttgaggccctccctcagctctctgtgggtaggggttacaattcacattccttattctgagaatttggccccagctgtttgcctttgactccctgacctccagagccagggttgtgccttattgtcccatctgtgggcctcattctgccaaagctggaccaaggctaacctttctaagctccctaacttgggccagaaaccaaagctgagcttttaactttctccctctatgacacaaatgaattgagggtaggaggagggtgcacataacccttaccctacctctgccaaaaagtgggggctgtactggggactgctcggatgatctttcttagtgctacttctttcagctgtccctgtagcgacaggtctaagatctgactgcctcctcctttctctggcctcttcccccttccctcttctcttcagctaggctagctggtttggagtagaatggcaactaattctaatttttatttattaaatatttggggttttggttttaaagccagaattacggctagcacctagcatttcagcagagggaccattttagaccaaaatgtactgttaatgggttttttttaaaaattaaaagattaaataaaaaatattaaataaaacatggcaataagtgtcagactattaggaattgagaagggggatcaactaaataaacgaagagagtctttcttatgccttccttgcagttatgtaatattttcttttttaaatttcacatgcatgtaatttgagcactttgaggggccaaggagggtggatcactagaggtcaggagtttgagaccagcctggccaacatggcgaaaccccatctctactaaaaatacatctagctgggtgtggtggcgggcgactgtaatctcagctacttaggaggctgaggcaggagaatcacctgaacccgggaggc

SEQ ID NO: 56080 - DNA, 1079 bp, Homo sapiens
ctgtccctctcccctggagccccttcctgtcttcctctccctactctctgtcccaatcctgacaccccttcttctagaatctcttcttgtgctcttccaaggaagttcagtgaccaattgttaaatccgatacaggggagaggagccacatctggacgcccagccggggagcgtcggcagaggccgaagcacgagtcagactgcattctgctgtagctctgccccagtgccaggctggcctgccccttcttccagaggctatggctagttggcttgctcccccgcctccacccctgagatgtgctggataacttatttatggactgttggggatgagagcaggcaacaaatgccaaggtcagacttggtaatgtccttgacctcacgtgctgctgccttctctgcctcccatccagggcaacactaggattggtgggtttctggttctcaactcccggtccctgaatagtcacacgtatgtacagactgaggctctggggtgaggtccctatccagaatgcatctcttctgcttcccatccctgctgcctggatgctcctgatcacctaggcaggcctgtctccagttgtttcagagcttaatttgggtttctatctcttatttgtaatgccttcctggggtttggaaataaaacttctggccgggcacggtggctcactcctgtaatctcaacaatttgagaggccaaggtgggcggatcacctgaggttaggagttcgagaccagcctgcccaaaaaggtgaaaccccgtctctactaaaaatacaagaaattagctgggcgtcatggtgggcgcctgtaatcccagctactcgggaggctgaggcaggagaatcacttgaacctgggaggtgaaagttgcagtgagccgagatcgcaccattgcactccagcctgggcgacaagagcaaaactgtctaaaaaaaaaaaaaaccttctttcctgagatctgttgtttgccttaccctgaagcaatagggttaagtatttgacccaattgaagaatgcaaaaagcgggaggtgggtcagaggcaggaaggtggttacctgtcatttct

SEQ ID NO: 56081 - DNA, 1019 bp, Homo sapiens
tcacccaggctggagtgcaatggtgggatctcggctcactgcaacctccgcctcccgggttcaagcaattctccctgcctcagcctctggagtagctgagattacaggcacctgccaccacacccggctaatttttgtgctttttagtttcaccatgcttgccaggctggtctcgaacccctgacctgaggtgattcgcccaccttggcctcccaaagtgctgggatcataggtgtgagccaccgcgctcggcctattctcatttttatatgaggaaaatgaggcttagagggtccaaagtcctgcaacaagtaagaagcagagctggaattcaaccccaaagtctgtgatcttttcaaatagtagttctgcattcaaacagagaacaaatagtgcaaagggcagagctgggaatgtgcacatcatggtttgcgggtggtgaatagtccagtcaggccggggtgacagtgggtgttgacaggggagaggaatgctgctgcctcccttggtcactccagttccaagatttgctacaagtcccaaagtattccttttgtattcattccttttggttactgtctaggtttggctgagcgcaaggggttcattgttcaccttcctctgtagatggtttctcctgacttcagaaccataccactgtatttggtccctactttgtgcttttctgcttagcattctcttcatggtaaggatctaactgaacctgattcagctgctgcttgcagtgaagcaacactgatgtaaataagcgtggaaaggttctccagcatctctttggaccctgcagtaggtctctcctgcttgctctgccttttctccactgctcttatgtttttcctccagtcagggccatatgcctcatgtttatatagtttcctctctagagaacactcgctccccctaactgcttcagtgagcaagttatttctgcagcctcttatctcaagtgctttgctgtcactttggtccacagccatttgggcagttcttggtctcca

SEQ ID NO: 56082 - DNA, 1207 bp, Homo sapiens
atcttaaaaaaaaaaaaaaatagctgggcgtggtggctcgcgcctgtaagtcccagctacttgggaggctgaggcaggagaatcgcttgaacctaggaggtggaggttgcagtgagccaagatcgcgccactgcgctccagtctgagcgacagagtgatgctctgtctcaaaaaaaaaaaaaaaaaaattagccaggccgggcgtggtggctcacgcctgtaatcccagcactttgggaggctgaggcgggcagaatcacctgaggtcaggagtttgagaccagcctgaccaacatggagaaaccccatctctactaaaaatacaaaattagccaggcgtggtggcacatgcctgtaatcccagctactcaggaggctgaggcaggagaattgcttgaacatgggagccagaggttgcggtgagccgagatcatgccatcgcactccagcctgtgcaacaagagcgaaactccgtctcaaaaaaaaattttttttaatctataaatatctcaataatgtctgtttaacaaatgtacacatttataataattccatccctaatttactactggaaaaaactaccaaaaaagcaacacgattatgtgactttcctaagtctgtttggctcctgctaatatttttttcttgagcacattgtggttatagcaggatactgacagaaggcagcctgagagagcattatccatctatggattcattcagtaataaactttcctttttttttcttttttttttttgagacagagttttctcttgttgcctaggttggagtgcaatagtgcaatctaggctcactgcaacctccgcctcccgggataattttgtgtgtgtgtgtgtgtgtgtgtttttagtagagatggggcttcaccatgttggtcaggctggtcttcaactcctgacctcaggtgatccgcccacctcggactcccaaagtgctgggattacaggtatgagccaccgtgccaccaccttttttttttttaagagatggtgtctctctcgctctgtctcctaggctagagtacagcggcatcatcataaccttgagctcctgggttcaaggaatcctcccgcctcagcctcctgtgtaaaagcatcattcctggctaatttttttttttttttttttgaaactgagttttgttcttgttgcccaggctggagtgcaatggcaccatctcggctc

SEQ ID NO: 56083 - DNA, 1412 bp, Homo sapiens
tgccaccatgcctgactaatttttgtatttttagtagagatggggtttcaccatgttagccaggcaggtctcgaactcctgacctcaagtgatccacctgccttggccttccgaagtgctggaattacaagcctgagccactgcacctggccaagaactgcagtttttaaagtcaggtagatgtgcttttctgttctaggtttgcctcttactcactctttgagctaaggcaagtcagttgacttctgcatctggaaatggcataatagtacctactgctaattctgctatgatcattaaacgtaatatcatgtgtaaagcacactcctggagcagagtaagcactttgtaaatagtggctcttactaatcctgtcagtaagaaaagggtgctttggccattagaagtacctcttccacgttcctgaatcttctcccctctgtgctgctcttttaaagctgtgtggatttctaatgactctaccattgtctaggttgcccctatgcttggaaacaggagtccttctctctctgttttgtttttgtgtgtgtgtgtgtgtgtttttttttttttttgagatgtctcactctgttgaccaggctggagtggtacaatggcactatctcagctcactgcaacctctgcctcccgggttcaagcaatcctcccagcctcccaagtagctgcggctacaggcacaccaccatggctagctaattttttttgtattttttgtagggacagagtctcgctatgttgcccaggctggtctcgaactcctggactcaagtgatccaccagcctcagcttcccagagttctggaattgcaggtgtgggccactatgcccagccaggagtccttttcttacagtctactctaccatctcctctctttctcctatgttaggggtagtataatatattgatttagaacactggctttggtgacagctctgggctcagtgtcagttttgcttcatgcaaattatgaccttaggcaagttacctgatcattgaagcctcagtttccctgcatgtaagtgagggtaatagtgataccagtcttattttgttcaattcattctttcttcctccatccctcttctggcctctagataaattctagttccatcctagttcaagttcttgagcacatttatacacttggaaacgacactagattagaagctggggttcctcggttctggtttaactgccatcatctgcatgattttactcacaaccatcttacttcgctttagttactttaataataaaatgaaatatacaatctaaactgtttcctctgtttttaaaatactgtgtatggctgggtatggtagctcatgcctgtaatcccagaactttgggaggctgagctgggcagatcacctgagctcaggagtttgag

SEQ ID NO: 56084 - DNA, 2279 bp, Homo sapiens
cctggaacgctcccactctccacccctgaagctgacccctgcctcaagtacccaccctaacctccatgcctatcttcaaggcaacacccaggtctctcgaaagaaacttctgcccctgctccaggaagccctgtcagcatattttgactccatgaagatcccttcaggacagcctgagacagcagatgtgtccagggagcaagtggacaaggaattggacagggcaagtaactccctgatttctggcctgagtcaagatgaggaggaccctccgctgcccccgacgcccatgaacagcttggtggatgagtgccctctagatcaggggctgcctaaactctctgctgaggccgtcttcgagaagtgcagtcagatctcactgtcacagtctaccacagcctccctgtccaagaagtgactgttgagaggcgaggaggtagtgggtgaggctacctgactcacttcaaatgcatgttttgagatgtttggagattcagcaattctgtcttcattgctccaggatctggtatactgttctcataaaactgagaggagaaaaaaagtgaaagaaagcagctgctttaagaatggttttccaccttttccccctaatctctaccaatcagacacattttattatttaaatctgcacctctctctattttatttgccaggggcacgatgtgacatatctgcagtcccagcacagtgggacaaaaagaatttagaccccaaaagtgtcctcggcatggatcttgaacagaaccagtatctgtcatggaactgaacattcatcgatggtctccatgtattcatttattcacttgttcattcaagtatttattgaatacctgcctcaagctagagagaaaagagagtgcgctttggaaatttattccagttttcagcctacagcagattatcagctcggtgacttttctttctgccaccatttaggtgatggtgtttgattcagagatggctgaatttctattcttagcttattgtgactgtttcagatctagtttgggaacagattagaggccattgtcttctgtcctgatcaggtggcctggctgtttctttggatccctctgtcccagagccacccagaaccctgactcttgagaatcaagaaaacacccagaaaggccttaatgacctcataggcactcttccaaaaagacaacagaactggaatgagaggcctgggtctgtctcctgccttagcaggcctatcaatttcttgtcaatctctttttttccttgctcacattaaaaggaagcatggagttctaatgctcccataaactatgtattttggcaagacacttcactactccaggtctcactttccccatctgtaaaacagggtttggactaggtgttccctggtattctgtgatctgcctcttgctgccattctttctctcctctgcttctctgtatttttcttctgttatccctgggggtgctcaggttcacttgattgtctgtatttctgtgtggttgtagcaaggactcagcctcatgtagcacgaataggggtgtggttcatggcgtgttgacccagcagagcactccctcccactaacttgttctgcatgtgtagagtctccccattttttttaacgcaaccctttcccctttttcctaccccacagctctgttccatgtaagttgccaacagtttcactgaacagtggggtatgtgatggttttggcatgacatcttcagtatgagggggacagtttgacttcactttgagggtgtgatgtctgtagctatgtggaaggtaaaaatagtggtgtgatcatgaaccaaaggaatttatgttttgtaacttgggtactttattttgcattttgttatactattaaataattttttcctgtttgggggtcttactgtctttttttacaagtgtattcaggcctttctctgtgatagttgtttcagtctcctcaaaattgatcccccttcttcctactatacttaatgtcttctttctgttgactctttttgggaataaggagcaacaggcttctgtctcccctcatcctcagcctcccgttcaacttgtttattctcccagaaacctccttataacatacttccgtttccccagttttccttatgcttgaaaagtagatccaagataacagtcctagaaacacacacaatggtttctttttctttttttttttttttttgagatggagttttgctctttttgccctggctggagtgcaatggcacaatctcagcccactacaac

SEQ ID NO: 56085 - DNA, 1055 bp, Homo sapiens
aactcttattcggtgggaaacaaggttcctaatagggatagagttaagggcggaggcaacagcaggatgaggataattaagagaacctgaattaaatttttaatattttaaaaaaggaaagttgctgggaagctggtaaacagaaacagaagattagaggcctaactagaaagagacactggtgttagcagagagatattgaggggctgtaagcctaaggtttgaaatctaaagatagagtggaaaagggagtaggcacccccaccagcccctgcttgacatctgctttagttcattccagcaggaaggaggagaagggcagggaggtagggagcttctcagcaaagccagcttcagctttgataatctcacccacctaccccatttaaggagttccaggtttaagagtttaaaaacaggtggcacccagaccatcattcaggagacaggaactcattccaggttcctagagaactcctatctcagacctgagggtttccagggcttcagctgagctcctctggctaaccagtagtcacttgatcagtcctgctgccttgaccccatctccaggaggggctatggccagagggagtagagggagtccagcccccaagccttgtgaggcactgttaggcagatagggaaaagaggggtccttagatcactggttcaaggagggatctggtaggggcagcatttcttctgggctggaaacagaatgggggtttcaagatggcagaacctgaaataaaaaaaaagtttttcttaaagaagattagcctcaaagaaaaccaaggctttaggaagaaggcactacctagtgcagactttaagctatttccacagtgtgttctttacttctgtctgcacaacaccctctcagtctttctatatcctacattctttttttttttgagatggaatctcactctgttgcccaggctggagtgcagtggcgcaatctagactcactgcaacctccacctcccgagttcaagtgattcttcggcctcagccgcctgagtaactgggattacaggcgtgtgccatca

SEQ ID NO: 56086 - DNA, 1046 bp, Homo sapiens
cactatttcctcttcagagtcacttaaatgcccctccccttctgccctaaactcagagagaagggagctggagcttgtatcaccccaaactttgctaatttctgccactatcctttggtcctcgcccatcctcttaactctaagtgcttctagcccccttcctctcccttggtaccaccagccactgctccttaaccccttggtgtccttttggttctgttccttttttttagagtcaaactgaggttcatagtgtttgggaatgagtgttggtgtacaggtctagggcctctcagggaggactgggaagatataggctcatcaggaggtttctcaaggattgggggagggggagatttctcactgatctttctttttactttcttctaatccagggttccgagtctgaggaagacataaccttgtgcctgcctgcccacctctctctctggtcctgttcatctctcaggctctgagacactgaccttcactgctcagttaaaggttccagggattccactttgtctggacccatccagctgagtgaacccagggtggtggtgtatctggggagagtgaggagtgggttgtccaaacaccagggaaagagccctttggggcctcagacagcggagtgaagctggaaccatcagggaacatgagtgaattttggcacaaactgggctgctgtgtggtagagaaaccccagccggtgagtctccccaccccccatcctaacccaaagagcagtcagttactgtgtgctgtgaggtagccacaccatctaggatctgccatctaaaaaagcacacttcttgcctccctctgtgtcaggagcttctatggtcaggcagctgtatatgtggaacaaaggggactgggtgatggaagaagtgaatagtcctagctattacctcctgttcctgtccattctgagctgggtggggtttgtaggtggagctgcatacctgtcagttttccccattatttcatcatcagtcagaggtgactttgacatgtcctttctttgtccagtgttcactctg

SEQ ID NO: 56087 - DNA, 1041 bp, Homo sapiens
gcgccgggctccgagccggacgggtttcgtaatcgcgtcgccgccgcttccgccctcagccggccccacctctgccggctcgtactcggctcccccacctcgccgcagagctagcccgggaagcccacactggcggccacggagcagagtccctcacccccaccagctgtagctgaacgtctggatggtggagaagagcaggtgaggccgtgcagttggtcccctggcccgcctgccgcgccggccgggccaggcggagacacaccggatgcggggtgtgggggaggcgggtgtcctgggctgcagagatgctggggtggtgggaaaggggtgcgcgcccggggtggccgtagtcatccacgctcctggggtgcgcaggctgaggccgctgaagagtagaaggaaaagaaggaactggaatgttgggggaggtgggagggagagggtccgaaagattcccagagaggtcccagtccggttaagggttgagaacagcagagaacttctaggtagagttgtgtagtggggggagacagatacggaatctgtgtgattgaatatatttggggaggggaggcttagggcctagccctctttcctcttaagcccccagaagacctttcctggggaagggaaggttggtgttgggcctgtcacttggctgaaatatggagtccacaccgcttctccagagtccctcagcagccctccatgtctcggggtctccacacagggaccagctgctgccccgggcttctagccagaattgcccatgccattctctcgattctttctttctctccagctgcttcatgtgagggcttgtcaggccgcgggttggaggccttagggccagaggcggtgggaccgggagaaccggtttggggcccgaacaggaccagagaactagcctgtacatccttcctccctggcacctctttcccatcccttctgctcacctcccaacagctctgagaccctcaagtcctagtatgatcttggtgggggcggggggtggctttcccggttccatatttcact

SEQ ID NO: 56088 - DNA, 1048 bp, Homo sapiens
aagcaaattttatgaaatattaactcaaaaggcctaaaatctctatgtcattgacccagagacatgtacacagggtaccaaatacattcaagaaagacatgcatgcaaacatacgtggcattaaaatcaagtcaagaacataaagtaatactacacagaaaattgaagttaaaatgctattcactaatgtaagtagtaatgacatttttgatttaatatagtatggatttaattatcaaatactccaaatttcgcaaaagatccttttttggctagcttccccttcccctccacaaatgctctccagccctacttcatctatctttacatctttcattatcttaaatggtatcatttacttaaagggttttgacagtgccttgtaccacaatatatgttcaataaatgcttcccactatccttcactttaaattatccgggtattttaggcaaaggcaatatctaattatcactctgttcttagagatacatgattagcaaatgtatagattagaaagatacactctcggagccacacagacacgcccaaatatcctttgtccagaccctttgtgggcatccaaggcctactcaacagggccttgctgtgtcatgctgccaccatggggaagggggaaggacaaggtggtggtggtggtagaggggagcagaacctctctgacatctcataatgtgtgcctcagtcagagcttggattttcctactagcattcctccaccaattccactgagctgcaaatcattcttttccagaatctgtccccatacctagctcctgtgggctatactgatttcactatggaatcaggcagttctccaacacagaggcccccacctttcctaccctaggctgcctctttctttggagcaaagattcgaggtggaatgaaagagattatccaaagaaaggtcaggattacacccaacattatcccatataaccccctcccaaactccctcctacagagaaacatagaacactacagaaaaaaattgcaagtatagggaagtagaggacagagagatac

SEQ ID NO: 56089 - DNA, 1071 bp, Homo sapiens
cccatggtggcagcatgacacagcaaggccctgttgagtaggccttggatgcccacaaagggtctggacaaaggatatttgggcgtgtctgtgtggctccgagagtgtatctttctaatctatacatttgctaatcatgtatctctaagaacagagtgataattagatattgcctttgcctaaaatacccggataatttaaagtgaaggatagtgggaagcatttattgaacatatattgtggtacaaggcactgtcaaaaccctttaagtaaatgataccatttaagataatgaaagatgtaaagatagatgaagtagggctggagagcatttgtggaggggaaggggaagctagccaaaaaaggatcttttgcgaaatttggagtatttgataattaaatccatactatattaaatcaaaaatgtcattactacttacattagtgaatagcattttaacttcaattttctgtgtagtattactttatgttcttgacttgattttaatgccacgtatgtttgcatgcatgtctttcttgaatgtatttggtaccctgtgtacatgtctctgggtcaatgacatagagattttaggccttttgagttaatatttcataaaatttgctttagctttttaaattgcaagatagctctaccaaacactcagggactgtttgagcagttttttatacatactctggttgtaagaaaaggagtcagtttgtcgaagagcttttttttttttctcagattctagcttgctctactgccctttgcttttccccattcagatcacaattacaggaacaatcacctaaaccacggaaaatctattcttcagcaactaaaaattcttttaagttttgggaatactggtatagggttatataaagctgttggcaactatccatgtacaacacaaaaagggatcagattgggaattatgagatctggattctatacaaactggctggaagtcttcccaagtcattaatttctaagatgtcttctagttttaaaattctatgattttttccccccatgattctattttttttttttttttaaga

SEQ ID NO: 56090 - DNA, 1088 bp, Homo sapiens
gaagcttgtccaagggaacttggattctctccagaggcaattggggatggtgagtttcttttttttcctccccaaattcctttttactggtgggattggaggatatacaattttctttctttaatagaaaaaaaaaaaaaaaagaaattcctttttaccagtatgtggagtatctaagcaaggaaaggccatgggccacaaagaagttgctgtagcatgaagactgacaagtggtttctttctaggaagctatgagggaccctgtgagtagccagtacagttcctttcttttctggaggatgcccatcccagaactggatctgtcggagctggaaggcctgggtctgtcagatacagccacctacaaggtcaaagacagcagcgttggcaaaatgatcgggcaagcaactgcagcagaccaggagaaaaaccctgaaggtgatggcctccttgagtacagcaccttcaacttctggagagctcccattgccagcatccactccttcgaactggacttgctctaaggccaagacttctctctcccatcaccttgccctcattgtcttccctctcaagccccttcctttccactcctttcccattttaatcttgttctctccctactgtgttggtggtgctgatgaatctgccagagttgagttctatgtatttatttatctatctgtctactccatttctctcaaaagccctcaagtcacaaagtaaatggttcaagcaatggagtactgggtcacagggattcctcctttcccccccaaatattaactccagaaactaggcctgactggggacacctgagagtagtatagtagtgcaaaatggaagactgatttttgactctattataatcagcttcagagattccttaaaccttcctaatttcctgctccagggcagtaaacacaaatatttcttcaaggggtgatgaaaacctcggaagttttaatttgaggttatctgctacgaaacagtatttctaaaaggctaaagtgataagtctcttgcttttttttgatcctgctcttatattcttttttttcctcagagaaatcaggagggtagttaga

SEQ ID NO: 56091 - DNA, 1057 bp, Homo sapiens
ctaaaatacaaaagaaattagccgggcatggcagcgtgcgcctatagtcccagctacttgggaggctgaggcaggaaccctggaggcggaggttgcagtgagccgagatcgcaccactgcactccagcctgggcgacagagtgggactccgtctcaaaaaaaaataaaaagagagagagagagacagagaaagcaagcaagcaagccatttctgctgcattttcagtatttttttttaattgacaggtggtctatatactggttagtcccttgaactttcaattctttgtttagagccctttcataactggactttttaaagtagtgattatgtttgtagaaaattgcttctgaaagtaataaagataagctacttttcaccaaaattgaacagatatccctggaagcaaaagtacagcatatggagcgagactttaaaatctggcacttatttatttgcttgttatatattctctcaggaattttttcaatggccgaatggaacaagtagttggacaaaactctagagaatattgttctctatagatactctgcagggatctcttgctagcacactgacttgtagataattaatcataaaatgttagtgctggaaattactttttaggctattcaggtcaactccctcatttttcttttttctttttttgagacggagtctcactctgtcgcccaggctggagtataatgacaccaacttggcttaccgcaatcttggcctcctgggttcaagcaattctcctgcctcagcctcccgagtagctgggattacaagcacctgccaccacgcccagctgatatttttgcatttagtagagacagggtttcaccatgttggccaagctggtctcaaactcctgacctcaagtggtccacccgcctcagcctcccaaagtggtaggattacaggcatgagccaccgtgcctggcctgactccctcatttttcaaatgaaaaaaacaagattcatagaggttgattgaattgtctagaagtttttgcaaatgatacacctttgctttcctgaagtaggaac

SEQ ID NO: 56092 - DNA, 1008 bp, Homo sapiens
gctgttcagtaactgtgtaactaaagctaataagtgttcttgggctgggcacggtggctcaagcctgtaatcctaccactttaggaggccaaggtgggcgatttgcctgagcccacaagttctagaccaacttgggcaacatggcaaaaccctctactaaaaatacaaaaaattagctgggcgtggtggcgtgtgcctgtaatcccagctgctcgggagggtgagtcatgagaattgcctgaacccaggaggtggaggttgcaatgagccaagatcgtgccactgcactccagcctgggtggcagagtgagactgtctcaaaaaaaaaaaaaagaaagacagaaaagaaaagctaataagtgttctgattgaaatatcctgccttgtttgataggaagcaatgcagaatcaggtgaatgttaatccagagagagccaaccctgtgactgaccctgtgagtatggctgctccattcatcttcacgtcgggtgaggttgttaacctcgcaagccttatttcttcaaccaacaccaaaacaacctcaggtaatgttctgataacatgaaatttattttagactcaaaaaagaacagaaccctagattttccaggagatgaatggataccctttctaatactccttaattaaaatattgccaaagcagaagatttgtaatagattttaaagctgaggtacttattctttctggggaagggaagatcatacatagggattacaaaggaatacttattgtgttaaaagtaaaatattctggcttgggcacagtggctcatatctgtaatcccaatgctttgggaggccaaggtgggaagattgcttgaggccaccctggactggacaacatagcaagaccccatcctctactaaaaataaattggatgggcatggtgatgcatacctgcagtcccagctactcaggaggctgacatgggaggatctcgtgagctcaggagttggacttactgtgagttataattgtgccactgt

SEQ ID NO: 56093 - DNA, 1047 bp, Homo sapiens
tcctcccaccttagcctcccaacatgctagaattataggtgtgagccaccttgccctgccatttctgggcggattgataagctaattggccataggtgacctagagtcagacaccttcatataagagcttcagacttgggacttacttgcatggcttccaagcctgcaaatctatacccttcctttttgagccattctcagtgctctattaatcctttttgtttctccctgaagggccatgccttacctgttgattcgaaaattcaaagagatattaaaaataatatatcaaggaatatattttactttctctttctttgcttttttgttgagatggggtcttgctgtgttgtctaggctagtcttgaactcctggattcaagaagtcctccagtcagctgcctgagtagctaggaccacaggcacacaccactgtacccaacctagaatatattttagtttattttctaattaaaagcaagcaaaacctctttgttttattatgcattcatcacctccaattggtgtcctttgacttgtagttctaactgtacctgctggtaaggttgcagaggagactgtaattaaagaggaagaagaagagaagttgccactaacaaagaaaccaaggataggagagaagacaaacagtgtggaggaaagcaaggtaatgtttttaggagtgatgaaaagaatttaaagccttaattattaaggcctgaacccttcttcatcttttcttttttctttttgagacggagtcttgctgtgttgcccaggctggagtacagtggcatgatctcagctcactgcaacctccgcctcccgggctcaagtgattctcatgcctcagcctcctgagtagctgggattacaggcacctgccaccatgcctggctaatttttgtatttttagtagagacagggttttgccatgttggccaagttggtctcgaactcttgacctcagataatctgcctacctctgcctcccaaagtgcttggattataggtgtgaggcaccgctcctggcctgtctttttgtct

SEQ ID NO: 56094 - DNA, 1138 bp, Homo sapiens
gataatttatgatcaggaatttacctggtggtgacatggcttacttttacaggaaggcaatgaaagagagctactacagcaacaactccaggaggccaatcgaagagcccaggaataccgacaccagctcctaaagaaagagcaggaagcagaacagtaccgtcttaagctggaggccatagcccgacagcagcccaatggagttgatttcaccatggttgaagaggtggctgaggtagatgctgtagtagtcacagagggggagttggaagagagagagacaaaagtgactgggtcagcagggaccacagagcctcacactagagtttccatggcaactgtttcatcttaatatgcaagggccacaatttgcactgtgttcatattaatcctcttttaaaaaaggaaatatacagaagacaaacattgtataaaaactaagagtgtctttaagaagaaaactatagcagggtacaatgcttgggctcaggaagtttctctgtgcaactagaaaattcaaagccatatttagggaacattttttctgaggggccaaaagaataaaggaccaaatttcttagctcatatcattgctttaaacatagaagtaaaagaatactgcatgttgtgggttgattttttttttttaaataactgactttctcacaaaagattttaagataacatttctaatatatatgcaccaatatatatgcctttaataattataccatcaagtgacctgaaaatgccccttagatttatgatgcgtatctgttggaaaaaccaattggaagggaagttagacaagctttggggaagagaaaaggaatatagtccatttccaaaggagcaggaactcccaaccttaagttaatttcactgaagagaattttccctttttttttttttttttgagacacggtctgactctgtcacccaggctagagtacagtggtgcaatcttggctcactgcaacctccgcctccagggcgcagcctcctgagtagctgggaggacaggcatatgccaccacatcactgagaagaaatttttgattgtctgacagatacttatccattatgtgtctatagttcagatgcttgtgtaagaaactgaaataagctgcgtgtggtg

SEQ ID NO: 56095 - DNA, 1551 bp, Homo sapiens
cagacccggcagctcatgcctgtaatcccagcactttgggaggctgaggtgggtggatcatgaggtcaggagttcaagaccagcctggccgagatggtgaaaccctactaaaaatacaaaaattcacctggcgaggtggcaggcacctggaatcccagctactcgggaggctgaggcggtagaatcacttgaacccaggtgacagaggttgcagtgatccaagatcatgccactgcactccagcctgggcgatagagtgagactctgtctcaaacaaacaaaacaaaacaaaattagctgggtgtggtggcacatgcctgtaatcccagctactcaggaggctgaggcaggagaatcgcttgaacccgggaggcggcagttgcaatgagccgagatggcaccattgcactccaacctgggcaacaagagtgaaactcaattaaaaaaaaaatagaaaagaaagaaaacttgtttatgtgggaggagtatatataaaaccaaaatccaggctgtgtttccacagtgctgggaagtggccagaaaaaggcttataggggctatgaaactctggtcttgacatataaactttgctctgactggatttcataaaattacagtgaggagggtagtctcttgtcagaaaaacttgtttccaaacatttatgtaatgtcaagctcagtctctcttttttttttttttttttttgagacggagtcttgctcttgttgcccaggctggagtgcaatggtgtgatctcaactcaccgcaacttccacctcccggtttcaagctattctcctgcctcagcctcccgagtagctgggattacaggcacgcgccaccacgcccggctaattttgtatattcagtagagacagggtttctctatgttggtcaggctggtctggaactcctggcctcaggtgatccacccgccttggcctcccaaaatgctgagattacaggcgtgagccaccccgcgcacagcctagactctaattttataaaactttgttgaattttctaagtgtcatttaggacatattgtgcttttctgtggagcttatatcttatcctcttatgtgcaacaaaaagggggtcggaggtaaatgctgatgatgttgtttagttttatttccttttgatctggcatgagtaaattgctctgtttccttaagcttgggtctgttacagagctttgtgccttatagggtgctcagtgtgtgttgacaaagggaataagaactgtcagtgccataaagaaccaaagattctggctactttgtcttcttcctttctctcccactatgcctacacttcctctgcccagacacttttggaaagtgtttaactgctgggttttctttttctttttctttttttttttgagacggagtttcactcttgttgcccaggctggagtgcaatggcgtgatcttggctcaccgcaacctctacctcctgggttcaagtgattctcctgcctcagcctcccgagtagctgggactacaggcatgcgccacaatgcctggctaattttgtattttta

SEQ ID NO: 56096 - DNA, 1801 bp, Homo sapiens
ctcgacctcccaaagtgctgggattataggcgtgagccactgcgcctgaccacctacctgctgggttttctttgtatgtcagcatggagtttttcccaaagaaagggaatatggatggagagagagaggttatgaacaggttatgttacagaggttattgcctttgaaactgggccctcatcattctagacttgcttgctttgttataaattagaagaaaccagagggagatgtgccaagtaaacattcgaatgactgtttagaatatggttttcttaattagcagtcatggggaaaacatgcatttttaatttggaaaaaacctgacagttaacatggttctgtttaccttgattagtgaagtaatttgctgcagtgttacagaggagcagaatcacttgggtctcaaaatagactgaaaatttaactccccaaaccaaatttaacaaacagaattggttattagagatttataggcaaaaatatcagtttggaaattaaccttggctactggccaccttagctaggttttctccacagatctgttttctccacagatctgagtacttaacacttcccagatgattggagaatattctgggctgttggggatgacaggaaaatgtgagggggagtagcctaggtaagggtgatgatgaaattgttctatctgctgtcaaataatcttttcctgtttgcaatgtttttattttttctgagtccctttgggaaccaggtgctaacaagaagctgttatgtgtgggatttcggagccttactttaacgatagaggaaccaagtatcattttagatatcttttatttatgttctcggtgcatatgttgactttaatccctcttcccccacacctcgcccattaaggggaaggaggttaactctgcagatgatattcaggcccaaccagctcactctctggggtggctactgactaaaggcagagaatgtccatccaacatgcccttctgactatacagtcaccacttttttgggggaattctttagcagatcttattgttctttctgcagaagctatcattcctacctccccaacccccaaaatctctaatacaggccaagtcattttttatgatgggtctctgagatagggcagtttgttagaggagaggctagggtagagagggagagaatggaggtatctgaaaataagtaagaaaaaggcattgatttttatttactcggaacggtcctcttggcatcccagataagggaaataggatttgatctccaattgtattgccatggagagaatggcaggtgaggatgctttgaagtagttagaaattaaatattgaatacattaatggcaataccatttcatgactttgcatatctttctggattagtcatggaagttggggaaatattgcttagatcttctgggttagaggattccaactgtttattggcaaggttggattattaagaatcaaatagcagacaaaaatggctgggcacggtggctcacgcctgtaatcccagcactttgagaggctgaggtgggtagatcacttgaggtgaggagttcgagaccagcctggccgacatggcaaaaccctgtctctaccaaaatacaaaaattagttgggcatgatggcatacgcctgtagtcccagctactctggaggctgaaacaggagaattgcttgaacccaaaaggtggagtttacagtgagctgagattgtgccactgcactccagcctgggcaatagagcgagactctgtctcaaaaaaaaaaaaaaaagaaggaaagaaagaaaa

SEQ ID NO: 56097 - DNA, 1301 bp, Homo sapiens
atttgatgcatttactgaactcttcctgaaagtttaatatggagtgggaatcagtttttgtcctaatttattagagaaggcttcctcttctctactccttgtgcaaacccatctctggatagctagaaaaggaacttcagaatggactatatgtgatgaccacctgtatgcactctaggctcttatctgtctctattttatgtggtgactatatctcagaagtactaccccttctgagtagtactattatttcctatgccaattttttttaagtctctgatgctgccctttttaaatttttgtcttattttttagcctctttagtattagggggtgaggtgacattcctagactctacagtagcagtttggcatgttagtgacaggaaattgtgattccctatctccccctcctcctaccttttctgcttttgtgattccattgttcctatctcattgaggctttcccaggcattcgaatttagttagtaggtcatttctaatctctgggccttgtcttttctctctccgttcccctccttccctaccacatattttttgtttattctgaggtggtttgtttctgaaagttaatctaggtcaccttctatatcctgtgctttctagttggctttagacatcttgttctagcaacaatgatggtagcagctctctccctgaccttgccccatgtgctgtccttctgtcaaggccatttgtgtgtgtactgcggcaggtgtgtgtgtggggggatgcgcccagactgttctcacaatgtcctcagtttttcaggttgtctgacagctttatgtacagcgtatttttagaaaaacttaaatatacttctttatttagggttttattctgatgagcaagtttgtgtgtatatgtgtgtatgagcatttgtatgtatatatacttatacagatctatattatatatacagtttttgtactatcatttaaaataaaaatgtttctcaataaaatgtcaaagccgaccatttcagggtgtcattgaatttgttttcatctcctgggcaaaatttgtatctattctcttttttttttttttttttgagacggagtctcgctctgtcgcccaggctggagtgcagtggcgggatctcggctcactgcaagctccgcctcccgggttcacgccattctcctgcgtcagcctcccaagtagctgggactacaggcgcccgccactacgtccggctaatttttttgtatttttagtagagacggggtttcaccgttttagccgggatggtctcgatctcctgacctcgtgatc

SEQ ID NO: 56098 - DNA, 1043 bp, Homo sapiens
aggtgagaagcccgtctcctcagtgagccagcatttcagggggagctggcggactcccactccccgctcccttccagccaagctgccttaactcgcccctcggggctcccccagagactgtgccccgggcgggccgcgcgcgctgtgtccagagtcctcgggccttctgggtctgggacgtgcctctcctactgtgtaggagcctccgcttcccaatacagccgtgtctgcagccactgcctgacttcactcgggcgggggagggcggcagtcggtcggctcgctctgggcgccctcgctctctgccttcatctgggccctgggctctcccgggtaatgggatggctgcggtcccgccggggggcagtctggaaaggtttcctaaaggagacgagcgaattaacggtgtcgaggtgagccagggccagggggaccccggtaaagtttagttgaggctggggaaggccctcggagctcgtttccagatcgaggtaagagggactttcttaaaggcctagtctatgggatggggcggcggagggaattttttgagaaataaaatgaagctgcagtgtacgttacttgaagttccacatcagaaaatcttgtccttaggagaatttgtctggcagattttgggttgcatgaggggtaggctacaaaaaacagcaaagtattcgtccctgttggaggcaagggtctgcccccggctcttacttaaggagcgggacgggggacgagagcgtgcgcggcgtcacacgcacgcttagccaccccccaagaagccgccgccgcgctcaagctccgcgcgctcaggaccaggtagcgtgtagctgtcgtgaagctccctttgctccggttgggactggctgcggatacctgtccgttatccccggcaccaatgagagggacgaacaggaccacctgcaccgcccaccaccctcgctaacaacgctttaaggcctaacgcaggaggcagctggtgcgaatttacaaatcgggtttttcacccccgcgtggctgcaatgtccgcccagttcgag

SEQ ID NO: 56099 - DNA, 1052 bp, Homo sapiens
cttatggtgagtcctcttgtcccaacctcaccttcccttgctcagcccacatacctgagtgtgtgtcctgtagcagcagcagagcagcattctgaataccctgggagtatcggaaaagggtcggcatcctccagatacccagcatgtagctcagtacttggcacacagtagggtactttttgaacaaataaatcaatgtcctgcatgatgagcccttccccaggcccagaagaaactagaggctggcgttctggactcctgggttccacaggagggaggaaggacccctggaagggtgtcaggggtagagatcaagagcctcactggctctgacctggtctctgccaccagtgcttccgggtcctggcccttcccctgggacccccagtcctcccagtgatgcccacccccggccccagtcttccactcttggagttcacactcggggtaagggggctacttgggagagataggagtgaagtgtggggctgctgattctcggagcgttctaagcccctcactgaatggtgtttggtgctcactaacgcctgtttggagcctcccttccccagaattgggcatcccagccccgagttctcctgcacgagcagtttttggcagttgctcttggcatggctacaggggccagaagtgggatggggaatccccaggcccaagctctggcctgagtgtgaggggtagtgcgtgggctgtatgctgaggagtcaggagaggtgaatcctgaggatggtggaggctgtaggagtgaggctgagtagcagcgggagggacgatgatgtcaggcctgggaactgccggcgcctctgggcctaggtaccccgcaccgcctccccttggctgagcctccctcctccctctcggtcggcaggcgtgcgccgggacctgcccccagcctcggcctcccgctccgtccccatcccactcctcctggccagtgtggccgcagcttttgccctgggcgcctcagtctctggcctcctggtctcctgtgcttgtcgccgcgcccaccgacgtcggggcaaggacatcga

SEQ ID NO: 56100 - DNA, 1023 bp, Homo sapiens
gccccaagccctctgaccccacatcctgcttgtccctcacccttgacccaagttgacctaccatgccatacccttcattcactgtgcccctcacattgctcccttggtgctctttttttttttttttttgagacggagtcttgctctgtcgcccaggctggagtgcagtggcgccatcttggctcactgcaagctccgcctcctggcttcacgccattctcctgcctcagcctcccgagcagctgggactacaggtgcccaccaccatgcccggctaatttgtttgtatttttagtagagatggggtttcaccatgttagccaggatggtctcgatctcctgacctcgtgatccacccacctcagcctcccaaagtgttgggattacaggcgtgagccaccgcgcccagccccttactgctcttaactcaccacactccttgcatgcagctggccctgtgggtctgtctcaccattgtctactccactctcctcccctaggtgcagttctcccgcgtagcccgagtatgtaaacgtgacatgggcggctcgcctcgggccttggaccgccactggacatccttcctgaagcttcggctcaactgctctgtccctggggactctactttctattttgatgttttacaggccttgactgggcctgtgaacctgcatggccgctctgctctctttggggtcttcaccacccagaccaataggttggtactaggctgactagtgtgacccaatctgtcccctgcctcaccagcctccaaactcccctttcacagcctactgatggggcagttaagggaacctccgaacaaagccagtttgctgtgttgccattttttctcctagtgtggcacccagtggctgccccacctcctcagtctctatctcttaatgtggtatgaagggtgccaccacttcttcctgggggaagttgtgcagttcctttcagcacctatcctgcatcttttctggctcctccagcatccctggctctgccgtctgcgccttc

SEQ ID NO: 56101 - DNA, 1067 bp, Homo sapiens
tgcctggctaacatggtggaaccccgtttctactaaaaatacaaaaaattagccaggcttggtggcgtgtgcctgtaaccccagctacttgggtggctgaggcaggagaattgcttgaacccaggaggcggaggttgcagtgagccgagatcgcgccatttcactctagcatgggcaacaagagtgaagctccgtctcaaaaaacaaaaaacaaaagtcttctacctcatggaattatttagggattaaatgaggttatacatgtaaagtgctgagaagactgtatggcacaaagtaaatgctttatatgtgtttcctgttattcttagctacatagagaaggtctaatactagttcagtggttcccaacacctcttactcgcctctctaccactggtaccacccaccaataagcccaccatgatagaaagcataaacccactttttctgagaagaacctttatctatttgcagttccggttatatttgtaggatttagagtaattttaaggatagaggagctgcagttgggttactgagagtaattgttgagggatatataagaatagcaaacactcctatgtgctagaagcagctccaagcacattatgaatttttttttttttcgagacggagtcttgcactgttgcccaggctagagtgcagtggcgtgatctcggctcactgcaagctccgcctcctgggttcacgccattctcctgcctcagcctcccgagtagctgggactacaggcgcccgccaccacgcctggctaattttgtttttgtatttttagtagagatggggtttcaccatgttagccaggatggtctcgatctcctgaccttgtgatccgcccgcctcggcctcccaaagtgctgggattacaggcgtgagccaccgctcccagctgagcacattataaatgttaaatcatttatccctgaactctggctatcctttgaccactgatgactgtggtttccaccacgatcaggccaggtggatgctggaggtgaggtggtcagaggaggcagaaaccttggagggctgaggtggcctgtgaa

SEQ ID NO: 56102 - DNA, 1119 bp, Homo sapiens
ctaaggcgcttttgctaagaaggctgttggattctgagggccttaacatgggagtggtcgccatgccccacaaactctcccagtgaccccctttgccaaggctagccctgtagttctagcagtttctagaaaggggccatccccttcccctgcatctctgggcataaagccaccagcacctttgtaaccaaactattaagaagtgtcatcagccccctcccattttcaaggcagcatctcccctacccaagcgtcagcagacttttcttgaatttttacatttacttgtaagggatgtggtaaggggagcataatgcagtctcttctctcctttgtcctgtcttccatcaggtcagaggtttcctatccccctcaagcccccacaggagtcaccaacccaggtaaggaaagggcagcagctcctgagggcagggggtggaagcaggcatgagcagggagcagaaagaggggctggctcttctcctcacttgccagagaccaaagttgtttccagggtgaagataccagttgctcagggcaacttggaggcaggggggtggtggggagagcaggttggggaggatgagagacaagctacgtccctttctcttcccctgggaacaacagtatccggaaacatgtcgggggagggaggaaggcccagcctttcaacaccagagggtcgttagctagctgctactctgccctggggaaggggggtcatcattaggtgttcctactcttttcctttcttcagctctcttgaggccccacctgacgtcagcctccccaccagtgatgctggattgggggtggggggacacttgggtcctggctgggagagtagaattactggggagatggaagggggcttggcctggaagcttagggtctgttttaggggacacggtgggatgggcaactaaggattggtgaaggatagttatctgttcacaaaagaaaggagtctcacccttcttgacctgatttttggagccgaccaagtccctcacttcaattttaggggaaggcaggaagctggtgtatacctcctgctgtgggccccagccagggtcatttggctgagggaggctgatggtggaaggagacctgtctcac

SEQ ID NO: 56103 - DNA, 1068 bp, Homo sapiens
ggaggctgaggcgggtggatcacgaggtcaggagttcgagaccagcctgaccaacatggtgaaaccctgtcactactaaaaatgcaaaaaattagctggttgtggtggcgtgtgcctgtaattccagctacttaggaggctgaggcaggagaatcacttgaacccaggaggcagaggttgcagtggattgcgccactgccctccagcctgggcgacagagtgagactctgtctcaaaaaaaaaaaaaacccacatcactgacagagtcattactgacacagccctaaccaactagtttaaaatagaactttctcatccctcctctaaggccattttcctatttctgtcattttacgacttgttatttaatatgtacccttcatgcttccaaaaaggatttaaggaggcttacaatataaacaaaaagtaggaacagtaaaaatagagacagatcagaagtaattgtaccaggaacctctgctaaaatggtaatagcaattgatattaaatttagttgtgagcttcctggtagccaaaccttgtatttctttttttagtaagaaagaagcatacaagttcttcaagagacacaaactttttcagccttaaatcctagggagcatttatcattatatccttatattataaaaagtaatggttttcatagatgatatacaaacattctcttttctagtgatgtctcttaatgactctcaataaaagccgaaggaatggtagtaaatccttaatttagtgcaagtatgttgattgggcactaagctaatgtgtggttgatctactaccctctggtgatatggcttaataccagattaaagctgaggggattaatgtgttcccaggctgtcttttacaaacatcagttaggaggaaatgatggtcatcagtgcaaaattgaactctggctggcttggagtgtcagccatctgtgttatttgcttgctttggcatcatgtgtaccaagattagcccattagtctgcatcactgattgaagagagaaccacatatgtgaggtgtcagccagcccagttgactccctctccctcaa

SEQ ID NO: 56104 - DNA, 1053 bp, Homo sapiens
gccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcaggtaagcccggcagggcgtgggtagggagctggtgaggaatatgcgatgggaggaagagcgagacctaagagggtacctgtagctgggaatgtcctacgtgttaccggtaagtgggcgcgagctgggctttcaaatagggatttatgagcgggcaggagtttgaggaaaggataagtttgattaagaagttgtcgaaaactttggttgtctttgaggaggacggatggagattgaaggtgggggtagggtggcccggcgcggtggctcacgcctgtaatctcagcactttgggaggccttggcgggcggatcatttgaggtcagaagttcgagacgagcctggccaacatagagaaatctcgtccctactaaaaatacaaaaattatccggacagtagtggcgtgcatctgtaatcccagctacttgggaggctgaggcaggataatcccttgagcctgggaggcagagcttgcggtgagccgagattgggccactgctctccagtctgggcgagagagtgagaccctgtctcaaaaaaaaaaaaaaagaagttg

SEQ ID NO: 56105 - DNA, 1074 bp, Homo sapiens
ggcaggtggaatctaagttgattgtgggctaattggatgaaaatgttgaagagaagccatgggacttaaaagatatcgaaaagttattggacgctttcgatttctggagaggtagggaatcgtgaattttgttgggtgggcgggagttgttgaagccatcttttccctcagatactcccccctaatgtgtcaccccttctcacttcgcacccccacccttagggccgcacaggcacacagacacacatacatactttctcagactaattcctttggtgattcccaactctaaactgcccaactttgggaaggaatggaaattttgaagagagtctaaggaatgtaggaaattaaggtcaaagaccttaaaaacagatgggaaagatggaatggagtcttgaattgcagtagagactgcgagaagtgatgttttggaaattaggcctgagaagaagaaagatgggtgggggggtgactgtaagtgttgtgggggagtattgcataatagaaaaatggactggaagaatgcttacgctgtatcaggagattggaatttggagaatggagccaggttaatgtagagagctcagcgtattaatagttaaaaacgaatgaagattgagggagggctgaggaggctcacaagaaaagcagtagattgtgtgtaggggagaaagtgtgtgtatgtgtgtcgggtgggggggcgggaggtgagtcagaaactgagcgcttccatcagaagtgtctggtgtttcacagtaactgctgcttctacactggaatagacgctgccagatgttggatgctttgcttgagattttggtatttcctcaggcctggtgttgcgtttttgctgtttagaatttgctgaatagggttccttccacctttcacattccagctcagatgctgaaatatctagtcacacatatcttcttaataagctgcagttttatttatttttaataaatctctatttttagtttgttgagaggggattttttacctttcctataaaagtattaggggaccagaacaactcatgctgcattataagcatgaaataggataaag

SEQ ID NO: 56106 - DNA, 1057 bp, Homo sapiens
agcctcccaaagtgctggtattacaggcgtgagccgccacgcccggcctgtggatgtttttttgatctgtgttctgttgtgtacagtgtaagccatttgtaggctgatttctttcctagttcttcctcttagtgaaaagtaaagcagtttagatcatgttgaatgataaactgaaatttagaaatgcaaacatagaatacaatgtcagaatatcaccaggtgccattttggttgatattttataaatagggagatatttttctgtttactctccatagggattttgacactttccacccacccctttttccttttgtcaccttggtatattctgccagaaaactgacatcagaatgtcattgcttctgatcgatttatttctgccatgacactcaagcccattgtcagttataattaactagtctaataggtatccagtttctgatattaattgataatgtgtacttacacgttagcgttgaatatcaaaatagtacgttttgcttattaatgtctgtgggcttttttaggttaatttaaaactcttctgattaatacctttgctcaaatatgtgctacctaatagctattaaatattttattagcctgtttttcttggataataaagtggaaactatagcctgtgaagtgaacaacagagataataccaggccagctagcaaactggggagagggaaggtggtaattttatcctttaaattgttctctcctagaatgttatttattatttttttgagacagagtcttgctctgtcgcccaggctacagaccagtgtagtgcagtggtgcgatcttggctcactgcagcccttgcctcccaggttcaagcgattctcctgcctcagcctcctaggtcactaggatcacaggcgtgcgccaccacgcccagataatttttgtatttttagtagaggcggggtttccccatgttggccaggctggccttgaactcctggcctcaagcgatcctcctgccttggcttcccaaagttctgagattacaggcgtgagctactgcccggcctctctcctagaa

SEQ ID NO: 56107 - DNA, 1050 bp, Homo sapiens
ctttcagtagagacagggtttcaccatgctggccaggctggtctctaacccctgacctcaggtgatctgcccacctcagcctcccaaagtgctgggattataggcgtgagccaccttcccggctatttttgtatttttagtagagacggggtttcgccatgttcgccaggctggtctcgaacttctgacctcaggcgaccctcactgcaaccttcgcctgctgggttcaagcgattctcctgtcttagcctccctagtagctgggattacaggtacacaccaacatgcctagctaatttttgtatttttagtagagatgaggtttcaccatgttggccaggctgatcttgaactcctgacctcaagtgatctgcccgccttggcctcccaaagtgctgggattacaggcgtgagccaccgcgcctggtctgaaatatgttcattttaatccagcagaattcattgctgtttcaagatagaaccagatttggaaataaaattggaaggtggctatctgccaaaaatttcaagtgcctcttggccatgggtagcttattcaggaaacccaagtcttttaaggaaggacttggatttttttcttaatttcaaagaacgtttttgtgccaagggatacatatttgaggtctgagaaccatgaaacttgtttgtaggattagaagcaaaagttgactagagggaaatgtagagttattttaatttaactccctcattttccaaattaggaaactgaggtaaagatgttgcataaaggctgtatgttaccaagattaatctttttttttttttttgagatggagtctcgctctgtccctcaggctggagtgcagtggcgtgatctcggctcactgtgacctctgtcttccaggttcaagtgattctgcttcctcagcctcccaagtagctgggattacaggcgcacgccaccacgcctggctaatttttgtatttttagcagagtcagggtttcaccatgctggccaggctggtcttgaactcctgacctcgtgatctgcctgcatcggcctccca

SEQ ID NO: 56108 - DNA, 1660 bp, Homo sapiens
tgtatttttagtagagacgggttttcaccatgttggccaggaggctggtcttgtgaactcttgacctcaggtgatcacgcctcccaaagtgctgggattacaagtttgagcctctgcgcccggcattcttttttaaaagataaaaaagtctggctgcagaggaaccttatacctgaaatgttttgctgtctgaattcactccagagtgaaatgacttgaagtacaagttttgtgactgctccgagaatttttgtgtcagaggcttctccttctgccattttttgaacatttacctagaattacaaaaaaatcattccacatttcacagtatggtgctaggaatctgaccaggtccagttcataattttaaactttagagttttaaaaacatgtatgcttatcatgctgtaagcaaatgggaccccaggagtaaggggtaactttctgtttttcctcattaggtttcaactttctgtgctgtggggtcagtggtaagagaggtagatctgatgtgtatctgtgctaaagaagcatgagctccttacagtaactagcagccaattcctcttccccataacagttgcagacttctaatcccagcaccttgggaggccgaggcgggcggatcacgaggtcaggagatcgagaccatcctggctaacacagtgaaaccccgtctctactaaaaatacaaaaaaattagctgggcatggtggcgggtgcctgtagtcccagctactcgggaggctgagacaggagaatggcgtgaacccgggaggcagagcttgcagtgagccgagatcgtgccactgcactccagcctgggcaacagagcaagactccgtctcaaaaaaaaaaaaaaaaaacagttgcagacttcttggagtggtagttcatggtcttcttctaagaaggctgtggatgccttaaaagcattatttgacgctggctcccatatctcactgccctctccaaaaaatgtgttaccctaacatagaagtatcttttctcagaattcttcagtatattatgaatcagtgactaccttttctctcccttgaaattttcctgtaacttaatgttcatttccttttgtttcagtaaaccagtctcaactcttttccttttctctttctgttgtacctctcatttccccgacccttcctgtcctgtagatggcatttcataattcacattgataataattgctagaatttataggcatttattgtagattaagtagagcatttattatagattaagcctatacgtaacttgttgaattctcataacaaccttaggaagtacatgttgttacttccacattttatagataaggtagccagtctgctctagagaaattttaaccaacctacccaaggttacctacttagtaaatgttttttttttttttttttttttttttttttgagacggagtctcgctctgtcgcccaggctagagtgcagtgctgtgatctcagcttactgcaacctctgcctcctgggttcaagcaattctcgtgccttagcctccagagtagctgtgactacaggtgcgtgccactacacccagctaatttttgtatttttagtagagacagggtttttccacgttggccaggctggtcttgaactcttggcctcaagtgacccaccca

SEQ ID NO: 56109 - DNA, 1058 bp, Homo sapiens
caacctgggcaacagagcgagactctgtctcaaaaaaaaaaaaaaagcgacagagcgagactccatctaaaaaataaaaattaaaaaaaaagggacaggtgcggtggctcttgcttgtaatcctagcactttgggaggcttgaggtggatggatcatttgaggtcaggagttcaagaccagcccagccatcatggtgaaatcccgcctccactaaaaacacaaaaattagctgaatgtggtaggaggcgcctgtaatccctgctactcaggaggctgagcaggagaatcacttgcagtgagctgaggtcatgccactgcactccagcctgggcgatagagtgagactccatctcaaaaaaaaagaaaaagttatatttcccagagaaaatatggatatttgaataagaaaggggtctagaataaaaatggaatatgcacgaggcctatgtgagtatggagaaggagagagggacatacacagttgctatccaaaaggatctggtattactgagcaagaggcaggagtttatacttatgtttagtttgactcaaactctgatggtttcagtatgcttgacagagatgtgagtgtgtgatacactcttatgattgtttttttttcccccctagcagcatctggaatcaagagacccatggcatctgaggtgagtttcatactgatacaatggttactaaaaccttaattctgggatagaaggaacctgtttatgacatttttattttttctctacttaggtcttggaagctagacaggattcttacatctcattggtaggctagaaattatgcaactcatcttttattgtagtttattttaaatattaacaatatctcacatttattgagcatttttaatgtaccaaatgcaatatataccaaaaagtaaatactgtacctaagtgccctttaagatattcttatttaatccttcaaacaactacagtgaggcaaatactgttatctgttttacagatgaagaaagtgaggattgcatagttactaagtgggattagtaaagctgggattcaaattcaaa

SEQ ID NO: 56110 - DNA, 1047 bp, Homo sapiens
tgtggaaggcatccttcttcatcatgcctagtaagtgtaattactgaagtgtcacaaatatcttagattgtttcatttttttaaggtatcctgtaatatgactctcaagaagagtgtcttagtgggcataaattaagatagcaaaagtactgaagaagttgagttaattaggagagcattcccaaaattgctgagtagtggcaattttagattctctttggtggaatcagagtggaagaggtaggcaagaagatttggagaaaactagattataatacatactgtagagagttcctggggttagaggaaggatctcattttctcctgtttttttaatgtatttttttctctttttgttttcttgatcacttattatctgaccttctggtttatggaggatgaggcagttatgtgtaggtttcacttccccatcctgatctgactaaactagccaacagattttctcaccctttcctttttgccttttccagtatgggtggcatccctgcccggaatagtaaaggggaaaggcttctgctttatattggcatcattgacattctacagtcttacaggtgaggagcatatggatcccaaattaagagagggtggatacagataaccagtcacgtttctcttttagataggtttgttaccaagttcttccggaagcaagaacagtgagttgcagtctggctacttacttcattagttttcagatggtttatttccttgattttgcctctttccccggcctttataacccttcctcccccatctccccagacataatgtataccttctgtggaaagctgagtcagtccttggaagcaccagggtagaatatgccatctgtctggctctttgcaaaaacctatgagatgagtcatgttccacatggggatacaactggaaacgttacccttttccaaggaggaaaaacaggagggtcactgtgttctgtaaaatgtattagactgtggaactaagaggcaatggagtgatcatcagggaggagctggaattgttagaccccagttttgttcc

SEQ ID NO: 56111 - DNA, 1028 bp, Homo sapiens
gttgaacaggctggtgtcgaactcctgacctcaggtgatccgcccacctcagcttcccaaaatgctaggattacaggtgtgagccactacgtctggccccttccgtttatttcatctgtaggttttacccttctgctaggggctcagtctgggggaagatggcccttggactagagttcctcttgccgggcctcctaactctatagcatttcttctgctctgcaggacactgtctcagtgcatcgcccaggcttctacgctgaacggttccagcgcttcatgtgcaacacagtatttaagaagattccctgtaagtggtttctaccaattgactgcctactcctgcccagtggctcccttaccccaagagaacagagggcaggacacctctggtagggagctgccaatgccagaggcctctccttccacctacatcccatgagagccatttcttgtcctttgtgttagtctgtcatagtcatttccaagttgctgtttcccccttggctcttcctgcatatgtcaatgaggtgaggaccatttctggggaattgggatttgcaaaaaaataaataaataaataatgtgtagttgtggatgtaggatccatgccacagagataggcagagcctatgtacagagatacgcagtgaggttaatggtgttctgttttgtcttctagactatctcaggtggttacagaagcatttactgatttctgcttagcacatgtttttagtctcttttctcaactttcttgtttaggaagtgccaatatttttttgcaaatcttccatgctgctgccatagcaaattctagcttctctttcccttcttctcatattaggcatcattattcccatagcgagggagaggggacctaggcatgccagtcttaagggatatggaaaaaccaggctgggtgcagtatctcacacctataatcccagcactttgggagaccaaggcaggaggatcggttaagcccgatagtttggaaccagcctgggcaacatcatgagaccttg

SEQ ID NO: 56112 - DNA, 1427 bp, Homo sapiens
cggaccacctgaggtcaagagttcgagaccagcctgaccaacatggtgaaaccccgtctctactaaaaatataaaattagctgggtgtagtggcgcatgcctgtaatcctagctacccaggaggctgaggcatgggaatcacttgaactctggaggtggaggttgcagtgagccaagatcgcgccattgcacttcagcctgggcaacaagagcgaaactccatctcaaaaaaaaaaaaaaaaaggaattatgcaatagggtacatttcatctgatggaagtaaagcagtcatcaaggctccatgttggggggttaggtgtggatatgtttcctttcttctaggttttcatgcctcttggaaagtgaagtgagctaacaccttgttctctgaatagtaattcataggcctgtctttgttgacattagccttttcacttttcagaccaactttgggtgtgtgttggggatactagcaattatttgtatctatgtcttggtaatagttgctaaggtagttgctaagtaggctctctctttcccttttgaagtgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggtcagcgctagggctggggtccccatgtgattgggtactccctcccttccttctgagcctttatcttgtctggccaggacctctgctcccatttctatccaggaagcctagctgctacatatttttccttgtatttactgtaccccatcttctctatcttttttccaggcgttcaccttggtcgtcctgatgttttacctcagactccacctttggaggaaatcagtgagggctcgcctattcctgaccccagtttctcacctctagttggagagactttgcaaatgctaactacaaggttggtttattggcccctttctccatataatcttatctctcttttcaagtccttggaaacctctataatttgattgcatcataataaattaccccaaagattagtggcttaaaataacaaacatatatcatactttctgtgggtcaggaatccaggcccagcttagctgggtcctctggctcaagatttctcatgaggtggcatttaagctgttggccagggctggggtctcatctgaaggctcaaacaggaagatctgcttttaagcttatttatgtggttactggtaggattctgttccttgtgggttgctgaactgagggccttagttccttgctggctgttgtctgggggcttccctcagttctttgctacatggacttctccataggacagctcagaacatggcacctgggctatctgacaagtgaaca

SEQ ID NO: 56113 - DNA, 1082 bp, Homo sapiens
tagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttagacctcttattttttctgattctttttcatataccatctg

SEQ ID NO: 56114 - DNA, 1017 bp, Homo sapiens
attttttgtatttttagtagagacagggtttcaccatgctggccaggctggtctcgaactcctgacctcgtgatccgcccgccttggcctcccaaagtgctgggctaacaggcgtgagccaccgcgctcggccgatcccgacacttttttaaaatgccgaagccggaatcgacacagcactttcaaaggttcctccatagctcccctgagatccggccagcgggaaaccccaactgagaactgcaatggcagggaaagtggaggctagatcctgttttttgtgttaccgcgattcccttcaactaccctcaagacgcctacaaatttgtttggcggcacctacaactcccagaacgcaacgtgggggacggaggcggaagcagctggccaagccgaggtctgtgattggtgaagagcgacgggccaattggaggagttgttgttaggccgtcccggagacccggtcgggagggaggaaggtggcaagatggtgttggaaagcactatggtgtggtgaggagctacttcggggcaggaggggcagagctgggttccgggcgcgtgtagcgccaaggcagggagggcctggggtgggggccaggggctcatgggcgagaggcggccctggccccggaggtaaggagcccgctggactccctgagtcatcccggggccctggagtggcggatagtcccgggttaccactgttacccccagggggacggtcattgactggtcattcctgcttcctttctctgttctagcgccgtcttctctagagcagcccgggtctgtctttagctacagttctgcttttcggactcatcgtaatagttttctgccctcctttctttgcaaaataacgtctattaggaaaatagattattaatcccttcctctccccattccctcgtctctaacttcattacctttccctgtatcatcttcaaaggtaccatttacagattgctttttatgtatcagtcattttgtttatctcacttatacctcacaacc

SEQ ID NO: 56115 - DNA, 1022 bp, Homo sapiens
aattttttcggctgggcaccaggtggctcacacctgttatcccagcacttggggaggtggaggcaggaggatctcttgagctcagaagttcaagaccagcttgggcaacatagctagatccctgtctctacaaaaaaaatttaaaaggtagctgcgtggtggcttgcacctatagtcccagctacttgggaggctgaggtgagaggatcacttgagcccaggaggtggaagctgcagtgagccattagtgcaccactctactccagcctgagtgacagagcaagaccctatctcaaaaaaaaaaaaaaaaaaattcctcattggttattctgagtcaataaatgtgggctaaggcttgatcatctgtatatttaaaaaagaaaaaaagctacaggtgatgctatgaagactgctgctatagggggcctctggaactggagagaaggttttggaaaacttctacatttcttctctcttgtccttcaaccctaatctgacagtgtggacaacagtgagtatatgcggaatggagacttcttacccaccaggctgcaggcccagcaggatgctgtcaacatagtttgtcattcaaagacccgcagcaaccctgagaacaacgtgggccttatcacactggctaagtatgggggacagaggaggaggggactcagtaggtgggtggttgttacatgctactcttctttagattccatgaagctgcttttgcccatcaccttcctagactgccttctgcactatttagtgtaaatgtcaatagcaacttgttttttgtattaacctgtatttaatgtagtacggaagctaaatctcctggggtgaaatttctgtttctttttattgtttgttgggcagggctagggtagggggtgaaatttcataatatattttaaagtcagtgaaaagtgattttgggctgggcacagtggctcatgtctgtaatcccaagagtttgagaccagcctgggcaacaggacaaaaccctgtctctactaaaaatacaa

SEQ ID NO: 56116 - DNA, 3459 bp, Homo sapiens
tggccaacgtggtgaaaccccatctctactgaaaatataaaaattagccagtactaggaaggctgaggcaggataatcgctggaacccgggaggtggaggttgcagtgaactgagatcacgccactgcactccagactgggcgacagagcgagactccatctcaaaaaaaaaaaaagagagaaagagaattaacctcccttctttatgcacagagagtcatagcaaaaagggaggaggtgggggtgttaaatcttgtgtgaacgtgatggtagatggtgtacttcaggtacaaagaaactgtaagaaaaagggaaccgagtgacagaggaaagagctgagtgattcctctggttaactctgagaacttcctctccctttacaagctggctctgaagcaccgacaaggcaagaatcacaagatgcgcatcattgcctttgtgggaagcccagtggaggacaatgagaaggatgtgagtccaagtggcagctggggaatgtggggagcccatgtttgggactgaggtcttccagccctcaggagaacctggcagaggcatcaggctcatcactttggggaaaggtgaatgtggagaattcagtgattctgttggaggaccttggggaggtcaatagatttctgtatgcttttatgcggcgggtcctttccccccctcgagtatggaacagatttcttgatttttctccccttcttcccagctggtgaaactggctaaacgcctcaagaaggagaaagtaaatgttgacattatcaattttggggaagaggtgagtagggactgattggagggcattgacttaatttggtcataaacagaatggtccttaaccctgaggagtgcgggtactgtggcagagtagtgcagaaatgggaaagaacagggagcaaggcctgaagaagggcatcatgtgttctttcctccccaggaggtgaacacagaaaagctgacagcctttgtaaacacgttgaatggcaaagatggaaccggttctcatctggtgacagtgcctcctgggcccagtttggctgatgctctcatcagttctccgattttggctggtgaaggtggtgccatgctgggtcttggtgccagtgactttgaatttggagtagatcccagtgctgatcctgagctggccttggtgagcaaatgttgaccccaggtagagtccaaaggtccctctttgttctcttctggcacacacatcacagagcttctatcaggctggatagtcctagacactaccaatcactcattttccaagacctccttttgccgcctcttccctataatgctgtctgatctctaggggcaccagtgtcagatgctttcttgttcacttctgatgaaaaccgaggcttctcccaagtccttactttttaatcccgtaccactgcttatccctccagcttcttctctgtgtgataaaccagaagctgcccctttatgttcctttcccacaccccaactgactttcccagctccctgtaggagtgagggcaggggagccctgattatgccctgcccttcaccaggcccttcgtgtatctatggaagagcagcggcagcggcaggaggaggaggcccggcgggcagctgcagcttctgctgctgaggccgggattgctacgactgggactgaaggtgaaagaggtggaatccgaagtcctgggactgcgggatgctaaacattgaaagctgggtgtaggcactgcagggagagtgtggaggtctgacagggtaggaatatgtgggagggctgggctaggaatggccttggaggctggcctgtgtggatatggcaccaattctaccctgctcctcttttccttttcccagactcagacgatgccctgctgaagatgaccatcagccagcaagagtttggccgcactgggcttcctgacctaagcagtatgactgaggaagagcagattgcttatgccatgcagatgtccctgcagggagcaggtgagccagagcctgggtggtgcctaggcagaggttggggtgaggaagtgtaactgaacagactgacctctcttcctcagagtttggccaggcggaatcagcagacattgatgccagctcagctatggacacatctgagccagccaaggtgagacccaaccctgcccccatcaggtttaaagtccttgaatttagatcctcatccctctggggctgggagtatttctaccatagctaagtcctttgaggagcagagggaaacacatggatttgcatttcttacatgtaaaccttgctaaggtagcaatgctaatggtcagagttggagaaatgtcctcttgttctgtaattttcctttcttgctggtgggagcagcctgggcagttctctaggatgtcttcccaggagggaaaaaagcgggtctgggaaaaagaaaaaggagaactgggtgtcttgagagcaggaaacctcaatgtgatggcatctgtttttctcctcagagctcaattaacagagttctcagcaggcccctctatttggttagtaataactgcattcatgctgtataaaggattttgctgacttgtcctttccttacgtcgaccagaggtgcccagatccccacacagtcagaaggcagggggcctctggcagcggcatgctcctgtccttaacacctgcttacttcctgccgctccataccctcccttgagctcacactgcctgtttgcaggaggaggatgattacgacgtgatgcaggaccccgagttccttcagagtgtcctagagaacctcccaggtgtggatcccaacaatgaagccattcgaaatgctatgggctccctggcctcccaggccaccaaggacggcaagaaggacaagaaggaggaagacaagaagtgagactggagggaaagggtagctgagtctgcttaggggactgcatgggaagcacggaatatagggttagatgtgtgttatctgtaaccattacagcctaaataaagcttggcaactttttttccttttttgcttcaaatattgatggttttgagtgtgagagaggggaggagtccctggcctgaaggagaaccttccttgttgagttctctatgtctctgtttccacctgtctgggcctcctaacgtgctgggattacaggcccaggagccaggtttccatttctaatgaacgaagaccttatttaaaccaccttcttgccaataacttttactctgcactcacacagctgaaccccaagcatggaatgatactcaaccttttcagttttttcatgtggacttctgaggttcagcaagtttaggttatttggccaaggatatttagctaatgaagaggcagaaccaggatcaaaatccaaacttgtctcagacctgtctcgccaggagttgaatcaccaccaaacagtagtttcccattggtcagctgccttcagtgactctgct

SEQ ID NO: 56117 - DNA, 2562 bp, Homo sapiens
tccacaattccttcaggcatggactggaactttcctcctctaggccgggccctgccctagtgcccacccccgcccccgcccccgcccaaccccaactcactggcactcaagccccctacccctgcagtgcctttcacttctttttttccccagaaatccggggcgggggggtggggggttggtagggatgagtcctgtcaagggggccacaggagaggaggggacaggctctcaggaatcctttattcttgtagtaataataatactaacaaacagttggggaactagggagaaaaccagaccattaaaactgtttgtggtcgaatctccattcaggcctctctttttctgtgacttggacaatgtggagttgaagcgggtgagagaacatggaaggcccgcccttctcagggaagaggtggtagtgaccaagacaggcagggaaaaagcaaacttctatgtagtgccttttgtatcttggacactgaggcatccgttcatacctcatcacccatctccccctgcactcccccagaaaacctggaaatgacacaagtggctaactaaggactttatttcaaacaaaaattaaaaataaaaaattgagagctcttttccctgggtttggggaaggagtcagggtagggaattccacatggctaggccagtaccctcagtacactggagggctgtgggaattcccttccttgcccatgatggggaacctcagcaagtgcagggcccacgcagcgcccgccagcaaggggagcttgggccaggggtcggtccctgggaggggtaggtccctgggaggggtagagctgggcagcagcatggccagtggccaaccacaggatcaagtcctaagtaccgagaacctactcttccccacttcctgggccccagaacggaataagaggatggcctgtggaaagaacctctgagagacccctacaaggagaagaaaggccccagtgtccctcacatttgtcacctctgttttctggagggcagtgagtcctggagtcagtctggtggtaatactgacacagaccaggaggggcagggaagccccaacaagtctggaccccacagctggctctcccacccctcagcaagctctcgcagttaccacatgatccttcgtgtttcttgccttccatttcccttgggtggatggttgggtaggtggggtttcctggtttggggtttctcagacaagggccctctagggagggtgccctggaccccccaccactcctgggctgaggagcgtgtcacatgatgccgttggtgaggtactggaagccgtcatagagtttggtggtgatagaccgcatactgccatccaccatctgctccaccagcagctgcagctgctcctcagtcatgctcatgtggaacctctctttgaggtttcgaatggtgctggagccatggaagcaaggaagctgagaacctgggggaagcagtcggagttcagggtcatggatggacgggaggggcagtggtgtcagccatagcaaatacagagctggggcatctgaagtgcccttttcctcccacctcaggtccttgatgatgtgggtgcagttctgcttgggcagagagaaggaaccggcaggaacccctcatcaccccacgcctaagcccttctgtaggtgagggcatgtgggcagaggaaggaaggggaccaacaccacatctccctcagtaagggtggaggggcccagagggcaggctgggaggaggctggagggagtgggccctgagctgggcacttatctggttgcagacctctgcctatgctacgtctgacactcacagatgacctgggccaccgtcatcatggggccagatggggatgatcctgagcaacggcgacaacctgtggggtaggggcaggaatggggaggagggggagactggcagttcagacctggtatacacctggagccttgaggagggggatgaggacagaagggggtcctgggcaaaagactgtagatggcaagactgtagtggaaggagataatgatgagaggggaaatacttctcagagctgaagggtggcagaggacagggcaatcagaggtcatagtggaatggagaagacagatggaaggagactgagaaactcagagctggacaggggtggggaggtgagaagggaccaggaggctgtaaatgggcctgttttctccctaaagatgccaaggaggcaggtgctgctatccccttccccagccttctggacttagccttaccagggtcaggaggaatgtcctaaaggagaaacaaggcactggaccagagctagaaactctctgggaacccccctccctcaaccgagtctcgtgggatcagctttcttatgctccagggctccgacttaaaggggaagcctgaggcactatagcacctgacctcaccccagccccaccttgctgcatgatctccacgatctgcaccaccttgtccatgtgtttccgagcggcaatcagcccttgcagcatcagcatcttatagtagttgaacatgtcgccatccaggccgcccatc

SEQ ID NO: 56118 - DNA, 1435 bp, Homo sapiens
ccacaggttgtcgccgttgctcaggatcatccccatctggccccatgatgacggtggcccaggtcatctgtgagtgtcagacgtagcataggcagaggtctgcaaccagataagtgcccagctcagggcccactccctccagcctcctcccagcctgccctctgggcccctccacccttactgagggagatgtggtgttggtccccttccttcctctgcccacatgccctcacctacagaagggcttaggcgtggggtgatgaggggttcctgccggttccttctctctgcccaagcagaactgcacccacatcatcaaggacctgaggtgggaggaaaagggcacttcagatgccccagctctgtatttgctatggctgacaccactgcccctcccgtccatccatgaccctgaactccgactgcttcccccaggttctcagcttccttgcttccatggctccagcaccattcgaaacctcaaagagaggttccacatgagcatgactgaggagcagctgcagctgctggtggagcagatggtggatggcagtatgcggtctatcaccaccaaactctatgacggcttccagtacctcaccaacggcatcatgtgacacgctcctcagcccaggagtggtggggggtccagggcaccctccctagagggcccttgtctgagaaaccccaaaccaggaaaccccacctacccaaccatccacccaagggaaatggaaggcaagaaacacgaaggatcatgtggtaactgcgagagcttgctgaggggtgggagagccagctgtggggtccagacttgttggggcttccctgcccctcctggtctgtgtcagtattaccaccagactgactccaggactcactgccctccagaaaacagaggtgacaaatgtgagggacactggggcctttcttctccttgtaggggtctctcagaggttctttccacaggccatcctcttattccgttctggggcccaggaagtggggaagagtaggttctcggtacttaggacttgatcctgtggttggccactggccatgctgctgcccagctctacccctcccagggacctacccctcccagggaccgacccctggcccaagctccccttgctggcgggcgctgcgtgggccctgcacttgctgaggttccccatcatgggcaaggaagggaattcccacagccctccagtgtactgagggtactggcctagccatgtggaattccctaccctgactccttccccaaacccagggaaaagagctctcaattttttatttttaatttttgtttgaaataaagtccttagttagccacttgtgtcatttccaggttttctgggggagtgcagggggagatgggtgatgaggtatgaacggatgcctcagtgtccaagatacaaaaggcactaca

SEQ ID NO: 56119 - DNA, 1052 bp, Homo sapiens
cagacacaatgggaatatccttttggacgcagaaggccacatcatccacatcgactttggcttcatcctctccagctcaccccgaaatctgggctttgagacgtcagcctttaagctgaccacagagtttgtggatgtgagtcaagaaggagaggtgcctctcgggggtcattgtattctttctctgtcatgggagagggagctgatgggctccctgcaaattagggatgaacagaacaggcagtaattaggggtgaggcaggagttcctgggagcttcctgcccaataaggaagggggaaataacagggccccaagaggaggaggagttctggtaggccagtcaggacagggaccatccccggtgtaagaccccttgtgcacacaacgctctcttccctttccaggtgatgggcggcctggatggcgacatgttcaactactataagatgctgatgctgcaagggctgattgccgctcggaaacacatggacaaggtggtgcagatcgtggagatcatgcagcaaggtggggctggggtgaggtcaggtgctatagtgcctcaggcttcccctttaagtcggagccctggagcataagaaagctgatcccacgagactcggttgagggaggggggttcccagagagtttctagctctggtccagtgccttgtttctcctttaggacattcctcctgaccctggtaaggctaagtccagaaggctggggaaggggatagcagcacctgcctccttggcatctttagggagaaaacaggcccatttacagcctcctggtcccttctcacctccccacccctgtccagctctgagtttctcagtctccttccatctgtcttctccattccactatgacctctgattgccctgtcctctgccacccttcagctctgagaagtatttcccctctcatcattatctccttccactacagtcttgccatctacagtcttttgcccaggacccccttctgtcctcatccccctcctcaaggctccaggtgtataccaggtctgaactgccagtctcccc

SEQ ID NO: 56120 - DNA, 1779 bp, Homo sapiens
caaagtactgggattataggcatgagccaccacacccagccattattagctagatcttaatgggccaccatgttactggaagccccagcagcactggccattgcatttccacctttccaggacagctgccctgtgccgagggtctagagctggaactcataggagcattcagggcagagaccctgggtcactgttgggagatactcttagaaggcagggcctagatggtgtaattatttttgtacattatgtgcctcacctatatgtgtagttagttttcatcaaggtcatgtcatattgaaaaaaaatgacagctctgggcaaaacaacagatacttaaaagctgtggaaatcatatgctggaataagaagtgaggagagttcatggctgagagtttccacttcatctccatcatgtttctcctttctgctctcagtcactaaccactacccttagtgccaggccctattatctcttgctttgttgctaaacacccaattacatccaccttcacccacagtgccacagggcatttaatcaacacagactggatcatgtcattcctctgcctgcaaaataaaacacctaagcttcacaatgaaggcccttcttcaactggcctcaatttacctgcctcatggtaccacctcctactccactgccatgcagtgcagtctgtgctttaatcacattcaattatttcttctagctgggatgtacctcccctgcagcttcctctgtcatcattttcccttgtccttgaagaccctgctcactcaaacccttagtcctcccataaatccttcatttctttgcccttttaccctagttcttattagtctgcctcctgacttaatgtcatgggaacacatctgtctctgcttaaaatacattgtttcatttttcacatctttgccatggagggcagtaataagtaattgagaactacacacgaagggacagagagaaccctggagaaatgttaggatgagcagcagaagtcacctacctgtccttgacttgcagcaggtagcagaccaagcagtacccagcacaactttgcacaaaattgcgctgtgcactgaggaatgcctcagtggtgtaactgccgtgctcctgtaggaagtaatcgagcaaggagagctgtgactgtttcttcacctgatggatggacacagcattgaccactggttcaatcatgccactatcagccgaaatcacaagaatcttgtatggcttgatccaaaggggcactcgctcctgttcccaaatggactgtgaggagacatggaggatacaggactcttatctttctccaaactagagaagaaggctaaaactcttccctttctccagcctctctccttggtagcattgaattctaagccatcaaatgagtaagactcacttaacccagtgaggaccagggagtttggaaaggaagtctagggcctgacaaagtcagaaactacactcaggtatgtgggaaaaggtatcacctaagtagaaagcccaagacaggcagggagaacaggaaacttcactatcccctctcaagcagggagaatgggagctgtaagttcaaataataagaaaaaagaggccaggtgcggtggcttatgcttgtaatcccagcactctgggagaccaaggagggcggatcacctgaggtcaggagttcaagaccagcctggccaacctcagtagagagtgaaacctcgtctttactaaaaatacagaaattagccaggcgtggtggtgtatgcctgtaatcccag

SEQ ID NO: 56121 - DNA, 1053 bp, Homo sapiens
gtagatcataaggtcaggagatcgagaccatcctggctaacacgatgaaaccccatctctaccaaaaaaatacaaaaaaaaaattagctgggcgtggtggtgggcgcctgtagtcccagctactcgggaggctgaggcaggagaatggcgtggacccaggaggcggagcttgcagtgagccgagatctcgccactgcactccagcctgggagacacagcgagattcttatctcaaaaaaaaaaaaaaaaagaaaagaaaagaaaaatgcaaattctagagacacacccattctgaatcagccttggtagaggaatatggagggcctggtaatcttaattttaacatgattacaatcagttagcaaaaaggtgtcattggttatgttttcttccatgagtccctttcagcctgggttcctatctttgtgtgtccagaatccaggagacagtgcaggaaatgtcagtatagactgggcatggggcttgggggtagcttctccaagcaaatgatgtattttcttcctgccagccggcgcctttcggaacagctggctcataccccgacagccttcaaacgagacccagaagatccttctgcagttgctctcaaagagccctggcaggagaaagtacggtgagttgggtgtgggtctctgaacccctctcaaagctcagaggcagttgtaagtgctcactgcaccaactttattgtccatcagcctccaaaaaaatctgtcaggcttccaggctgtctgggtccttgccctatggggcgtttgcttgggattttttgtggaagccatgtctcttgtcctcaccctggcatcaacctttgacaccctttacttctgtcttcacaggcggatcagagagggctccccctacggccatctccccaattggcggctcctgtcagtcattgtcaagtgtggggatgaccttcggcaagagcttctggcctttcaggtgttgaagcaactgcaggtaagagaagagaaggagaggccaggcacagtggctgtaatcccagcactctgggaggccgaggcgggt

SEQ ID NO: 56122 - DNA, 1232 bp, Homo sapiens
atcttccctctttgaaagtggaaatgatgtggggctcccttctctagccttgcgggacttgacggagcccctcggcagagatctagcccaaggatccagatggggagaaggacaaccctgttcttgaaaagggtgaaacaattcaggtgtaagcagctcttctctctgtggccctggctaacctatccagatgtccccctgctcactctgaagccttggtacagtccttaaggaacccaagtccaggagaagaggagtgcatcccagttacctggactcatggcctcccttaccctcaagggatagcctatagggaaggaatgtgctggctattctcaattcaagttgtgaagggtgggtggaagctcctactaagactaaaaagcagctgctttcctggagttctccagatagtggggtccccggcctgcatggccaggagtgactgagtgggtgtgccattgtattctatggtttcttcaccatcttttgtcttaccccaaacccctgtagcctgttcgactggctcctgagagagaattcatcaagtccctgatggcgatcggcaagcggctggccacgctccccaccaaagagcagaaaacacagaggctgatctcagagctctccctgctcaaccataagctccctgcccgagtctggctgcccactgctggctttgaccaccacgtggtccgtgtaccccacacacaggctgttgtcctcaactccaaggacaaggtagatgggttctggcccaaacccctaccctggacgtgactcttcacccatggttgttcagagtttgcgtgtatgaccagtgaggccctcaccaacatcctagactcccttcatagttcatgatgcatatgtcaaccatgactctgtctcagtgcgattgtgattttgagagcccccctgtatccctttttgggctttgtttttctggaccaaagaaacctaatctttttagcttccttcttgctgtatcttaggagaattgctcttcaccccaccttatggtcattttggtagcttttctccagcctttctataactcttgggctttccagatacagcaaccataaggatagagaaatattttgtttctaagaccttttctgatcagaatgagccgacaaaaggagagaaggatgcccaattcacactggagagaattagctgaatttgtgtgctgactggaatgagtattcatggttcagattcttctt

SEQ ID NO: 56123 - DNA, 1044 bp, Homo sapiens
aaccctttccccatggcttctgccgtcagattatcaaatatttattcataatcttctaaatgctaggccctgtgctggtgagctgactccaaaaacaaataggacttggcctgaaggaaagttttgcctctccacaactggttttcttttttaacttcaaccacattttttccaggtctgagttcttcccttttcccagctcactgcccaggatgttccttaatcccctctcctttcttgttccctctggactaacccctgaccctttggtcccacagggtcttggaccttgttgctgggcaaagacgtgagaggaaatgcaggacctctgggagtttggctgattttttttatattttctatttgatttgtctatcaaatcagttttctctgttctgtgctaatcccctttcagtcatgattcctatctcctctcatgtggcagagcctctctcttgaggcctggggtcacatttctaacatgctcacgtaacttaggggcccctaacccaaatgctgatttgagaatgggaaggaattctgccttttctaatctgagatgattatgaattgggtggggtagagggtccttgggacagagatcagttgccatctgagtggattcagatgaaggaagaagtgagtcttcaaatttcctcttattttctttctctattagacccccaggatatttccagggaccttagaaacccaattccattgttttccttttctttatctcttttcaacaatgtcacttaaagcattcctgaaggattcagacaccctctttcagtccctatgtggcactctgaaccatctcccaagaggcagaggctggaatgagcttttcctttgaatcctggcactgttgcacatgtagaggtaggcctgatactccccagttttcaaaagaagctcttttagagttcgagggagcaaggatagaaattctctcaatccagaaactaagcaagacacacggaaagggagagaaaggcttggtgagtcaaatgctgtttctacaaaggaggggagatggga

SEQ ID NO: 56124 - DNA, 1011 bp, Homo sapiens
agatactctaggagaatctctaggtagaccctaacactctgctcccagtctcttgcttttcttttaggttctgagtttaatactatgctcctaccaccagtagaggggctcccaaggatgaggtcgggcctcaaagaagaggctcaggggcagcatgtacagttctcttcctgcccatggtctccctgcagagttgttctctgctcagctctcacagtgttctctttcttactatgaggaatcctttacactctctcccacagtcagaaggctttgtgctgatttttcacattttccaccactgctcctcaaagcctgccgcttcaaagccattttatcagcctagtcggggaactctgcccaggcagtttgtcctcccatttgtaaccaaatggcaaatattttggtatagaatgggggagctaaaaggagagagtgatttaggtatcacaccctccccgatatgatgacactgttagtagattagctttgtcttttcaggactgcaacctttgtacagagaaatctgccgcatgtcacactggaagccccagtaggccttctagcttgatatggtgtgatgtcagcttcttgcttcatctttactccccggagctgactcagtgtgagtgactcaagcccagggagtaggagaggagcaggtcatgatatacctcccttcccccagggctgtcaatgagtcagacaggacctgtctgtgacagaatcagctggagcgttgctcagggagccaatatcttgcctgctgttccttctccaaccagctcataggtagaaatagaaccactaattcataatagactctgacatcctcactgccttaattctcccaccaccttctacccaaaatggaagagttgttgccttaggggcatgtttccaaatgtggcttctccctcaaagtgctccagtccccagattcttcaaggaaggacctgactataggacctccagctagaatagaactgaaaccatggaattgagttcaag

SEQ ID NO: 56125 - DNA, 1049 bp, Homo sapiens
ggtcttggcatctgcctctgtggggcatataacccacccacgtttttgatacaatgggacttctttcaaatagagggaagtcagagtgactagagaaaaggaagagggagggagactatagagcctgctctctggaaatttggaattttgttaggatagtttaataatggtaaagctaaaagtgctaacatttattcagcacttatgtgccaggcatcttgccaagtactttacatttaatcctcacaaccatgctgagagacaggtattattttgccagcaaggaaactgaggcttagaaagattagatgttttgcccaaggtccctcaactagtgaatgtcagaccaggactcaaatctccagctggtgctcataatcattcagctgaactaccttggttatttctcaatatctacttcccaaggtccccagctgtcagaagccatgtggggaagaacggcccaggctatggccatctgagcttccacatccatgcacaggcaaagccaaaactgttgtcagaactagaatgaaccgttttcatatctggttgagcttggcagcagagccctgggtcatgaagagaagttgctgcagaacaagaagagtcatccagattctagtggaacatgaagggttggatagctgtctcatcttggagtcaaacctgtagcagagggtgagcagctggaagtgaattccttggtgcctcttgtcaggcttggcttttctctttatccattttgtagtgctcatcttaggaccagaaaagctgaggcctcagggcttttcttactctgctgatccttggtccctctttccttacatctaactcccactccaggataagattatggatggcactgagaggcaggtattaggtgaatacttacatcatttagggtgggttctgtagctgccgttcttccaacctgactccttatcttgggtcactagatccaggagaggaaggagatactatgttcccaggcactcctgcgttatctgatactgacagaatgaaatacctgaattcattatggctcc

SEQ ID NO: 56126 - DNA, 1032 bp, Homo sapiens
tcatttcactgataaaagcatggaatgttagaatggaaaggccttagaattcatgtattttgcctgccttagtttacaaaggaagaactcagacccagagagataaagtgagttgcctcaggtcatataggtcatggcaaggctgacgctcctgactgtgtcccaaatcatttttattaaactgcactggccaggcgcggtggctcacgcttgtaatcccagcactttgggaggctgaggcaggcagatcacgaggtcaggagtttgagaccagcctggccaacatggcaaaatcccatctctactaaaaatacaaaaattagccaggcgtggtggtgggcgcgtgtaatcccagctacttgggaggctgagacaggagaatcacttgaacctgggaggcagaggttgcagtgaccagagatcgcgccactgcactccagcttgggcgacagagtgagactccgtctctaaataaataaataaataaataaactgccattccattaacatctactatgttaatgagaactgtggcagaagccctccacaccctgacctgagacttgagatagctaccagagcctctcagagcagcatctgtgggaaaggaaaaggtactattgtctttctgtgtgctggggtaggggagatgttagaacatcggcttcattctcctggccactcctcctcataatctaatcccttttcactaccctctgaagatcctaccttttgttgacataagtgtaaggtttatttcttatcactgaggcatctggagaatgccttcattgcctgcctttccttagggggaagagtgccttgctggtatctttcccataccatttgggagaagcacaaagggaagagaaagcactcttagtatagagtaaatatagtgcctagtcaaggacctggaggctgggaagaagaggaagctacagcagcagttggaggtataacttaggatatagagcagggaagaggtggccacatgaataggttatacccactcttcactccacatctgga

SEQ ID NO: 56127 - DNA, 1344 bp, Homo sapiens
cctattcatgtggccacctcttccctgctctatatcctaagttatacctccaactgctgctgtagcttcctcttcttcccagcctccaggtccttgactaggcactatatttactctatactaagagtgctttctcttccctttgtgcttctcccaaatggtatgggaaagataccagcaaggcactcttccccctaaggaaaggcaggcaatgaaggcattctccagatgcctcagtgataagaaataaaccttacacttatgtcaacaaaaggtaggatcttcagagggtagtgaaaagggattagattatgaggaggagtggccaggagaatgaagccgatgttctaacatctcccctaccccagcacacagaaagacaatagtaccttttcctttcccacagatgctgctctgagaggctctggtagctatctcaagtctcaggtcagggtgtggagggcttctgccacagttctcattaacatagtagatgttaatggaatggcagtttatttatttatttatttatttagagacggagtctcactctgtcgcccaagctggagtgcagtggcgcgatctctggtcactgcaacctctgcctcccaggttcaagtgattctcctgtctcagcctcccaagtagctgggattacacgcgcccaccaccacgcctggctaatttttgtatttttagtagagatgggattttgccatgttggccaggctggtctcaaactcctgacctcgtgatctgcctgcctcagcctcccaaagtgctgggattacaagcgtgagccaccgcgcctggccagtgcagtttaataaaaatgatttgggacacagtcaggagcgtcagccttgccatgacctatatgacctgaggcaactcactttatctctctgggtctgagttcttcctttgtaaactaaggcaggcaaaatacatgaattctaaggcctttccattctaacattccatgcttttatcagtgaaatgaaacagggaggacagaaagaacagcgtaaccctgtgtgtatataggaggcatcctgtctccatgcagccctctaccaccttttgtctctggccctccccagaattttacctcatcctcattctccactttagggttgctggctgttcgtttcaggttgctgctgagacttatgctggcagtggcatctgacttagagcgctggtgagtccttttggagggagacagccctgtgtcaggggccgggctcaaggagggcagctccctcttcctgtgagctggctttagctcatctgagaggatcagcttccgtagcttggtcccacgggagtgtcgttgagtgg

SEQ ID NO: 56128 - DNA, 1050 bp, Homo sapiens
taggatatgtcttcttatctgattttgaaggagtccaggaagacaaaaagaggaggtgcctgggaaggtgtcatagcaaagggaagatctgaggatggcaccactaaccaatgtgtgtatgtgtctccctttctgttcttttctccctccctcttcctgtagcttggaagctcgaagtctggctgtggccatgggagatacagtagtggagcctgcccccttgaagccaacttctgagcccacttctggcccaccagggaataatggggggtccctgctaagtgtcatcacggagggggtcggggaactatcagtgattgaccctgaggtggcccagaaggcctgccaggaggtgttggagaaagtcaagcttttgcatggaggcgtggcagtctctagcagaggcaccccactggagttggtcaatggggatggtgtggacagtgagatccgttgcctagatgatccacctgcccagatcagggaggaggaagatgagatgggggccgctgtggcctcaggcacagccaaaggagcaagaagacggcggcagaacaactcagctaaacagtcttggctgctgaggctgtttgagtcaaaactgtttgacatctccatggccatttcatacctgtataactccaaggagcctggagtacaagcctacattggcaaccggctcttctgctttcgcaacgaggacgtggacttctatctgccccagttgcttaacatgtacatccacatggatgaggatgtgggtgatgccattaagccctacatagtccaccgttgccgccagagcattaacttttccctccagtgtgccctgttgcttggggcctattcttcagacatgcacatttccactcaacgacactcccgtgggaccaagctacggaagctgatcctctcagatgagctaaagccagctcacaggaagagggagctgccctccttgagcccggcccctgacacagggctgtctccctccaaaaggactcaccagcgctctaagtcagatgccactgccagcataagtctcagcag

SEQ ID NO: 56129 - DNA, 1036 bp, Homo sapiens
agaagtccacgtcctcgttgcgaaagcagaagagccggttgccaatgtaggcttgtactccaggctccttggagttatacaggtatgaaatggccatggagatgtcaaacagttttgactcaaacagcctcagcagccaagactgtttagctgagttgttctgccgccgtcttcttgctcctttggctgtgcctgaggccacagcggcccccatctcatcttcctcctccctgatctgggcaggtggatcatctaggcaacggatctcactgtccacaccatccccattgaccaactccagtggggtgcctctgctagagactgccacgcctccatgcaaaagcttgactttctccaacacctcctggcaggccttctgggccacctcagggtcaatcactgatagttccccgaccccctccgtgatgacacttagcagggaccccccattattccctggtgggccagaagtgggctcagaagttggcttcaagggggcaggctccactactgtatctcccatggccacagccagacttcgagcttccaagctacaggaagagggagggagaaaagaacagaaagggagacacatacacacattggttagtggtgccatcctcagatcttccctttgctatgacaccttcccaggcacctcctctttttgtcttcctggactccttcaaaatcagataagaagacatatcctaggaagctttcctgactacctccacttctgattacattactcgtcattcctcctgtagttactcagcttagcctctgttcttagcttatatatgtgaaatgttgttttgtatatgttgtatttatatagatttacaaattctttttgttgttgttgttgttgttgttgttgagacggagtctcgctctgtcacccaggctggagtgcagtggcgcaatctcagctcactgtaagttccgcctcccgggttcacaccattctcctgcctcagcctcccaagtagctgggactataggcgcccaccacaacgtccagctaattttg

SEQ ID NO: 56130 - DNA, 1109 bp, Homo sapiens
aaggattgttcttggagagcagtggctttggtcagcagtgttctttcattgaacttccttccaacagtccctccagaggaggtgttctttgttttgtgactcctgttcctccctgttctttggaaggcctagatctatgagtcctagtctgatttctttttgccttttcaattgtccctccagttgttagaatgtgtgtatgacagtggggggagtggtattggggcagaaaaggctgtcataagtatttctggaagattctcaaacaattggaactctttgcttcccttataaaataatataagttttatgttacacacacactggttagtaaccttttaggtgatgaggattcaactagcatttcttttttttttttttgagacagagtctcgctggtcttgaactgctgacctcaaagtgatccacctgcctcagccacccagtgcactgggattacaggcatgagtcactgtgcccggcctcaactagcatatattgagtactactatgtatcaaagactgtgctagattctttcatacacgtgatggtatttgttccacatagcaacaatgagaaggaagtgttttttcccaatttgcagttgaggataaatggcttgcataagttgcacatttctgaaaggctgaatgaggattttcaaccccagcctatttgccttcaagtccagagctctttccattatatgttagcagccacggcactggagaaagagggtgtgatgtcatgatgtcagacaaccagagaaacggcacagcttcagcagggttgatgatggttgttttagagctgccttcttctaagtgaagcctggcatggtatttactggcctttattttctgggaacttcgagtttaaaagggaaggtaaaaaaatacctgtaaccagaaaaatatatcaagactttaattttatttatttatttatttatttatttatttgagacagagtttcgctctgttgcccaggctggagtgcagcggtgcgatctcggctcaccacaacctctgcctcccgggttcaagcgattctcctgcctcagcctcccaagtagctgggattacaggcatgcgccaccacgcccagc

SEQ ID NO: 56131 - DNA, 1051 bp, Homo sapiens
ataaaataaaaataatagtaataataaatagctaaagcaatttaaccctattccctacaacaccttcttctccatatgacttgcttcagatgcaggcagtgcctgggttcctgagaggccagggaagagacccagctccagtttggtggtttctagtggtagagctgcttatataggagaggagtctgttttttcctgcacctctcaacactgtctagctccctgaggagtaaaagctgccgggagggagagtctgttcagtagcaaaatcctctgaatactgtgatgtgattcttagctgagccctgggagtttttcttttgtctgtgagataaaagaggtgatagtatccttatttgccttcctggtgccagtaataatcccaatcgtagttaattggggcaggcatctgctaaattttctagtgaggtctgagacactattatgtgggagaatgtctgaactgtatttcccttgaaagttttgaaaagtgtacttctaggagctttcagtgacttaaaagtctgtggactagagggagaggaaaggatgtaccaaacatagagactgagaaaaagaagttgattgtttaagatgattgaggctatcacatgagtttctaagcagacctaaaaggtagtggtccccgttgaatcggtgaccctctgatgagagtgccctacgaaggtgtggcagggaatgattaaagcttccttcttattattcctgtgcaactcacagttgcgagtagggacagatccacataggcagccatgctggttctactgctcagagggcactacctaattttgggagagagcatagtgaaagagttgccaccttcttaccaataccaagctcaatctgcatcagggatattaaattcaggaatgaacttgcttggcagagttggcagaaagaaacagaaatagccttttttggtgatctctgagaacagaagagttccccatccgtctttctgcaaaactttagtggtgactgctgggaggcagggagctggactatatgatattgggcagttaaaagtaac

SEQ ID NO: 56132 - DNA, 1050 bp, Homo sapiens
cgagatcacgccactgcactccagcctgggtgactgagtgaaactctgtctcaggaaaaaaaaaaaaaaaaaagcagctttcctccttggaagcatccccaaccagaaatcatatttcctctcatttccctgctttcttcttagagttgagtccacgctccatgagaatgctgaacaccatccaaagcagcaaattgagattccttgatttggggaagaggtttgggaggaacccttcaataattggcatgggacaagaggggacccagtccaagtgtatttgggactcgcagtagggaggaacaattcagagagaggtgagtgcacaggctgctttctttgccatctgtttcagtagcggctcccatagctggcttgggctgtctggctggaatctgcttataccagctccatggctctgcacagagttctcagcctgaatcaatattgacttaactaccatgagaccactgccctccctaccctcgtgctagtagcttgagaatgccctctcccctaatgcccacactctctgggcccttgtgtcagcagttacctggatcctggtagggctggagctggcttgactgcctggccctgagtttctataaggaaaaaggagtactcaatctctacctttaccattgaggtcaaaggggagagatgagttgagacatccttaaagaaaggtttgagttagacattaagacatgaggaggaactcctcaacagcagaacaggcagtcaaagatgatatggagtctcttttgaggagcaacctctctttaaaaattatttttgggctgggcaccgtggctcatgcccgtaatcccagcacttcgggaggctgaggtgggcggatcacttgaggtcaagagttggaaaccagcctggcatgttcgagacaacatggtgaaaccccatctctactaaaaatacaaaaattagccaggtgtggtggcgtgtgcctgtaattccagctactcgggaggctgaggcagagaatcacttgaacctgagaggcagaagttgcagtgagctgagatggcg

SEQ ID NO: 56133 - DNA, 1128 bp, Homo sapiens
tgcaacctccacttcctgggctcaagcaatcctcccacctcaccctccctagtagctgggactacaggtgcctgccaccatgcctgaagttttgtatttttagtagagatggggtttcaccatgttgcccaggctggtcttgaactcctgggctcaagccatctgcccaccttgggctcccaaagcgctgggattacaggcatgagccacctgtgcccagctatgttatactctaatagtcccctgcagtttgctttttctcacttaccattgtttctaagattcatccatgctgttgtagatagctatgattcattcattttcatctgcataatattttatcaagttcataaaccacaagttatttatccattcacctatcaatggatctttggatattttcagtattttgctatttcaaactgctgctatgaacattcttgtacatgttagtgcctttgttttcagtaagatttctaaagaggcttctaccatggtcctttggtttatataacctctaagttgggaactgttccctcttgtcttattctctggaagagtttatatcagattgaaacaaactgttccttgaaagtttggtaaaactcacctgtaaagctatctgagattgatgtttctttgtgggaataattttaactattgattccatttctttaataattatagactgggctttctattcttcttgagtcagcttaggtaaagtattattctagggttttgtgcatttcatgtattttttttaacacaaaatgcatatatttcttctagtttctttttttttttttttctttgagacagagtctcgctctgtctcccaggctggagtgcagtggcgtgatctcggctcactgcaagctctgcctcctgggttttacgccattctcctgcctcagcctcccgagtagctgggactacaggcatgcaccacgtacacctggctaatttttttttgtatttttagtagagatggggtttcaccgtgtcagccaggatggtctcgaactcctgaccttgtgatccgcccgcctcagccttccaaagtgctgggattacaggcgtgagccaccgtgcccggctcttcttttttttttttttttttttttg

SEQ ID NO: 56134 - DNA, 1640 bp, Homo sapiens
gttgtgggagatgacgtaggggccggcgacgtggggagggggagcagcgggggaagtcgtggcgagattaagtaatgagaacttgggcccagttttttttccaagcctagaagggcagaatatgttcgtatcctttctgacctcccaggcatatgcaatggtgaggagtatttttgagaattagagaactttgttttgtggctgttattgttgtttttgagggggaggagggcagtatggggtcagaggcagaaatgaaaatttcttgctaacatggattcccaatccccctatctcttcctttacagttttccagatttaggagacttcagaaaggtggggcagatagaatggagatggcaaagatctctttgggcatatatgggcctggcgaagtaatggaataatttctaattttcggagaaggcaagtggtgagaaaaagaccaccggggaaattcggaggctttgtttctgtttctctgcctttctgggtaaagagatgaggagtgccctggggccttctggggaagggaaggccagtgtgagttacatctttatgcctgtccctctcaattctagccctcatgccgggatggcagaagatgagcctgatgctaagagccccaagactgggggaagggcccccccaggtggtgctgaggctggggaacctaccacccttcttcagaggctccgaggtaccatttcgtaagtactcatcacatctccaagtcctgtccaagacctgagtatagatccctgcagcacttcactttggctgtagatgaactgcctctcagcaagggcatgggagcagagggagatttttggccatggtagcaattcttgagcacctgctgggcatttcagtccttttccctccctagcagtcagataaagagacagggaaaatcttgtgtgtgacctccagctttctcctcttccccacagcaaggccgtgcagaacaaagtagaggggatcctggtaagtgtgttggggaagagggcaagagagggatggaaatgctgagggaggaggatgtgaggatgatgggcatcaacaaaacattgatgtgggagaggtagggtcctctgccttgtcagaagatagttggctttgcaaacttgctgccagtttgactttgtgcctctcacttgatctctgtgagcacttgcatagaagcccagcagagatgaagtcagagctgatcccctctacttccctcctctccatggtagcctatagggctcctcagagcacctagcatcaaataatttctttcttttttttttttttttttgagatggagtctcactctgtcgcctaggctggagtgcagtggcgcaatctcggctcactgcaagctccgcctcccaggttcacgccattctcctgcctcagcctcccaagtagctgggactacaggcgcccgtcaccacacccagctaatttttttttgtatttttagtagaaacggggtttcaccatgttagccaggatggtctcgatctcctgaccttgtgatcagcctgccttggccttccaaagtgctgggattgtaggcgtgagccaccgtgcccggccttgtcaaataatttctaaggtcctttttcagtctgacaccctgtaagtcagct

SEQ ID NO: 56135 - DNA, 1035 bp, Homo sapiens
ctttttcttttctcttttttttttttttttgagatgggagtctcgttctgttgcccaggctagagtgcagtggcgcaatctcagctcactccaacctccgcctcactggttcaagagattatcctgcctcagcctcccgagtagctgggattacaggcatgtgacgccatgcctgggtaattttttatatttttaatagagacagagtttcaccatgttggccaggctgatcctgaactcctgacctcaagtgatccgcccgcctcagcctctcaaagggctgggattactggcatgagccactcttcccccagccctggatgcctgaatttaaggaactggcaaatccagcagtggaggtagaggcaatgggcttacagcctcttagacatgcctcggggagagggctggagggtggggttagtgtctctactgcttctacctgccaccctgcttccttccctgttcagggggttttgtgctgctggatggggagacgttcgaggtgaaggggacatgggagagacctgggggtgctgcaccgttgggctatgacttctggtaccagcctcgacacaatgtcatgatcagcactgagtgggcagctcccaatgtcttacgagatggcttcaaccccgctgatgtggaggctggtgagaatccccccatgtgccagcaggagccttgggcctacatccccttgctttctgctccaaatctcccacccccacacttccctcctgtggccccagaatctaagagagatggcataggatgtaccgcatgctcagattgctcaagcgtcttcctgatccctccaatccatttcttaaccttctgccctgattggtggcccagtctttgcccatgccttccaacctctgatgctgagcctatcctccggccccactcccaccccaggactgtacgggagccacttatatgtatgggactggcagcgccatgagattgtgcagaccctgtctctaaaagatgggcttattcccttggagatccgcttcctgcacaacccag

SEQ ID NO: 56136 - DNA, 1029 bp, Homo sapiens
ggaactcctgagctcaagcgatccgctggcctcggcctcttgaagtgctgggattagaggagtgaggcacaacacctggcctgttttgactataactttgaactgaattcatcagtgaagactcatcttaatagaaatattcaaaactgaagttacttgctaacatttaaaatactggctgggatccagctcactggttctccttgggaagtcattccaaccctccccttccattctgctcctcccacagaaaaatgcttcccacatttcacagctgtggaagttttcatgagcacacagtgctggcaggtacctttgccattgcccttgacgtctcccagggagctgatcatcacttccccgctggccaggcagtggctggtgtggagaaaggccagttcgcacttggcatggatgtccttgggctcaatgacctggaaggggtggggaatggtgtcagaatcatacaggactgggagtccctgctcttaacctccatacttcccctacttctatctgctgactctgtcatcttttccttcaaaacatggacacaactctccctgtgggaatatgacaaagattcagtctggtaacttctacagagcagcaagggaaagtcagagagattgctaataactccccaggcagaaagcgctgacctttccccatgtgtcctgaaggcacacgcagccctgtgaaaccataagctcctcccaggctggcctacaccagtgtcaactctgtattaccagtagacaacacagtaaatgcctggcaccaaaagtgcactaaacaaagtgttgggagagaccggaatttttaagagaaccctgagctcctaactgcatgggggaataaatggctccctccctctctcagagtaaaacaagaagccttgtccctcttctcccatgccctggtcaccgtgctggagggtgatgacccagaatgcctgggtagactctgctctgaggtccaacctccctccctgctgccgagccagttgccgcgtaagagctggaggct

SEQ ID NO: 56137 - DNA, 2925 bp, Homo sapiens
acaggaaaaagaaagaaatgacactgaaggatcacttccgcttccgttggcgcaagcgctttcattttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagtaagttctcggcgctttcgtttgcgtagcgggagggaccgtggggcctggtgctgccggctggttttgagagcccgggaaggtgaggcggggaccccgggggcgcgcgaacggcaggggagctcagggcgcggagtcctggagaatgcagaataattggaaggaattatagaaaatcagaagcgcagctcagtgcgcggaaagagggcgcagtccatcccccctctcagctcccaccgttctcactctttaggaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgtaagtcatccagagaacaggagagtggttcccaagtagagaggggagtcccctgttttttattcccttcgatgggatggggggacttgttgcagcgggggactggaagagttgttggaggtgggcgatctgtgtttgcaataaagtttttggcattaggtgtaaaatgggggaaggtgtggtaacttcttttggggatgggtggagaccccgacttaattctctcccttttctcacaaccaattccttttaaggattgatgaggagcttctgggagatggacacagctatagtcctagagctattcattcatggctgaccagggccatgtacagccggcgctcgaagatgaaccctttgtggaacaccatggtcatcggaggctatgctgatggagagaggttcatatgaatacaaataacttatttcctttaccacccaacctagtacctgtgtagtatctcttctgtctcttctccccaagtgaatcccactttaactcagaccccatggtccccttcttcagctaagatgaatctaaggtgaaatgagttttgacccattgtgtcctgttagcttcctcggttatgtggacatgcttggtgtagcctatgaagccccttcgctggccactggttatggtgcatacttggctcaggtaagtagtaagtctagaggtgggggaaagggaagacaaaaggaaatggattagtggttgtctgcttttctcctgaaattctgatatgagggatgggctgggatcgctattactgggcagatggttttctttgtagtctgggggctgtaggtgttgacactgattccagtgacaagatgacatgactgggagtcagtagacatgcaaagagaggacaccctagaacttcttcctgaagtggctcttagcttattttctaagcagagttcattctggtgaggcaagaagtagaatgtcatctttcactctaatgctttttataccatagatttgagacaactagcctgttattcagcccaatatccccccatggttttcccccaatctccctagcctctgctgcgagaagttctggagaagcagccagtgctaagccagaccgaggcccgcgacttagtagaacgctgcatgcgagtgctgtactaccgagatgcccgttcttacaaccgggtgagggatgtgctgggaacctaattggcgggctctggctacttgcaatccctgggtctctatgctttgaagaacagattgccttacttgtgtgactcctattttcacattggggaagacctccacctgacctttcatttaaggacttaaggcgtgggcattattgaatgctctgctttcttccagtttcaaatcgccactgtcaccgaaaaaggtgttgaaatagagggaccattgtctacagagaccaactgggatattgcccacatgatcaggtgagtaatagggaaaaaattggtgacagacttgggaggtctttggcttacactaagctgggcttttctgggaggctcacccaggaaaattttctgggtggaaagttttggttggacagtacagctatttttaggaattgatccctttatgcttcacaattttattattctgtcttccttttttagtggctttgaatgaaatacagatgcattatccagaactgaagttgccctacttttaactttgaacttggctagttcaaagatagactcttcttttgtaaagtaaataaattcttcaaaatgcttgctgagtggtttttgtctgactgggtcacaccaagtgcaaaactgctgagtactgccatgtgccatctccctccctggtcggagaacccttgtggtcttgcagcacacacagaaattctctctgcacaacacagaaagacacactagcgtcatttggagctgtattagaagcagagcttcctgtagaagccagacttaatttttgtgtgctaactggcttttgtgttcaaattcccctcccaaatcttcctccactgcactggattatcaaatacagatttcttaatgttggctgtgattttcattaaaataccactttaaaaataatctagtagaactattctgcatcaggttgccctcaagtcagctggggcatcagccatccctggaatggttctaaacctgaatattttagagacaaaagtctcattctgttgcccaggctggcgtgcagtggcatgatcatagcctactacagccttgaat

SEQ ID NO: 56138 - DNA, 1041 bp, Homo sapiens
ggatttataaacttgttttttttctaggtgaccctgtttaataggctttcacagactggggaatgctcaagatgtgatgggcctggtggtacaggtgtgacatttgttaccacccatttctcccaccccaccctgcttttttgtttgtttgttttttcatcccccagcacactataatatagtgaactggaaaagtcccttccagaaacagcttggccagctttgtgaacctttgacatctgaaaacaaccaaggatccatctgggcttctcttccccagctttttgcctgatgccattttattgacagacaatggactttgaagtcagcctttgcctttgagaaagttcaagaactatggttggtcacgtctatctacaacctaatcctactctttggtagtctctgcagcagccacagccttagcagagctggggttcctgtcttctgcacacgattgactttcttgatgggtaattttttttaagattataccaacagtggatcagctgggttttggccaggaagttgtctttgtggactctgcctgcatggcttagtagtagaaggaaatttttttttggttttgttttttataattcagtttaatcaataaacatgtatttattgactgtttcctgtgttgagactgaatgtgtggaggtttcagattgaaagctcattgtttggctttacaagtttgttgttaacggacaatgcaaatggagggatggttttattttttccttcagttctcactgaatttctgtactttgaatttgctgcctatattttctttctcaagaagtttggagaggatttgtgtcagaatcgcctacagtgttcattttaaaaattcaagctgggcatgatggctcatgccagtaatcccagcacttgggaggctgaggcaggaggttgcttgagctcagaaattcaaggctgtagtaggctatgatcatgccactgcacgccagcctgggcaacagaatgagacttttgtctctaaaatattcaggtttagaaccattccagggatgg

SEQ ID NO: 56139 - DNA, 1238 bp, Homo sapiens
tagatctgatggagatttgagtgttggggtcatgagggggtgtggagtgagggtgggaacatgtgagggagggtaaaggggcttagggaaaagggggcataccaggtggggtatttggtttctattttttaattttataccaccactcccccctgaagttgacttacacttccctgtggatttgtggattaattaggaaaaccaatagtaatcacgtctgagccaaggagctggcccattggtcattcacttctgctaaaaacaggtttttgtgactttttttttttttaaatttaaatcactgtgtttggtatttttctgacaaaattaagaaaaagaaaaaaaattatttgtgggcaaatgttaaatttttttgtttccccttttacctcaattgtatcatagtactgggtttttttgtttgttttattgtgtggccaatgtctttgggcatgatgctatctaatcattgttaatgtgagaacatttctgaagatgggaaagacaaattatgtagctcacaaactggtttattatatatatggataaaaaacttttttcattgtggtcttaacacttttatataaaaatgaaaatggaaaaaaagtcccactgaactctctcttccttctccttttctttccttccctctccagagatgttggtttctacagcaaccctagatataaaattgtggctttaaaaatgcatgaaaccacctttaattatccagaatgaatagatttgtcttttcctcaccaccttccctccaaaacatgacataaacaatattttttgcacttgtgatccttggcccctttccccattctcaacaccatccatccctctggacaaaggatcatacaggtgttattagcaagcaagagatactgaagcgatcaaacagttttagggtggaagccattcccagtttgagtcttcatcctgtaagcccccaggggcagtccctgctttactgaacttcatcctgttagatggagagcatgcctgtttaagggattactggtcctacagccaggagctaattgttcaagaagtgttgaactttaaaaagacaagaccacttgttgaaatccagcgtgctctgtggctttcccctatttctcttaatacttagggaagaatctgacaggaagaagcgcacaggggtgtgcacaaagaaaatgacatgaatctttatttttcactgccagcttcaaggaaagaaaattttttct

SEQ ID NO: 56140 - DNA, 1442 bp, Homo sapiens
ttctgaaatttagtgtgggtgatgtctcattgttacttcccttggttctcaggtgacaatccgggcttcccgagggcagccacgaactgttcctgtatcctctaatgatacacctcccagcgccttgcaggaggcagcaccgctgacctcctcaatggaccctctgcctgtcttcctttatccccctgtccagcgcagcatccagaagagagctgttaggaaaatgtcagcgccttcttctaagtgctgggcgggtggggactgggtggccaggattattcctgatacacagtgcaatctggtagctttttagcagggtttgttgtctgaaaatcctacattttggggacccatgaggcagtaatgagaattctttttttttttcccccacaggagtgtcatgggccggcagacatgcctggagtgcagcttcgagatcccagacttccctaatcatttccctacttacgtacactgctctctgtgtcgctatagcacctgctgttctcgagcttatgccaaccacatgatcaagtaagttggtttttaaccagtgttttagcttgagagttcagattctttttttcttcttcttcttcttctttttttttttttttttttgaagacagggtctcactctgtcccctaggctggagtgcaatagcatgatcttggctcactgcaacctctgcctcctgggttcaagtgattctcctgtctcagcctcccaagtagctgggattataggtgtgcaccaccatgcctggctgatttttttgtatttttagtagagacggggtttcaccttgttggccaggctggtctcaaactcctgagctcaggtgatccacctgcctcggcctccctaaagtgctgggattacagacatgagccactgcgcccggccccagccagattcttgagcactcatttcattttctcccctgcttctaatatgtttcctccttcaactcttagagctatttgttcttctctcctagcagagtgagaggctctgttttttcggttttgatggtctgtgctctaatttcatagggccttgctattcaagtaccagtagtattaggtgggagcttgttagaaatgctgactctcagccccgccctaggcctactgaaccagaatgtgaattttaatagatcctcagtgacttgtatgcatattaaagtttaagaagcatggtgacaggaaaactggcttaggttgagattagggtgcactgaagaagtgtctcttttgttgggggcattgtcactggctggtgatctctagcttagccagcagaactccgtaactcataccacttctttgtctttctcagcaatcatgttccacggaagagccccaagtatttggctttgtttaaaaattctgtgaggtaagaaaaaacttattggcagcatcttaatttttcaggtttt

SEQ ID NO: 56141 - DNA, 2603 bp, Homo sapiens
taattacttgggcatggtggtgcaccactgtagtcctagctacttgggaggctgaaacaggaggctcgcttgagctcaaaggatagtcctagctactcaggaggctgcggtgagctatgatcatgctccagcctgagcaacagtgagattctgtctcttaaaaaaaaaaaaaaaaaaaaaagcccaggcacggtggctcacacctataatcccagcactttgggaggctgggacaggtagatcacctgaggtcaggagttcgagaccaacctggccaacatgaaattaccaaaaattgtctcagaagtttgacaaaattgttcatttgtgtcataaaattttgtcaaaattttttctcataagcttgacaaaatggacaatttcaaagagagtaggaggtattggaggccagctgattagcagtgggaaatcatatgggctagtaccaagtttttgccttattataagtatagagaagtgacagttcctacatgcagtttgaaataatggtgacagaatgcagggtttggaatccgagatagtgcctaaattttgagctcaggaagaaatggggaaaggaaaaagggaaacagtggtaagacaggaggatgctgaattaggttagagttgacgatagaataaccaatttaaaatgtcttatagataaaatctagaatgaagctttggtaagaagtctgagctacgtacataagattatcagcaacatatatgttaaggtggagccatttaaagaaagaacagaagggacctatgatttactgattgttgaaaatcaaaataaaggaggcagagaaaataaagattgtgagtcagcaggacttttgtcttattttcaagtggatttattgattacttttcttcttacagccaagtgcaagatctgtgaatgggcgtttgaaagtgagccactatttctccagcatatgaaggatactcataagcctggagagatgccttatgtttgccaggtattgcctttttctccagggagttttagcagttttgccctcaggaagaatacaaagaatttactaatgaatattgttgaccacctactgcatacactcagtttaggaactctgagtaggtacagaagaaatagtaaacacagtttatcttcagggtttccatgcaggagaaaaacataaaagaacatgtccacaagtagactagccgggaacatgtgcatattctaagggagtgtctgtctcctgaacgtgccctttggaaattgacagaaaaggctttatttttcttagttagagaacatggattattcttagactttctgtcccttcctatttttaaagtaatagctaaacctatcacaaacatagcccagcattacaaagtcaggaaaataatttgatttctatgcatttgagaaaactttttttttttaatttaaaaatttttgttgctacctttttttttaaggcctctcagttgttcacttcattcttagccttattttccctcctatgtgactcaggtgtgtcaatatcgctcctcactctactctgaggtagatgtccattttcggatgatccatgaggatacccggcatctgctctgcccttattgcctgaaggtcttcaaaaatggcaatgcattccaacagcattacatgaggcaccaggtactaggcaccaagcaattcccatattctcttgttttttttttttttaaacatggatgctggggccagggctgagctaggcaaataatttgggcagagattataatatgcatatgtttgcagaaatttattgaattcacttaatgtgccatgtactagtctagatgctagagatttagtagtaaacaaggcaaacaatacaataaaacatgaagagtactgtgttggggaaattataggatatagaaaatcacatagctattctgggtgcctagtaaggcttccagaaagaagtgttgttcaatacctgagggatgaataagaatgagccagatgaaataagacgaagaacagtgtgcccaaggcacaaagcaaaattgtggaggttcaagaaattgagagagattcagtgtagggtgtaagagacagaggggttggaagttaggcagggacagatcatggaggatcttttaagccatgaaaagaattcactgggaagccactaaaggggttttaagccctggagtgatgtgttcagctttagttaaggctttatactgcctgcactgcagagaatggattaaaggagattgagactacagttagggaaactagctagaaggcctttttcagtagtttaggtgagagatgatagtggctattggcttttgaaataaaaagagggtagagttgagagatattcagaagatttgtgatatttatgatgtagagatggattaggtgaaggtagcaatgcagtagttaagaatagtgcctaagattctgtcttgggcagttgggtgaatgagggaactatttgctgaaatagaaacaatagagaaagtatatttgtgaggggggagatcatgagcttggatattgtaagttagcagtatctgtggatgtcaagtgtagctgttggataatagatctcaagcctgtg

SEQ ID NO: 56142 - DNA, 1026 bp, Homo sapiens
caaacaaaaaccatagtgatctctcatgcttgcttacccttttatatacttctcagggagtgtttgactttttcccaaaaggtcagtaatctttttccagtgtcattgtattaatcttatcaattcttctcacttctttcagtgacctcttccatcccagtatttgacctccaggatggtggacggaaaatatgtccacgatgtaatgctcaatttcgtgttactgaagctttgagaggtcacatgtgtgtaagtgatatcacctgtgatccagcttaagtggcttctgccatttaccttcattaatattggaagcttgtaagcaggggctctaaaatgactgaagctttttaaagggttactgtttctcttggtctgtttttagaagagctgtgtactttggaatgtgatgggatacatttaaagaccctcaaatagatcagaacatatgtgatcttactttcttagtgtggtagattttgaaaccacacaggagaacaggtttatagataataaggactcaaaccatattggcctcagttcatttttgttaattgtgtcattggatgaatcgggagctcttacttccattttttagcttttcattttttggtattagtccagataaaaaggttggaacttcttctttgccagggagctcagagccaagttatactaatgattaagggacctaagacaggcaggagggagaaatacaaagtatagcgcttgggtggcatatgtggatatactctagaaaaggagtaaaacttggaaacgctaaaaaaaactgaagggtgaaagctgaatgagaatacctgaaaccaaaccgttaacaaggaatggtagtgaagttaaggagttagcacattctagcccccaggataaccagaatgatcagatgtctttctttatagtactgttgcccagaaatggttgaataccagaagaaaggaaagtccctggattcagaacccagtgtcccatcagcagcaaagcccccatcccctgagaaaacagctcctg

SEQ ID NO: 56143 - DNA, 1017 bp, Homo sapiens
tgcctgtattcccagctgctcgggaggctgagacacaagaattgcttgaacctggaaggcagaggttgtggtgagtcgagattgtgccactgcactccagtctgggcaacagagaaagaccccatctcaaaaaaaaaaaaaaaagtaggaaagtaggcaaaggactgaatagacctttctccaaagaaagttattgccaataagctcatgaaaaggtgctcagtgttattaatcattatggaaatgcaaatcaaaaccacaatgaggtaccgtctcactcccattaggatggctactatcaaagaaccataaaataacaaatattgttgaggatgtggagaaagcagaacccttacgcactgttggtggaaatgtaaaattatgcagccactttggaaacagtatggtggttcctcaaaaagttaaaaatgatagaattgttgtatgctccaggaattccattctatacccaaaagaattgaaagcagggactagaacaggtatttgtacacctatgttcattgcaacattattcacaatagctgaaaggtgaaagcaacacagaggtccatcaactgataaagggataaataaaatgtggtattcacatacaatggtatattgttcaggcttaagaaaggaaattctgctacaacatgtgctgcaacatggttgaaccttgaggacattatgttaaagtgaaataggctagtcacaaaaggacaagtaccatatgattccacttacttgaggtacctagagtagtcaaattcatagagacaaagttgaattgtggttgccggggtggaggcgaggggagaatggtgaggaggtttttattggatatagcttcagttctgcaagattaaaaaaaacaaaaaccttaacaaaaaaatcacatacaaattattcttagcttatgggccaaacagaaactggtagctgggctggatttgatctgtgtgctgtggtttgctgacccctggcctagagttagaacagtaaaaggaagcctca

SEQ ID NO: 56144 - DNA, 2067 bp, Homo sapiens
agtttttttttttaagattctgctagatagttttttttttttttaagattctgagaaggataatttttttaaaatcttagaattttccattgctctatttagcatgtataagtttactacaattcagaccaaaaaagagtatcttaatttagctatttgtaagggtacctctgtagcttgtcttcctaaggttttgttttttgttctcgtagcccataggggtttaagtctgaccagcttaccctggcatttctttatttttctcagtggaattgtctacagttgagccaggagacattcctctttgggacatcctagtagaatggcatagtctgtcttctgagttgatagaagaggatggaagactcctttagtactctgagaaagactgatttcttttttcaggaccaggtttgccatttggcctatatacacccatattgcttcccactcttttcttccagtaccgaggtcaagccactgattgtattcttagaattaaaaaggcagtgtgataaggtgttttaggaggagttgatgggagtcttatttaacttaatgtttttaggctgcccaggttattttgtcaacatggacaccttgtgctttcttagtctttagaatctatactcctcttggaaacctctgatgatcatccatcagtttggggaaataatctttccagtaaaggcagggagaatgtgttataggtgagctcactgaccaagatctggtactttgtctctcttttaaagccccaggtacccagtttgttaagccgacagttggagttccacaagtgttctcccagatgacccctgtgaggccaggctccacaatgcctgtgaggcccaccaccaacaccttcaccaccgtcatcccggccactcttaccattcgaagcaccgtcccacagtcccagtcccagcagaccaagtccactcccagcacttctaccactcccactgccacacagccaacctcactggggcaactagctgttcagtctccaggccagtcaaaccagaccacgaatcccaagctaggtaaggcttcggaagaggagatggcagagccaggttgggatggtgggtggagaacagatgattatcacttggtcaccgtagctccctccttcccctctccacctgcagtgagcattgccagctttgtcactgtgaagcgacctggtgttacaggcgaaaatagcaatgaagtggccaaattggtgaatacccttaacaccatcccttccctgggccagagtcctgggccagtggtggtgtccaacaacagctctgctcatggctctcaaagaaccagcggacctgagtcttcaatgaaaggtacaataacctgaaagactctgagcagccagtcattcaaaaacattaataaagtgtttgttgtatcagagctttatactcagaaatagaaaaataaaataaaatacagctgctgtagtttgttcttacagaaactttagtaaggagaaagccacttacaaaaagtgtaactgaatcagctccaagaaattatgtgtgtaattgtgctttggagattagtgaaattgattgattaaagatgggtgagataatgaaagataacttcatggaagagatggatttctgagcaaggttttaaagttaggatttggtagagagatcttcaggttgagaatgatgagcatgagggttttcagtggtctagagcaggggtcggcaaatgttttctgtaaagggcctagtagtaaagttgtaggctttgtgcacaatatatagcctctgttgcagctattaactgtgctgttgtggtggggaagcagccacagatacataaacgaatgagcatggctgtgctccactaaaaactatttatggactctgaaatttaagtttcataaaattttcatgtgtcgaaaagttttattcttttatttcaaccatttaaaaataaaaaccgcaaggtatagtggctcacacctcatcccagcattatgggaggccaagacgggaggatcacttgagcctaggagtttgagaccagcctgggcaacatggtgagatc

SEQ ID NO: 56145 - DNA, 1087 bp, Homo sapiens
aggagaaatcacatgaacagttggatttatgaaacaggaaactttttggctatagagacccacaataagatggaaagggaagattagagcagtatcctttagtgtcatctgtccctgtctccaagtgactatgcctccccttccccacagtttctgtgagccagcagccagtctcggctccagtgcccatcgctgcccatgcttctgttgctgggcacctctctacatccaccaccgttagtagcagcggggcacagaacagcgacagtacaaagaagactcttgtcacactaattgccaacaacaatggtaagtgggattattgggaaataataatcctgggctagaggggtgaaagaataaaaaaggtctcagggacagccctacctgtttagttaggtacagatgtggttctactagttggaaaatgaatttagtaatgattctctgatacggaagtgatttctgtagatggtgctattccttctaagttagtgctgactcggtactggtgtttcaagtgagagagcagtagattcttgctattgataatttcttggagagaaaatgtcaacccaaaattcctgttaagatttttttgtttggttggttggttgtttttgtttctttaatgagaaaaattccattagtttggtaagaattttcccagggcagttctgtattttctctggcagattcatttgtttattggttcctgagtatggaagataggatagggttgttgtctacatgaaagaaatggtgaaagactagtgtttttagtgtattttattttattttttttaatagaaaggctatatagtattggtttctatttaatttctaatgtctatttctacactcctaagatgagttgttgaccagttatgtctcaagattcataactgaagtaggcactttcatagagtcattgcatcgctgcgagggactttattttttaattattttatttcctttaaaactaaaacagctttagtactacaaaaataatatatgcattgtagaaaaactataaagtgaaaaaaaaaaggaacaaaaaaatgtttaaccataatcccaccacctg

SEQ ID NO: 56146 - DNA, 1050 bp, Homo sapiens
taaaaggcttgattaaactaaatgtgtcctctttgttaacctttgattgtttgattatatttttcttaaaatttatctttttaaaataattttttaaaaattttaatagatatgaggtctctctctgttgcacaagctggtctcgaactcctgaactcaggtaatcctctcacctcagcctcccgaagtgctaggattgcagatgtgagccaccacacccagccaaaatttcttaactacatataaattatcttaatgatctaggtattttgttaggggaatacatacagtcaggataggataagaggggaagtaatgagtggtttactaaatatataagacaaacatttcaagtaaaaatttcaggagaaaatttttttttaggtttctaagaaatatatttgtggatgtggaatttttctgtcagatgacgtaagagcaaagttgaagatagctaatacttggggattcatatggaggtaattttttatttaaaatgagcaagaaggaccctagccttttattgtggtcttggaaactcattccccaccagtatcattccttgaagaaatggttggttctaggtctggggcaggaaatatatgagataagctgaaacatcttgactatcagcaaagattttatcaaacgatgctagggttgtgtcagaaggactcagcagccaactgaagacgttcccactggccaaaatagggcacattgagtatctgtaaagataactgcatggatcaaaacacatcaaaagctgggcacagtggctcatacctataatcccagcactttgggaatctgaggcaggtgtgttgcttgagtccaggagtttgagaccagcctgggaaacatggtaagaccccctctctaccaaaaaaaaaaaaaaaaaaaaaaaaaaattagccagacatggtggctcttggttatcccaagagttagttagctctttgtcccaagagttactcaagaggttgaggtgggaggatttcttgagcctgggaggtggaggttgcagtgagctgagattgtgccactgta

SEQ ID NO: 56147 - DNA, 1012 bp, Homo sapiens
attctggttcctgcagaggtaggtgaaggacagaaagggccctggccggcgattcccttggagtaaacgggaggcaggaggctgttttctagcagagcccagaagatgctctggccgacggctcccgggatcttggccggcggtcactcgcgaccatccgcgacgcccccaaaatggcctccgcgcccctcgccgccccgccccgacgctccgcagcccgtgggtccacgtgacctggcccgcccttcgcggctggagaccccgggtcccggtccccgcaccggaggccccgccccctacgggaagcggaccaaccggagcggggaaaggcggggcgggcactgacggcccgcgggggtggagctccgcagcggagtaacaggttggtgggagggagagaaaggagggagctccgaggacgagggggagggccggagctgcgcgtgctgctttgcccgagcccgagcccgagcccgagcccgagcccgagcccgagcccgaacgcaagcctgggagcgcggagcccggctagggtgagtggacccggtgcgggccagggcacccgagaggaaagcgagccttcaggggtacctttgaggggcaggcatcgaggcggtgtgagatgcccctctccagggcaccggtgccgagtgggagacgggaggaggggagattggggcggggtggggtactgattaagagccgacccctaccctgaggtgccagatgcaggtggctaggaaggtgccaggcgaggggcacctggggcgaaggctgttcccagcgcatgaaagcgtttcagcgccagatgtctctggaggtcagacgccagccctaggggcagaatttctcttggagacagcggtggcgcggggaaggagttagttccagctgagtcgggaactgctgctgcctgaggtgcagactcgccaggggagggcatctgcaggtgctgctcgcctgagggtctttcctgcgtcctgcggtctcagctggccgttgtcagcaccct

SEQ ID NO: 56148 - DNA, 1052 bp, Homo sapiens
tggaggagaaaacagaagagtgcagccgactgcaggagctgctggagaggaggaagggggaggcccagcagagcaacaaggagtgagtgcagctggtggcgcacctcgggctgcttgggggcctaggccaggtttagaggccactccctctttgcccctagggttgaaggagacagaaggaaatctccagaagctgaaaggggcagtgttggtttaaggacaggatagggcctttctctctaccttctttatcaataatggtggtagtgcatgatttggagttaagctacctgggtttgcctctgtctcagattcttaagctataaaatagacttaataatagtacctacctcacaggatcattgtaaggattcagtcatccattcagcagatgtttcatcaagaatgctgtgacaggcattaatctaggttcccaagacacatcagtgaaccctatagatgaagggctcgctctccagaagcttagtttctactgagagggaacagacagtaaacaaacatattttgcaagtaaatttgtaacacacgagaaggcagtaaatacaacagggtaaggcagatcaggagggccaggttgtagcggggcaggttgcaaaaatcaggggaggcctcatcaagatttgaaggaaggaagtttaaatgcattaataaatatgaattaaaatatatgatgcgtttagagaactgcctgacacatagtgtgcaataatgttatctattattaggctccagaacatgaagcgcctcttggaccagggtgaagatttacgacatgggctggagacccaggtgatggagctgcagaacaagctgaaacatgtccagggtcctgagcctgctaaggaggtgttactgaaggtagggtctggggtcatatgccccagcctctgctttttctcagttggagcatcctcaagtctgctcatccatggtttccccaaagtatgaggagtgggtggctgattacaggtactcagtgtgctttcaggtagattcaatggtgtgttgggactagagttaggataaaggaa

SEQ ID NO: 56149 - DNA, 1096 bp, Homo sapiens
tgtaggcacatgccaccacacctgactaaaattttttttttttttttctgttggtagagatgggatttcaccatgttgcccaggctagtctcgaactcctgggctcaagcagtctgcccaccttggcctcccaaaggcttgggattacaggcatgagccactacatctggccccttttactctttcttgatgtttttgctctttgtctggtggggcagaaaaaattactaagagaaaataatggacaaggaattcagatggtctccatcataggttagtttgaagctaaccagagacctctagagcaagggagagacagaaattcccttttattccttttttctaggctgaacttgagacttattttactccagagctgggaatgaagtaatcattgcccagatctgatcttggagacattcctgggcccttaagggaggggaggagatggtgaacagtcgggacacaggccttgtcctggattcctcttctctgagccaacttgcagacagaatttatggctctggacaacccccaggaatctgtcatatattcacaccactgaatgggtgctcaattcatgtgcaaagtgagtcaataaataaatgaacagatgtttcttccggagtcagaatgtagacagttgaactgattagagatcctactgggagtgagggccctgggactctgttggtgtttccccactagccaggcagtgtgccttagcgtatcacatgtggacatggacatagggccaatacactctctgggatgtttttattgttggaggcagatgcagcaggtacaaggagccagtgtttttcagaactgcagaccataaccagtagtgggtctgagatcaacttagtaggtcagaccagtattaaaaaagaaatagaattaacactcttagagtgttagtgaggatagacatttttggtagaacttttatttcagttatatatatatgtgtgtgtgtgtgtgtgtgtgtgtgtgtgtgtattatatatgtacgtgtttgtttactgggtcttgatgtgaaatatgtttttgagattgaaaagttttgcaagccactgtggtaagttatattggc

SEQ ID NO: 56150 - DNA, 1103 bp, Homo sapiens
tccctattcacatgagcctgtggtgtgagaactctgcacctctctccttatttccctggggcctccctgtttatctccttatctctgctgtggcgtcttgatctctaacccctcagctatgtgtttaccccctccctgctttgaggagtgagtcagggttggagatttgtttgaacagagtggtgaggctgcctataatttggaggtagctgggcttctcccaaaaatgtttatgaggttagaggctgcttaccttgtgattagtactgctcctttttccctagagaagaaggctccacttctcatcttgccttttagagtacccagtagagacccccctgccggatatttttggggtgttcctaaagctccctggagcctgctcatagtcctgaggaaatgcaagcctgctctagaaaacaactaagtgcaccaggcagagaggagccccaggatttgctccttgactctgggttgggggtgcaggccgaggtctgtggccttgctgactaagatgcattctccagttctggaggatgaggtgccagagagagccctaagtttttcatcagctccattagacaatttacctcatccaccctcttcccttgcagactttccagagctacttgggaaagtaatgctgcttcacccttgtgaagagatgtatggtttgcaaatcacttttacatcattcttgcacatctatctactcttcctaaaatgtcggttgtgaaattatcaccctcattttacagacagaaaactgaggcccagagagattaagtgatttgctcaaggattaatggtcatcaatcaggactcagacatcctgcctctgacttcaagtttagtactttgttttgaaacagagtctcgctctgtcacctgggttggagtgcatggcacagtcttggctcactgccgccttgaccttatgagctcaattgatcctctcacctcagcttccctagtagctgggactgcaggtgtgcaccaccacaccaggctaatttttgtactttttgtagagacagggtctcattatgttgcccaggctggtctcaaactcctggactcaggtgatctgccctcctgggcct

SEQ ID NO: 56151 - DNA, 1182 bp, Homo sapiens
tttcctgggagggataatcctgggatcctgcttttcagtttttccaaaactcgaggacagaaatgtcctcaggagagcagagctgtctctttgtgacttcgccctcatcctttagattctgagttgtatccttgatttgcattttggttcaggcagagtcttgctccagcagcagcccctgccttcattcccttgaggggaacagtggcccagcagctggtgcaaggaaagttctttgtcttgggcatgcacttgtgtggtggaaattacctaatttttgctttggctgaaggtaggtctttcagtgcttgagctcacatctggctggtgggagctactttgtcaggtatcagaagaacctaatgtgtgcagagactggcccaaagtccagcccccttgtttgcacaaaccggctgtcatatgatgaataatcaggctttgggtcagaaataattgaaaaagatcttccctttgtaatttttgctttgtcaaactttatcaggatccctgggggcaagggaagctctttgtttgtggcaggcagctgcatgtattccctggctaagaagaatgggctacacatacttttccatctgctgaaagattttagcctgaggtttttttcatcctccctacaagactttcaaggccctttcaaggccgcataacatctctccaccccctcttgtttctattttctcatggaacgctagaaatcttttcttctttcgcttcgttccttcttcctcttctcctttcttcattccttcctttttctccctccctttctttttctctctccctccccctccctttcaccttcctctccctctccctgtccttctctttctaagatttgagtgttaggagaataatgtttcaaagttggttgctttcatctgttttaactaccaattttatttttctttgaacaggtggtgctagaaaagccaaatggctttagtcagagtcccacagccctgtacagcagcccacctgaggtaggtaacagaggacaccatggtggctccgcttagccaggggcaggattgcctcctccccatccttttgtttattgctttctctctctctctctctctcattaaatacaagagtagtagttgacataaaaattcaaacacagagaaatacaaagagtagaaattctccttccccaatctc

SEQ ID NO: 56152 - DNA, 1030 bp, Homo sapiens
gaacttcggagcaacaatgctgactgccaagcagaacgagaaaagtaagggcttggctcttgttcacggtgaagttgggttgcagggaggggagggcaggccatacagcctgttgctcctgtggtggcctggtctggggaggaagctggtgctgatgtcagatcttccagctctgactcaccgtgagcttgctcagggtggagccccacccaagagataccatttgggaggccgccatctccagggagttcattttccatggggtaataacctaaagaaaaggctttcacagttttagagccaagggcaagcaagagctggtggagcatctgctgttgctgtgtgtcattccacagattagtgcagtggatatgttatgccttcgtttcctccccaccgaaacaaaaattgactgtaaactgtttgagggtaaaattgattaacagtcatgctgatgaaaaatggaatgagcagcttcatgaggagatactgaacttcctgttacttgaagcaatgcagatagaaactgagaaccacctgtcagcagggtcccgtaggtgatcactgagatcctttctacctccaaggtgagagggttttgcaaattccctctgatcagaggaaatcagaggccccagacaaccaatgaagcctacagagcaaagattgtgccttctagaacttcaggaatttggaagttatgctgttggcaattaataaataagacctcaaatggtaaatcacatttaacatcagcatatttggtttgatcttcattgtgtaaggtggaccttttttagttcaacaagacattatctgaagggccttttaaggaattccaagatgaacagacacaattcttgcccttcagggcccctcagtcttggaggcattttctctcctttaggataacctagatttgaccttcctggcatggaaaatacacgtgtcatattgtagcctcctttctgactggactttatatcagaattaatatcagaattagtcagcactccttcctcggtgggta

SEQ ID NO: 56153 - DNA, 1007 bp, Homo sapiens
agcccaattagagtagaacctgttaacacaagcccagggaggtccatgaatggcttctagagatgtatgaaccacctgaaatggtaggaaaaatttagttataatgtttgcatatttctagggagagggtattttgcctctaagagattcagaaaaggacccatgatcttgacaaaatcgagaatcacagctatatccacttctcagttgtttaactgcccctctcttttcttcacccttgctacaagacacatgtatcatgccccaaatcttcccctagttgtcactgataattactgttttaaagcacttggaacccaagtgatcagccagcactgcagtgtaagattccagaggccaatgtgaagattccaggggctctgtgaagggtgggccacaacacagctgttcccagcacaactcagtgtttccaaccttcttttcagtattaggatatccaagccgcctagcccgaagcccatgcctgtcatccgagtggtggaaacctgagctgcctggagatggttgctgccattgctgctgcctctgcctcggagaagcccactgcccctgttggctgttaacactgcctttgacttcctgactgtcccctggctgcacccaggacttcgggctcctgtgtctcaccattcccaagcccctggccactctaagctgggcagacggagcacgagcacctattcaaggcactgcagccctttggaagacattgtcctgcaagcaggagccagggcaatatctatattcctacagtgactatttttctctgtagagagcctcccttctgttgtagactggactctggctgtgccataagccaggccttcatcagattgggagaggtgacaagatttgcctcagccctaaaagctggagacacagatgtccagagtgattggagaatgtcctgggggaatgaagttccttccacaaacacagctcagttcttagcaacaaactgtttgtttttctacttgctccatctg

SEQ ID NO: 56154 - DNA, 1092 bp, Homo sapiens
atggtgtccactcattctgtttcctcacctcttccacctcaagaaatggttggttttaacctgggagagttgattgaaaaaaaaaaaaagaaatagttgctcacctaggccagtgtttggagacagtatacctttcctctgtcctttctgtaaatagatgctttcttgtttcattaatgtcctacatactgtttcctagtattcctagtattgtctgacaatatattctttttttttccttgagatggagttttgatcgtcacccaggctggagtgcagtggcgcgatctcggctcactgcaacctccgcctcccgggttcaagcgattctcctgcctcagcctcctgagtagctgggattacaggcatgtgtcatcatgaccagctaattttgtatttttagtagagacgggtttcaccatgttggccaggctggtctgaaactcctgacctcaggtgatccgcccgcctcggcctcccaaagtgctgggattacaataatgactttcagatttcttatacttgggcacctaattattttctttctagataactcaaaatttgtggctgatgttttcttccaatagaaggtctcagaattgtcactttcctttccctttggaagttaattttggactcagcttcttatttttaaatttaaaactaaagcatttataattataaatttatgatgaagttctacattatttactcttcacaggatctaaaggaactaaaccaaaaagaataattctgtaggagactatagttaatatgatctatctttgcagatacacgcacacatcccaacatacatagttagtggcttcttgcctttattgtggcttctgcccaagagcctaggtataaactgtaaaggagacctcagataatcccctaggaaaggtagaaggacttgccttaggctcaggttccagactaggaagctgggaaatctttgccttctagagaaaaaacattactttttggcacatcctttgtggtaagtagagaactttgtcacttttagtgggcaggggaaaagaatactctgcctagaagacctctctggaaggttgtgataatcagaaa

SEQ ID NO: 56155 - DNA, 1688 bp, Homo sapiens
tcttgaaataaagatggatggttaagaggtagcacaagttaatattaatagttataataatcattttactgctttgcagcgtgtatagtgtgttatagtttgtagttttatttatttatttatttatttatttatttagagacagcgtttcactcttgttgcccaggctggagtgcagtggtgcgatctcggctcactgcaacctccgcctcccgggttcaagcaattcccctgcctcagcttcccaagcagctgggattacaggcatgtgccaccacgcccatctaatttttgtatttttagtagagacggggtttctccatgttggtcaggccaggctggtctcaaactccccacctcaggtgatcagcccgcctcggcctcccaaagtgctgggattacaggcatgagccactgcgcccagtcagtctgtagtgtttttacatctgatcttcacacagtcctgtgagataggaagattataagctcatcaagggcagggactacatcaaatactatgtatttgttgtatccctagccaaatgtctggtggcccatggaaagtattcttcagtaaatacttgccaaatgaatatatgagtattatccctattttataagacaggaaatggaaactgagtgttgtaccaatgaatggcaaccagaattaaatccagatctttggattctagatcttgaatattttctctttttagagctgtttttttttttttttttttttttaaagagataggagtctcactatgttgcccaggctgtacttgaattctgggctcaagtgatcctcccacctcagccttccgagtagctggcactacaggcatgcactaccacacctggctaatttttttgtactttttttttttttttgtagagatggggttgccatgttgcccagtgtggtcttgaacccctggcctcaagtgatctgcccactttggcctcctaaaccgctggcattgcaggcttgagcacctggctgcttaaaattcagttacattcatataaacgtcgatagtggttgaactttggttctactattgtgaaatgtaactattttatatctttatttactcactattacccattgttaaattggatgagagacaggggactaaagcaggcattctttgcctttattattgctatctttaccctgttggttatcagtgaagacagcagaacaatcatttttaaattccttttaatttcacaggtagttgaggttgcaaacaaataaaactaaatttgaaaatagcattaccttcccctcagaaatcacttccacagattgctgtaaccaggaaaatatattttattagtagcataacaatttgtctgggtcttttaacttattgtgaagaacagttctttttccatccaccactgaccagtttttttcagatgagggcctgttaccatgctctcaaagataattatttttctaggtaagtcccattgggaataattcttatgaccttgtagataagcaaagagacttaattgacaagcagacacttaacaatttatgatcactgctcaaaatgctttttgagcataatctttggcaggttcattcattagatgatggcattgctgacaaaaggatattgtggtggtttaggttagagccatttaggttcattcttttcttccacctcagctat

SEQ ID NO: 56156 - DNA, 1059 bp, Homo sapiens
agcttctcagttatcctttctctttctcttctgttttaaatgactatacttactattgtgtttacaattgataactttcatccttgtgtgctacaagcctgttgtgttctagctctactttcctccaagtctgttcctctgatttgaagatgctttttttttttttgtgacagagtcttgctctgtcgcctaggctggagagcagtggcacgatctcggctcactgcaacctcagcctcccaggttcaagcaattctcctgccttagcctcctgagtagctgggattacaggtgtgcaccaccatgcccagctgaattgtttgtatttttagtagagaccgggtttcaccatgctggccaggctggtcttgaactcatgacctcgtagtccacccacctcggcctcccaaagtactgggattacaggcataagccactgcacctggccgaagatgcttcttttaatttaaatcttttattttggcatacagcatgttgggagctgagtggactgaagacgggggggaaacttaatgtggtactaaagtttacacttaatacctaccttcaaaatgaaaattcatgtgaagctccttcaaataagtttaagacctggtggtgatcacaaagtgaattgttgctttctttcataatattcgtactccagggttaaattttgtggtatggtattagtcaaatgctaggtagtatgtgtgtagtctcttgtttattatttattgctccctgccaactaaataaggttctcataatagttgaggaaatgtgcctttctgcaaggtattgagttgctgaataaggagttgtatttgagtactcttatgtgtacttcctcagtgaacttccactgatacgaaaacatcttttaagaaatggtctgtttttgcttaagctgtctgaaactttttagattcttgtgtcaaacctcagagcaagaccagaatgataggcctatgttttctacaggcctgatacacaaggaattagcttacttccctctggaaaagtacaggcagtctgcagagagtcagctgctctggt

SEQ ID NO: 56157 - DNA, 1880 bp, Homo sapiens
aagtttccatcagtgaaaggggctctttatttttttctatagctagcttattgtaaaattactgatttttttgtatataagttagacttgtaggatgtgaaatgtcaggagtgctgaatttactggctagattgttaaaccctaaattaaatcccaggaggctagctggggggtctcctgactgttctgtttatataaatggatatttcagataccagactctgacagagacaatttcagtgactgaaaagtttatggaaggcttgttactaaatttagtatcatttttcaggaaggaaaatccctaatggtttggaacaggactgaaaaagaatttaactctaaagggtagataagctttaaatgttaaattgattagaggtcaggtgtgtatttcctacctctcttgggatagccatgggagggaacctccaggcctgctgcccagtggtttttgctgagagagcagctggatcagcattctggaaggtagtttggtttgctgagggagtcttgtgagactcagcatctttcttgacaaaatacttcatctaaaccttgtactttgtttgccttatttcagccttttgtacacagcaaaacaggaaggaaaattagtaggctgaccatataattataggtgtatattttttagtttggactgattacacaggactctaaatgagatagcatagagcaggaaaaaagttgatggaatcccaagaggttaattgaattggaaactagtgtatgtgaagagtaataccatttagctcccaaagtaatgaaacttggcataaaggaaaattaagttgactgatttgagatatggagagaaattggatgtaaatgtaaaggaattatcttcagtcataactttttttgagtctctatttacaaattaagagaatttattttgtgaaggttcttttaacagaattcctttgaggtttaaaaaggacaaagtacaattcaagtggcagggctgtcaaaagccactttgattgaattgtatacatgcttagttagaatgaggaaattggattgtttgactgaaaaagctttgtttcctcctcagcttcagcctctttccatgtgcgttcctgaagctatgtgtgggatattagtatagaggaaggggaggtcttctcacctctttccatttttccccccgccataagttcacaaagtttttcacattagaaactgttaaaacataaacaacttttctggaaccaaattaatcttttgacttcatggttcataccgtgtgacactggagtttgggcaggagggtggagatacaaggtgtttggacccttctggtttatgggattgtctttttccctttttccccttaggaaccacgtgaatgttgagggggcgacacacaagcaggtggtggacctgattcgagcaggcgagaaggaattgatcttgacagtgttatctgtacctcctcatgaggcagataacctagatcccagtgacgactcgttgggacaatcattttatgattacacagaaaagcaagcagtgcccatatcggtccccagatacaaacatgtggagcagaatggtgagaagtttgtggtgagtgtcagcccaactcgatcctcgaacatctagctttgtttcccctagtcttataattatgaaactattatagtggtagataaaaggctgcaacctaggtcagtttgtctaccaggaggatgagttcacacataaataaaagacactgaccctgatttattgcagggggtgaattacagtagtggaaaagagtcctactcagcttgagtataattccattttatttttagatagtttcaagtttgcattctggtttgtcgtaaacgtgtgagtttttgtttagt

SEQ ID NO: 56158 - DNA, 1007 bp, Homo sapiens
cttaatttttcttttggttgcaatatgctttatttgcctttaattatttgtggagtgttgatataatgagaaatgttcattattcttagtagaaaatgcagtgggttctgttagatgctggcaaacagactacaggttttaaagcttaacagttgactaaagttacagtctctaaaactgagatttatcctctgcataggaacgagctactaaacatttatggtaaattctttttagtgaagagataagaaaagcaaggaagctaaaagagttgcagaggatcaaataatgcttggttgcatctgtaattagctgtagataatggcatataggttttatttcagcatggacttctgtagtcttagaaccacacacagaatttagagttttatgcttcctaagtgctaactttgagtcataaggcatgtaagaagttgaaatcaaggtcacatcctaaaagtagagcagtctggatgttgagaccttttgggaattacctaaaaccttggaaacctgagaaaaggaataatactaccaattgtacctttgtttatttttatttttattatatatattttttaagacgaagtctcactctgtcccccagcctggggtacagtggtgtgatcttggctcactgcaatctctgcctcccgggttcaaacaattctgcctcagcctcccaagtagctgggattacaggtgcgcaccaccatgccctgctaagttttgtatttttagtagagatggtgtttcaccatgttggccaggctagtctcgaactcctgacctcaggtaatccacctgcctcagcctcccaaagtgctgggattacaggtatgagacactgcgcccagcccactaattgtacttttcaaatcaactttattgaacatagtttacctatattaacattcactcatgttaagtctccacttttacaagttttgacaaatgtacatagtcttataaccaccaccaccaccatgaagatttagaatattttc

SEQ ID NO: 56159 - DNA, 1505 bp, Homo sapiens
gtgatgcctaatggacttttttttttagacggagtctcgctctgtcgccaggctggagtgcagtggcacgatctcagctcaactgcatcctctgcctcctgggttcaagtgattctcctgcctcagcctcctgagtagctgggactataggcacatgccaccacgcccagctaatttttgtattttttagtagagacagggtttcaccatgttggccaggatggtctcgatctcttgacctcgtgatccgcccacctcggcctcccaaagtgctgggattacatggacctttatttttagggttatattatctgccagcaaacacatatagactcagcaatatgctgaattgatttgggaactaagtgggcaatattaagacattttaaatatttaagacattttcattaaaatgattcttggcttactgctgtatcctacatgaaaactttattcattttacaggtattcatagataggtttgctgagttgtaggtaatctagagtgcccttgttctaagcaggctaaaggtagatactaatacttctgtattgaattttttgttttgttttgttttgttttgttttgagacagagtctctctctgttgcccaggctggagtgcagtggtgtgaccttggctcactgcaacctctgcctcccaggttcaagcgattctcctgcctcggcctcccgagtagctgggactacagaaacgcaccacatgcccggctgatttttgtatttttagtagagacggggtttctccatgttggccaagctggtctcgaactcctgacctcaggtgatccgcccgtcttcaccttccaaagtgctgggattacaggcatgaaccactgcacctgaccctgtattgaaatttccttgttatctcactgcctccagatgatacatcaggagtctgtggatgtggatggtgaaacatttgtctagaggcgtgagccactgcacctggccctgtattgaaatttacttgttatctcagtgcctccaaatgatacatcaggagtctgtggatgtggatggtgaaacatttgtttgtctaggaaggcagggaaatgacacagatctcctcaataagatagctcatcttctggctcagggaagagacctttccttgctacattataaagttatattatttggtagctgttcagtaggtttttctctaaaatactggcttatagaataacagttttacgtgatatgtagtcattctgtttccttgtaactaactgacctagttgaatattttaaaaacttttgtagggagccttatcgtgaagagaaaccattttccccatagaaggtagtggaacttctttatctgtttttagctttttctaacatggactggcctctctgaacaaagcccttgggaaatgagaaagggtacaatttttaaaaatcaaacgaagtaaagtcaccagtttaatttaccattctcatgagagtgtcaggaaattaactttcttaaatttaga

SEQ ID NO: 56160 - DNA, 1067 bp, Homo sapiens
aaaggaaaaatggatgagactcaggtatccattttttcttttaacaatctcctgattatttcagggttcagaaagaaacttagtatatctcttgatccagtctatatgcctgaccattaataccagagaatatacatcgaaactactgctttcagttgttttctcctctcacttgtgaattctgaatggggaaagggaagcgaatcaaaaatctcatctgtgtttgacctagactgtttcacgcaagtttcctgttttgaaatgtgaacacgttggcttcaacatgtttctttccttcctgcttatcttaaagattaacttctgctgcagccctgaagtcagctttatgacttgtaaatgtattgatttttttcccgttttcattggaactcacttcttctctaccacgttttaggttattgtctagctagcttgttacagggagagtgaagatatactgggccataaattatttctctatgtcttttcccccagaactacaatggtgtgtccgacgtagagctgagagtagcattaccagatggaacaacggttacagtcagggttaaaaagaacagtactacagaccaagtatatcaggtaaattaaatgaacacgtagacttgacattggatggtgtgaagctaaggaagatagattaaataagtcaatacatataaagtgcttagggtgtctggcacataatccgtttattaaatgttagctactattgttattattaatgtgaaagtactttgccctccttaaaagaaaggtacggtaaatatcccaggttgtagtagttgtgattaacgcctcctttttttttggagatggagtgttgctctgtcacccaggctggagtgcagtggcgcaatctccgctcactgcaacctctgcctcctgggttcaagcgattctcctgcctcagcctcctgagtagctgggactacaggtgcccgccaccacacccagctaatttttgtatttttagtagagacacggggtctcaccatgttggccagaatggtcttgatctcctgatctcatgatccacccacctcggc

SEQ ID NO: 56161 - DNA, 2089 bp, Homo sapiens
tagcactattgctttggtattgcctaataactactccatagtcacatttttccaattgtctaaaaatgattttttacatttggtttgttaaaatctgaatctaaacaaggtccttagatcacatttgattttttttttttttttgagacggagtcttgctctgtcgcccagactggagtgcagtggtgcgatcttggctcactgcaagctccacttcctgggttcacgctattctcctgcctcagcctcccgagcagctgggactacaggcgcccaccaccacgcccggctaattttttgtatttttggtagagatggggtttcactgtgttagccaggatggtctgaatctcctgacctcatgatcctcctgcattggcctcccaaagtgctgggattacaggcatgagccaccaccccggcctcacatttgatttttatgtttgttttaatatagaacagtccccacttctccccattttttttttcatgccattgttttgttgcagaaatgggtcagtgtcctgtggaatgacccatattctgaatatatctgtttgttttctggtggtgtcatttaataatgtccttctgtgtctctatattttctataaatggaagtttgctctagaggctcaattagattcaggttctgcttttttgataatacttcataattggtcctgtatactttatattgcttctcaacaacaagtacacaatactgggttatcccattttagtggtactgaggttaaccagtaggtttaggtggtgaaatctgatgttttctttgtaaaattcaccactgatctttgatcaaatgaatcgatccattgatgattattgccttaaccagtgatttcattaaagattacaaagtgctgattttctaatactctcatttcttccaccgattagctagaattcttctgaaaataacttttccttgtcaactaacgctatttaattatcttgaaatagataatttcccagtttgtgggaaagacaggatacatatttaagcttttcctttcattgctgattttcagagtaaatatatcattatatataaatataattatatatattaataacatatgatatgttacatattaaacaatatatactttatatataattatataatatactaaataatataataatatacaaataatatatatttaatatataatgcattatgaaatagtatatattatatataataatttagtctcaggtttttagattcagtgtgatttaatcgataacatatattatctttttgatgctcagattgttccatctttggccaatgaatgctccttcatgtctgctcctgtatgcttttgatgcaacctagtattttcatattatccttgctttttggtacaataagatgtcctggcctcatctttgtatatttcttaccctagatatctagaataggacatttccctaaggagtcctattcttttagtgagaaactgtatttagagatcatgatctgcgtgctgggtgtaatcattgcctgtgtatgccttttcaatggcctttaatcctaacttgatcagaattttcagggagacaagcaggtttctgggtactaatgcttatatttctcttttgtagcaaacattaaaaaacctatcccccatacatttattcattcactgtattttatggcaaatgatatatgcaggatctcaggcatttatgaaattatacaatggtagggaatttcaagaaaagtactatttttacagctttctgatctttttgttttgttttgattgcttttttccagtgttcctctagcaaggcttaggttttttacactttcctcccaactctgttactgagacttctagctataaactattttctaaaccttgaaagcattttaatttctatccagtgcaatatacaatggtaatttagaatgcttataatgtccagttcctctatcacataatggatgaacctaggcctcatatgtgagcagatatgagaagaagggatataatcacatttggcttactgagatactaataatcaacagttttatctttgttttatcaacaaa

SEQ ID NO: 56162 - DNA, 1014 bp, Homo sapiens
ggaggctgaggcaagagaatcgcttgaacctgggaggcggaggtttcagtgagtcgagattgtgccactgcactccagcctgggtgacagagccagactctgtctcaaaacaaacaaaaaaaccccatcagatcttgtgagaactccctcactatcatgagaccagcatggggaaaccagaccatgatccagtcacctcccaccgggtccctccctcgacatatggggactacaatttgagatgagatttgagtggaggcacagagccagaccatatccctggacatgtggcagagttcactggtaatgatggtggtccaagtggataagagattttctgaaaatgcgtctgtgtctgttttcatcgagaatgtacataataatgatttttacactcctttctgctctacttctgttttggtgataggcagtcgatgatgtgaagaaaggttacatcaaagcagaagaaaagtcctatcaattacagaagctatacgaacaaagaaaaatggtcatggtaagtttatgtccccataatccctttaaaaatgccccttcctacctttaaaacctatagtcctagtcatttttgaaaggattacaacctggttagtggcttaactaattttaaaaaaggaggggaatagggaccttgatgcaaagtccattgtgtttctccatttaacacacaaagatcttgaattactgtgtattagtacataattttattattattttggggggtggggtgggggagggacagagtcttgctctgttgcccaggctgaagtgcagtgtcgcgatctaggctcactgcaacctttgcctcctgggttcaagcgattctcctgcctcagcttcccgagtagctgggactacaggcatgtgccaccacacccagctaatttttgtatttgtagtagagacagggttttgccatgttggccaggctggtctcgaactcttgacctcaggtgatccacctgcctcgacctcccaaagtgctgggattac

SEQ ID NO: 56163 - DNA, 1009 bp, Homo sapiens
catgcctgtaacccttgcactttcggtggctgaggtgggaggattagttgagcccaggagttcaagaccagcgtgcgtaacatagggagaccctgtctctatagaaaatcaaaaaattagctgggtatggtggtgtgtgcctgtggtcccagctacttgggaggctgaggcaggaggatcactggaggctaaggtgggaggattgcttgagccctggaggttgaggtttcagtgagccaagatcatgctactgcactccagcctaagtgacagagcaagacctggtctcaaaaaataaaaagaaaagaattgtctcagagtcctttcccaacttagagatgggtgtgagaccagaggccaggtcttcaggttgttgggtgagaatactctttgttctttttcttgcaccacatctcaatagctctttattgtgtttaataccatagtaaccctgtttcctgtttctccttccttttttttttttttttttttttttttagtacctcaacatgctaaggacttgtgagggctacaatgaaatcatctttccccactgtgcctgtgactccaggaggaaggggcacgttatcacagccatcagcatcacgcactttaaactgcatgcctgcactgaagaaggacagctggaggtgagttttcagcatagggctctggctgcgaggactggagatactttgatgctcacttgcttgtgacgttttaattccattttagggggaaatgaaatcaaaactgtattttgactggggcaaataaacaggcatggaatccacactgatcctcaacttcattggctgcttccactgatttgtattcttctatcacagtcctttctctgaagcgatgcagacatccattcatttctcttctgtctcctggttcagaaccccctacctcagttccccagcactctgaaacacagactgtaccttactcccttgtcttggttgtccagaaccaggtaattgcatttgaatgggatgagatg

SEQ ID NO: 56164 - DNA, 1733 bp, Homo sapiens
tttctttaaaatttataggcctgtggccaaatacctgggaccctcacctccatctctgtctttctaggaatattagttagagactgattatctcatgtgagccaggacattcttccagcaaggttggcctctggatggtgaacgggctgtgcaaaaaagccctgcttcttcccttgtctagagggtggacattggctacaggctcttccatctctcatgacttcatggaccctcctctgccagttttttaaatcagatcaccctccatgttgttcctgacccacaggggaagctgtcctcagttgtagccgtcttgactggatgagtcctggcagtctttctaggcgaaccaagaatgtttgtgtgagggaaggtgtttgctgttgctttactgctgtctgtatgtgccagtgctggaacagaatttggaagattctgaataattagttacttattctcaaagaaaatctttgaaagaatcaggaggtcaagtcaagaacatgaaaatttatattttagtacagtagaaagaacattgggctctgggaattttatctgggttttctcctggcttttttttccctctgtgtaattttgggtaaatcagcctccctagctttcagttttctcttctgtgaaacaggaagactgaaccacgtaattaatatccaaggtcccttccggctctaaaaggctatgattctagatgagaagttatatcaagaaagatgtggccaatcagattgagtcatccaggcatacctttttagcttctgtttgtggagttgtctccagataagaggagatgtgccttcccaataactctttttttttttcctttcagaacattttccagatggcgaggtcacagcagagagatgtggccacctagcctttccttatccccttcccttcccttcacccccatcctcttactcctttcatgtcccatttcagacagagtaaccattaacaaaaaagaagagaaaaagttaaagtcgttatattcaaaagccctaaactaaatattattaataaccccctctgaatttcatgtctctggaattgaggtggtagtgaacagcagatcggtcagcaccagaagtcaactgagttaaggcaggaaaagaaataagcccaaccaacttgccaaaggtatctttgtcctttcacctgggcctcataccaacagcctctccttgtactatatttttaaaactggaactatgaacttcatccatttgcactgttcagacatatatatgtatgtatgtaaaaattatatatacacaaattagctgcacgtatatacatatatatatttctttttaaatttcatattgatggcagtaccttttttagcttgtgtttttacacacctttcactagaatccatgacctccctcgtgctctctttcttttgaaacaaactttaaaaaggaaaaaaaagcattttacagggaaaaatacctctcctcatgaaggacttgaaaagtttacaacctgcttggatttttgcccctttttttgtattgagtatagattccggctcatgggttgccatagagtctaggaacaaggagtatagtttctttatcttccaagagggtgctggggaggagaaagaggtgtgtttctcaaggttaacaggctgtagttctgcagggagagcctgaagtcctggtatgggctcttgattctgtgacaatttttttgatccatctatttctctc

SEQ ID NO: 56165 - DNA, 2078 bp, Homo sapiens
aggtagttggcctgttggcagaatttatttaggaacagcccttttgaaagtgtcccagtaacaacgcacccagctgcagcaaggaggtggggaaggagggcaccccaaaggacagcgccttcttctcttccacccatgcacggccttgggtgatggaggcgggttccctgtggctgcgtggatcccataggatcaagcccttctttgcatgaagcagtgttgtgactcttctctctccccttcctctgcacttcctttctgtaatccctactgttcttcttagtcccagcttctgcccagggaggcttctacccagacttcttttgcaatttgtccctgggaagagggggtctcccagtgcccccagcttcatcccagcagaaccagcaggatcctcctggtctctcactggccttcctccacacttggtttctatcctcaggggtagaagctcagagctttttatggcccaggagaaaatgtagaccctgagaaacctgtccctgcagaaaggttcccttgggccatgctttgggccctctgctctttatatgtttattctattctccatttttccaccccgtccttaccctaggcctaaacacaggtacagatatgtgcatgctcagggcagctcctaggcctggactgagctctcaggggggaattagataaatattccaacatcctcatgcctggcccatttagtttcatcctttagttacccaggccagtagctttgggttatcccttcctgtagctccaaacccagcacttggagcagcaaaatagggcactgacaggagatgaaactctctcctatctcagaatttgccaacttctgggctgggctcctaggaggtagttttcttgaaggggactgcatcctagttgacctgaattttccagaccaggagggactgctgtgctctcccttctcgccatcatactgtttggctagattcattcagcagtagaagctgtttgatctgttgaccccagcatactgctgtttcttcaccagcttcattgtgtcacagtagcttcctttgggaggatgatgtgatagaacactcagagagagggagggagaagagagatagtgggtatgcttctctagctccccatcttccaggtccacctcttgacttcctgttcccctaaacctgagcacatcacgccaggcctctttgctgccaggacagcatcagctcactcctcagcaataatctagggtatgtgggaaggtcagggctgtggtaaggaatagaatcaaagaggggagtgatacggggtgggggcacttggccgcctgctaaacttggacattaattttatatcatgacccccttttaagccagtgagctgggcttcagtttttcccaggccatgcacatttaatttatttcagagaaactctaattgtattttcactgcagtatcttgtattttttatttgtgatttaagaaatgtgaagagaaaatacacagacacaataatggctaacattgtttctttcattccttgttctagagctaaccactctaaaattgtttggtaatgtcacttagtgtaattaattgtaacatattcttttaaataaattgatttattgatcaaacacttctttggtttcctagactacaaatcctttgggttgtgtgggaagaagtgaactgggacctttgagatttgagtcagagtggtcagtctgaaaagaagaaacatctaaccagttttcccaggtaactagtgtggcagttttttgagtgcagggaatggagaagggtgaggaaagaagccacaggaggcccttggtttgcagttctcttcccagtggctcctttgaaaattccttcttctccttcagatctcagaggtgattgagcttacccctcccatctgcaagcttgcacaaaaatcctttgaagaatcacaggattcctttctctgccatgcagatagagcctggcagagcctttggtacagatcttagcaatggaccctcctctccacccccagcaacaggtatatactttttcaggtaaatcgggaaagtttttctctttgggatctg

SEQ ID NO: 56166 - DNA, 1059 bp, Homo sapiens
gaggctgagacaggaggatcccctgaaccaggagttcaaggttgcagtgagctatgatctcaccatcacactccagcttgagtgacagagtgagaccctgtttcaaagtaaataagtaaaataaataaactatagcctgcctcacaaggttgttaggaggtaaaatgaggaaatgcacaataaggacttggaacagaatcacatatggagcagtggttagtaaatggtggtgtcacaactggctcccagtatccacactggcctctgtgcagaaatggaggtccagatgtgagactgcaagtcctcagccttcagagggacagagctggatacaggggagagcccccgacaggggagatctccttgtgccgaactctgcaggacattccagaattaagccccaaagaagggctgaaggacaggatcatgaagccatgaacaaggcctggatgctgctcaaaagcaagggcccggccttccctgatgggattttctctctcaaacctcattctctacctccctcccccttcccagtgtgggtagggaacaatcccctaccctcaaccttccaagactcttatttgatgcttttaaacttttttctttatttagacagaaaagaccaactctttaaaagtaaaatgcaataaataaataagttaagcatagagaactgtctgaaactgactccccggtctccccttaccacccccacccccaccccattttcttttccctaaaacctcttcctaaagaaaatgatcaggtaataaaccccttgacccctccccacacccctcctcccaatacccaattaccccccaaagcaaagggagaaattaagagagagaaaaaaatccaagggcaacattgtctaaactcccagaaagagagatggcagcgtccgggccaggccgggcgggctggataacgcacgggtggtagtggtatttacacagagggaaccagcagagactgtaaacatttttaggggttcaggggaaggtcttttcctcgtgaaaggaggagggtctctgtggctgactggcagagaggcag

SEQ ID NO: 56167 - DNA, 1044 bp, Homo sapiens
tacaggcacacgccaccgtgcctggctaatttttgtattttagtagagacagggtttccccatgttggccaggctggtctcaaactcctgacctcaggtgatccacctgcctcagcctcccaaagtgctgggattacaggcataagccactgtgcccagccctagctctcctttttctgactgggagaaaagtcagggtgaaaagctgggattaggtggtgctaaatcttacttacctgactgatctctgagaattcccattgttttgtgtgcaggtaaatgggcttgatactgtgagagtgcctatgtctgtcgtgaactttgagaagcccaagaccaaaagatataagtactggttagcccagcaagctgccaaggctatggcccccaccagcccccagatctaaatctactctccctccaaggcagcaaagcagaatcgggagcagtggagcagaaatgtgcaagcaccctgatctcactcccagctctgaccaaatacagaattttagagaacatctgaagacatcagactgcactgcgtatacatgttgaattcttcatttttgccatctttaactgtcatcactggggcagggaagtcctgttccagaagtaccaggctgtagatttgataagctagatgcagtagaccgaaaccatccaaaacctgtttagcttcttcctccattggagtttattgggacaaacaggagagccagccattgtctccagtacttgcctcattctcatcatccaaactgaacatttgtatcccaagcagaaataaagagaatatgttctttttaagtaagtgttgcttactggtcttgagtagatgagacaggacatccaactgagatttccttgagtcacagaggtttgctgctaaaaaggaaagaagagaatatcttagactgcatcccacagttactgtggtatgaacaaattgtgctgaacaagttgatgatgtgtttggtcttaacacttactcttcttagatacattgatgtagtcatcaatgtgaataagcacaatggattc

SEQ ID NO: 56168 - DNA, 1100 bp, Homo sapiens
ttggagagaacatggacacatgagaagataatcagtacaggcacccgccaccatgcccggctaactgttgtatttttggtagagacagggtttcgccatgttggccaggctggtttcaaactcctgggctgaagtgacccactttgggagacccaccttggcctcccaaagtgctgggattacaggcatgagccatcttgcttggcttgcataccctgtgaccctgacatgtttcctctcctttgactcaaactcataattcctttcagacagtgaaatttctaaaaagctgtcgcctggaggtagggatgaagaacaatgtcaaatgggagctgaaccctgaaatagttgcccgccacttctttaagaatgtgagtgagtgttcccaaaaaccactctacccctgaggtggaagctgcctctggaaaggaggcctgggattgatccctttgttaggaaggggtgtgatcatccagttgtagttaaggaaagtattcttggttagtttgcaggaatatgggaaggaaatggctaaggactaaggatggtcacatagaatttgaagactgataggaaaaggtggtggtttccatttatttcctgtctacctagggaaatgctggggatttgtgactcactggagaattgttacttttgtggatgaagtggttttggcctcaagccctgtttctctttgtgaatctacctccctttctgagaaatcagaattgaatttctctactaccgtctatgaaggtgtatgcccttctctcccatggaatcagccagagtagacaccccagttttattcatccctgtgcagggaatcctgtaaccctctttatgaggttccctagagtggcagtcatgaaaacagagttcatttgagctgagatttttttttttttttttttttttgcagcttggtgttgtggttgccccacatacattaaagttaccagaagagcctatcacacggtggggcgagtattggtgtgaggtgacggtgagtgttttgcatactttcttttttcttttctttctccttttcccccactttttcctttttttcctttctcttaaagacagggttttgtttc

SEQ ID NO: 56169 - DNA, 1027 bp, Homo sapiens
atggataaggggtcagcccttatgtcacctcaggactccactctgctgcttatctaccctaatcccttatccaaggctcatattcgactagtatgcatgttatggctgtatgaatgattaaaaaatagaacttgaagacttctgtactggttggccaaaagccctgcctgagcacttgtgcccacccaccctgctcctctgtggacactccccttcccccaaaatccagcaagtaaagagttggtatctgactcttccaaggctctgatccagtggtgacctgattagttggttcccagttcataccagttgagtatttttattatcatccctacccttaataacccaggatccttgtagggtaggaattgcaaactaattgtctaggccccttcaggggcctagacagcttatggaaattagtggagtggcagggtagggctgtagcaaaataggaaagctcacacgttatctaaaggaagtccacacaactcaattccatccagttccatgcaagaatgcagacttgatggtgctgtatcgtatgatttttgaacagaaactggaaagacagttttgtagtaaatctcaccaattttaaaaaatatcgactactgggccgggcacggtggctcacgtctgtaatcccagcgctttgggaggccgaggcgggcggatcacgaggtcaggagatcgagaccatcctggctaacacgatgaaactctgtctgtactaaaaatacaaaaaattagccgggcgtggtggcaggcgcctgtattcccagctacacgggaggctgaggcaggagaatggcgtgaacccaggaggcggagcttgcagtgagctgagatcgtgccactgcactccagcctgggcaacatagcgagactccaactcaaaaaaaaaaaaaaatcaactactaaaaaattgttgataaaaaaacaacattgtaagcaaaatttggttctgggactgccactttgagacctctgcatatttatccattcaacaaatatttattgaggg

SEQ ID NO: 56170 - DNA, 1184 bp, Homo sapiens
gaggcctgtggttgactgctgggccagagcccgagttcccactgcggcttggcctaatctccctcccgcttacttttttgggtggcccacgttggtttctcccatctctggtcttaggccactgaaaagagagatgccacagtgttggagggggaggtgttgggcaagaacagagtccacagggcccgagtgctcctctcagccttgccaggcccactggtcttctcagcctgacctctgctcaggagtaacttgaatacacagtgctttccattggtgatatcatttcattactctctgttacctacaatcaccccatggacaggcaataatacttttatcctgatcttgctgacaagaaaacgtaggtctagagggagaatctaagtgactagaagtatgggggccccaacgttttctgcccctgttccagacacccagtgccctcttattctctcttcccctccatgtattaaaatctgctcttaatttactggaaagaacctggaaaactcacttaccgcctggtcctggggggaccacagcttacagtgtgagcactggaagcttgctgctgggcaggcacgtgtggctgggggttgggtgaggaattgagtgctaatgaagggatttcagatacccatgtgccctgtccccgtcagggtcagctactgcctctgactcacctcaagtctggcctgagggatgatggtttaagaatgatggaaataatattttggggaatggcgggcaagccatggtctccctgcccacttcacatcaacaggccctacatgtgaccagtgtccaggccagggactggaggtgagatcacagcaatgtgcattcgccctccagagaggctgccacttcttttgcccctttggtgggagacacgtcatagattaaaaggggctttggcccttctcttcacttttctggcctgtcccgccccagggctccccactcagaggggaggcagcaggtcagtgatggtggaaaagagacccatgtgctctgggaaatgctaaaaacacctacagtaaccagggatcccaagctttgcccagctacctttcaaggaagagctgggagaaggcctcctgtggtcccatgaagctcagcagagagtcgtgggcattgacaggaacagggcaaagcagagatgagcttagggccagcag

SEQ ID NO: 56171 - DNA, 1223 bp, Homo sapiens
caagaaaacttacagtcatggcagaaggcaaagcaggagcaggcacttcacatggacacagcaagagcaagagtgcaaggcacaaggtactatacacttttaaacaaccagatctcatgagaactcactatcatgaggacagtaccgaggaggatggtgctaaaccgtccatgagaaattcacccccatgatccattcacctcccaccagggcccacctccaactttggggattacatttcaatatgagatttgagcgggaacacacatccaaactatattccagtgttttttttttttttcctgtaatactttttccagctggctaatttctgcttatctaatcaatattcaagtcaaagaaccccttcctgaacccctaatcctagatgagtacttctcccttatcccctaacttcctgtgcatagccactggaagcactttcaacatggaagataatgcctgttcttaacctccatctccagtgtgctgggcttacctgtgcttgattaaagtctggaaaaaaagaatggaatcagcagacctgagcataatcctggctctgtcaatagctcgctgggtgatgttgagcaaatcattttccctctctcagtctctcattttcccaaggaggttggaccagatgatccctgaaattcccttccattttgaagtgacaagcttatggggagaagaaaagcagcaagataatcttagaaattgggagaatatgttatgaaatagaatgcacctcccattacttacttttctttttcttctgtcttttagaggtcattttcttctgaggaagtcattcttaaggactgttctgtccccaaccccagctggaacaaggacctaagactgctctttgaccagtttatgaagaaatgtgaagacggctcctggaaacgtttgccttcatataaacgtacacctactgaatggattcaagacttcaaaacccattttcttggtagaaacagccactttcccattaatatatctgagcatcaaatataaagctaagaacagattgaagtactagttactacctgaaaaaaagaaagaatataatgcaggattatggttctatagtcaccaattttatagaccagaaatcacaataaattttgcagattggagagcataaagcctattgtcaagaataagactgctcccaccctggcattcttatcaccattagcaagagtgaagaaagg

SEQ ID NO: 56172 - DNA, 1032 bp, Homo sapiens
agttcgctcctccctgataagagttgtcccaaagggtcgcttaaggaatctgccccacagcttcccccatagaaggatttcatgagcagatcaggacacttagcaaatgtaaaaataaaatctaactctcatttgacaagcagagaaagaaaagttaaataccagataagcttttgatttttgtattgtttgcatccccttgccctcaataaataaagttcttttttagttccaaatttgagacagaatgtttgttgttccctcagaaattcttgttccccaagaggcagcttgcccttgggcagccagcacacagcagagcttttcttacacagcagagcttttctcacagaactggcaaaatgagaaaacactcttcattcaggcttggagtctgacttctctaattgttctgcccttgtagctgtgtctatatgaaggactcaaacttgaaggattaggagaaggctctacaggaatagatggtaagtttataattactgggcacagttttgcccagttaaatcagtgcttttctagccagcactttgcatgcctgcaatgtctgaatccaattttcatagcaaagtgtcagcaaacctaaggcagaactaggagaaccaatcaggagagggtgtagcttgacaccttggtaataacatcacattagcatctattaagtcaactcccagatgtcaggaaatatggtaggcatgacttatacacggggcagtacacttttgttgaaaatgaagtgtcagtactgatgtcttgataatcaatgcaaaatgttcctcctagcccttttttgtgcctgttagaagcttcagggtatatgtgcatcaatgctatatgcttattaataacacagtactctatgcttttatggagaggtgatatatgaattccatgaattggcacatagcattgttccaagtaaataggtcaaagaagatggaatatttactttttttttttttttttgagacggaggcttgctctgtcacccaggctggagtgcagtggtgcaat

SEQ ID NO: 56173 - DNA, 1030 bp, Homo sapiens
ctgctgagggagggaggtccacttgttttctttctacagcagtttggctggggtttgtgggagagggccctgtgtgacgtggtttctctactgaaagggttcccttgctgtcttaataagtggaaccagaaagagatggaggaagagcaggcttgatgaaggatcttccaatcatagattaatttggcccggtgcagtgaaacagacagacgtgcctttggtacttggttcaccacctgtgctttggccgaaggaatggcgctgcccctagccgtggacactgctgcctgtccagcctcagtccagctctgcctaagtgaaaccaggagctctgccttgttggctggggtggaatgcagagcgctccaagccaggccagcacaggggagccctaagccagattctgggatgcattaagcccaccccgttttctgcccccacccagttccgtctctgcgggagcttctgcagggcgtggttagcacaaagggctccaggattctcccagtggtctgaggcctgtgactcagctgtgagaccatgtgggtgtggccggttgcagatactctcggtggatggtttggacagaacactccctgaaggaaaaggagaactgtgccatctcagagggcattttccaagaggaagtgagtcacacctggtctggctgccagtctgcaggagaggtttctcgactgaactgccggtgagggcagtaattagatctgcagggccttggcgagaccgcttttcgttatcggccagtatgcgcctggcagcctgcctcagccttacttgggaggtagcttttcccgctaagaggtttgcagttgttgcggatatttttccccagaagcttgagtttcagtctccaggaatggagttttatgttgtgcgttttaggtgaggccaggctcatggaaacacccagtcggtgatctttgcctccaacatgtttcagcaaattgcaaaagataatgccaggggttggagtgggaatgagttcatataacttattggaagtttcttc

SEQ ID NO: 56174 - DNA, 1085 bp, Homo sapiens
ggccgccgagacccccagacggacctcctagggctaatctgatagtgcctctgaggtcgataggactccacgtgccactccctgcagggtcatccagcaagtaattcctagacccgtaggtggccgcagagccggttacctctggttctgcgccagcgtgccccacccgcaggacggccgggttctttgatttgtacactttctaaaaccaaacccgagaggaagggcaggctcagggtggggatgccctgaaatattcgagagcaggaccgtttctactgaagagaagtttacaagaacgctctgtctggggcgggcgaggcctctgcgaggcgggtccgggagcgagggcagggcgtgggccgcgcgcccggggtcgggggagtcgggggcaggaagagggggaggagacagggctgggggagcgccctgccgagcgcccgccaggctcctcccgctcccgcgccgcctccctctacccacccgccgcacgtactaaggaaggcgcacagcccgccgcgctcgcctctccgccccgcgtccagctcgcccagctcgcccagcgtccgccgcgcctcggccaaggtgagctccgcccggcccacgcgcccctcctgggtagtccccaggcccggacctgctgcccggggaaaaccctgcacccggcttcgcggggcgtccggagcaccgcggggctgggcggggagcggctggtggggaatccgctgctcagtgctccgggccacacccaaacgaggccagcagcgcccctccccggcccgggcgcggccgcccccagacccacgcggaccagaggagggggcacttgttctttaggaggggaccgtggtattggtgcgcctgaacctcttccctcctccctttatgtttgcgttgctttactcccacctttcctactttcccactcgtctctcgggttaccgaatccctcctacacgcccctgccctggctggcgtgtttcttggtgggttccgctcgcaggccgggtctgcatgttcgtagcctgctcccggctgtaccgcccaagtaggcgcgggtaggacgagtaggcagctggggcgtc

SEQ ID NO: 56175 - DNA, 1034 bp, Homo sapiens
aatgcaagagaacagcagcaaacaagacaaacaaaatccttgttcttatgggccttacattccagtagggagaaaaagataataaatgagtagcataaaaacaaggtatcaaacatgaaaagtgttaagaacattggcagcacaaatgaggaatatatggtagaggctgattggggtgatacttttttaaaataaatgccagagaaagcttctgtcacgaggtgactttttaactgagacctgaatgaaataaggattgagccacaccaagatcgagaagaagactattctgatcaaaagaaatagctggttcaaaggtctcccggtggggatcagcttgtcctgctagaatcatggaaagaaggccagagtgattagaaaacagtgatgcagaggacaatggtgaaagatgagactttgcagggccccatcctataggaaggtcctgagaacaaagctggattttattctcaatgtggagggaaactactgggaatttcatgtagggagtggcacaatgtggtctacctttttgaaagggatggggagtcccatcaggaagctgtgttctaggagaggtgacctggactgggatgacaggagtagagatgaaaagaatcatggatttgggctgttttgtattttgagatagaaaaaaaaaaaaaggatttagcatgtagatgatgcactgaatgttgagcagcttccagattttgaattctttcaccctgattctccaccttctcatttagtttgctggagagagtttaaattatagagaatatttgtgaaggagactcatcttacacatgaacacatatgtcatataaacagcagccaacatatgggcgttcctgttgatcttgaggcccaggacaagccatggccctttgcatttctctctcccccaggatcacagtcctagcttagatgcctttcttctaagtccgtcttaggactctttctcagtccttctaggtatagctacttactcccttggtgtcataacagtaatttttttgtacttatgactt

SEQ ID NO: 56176 - DNA, 1567 bp, Homo sapiens
tccctttgtgacaaagtggtctttcttgttggatttgtgctaagagtttgtgttggtgatgttggctatcctcttcaggctcccatacctggtggccgttctgctgtgagtccctagactggaatccctgtccctggttttggtacccttcctgtcctggagtctgttgacttagcctccctgatcttcctgattgttcaacataagaggcttttcttgttccttcagtcccttggaagtacttattttgcccttgtatttccccagtctgtgattgaatatagtgggaactctggccttgtctgtctgtctgaccataatgatagctctggccttgtctgtctgtctgaccgtagtgggaactctggccttgtctgtctgtctgaccatagtgggaactctggccttgtctgtccatctgactgtagtgggaactctggccttgtctgtctggctgaccatagtggaaactctggccttgtctgtctgtctgaccatagtgggaactttggccttgtccgtctggctgaccataatgataactctggtcttgtctgtctatcttaccatagtgggaactctggccttgtttgtctggctgactgtagtgggaactctggccttgtctgtctgtctgaccatagtgggaactctggccttgtctgtctgtctgaccatagtgggaattctggccttgtctgtctggctgaccatagtgggaactctggccttgtctgtctgtctgaccgtagtgagaaccctggccttgtcggtccatctgactgtagtgggaactctggccttgtctctctgtctgaccatagtgagaactttggtcttgtctgtctgtctgaccatagtgagaactctgatcttgtgtgtctggctgaccatagtgggaactctgaccttgtctgtttggttgactgtagtgggaaccctggccttgtctgtttgtctgatcataatgataacactggccttttctgtccatttgaccatagtgggaactctgaccttgtctgtctggctgactgtagtgggaactctggccttgtctgtccgtctgactgtagtgggaactctggccttgtctgtctgtctgaccataatgataactctggtcttgtctgtccgtctgaccgtagtgggaactctggccttgtctgtctgtctgaccacagcctaattcctgacctagcctctcagactgtccacaataagagcctgatttctgttgatttgtctggttaaagtgagaggcttgtccaagtgtttcagattgttgtgtatgtctttcagactgaccataatgagaatcctgaattggtttttcacaccgatttaaggcaaagatatgtccctgccatttagcctggccactggtagatttgtgactcacttttttaccagagctggagtcttgactttgtctctctgactgatcaaagctgaaatccttgtcttgtctctcagactgattgtggtgagaatctctgtcttgtctctcaggctgactgtggtgggaatctctgtcttgtttctcagactgaccatggtgggaatc

SEQ ID NO: 56177 - DNA, 1049 bp, Homo sapiens
ttcatccttaatatatgtcacttgccaatactaatagagggcaacagtcagctcatactgaagaatgctatctatgtggtcacttacaaacatatgtcaaagttggaactagagattctatttatttggccagaatatagttcctggaagaggtttcttttagactaacctttttcttgtgctggtagatatttggctattaacctattaacttattttgaattactattattttttcatttaacagctccacaggctagttgggagaagtagatacatggtcagttttggggatgaggggctccaatggtgcaacttctaccacttaagccttctaagacttactactaaaaagtttgaattgagggacatcatggaagtttatgatatctgtgagagagaaatgctgctagagaccccagcttctgttcacttcccatctccgtgcccttggatgccagcacagtgtcttgagcatgggaaattcttagtgaatatttttggggtaaaggaattattggattatggaagcactgaagaattgtatgtaaggtgcaaaaagctgtagactcacctgtatttctacgtttgtctcacatctagatccctgtttggactttttcctatgtatccatcagccaatccattattattaataacactaactattacttactatgtgttcaggattctacaagggaatcacaacagtgcagaaagattttagtttagttggaataaagaagcttcacatagaaaaatattttgaactccagggataggacatgctaagtgctgagtattagaaacctaggcgcatgtggagtcctcatggctgggcctggacgtcccttaggaggtgagcttcatgttgttcctgaaaggattcaggtgggcagagaagaaagcaaagaacttctgagtggggagaagggaagaatcaaaggtactaaggtgagagtttggattcgagtgagctggtaagtctgtgttgagcagagggatttaaaagagcagagggatttaaaagagtagacttagaaaatttt

SEQ ID NO: 56178 - DNA, 1031 bp, Homo sapiens
ttcctcactatgaaggaaagatttctcctcctttctctctctgtctcctataagctctctttgtcgtcctcaaggtaggtgttctttaaatgtgagactgactggctctctctagctccaatgcctgtggtagactgagattctaaaacatataactaggcttttatttcttgtggctctttagcactctctgttgttgcctatgtataattcttgcctctgaattagatgacgaattctctgagggaagagtccttgatttctccttctgattctcccatgagccctgccatagtgctgggaccccagtaggtgactgaactggatgatgtttcacctccacaagtccatgccccctgagcagtattcttttgggatttagaacttatttgcaacttgttggctcttggaaataaaaaagaataatgtgtgaaaattctagagccttacagagtatggggcaggaagatggtgttggtagatgaaccagtggtgggctgtgataatttcaggaggtttgggagatggctgctggtatcttgaagagtttacatgcagaaataacagaggaactgctttagtttctccagaaatatctggatgctaaagtttccaggccaaactgagaggtgggacttgaggcacagcccaagagccccagctgtcaccagcagggaagctgaatgtggtcatgtgtaccgggagcagcaggcaagttgaaagcagtgattggtcagaagcagattcatcagggcttctaaagatcatcttgccctgcttctgacccaggtaggtcagtgcccagtccattctttgtaggtgtcaattcaaagactccccagaggagcagatggcccactgtccccaagaagctcatgcctgtgtcttattcccttagctgtcaggcatagtaggatgccagatccaggcatctggcagggatgagaaagcaggcagagagagcagggagagaaaatcaggtaatgccagggagctttcatgagggattgagtaaggaaagtaatccttct

SEQ ID NO: 56179 - DNA, 1063 bp, Homo sapiens
acacaagcatatgacatgtatacttgtcccaggactctatgttctatgttttcctcttgtcacatttatggatccagtccaaggcagagagaacatgactctgaggtcaggcagatctgcaagggaatagcagttcttctcaggattgttgaagaaattaaatgagctcgaatatgtgagtgcctagcctagtacctggcatggggggttatgcattcagtgtgttgctctccttcccttccaaggtagcctggctgttatctcctttctggaaactcattgagcatcagagatcttgacctccttgggcacactcctgagtttatttaggcctacatttataggatgtgtcaggagctcaagtactttatgaacagagattaattgctcttatgatttaatgcattggccacccacactggtgagatgctccctgaactatgctatttgagaaacaatgaaggaactttgtgaggctaataagatttgtgctgttaatttaagtcttgaggatgtggactacagagagtataacattttatagaatttgtttaaagctacactctcatctttgccataacctggcctttcataatacattcccgtggccacctagcatcatgggtaaggctctcatcaaatgcttcttggagagcaatgcatcttgcagaacaggaggtgggaaatttccacaagggaatgactatgaatggggtgggagaaagacagggaagcaggggaagatcatttccattatttgttcagtggtgattttgggtgaacatctctctttagtccagaatgggcaggaaaatgatatgaattgtaattgttggcaagtgcgaaataatatatttagtgaggaatgtagtgtgaagcacatgaaactgcactgtcaggaagagaagttgaatctggggtcagaagaactggtttccattcctggttctgcaaactgccatcaaacttgaaggactcattctgaggcagagaatgaataaatcattacctttgtgaagcatcagaatcagcagcactttcctgtcccaggagaagagggaag

SEQ ID NO: 56180 - DNA, 1073 bp, Homo sapiens
ccatgactctgtggacctttcagtccaaaaaaaggaaataggtaaatggttattacccaacagtgtgagggatgctgcattaggacatttccagctcagagcagggcattgttcttactagagggtgattaggaaaggcttcccagctgagatggaatcttcagttggagtttgtcttttcttcatttccagtcctttgtccttgtcttctgtccactcctttctttgctgaatatttcctcagatttcaagtcccatctcacatttcttgttgtgttagacatcatgactgatttttccttggcctctacttcccagtttaatgaagataatagctattgccacccacatactcataagaatgcagaagtgttacaggggattaatggcattttaggattaaggacatgatggtagtttaaaagcttttagcgcctcctaaattaggagatctacctgacattgctaagcctctcagatttcgctgtggcaatagttctgtttctccttaggctcacactagctactgtttggaaaatttgggcacaattgtcttgggtgttaagtccttgtcctttggaccccacctctttcccttataggactttgtgataagagagcttagtaatgtggcacttgatgaacttacaagggatgtgacaggtgtcagggaagcttgatgattgtcagccacagccacagtgggaactgatgcagacttctcagtagttctcttgttcttgtgtcacagaccccactgatctgggtggggggggcaccagaggccttagaagcaggacacctttctctatctgggtcttcataatctgtcctgtcttctatttctgactccatctccccttcaaaactcccctgctctacttaaaatgatctctttgcctagccttgggtgcatttccacatctccagtaaggtggtaagtcctctgaagtaggtttcattctcccctcaatctctttaaatctacccatccttcaatgtccactcccaacaaaaccactcgagttctttaatctctctccaacctgcacttggggatcacatcttatctc

SEQ ID NO: 56181 - DNA, 1036 bp, Homo sapiens
ctggcctatacatgttcttttatgatccacctccttcatgaagctttctgtaattcctcaggctcctatttatcttcgtgtctctattaatcacacttttaccaaatatttatcgagctctttaaactatgctatgtactttacatccatcctctcatttgatgcttacaacaagcttatgagatagataatattatcactctcattttatacatgaggaaattaaggctaaaagagattaaattatttgtccaaggtcatagaggtagaaaatagtagtggtgagatttatatccaggcagtcagatcccagaacttatgggcctaacagttgcaaccatacagagctcctatttggtatggagacagccacactttgtatcatttacccacagattccttcacccaatatttcctagatactgactatattcaaaagaccttaaacagttttaaaagtttatgttaaaattgccccatcttcctagtgtccctgtgtggaaatctaatcttgtcaacttgactgcaagctccttgagggtagcttctttattcctatctctcttttaccctctgcccttttatcctgtcccagtatgctggatgtagatgctcacccaactgatggtcttgattggattatagcacctatagtctgtgacatgtgcaacagattctcaaattgggggagaagttagaagtcttctggtgaacttccctgattccaagtagccccaactacagctacaactaaaccatttaaggcaacacaataatttaattcaggggttggcaaatgatggcccatgggaccaatcaagcctgctgtttttgtaaggcccacgagctaagaatggtttcacatttttcactgattgaaaaaaatcaaaagaagaatactactttgtgacactaaaaattatatgaaattcaaatcttagtgtctataaataaagttgtattgaaacacagctttgcttattcattacataatattgtatatggctgctttcatgggacaacacctgctcaatgt

SEQ ID NO: 56182 - DNA, 1026 bp, Homo sapiens
attccagagaagggaagggactttgataaactaaggttgcgagctgtgaaggggttgagtcacgacactggatatgctgatttggctgccaagctccttcaacattccaccacaatgcccttttccaggaagagtgagcagtgggagtgctttagaacctggcatccaagggacctggtgggaagggggagtgaagaagtaaagctacagcaatatgcccagtgaataggtcctagggtgagccctcagcactttggatactggagtcaagccctctttcttctgctgtcctccttgaagctccactcagtgtcagagagggaagactatttaagatcacccaccatattagtaggatttctcagaaacagaaccaacagcatgtgtatttatagaaagagatttattacaaggaattggctgatgtgaatatggaagctggagagtctaaaatctgcagtgtaggacagcaggctagaaacttgggagagctgattatacacaatcctaaggcagtctgctggagaattttctcttgctcagggatgctagtctttttgttctattcaggccttgaactgattggatgaggcccaccccattagggagggcaatctgctttacccaaagtttactgatttaaatgttaatcccatctaaaaatatcctctgaaatgtgaaagggaagttcactatgccaaaagaaaaaaattaagcagaaggtaagtcatgcaagcaacggcctttccttttgttcctaggcccatagctactgataaaagattaaatatctccactctatgttcaccctaccttgtgtaaagcaccgatttactgagcatgagacggaaacataattgactattcccttaccttcttctccttttatcttgcaatatgtggatttagtaatgtgaccctaccctccctatttcttctccaccctgctttcaccctttaaatattgaagtcctaaaaaattatcattggggaaagcacagacctgtttctggagtggtccttaac

SEQ ID NO: 56183 - DNA, 1065 bp, Homo sapiens
cagaagggtttggtggttttatcagactgtttaaccataaaacgtttttcatccctgtgttcctgtgccccaccatttcaggcacttggtatttttactgcctcacccccatcaacagagaaaaggtggatttgatgtcatttattatatactttaaagtaattttattttgctgaatttgtaaatacatgcaaatgaaatattttagagctacaaaaacaaccatggccagatatgtatgaacgaggtctttcccagtccccctctgggttttgcacagatttattctgagggtcccttagtccaaactgggggatccgcagacaaagagatcaatatttttctcttctaaattcaaaaggcaaggtgcaggtatgagacattaaagtttgaaagaagacgctactgggaacatttttttccttctactccacccctatccagaatagaaaaaagaccatctaaacaagagtggagaggagtttggagaaaaagtagagtaggttgtagtgtatgggctgggcctgtgctcttcccttgccccagactgagtgtgaggagtggtgaataagaacaccacaaacctgtctgtacgtatgggaatcccagagctgagaggacacgtgtctccttttcttagtgtcaccaagatgactgcaaaccctgtagagaggcccttcagtgctgtggagtggaaaacttggtttcacatgtttggccttgcttgttggagaaattcagacccctgagtttctcttagccctaaaatggcatgagaggacatctgaaattatcaattattcttgttcccttcttagattcttgcttgtcttccttttcatcattctgatctatctttaagagaggtcacttttcaaattctatctttaagaggttttaggtctcaatatattgggttttcccttcaatatgggtccattttggactctaaacctcaagtttccttttatgtggttccctctttacatttattccttgatactttcccagacctgtttccagaaccaaaaccatctcttcatttaaaatattctgaaatttctt

SEQ ID NO: 56184 - DNA, 1787 bp, Homo sapiens
cactggagcagtaagaacactcatttatcgattaaactctctgtttcatataggaaaggtttgtggtgccctcaacaattacaagtgtaacagcaaagatcacttattacagatcaccatagcagatataataatagtgaaaaagtttgaaatattgtgagaattaccacaatgtgacacagaaacatgaagggagcacatgctgttggaaaaatggtgccgatggacttgccagacagggttgcctcaaaccttcaatttgtacaacacacagtctgtgaagcacaataaagtggagcacaataaaatgaagtatgtctgcatgcaaactcctctgaggtatacgagtaggagtagaactgctggtagacagggtatgcacatttcaaagaaatctgttccttatcctgtctctattttttcagtctgccagtccccttcctgccttctttcatatctatctaggattccatcatcacacttttgaagttgtgggcctcaatcatgttataatgcattgtgattgttgtcagcaattggtaagcatctcaaaaaagaacaaaccaagtcacccagatcactccccaaagtgggcagaagagaaaaggattgggttaaaggttgcaataacagtgaccccctcctgccaggcatgatgaatcttcctatctagacaaacttgctttaatctccttttgtttcccactctacttcctttgagagatgtcagagataatgatggtgagtgggctaaattcactttcttcctctcacttccttctccacttggctcttagcttcacctccactactccccatgcacacatgccttcagatataatatttacagctacttattgccttttatttgctgtgctctcactgctaattatcctacattatgtttcattctctttggttttgttgccaagaaatatccctatatccttactccctgccatcccttgctcttagaaatctggttttcctttaatgatgctgttttcctttttctgtgaagtggagcctggctgttctggtgaagtcactgtgggctagtagattgagaatgagttcatagtcacacttgagttcaaatctgaactacatcataggtgagctgtgtgtccttggatttataacctcaatttgcatactgaggagaagtttaaggatctctgcatcaaagagttattgtgaaggcaaaaaaggggtaagtaatgagacattggtacatagctcctagtatattccatattgttagttttattttacctgaaaagttgctactgctaacaaggcccatctttcctacaataatggagtcgagagtgtaaggtcttgcctaggggaaatttggctataaaattatccgtcccttcacacacatatagtttgggccaaggagggggcctgtaagggagcaattcccaacctttttggcagcagggactggtttcatggaagtcaactattccatggatgggagaacagtgggggtgggatggtttagggatgaaactgttccatcttggattatcaggcattagattctcataaggcacatgcaacctagatccctcctggtgtagttcacaatagggttcgtgttcctatgagaatctaatgcagctgctgatctgacaggaggcgaagttcaggcagtaatgcacggtgggctgccactcacctactgctgtgtggcctggttactaacaggccacagactagtactagtctgtagcccaggggttggggacccctgctgtaagggtttctggtttttc

SEQ ID NO: 56185 - DNA, 1022 bp, Homo sapiens
atttttgctgaattttaatctcctttttgtttcaagagtatatgaggtattcttttcctttccaagactgatttctctatgtgtatatttgattcaatttctgtcattccttctaggtccttgatccaacaacgattcctttctctgtatcaacagattcttactttctataaatcaccttccacttgacttagaactgttattcacattcagtaaatttttattgcatgctgcctgtgtttccagcatatattttaatttcttcctttataaaggatttttctttcttccttgcctactctcttatttcctctttactacaaactttttaaagaatcttttcacactgatatttaataagaattataacaacaagtagtaataaagatagccactaatatttattagatgattactgtggaccagacacttttctaagtacactatatatattaactatgtagcagacagttcacaaattaattaaaaatatatatattaggatctgtttctgggctatttattgttatattgatctgtattatctactcttctgccaatatgctatctggcagaagagtatttataataactttataaaatgcattttatcttccattacttagtgaaattccctctctttgggttctagaacaccattttctctgcctctcctccaactttgattcatctttatcagtgtccttcactgacctttcttctccgcctccttcatgtgattctatttaaagccctttacagcctgcctccaacttgcttttccagctgcagttcctgatactggtttttctacatgcttcagccaaagacatatactctttgatccctgagaacactatttcctcagtgtctttgcacatggagttcacttctctgcttgtgaagtctatgaatattgcatggctgatttgtcacaattttaagtcttcaacatctggagtgttctggcaagaatttgtaggtaaggacaaaccaaggtgggtggtgatgctcaggagccc

SEQ ID NO: 56186 - DNA, 1057 bp, Homo sapiens
ccaaagacttgaaacaaatgtgttacagtcaaattaaggaactatgtagcagtgacagatactcttccttttcatctgggcatggatgatattttttcaggtggaaacgttattgaactacagtagtaggtggaaagcattgtatttccatggaataactcctcaatatatttcccaatattgagcagcctcttagaaatagggagcaagatctttctgctgaaaacaagctaaagcccacatttgaatgtttttttttttcctgaaatgataaatccctattctttatgaaataatgctcttgctcactggcttgggaaaagaccctgatgctacttttttatgccactaattaacttactgattaaatatatacccaagaaaaaggacttgatggttttgataagtaaagacactaccgctgctgcatctttgctttcagagccttcaccttctgccacaataccaaaaattgggacacaccaaacttggggcacactaaaaattagggtacactaattgctgtaaaacaaagctttgtatctaggactggtaatgcatttgtaatattttgcttctaagaaatgtaaggttagctttggcaccatctataaatgaatgatgagctctcaaaaagacaactccaactaaacccaaagctctttaaaagcttttcattattcctcaaagtttaaccctcattctaacaagttattccactcagtattttctaacaaagtagcacaaatgcctaacagtctttggaaggaaccccataacaagatatatgctacagttttaggctctaaagaaagagacagaaatgcattgattcacttttagaacgaatttcatgatggattgcttgtctttcatgatgaattcatagatgactttcctatttcttaaattgctacttgagtaaattgcatttatgtttattattcactgataaaagtagcacctctgctcttggacatattcatagggtgaagtgctactaggaaaactgagaaaatatgagccagaacttcccccatcatggttacttcctcct

SEQ ID NO: 56187 - DNA, 1006 bp, Homo sapiens
aatatgtttttatacctacattaattatatcaactttatttatccaattaaattaactagctacttaatttactcactgaacaaagatttattattttactagttgcctaccattatgtcatatgagagtataaagaagtgaacaagtttgcttcctgaaaaaaaatggaatttaaagtttagttggccagatatacaaacttaaaattataatttattgtggtaaggtttctacaagagtacatcagagaggaaacattgggggtcctagaaaggttaatgagaggaaatgatgccttttgaaggatggattaggattagccaaatgaagaagtaggaagagaaagagaaggggaaaagattgttctaggcagagggaattatatgaacaaagggctagaggtgagagaagttatggagcattcaaggaactgaaggaaattcaggattgctagatttagagtttgaagagtcaagaaatgtggatagagagacaaatagggactagattatgacttttaagttatgttaaggaactttgtacttcattttaagagcaattgggaactattgaaggatttttagctgaggagtgaaatgattatatttgcatccaatgctgagagtagaagtagtaggtggcctgaaccagaggactaataatagtgatgaagagaaatgggttgttttgagagattattgatgagttagatggaggttagaaggtagtggtgtctgctgagagagagacaataaaaaatgacaccaggtttttgctttgggcaaaaagatgaaggaaaaaggttagtggggaagattatgagattcatagctgacacactgaatatctgacatctgatatctgaatatcatatctgaaatccacagaaatccaaatttaaggaattgaaactcaggagtctgatataaggtcccaaatatctaagctatcaaatctagacctgacagttttaaggtggtggacacattcttttgtgattcagga

SEQ ID NO: 56188 - DNA, 1049 bp, Homo sapiens
tgtaaacaaatgagcatggctatgtttcagtaaaacttatttatcaatactgatctttgaatgtcatataatttcacatatcatatattttttcaaccgcttacaaatgtagaaaacctttttatcctgtaggctacacaaaaatggatgacaagctagctatgaactgcaggctgtagtttaccactctttgctcctcttctgtatttgcttttcaggaagattctctgggagaggaggatctgagagaaaagaagggctgaaaagtgtgggacatcagaaccactaactcttgcatgagagaacaagagtgaaggtgaatttgtaaatatcagcatgtgtggggtggtggggaaagggaacagaacaagggacctttggctgctcgtaaaagggagataaattttgatttgatgtaagggagaaatatttaatatttgcattgactgaaaatgcagtgagctctttgtgaagtaactgaatttattgtcaagtatcatatgaatagttttttactattaaagaaaaaattaattctttcattacgttgttttctggatatgctcaccaactagaattttgttgggctttttttcctcgtttgtatcatgaaaataagaagcatattacatatgcgtcttggtctcttctctccccattgagaattacttattaagagtaggactagattatcacaaaagtcactttcaaaacagtttcttgttttttttagagtgtgtgctccatagtaacagagttggacatgaagattcctccatcatgggtttggttagtggtttttccacttggagatgataggtttcaggagaaaagcttttctatggtatgtgccatgttctaggtttttgagtgcctttctctgtgtgttggcagaagaatgaaaattacattcctttttatgacaagcacagtgctttgtgtgtgggtgtacattgtttcattaattcttacaacaaccctgttatctagatattatatttccattttgcagatgagaaaactgaggctcagatgaaatctgtaacttg

SEQ ID NO: 56189 - DNA, 1041 bp, Homo sapiens
acagctggatcagacaacttttggtgacatctcacagtgtggattatcaagccagtgtatcagtctggagcctaggttttttgcctttagctttgctcaggatgacttctgctcttctatggcaatacttgagaaggtaaggtagtttttttctcattttttgtttcatcattttaatccatatttcccagaatctacctctttctttacctcattctatcatttttctaatcaggccatcagttagttactcttgcaacgtgtactctaacagcatttcatgtatatgcttaaactaattcatagaacatggttactattaatatttgcatttcttttcacagtatgcatctagaaatcctcagctattttttgttttcttcatgaaatttttaattctaggaacttttcatatgagatatgaaaaatggttaaattcaaataacaccatgtccaccatattggccccctaattagagccaagatcacaaaatccatggtgtagtgttgagagcacaatctcacacacctcacagacttgcctttgactactggctcctccagttgccagctctatgactttgagcaaatttcttaacctttctgggtctgtttcctcatctatagagtaaagataataatacttcattttgatagttcttcagtatattaaatgaattatatgtcaatggtctgacactttgcctagcatgatagcaaggtattcagtaaatggtaattattagttttatataactatgaagtcttacagaattggtaaactcaatatgagacacttattgcaattgaatttttgcatgtgtgtttgtttccatcaagagagaagagcaagaaacatacatcttttcctttttcttttccaagaattttttttaattgagtccctctctgtgtgattatggaggtttttaaatgtcctttagggttcagtgtgatcatctctagaagatcggggagaaggttttcatctgttttaggaaaagagtagcttcaggagaatattgaatgttgaatacaaat

SEQ ID NO: 56190 - DNA, 1036 bp, Homo sapiens
tgtatcatttcataattaaaatcaatttttaaaacgttttttatttgcggcatgtttttgttgaatgaatgcatggtatgaactaataatgatgtgttcagtaattttcatgcatataattaataggagaatagttttgatgacaattttatttatttacagtaatatattggcttattttactagcaggcttgcatgtctgtttgtttgtatttagagactgggtctcactctgttgcccaagctggagaacagtggcaccatcatagctcactgcagccttcaacttctgggctcaagtgcttctcccacctcagcctcccaagtagctgggacaacaggtacagtccaccaaacccagctaatttttttatttttttgtgtgtgtatagacaggttctcacttcattgcccagactggtctcaaactcctgccctcaaggaatccttctgccatggcctctgagccaccatacctggtgcatgtttatgtaacgtgtctatattaaaaaataagaaaaaacattgataacacttaaaaagatgggctctcatattaagtcctcctttaacttccgctacacctacactaacccatttccctttggttctatttccaaaagacaacatgaggtggtaggaaaagccctggtctgggatatggtatgcagtgttgttctgattaacagttgacatctattggttgtgtgacactggaattcacttttttcagatgaaatataaagggaatatcatggggttcctaacctggcaatatctatgagtgtactttgaaaggtctgtaaagtccctgaaattataaggaaacatttgtaagtgggtctccgcatttttttgaggggaagggcatttaggagagggatgctcaaatagttccggaacaagaaaacagcaaaaggttaagagccattgacctagatgatcttcagtgacctttcagctgtgaacttctgttaaaagtaatccttgaggcttgaggctctttttttgccctgtcctgtttctctttccattt

SEQ ID NO: 56191 - DNA, 1063 bp, Homo sapiens
tcctaacaggaggagggattttctaacaggaagagtggtgctctaacaggaggagggggtgggtctaactggaggaggggtgcactagcaggaggaggggtgccctaacagaaggaggggtgccctacagggtgaaggtggtgccctaagagtagaagcggtgccctactagaaggaggggtgcctccacaggaagaggattctctaaaaaggaggagaggtgtcatgacaggaggaggggtgctctgtaacaggaggagagttgtcataaagggtgaaggtggtgccctaagaggaggaagtgtgccctaacagaaggaggggtgtcctaacatgaggaggaatgccttaccaggaggaggaatgccctaccaagatgaagggtgccctaacaggaggagtgagtactctaacagcaggagggtgtcctaacaggaggcagggtgcgttaacaggatgaggggtgccttaacaggagaagaggtgccttaacaggatgaggggttccccaacagaaggaagggtgccaaaacaggtcaagggatgccctcacatgagaaggggtgctctaacaatgccctgaaccttgggtgggagtttccattgagaatgtggaggtcccttgggcctagcctggtgatgagctgtagaagaggacgtggctgtagtaggagcagaggcactgagtctgtggctgcttcctcccgcctgtcctccaagacaggctttcagttagagaaggatttaatttcagggttgccccccaccttctctgaaacacagctgggacagctggggtacactcctggtctgactccgaagcactacccctggctatccttaactggagtcctggtgcccgctcatcccagtgccactctgagtagaacaggtaagctacggtatcatccacctacactggcacctacccctctctactggggatgaaaggctggctcagcgtttccaattcaggaaagggaatttctgtgactctggcctgtatggttaccagataactctcacttagaaaagtctggaagaaaagatgagcccatgggac

SEQ ID NO: 56192 - DNA, 1749 bp, Homo sapiens
ggaggttgggttgttaatttgagatctttctattaatatcttctttatatatatatattttttattatactttaagttctagggtacatgtgcacaatgtgcaggtttgttacatatgtatacatgtgccatgttggtgtgctgcacccattaactcgtcatttacattaggtatatctcctaatgctatctctcccccctcctcccaccccgcttgatataggcatttagcgctataaaattccctcttgggaggatagaggagcgaggctggcgggcacaccggtgagcgggccggaagccggagcagccgaggagtctgcagcagccgcgtggcggagtctgggcgaggaggtcaacgctcctggaaacttgggctcgtcctcgcgcctctgctccaggagcaatgacgatggtcacgccctggtcgcaccctggatgcggttctactccaacagctgctgcctgtgcctccatgtccgcaccagcaccatcctgttaggtgtctggtacctgatcatcaacgccgtggtactcctgattttgttgagtgccctggctgatccggatcagtatcacttttcaagttctgaactgggaggtgattttgagttcatggatgacgccaatacgtgcattgccattgcgatttctcttctcatgatactgatatcatgagaattaaggctaattacgtaattaaggctaattacgaagcatacaggcaacacgcattctggatcatcccattcttctgttaccagatttttttttttttccgagacggagtctcgctctgtcgcccgggctggagtgcagtggtgcgatctcagttcattgcaagctccacctcccgggttcacgccattctcctgcctcagcctctccgagtaactgggactacaggcgccagccaccacgcccggctaattttttgtatttttagtagagacggggtttcaccgtggtctccatctcctgacctcctgatccacccccttcggcctcccaaagtgctgggattacaagcgtgagccaccgcacctggccctgttaccagatctttgattttgctctgaacaccttggttgcaatcactgtgcttgtttatccaaactccattcaggaatacatacgacaactgcctcctaattttccctacagagatgatgtcatgtcagtgaatccacctgtttggtccttattattcttctgtttattagcattatcttaacttttaagggttacttgattagctgtgtttggaactgctgcagatagatgaacggcaggaactcctccgatgtcctggtttatgttaccagcaatgacactaaggtgctcctaccccggtatgatgataccactgtgaatggtgctgccaaggagccgccgccaccctaggtgctgccaaggagccgccgccaccctaggtgtctgcctaagcctttgagtgggcggagctgggggcagcagcttgacttttcagatatctgagcaatagtcatgttatttcacttttcaggtgagctctctgcgcttgtttgttgccgaagtgctactttttaagatttagatgttaggttgaaacctgtagttttcctcaacatatgctttgttagaacactgtgatagattggctgtagaatactttctgtaggattgggggtgtaacaggcttcactaaccctccctaggaatgtaaacttcccccaaatctagatggacctagagtcagagaagtctgct

SEQ ID NO: 56193 - DNA, 1549 bp, Homo sapiens
gctcccccgctggagggatagtcaggagcagcagtgctgtgccaggcaggccttgggctaagggatcgcaatggggtgtgctcttttggggtgcggaagggagtgccctgggtgtgtcattgccaccatgtgtggccctgtgaagctgtgtttaagctgcctttgcagcctccattcccctcccctgcccagccatactcctcaacttctggatcccctgaaggacagttctcagctgtgcccaaagctactgttcctatatgcttcttagaatccttaagccacctctcttgccttggccctagtgtgctctctccttccccttcaagccctgggctgtctcctgatgccattgtgtgtggcctgagactgggtggttccaaaggaggcggggctagtgcaggcagcattattggggtgtgtgggtgagaagtccttgctcccatggcactgactaggccctctgctgccagctccaagcccagccctcagccatggcatgccccctggatcaggccattggcctcctcgtggccatcttccacaagtactccggcagggagggtgacaagcacaccctgagcaagaaggagctgaaggagctgatccagaaggagctcaccattggctcggtgagtggcctcctccccaggaccccttttcccacccttgtcctttggaagcaggattaggggagagagaggtgccaggtgcatctgactcacatttacccacattctgaggccctggtccacatgtagaccctgagctgtagacccactctcccagcgggtaggggatgcttccagccggatatccatctctccaaatgaggaccagtaactgagaagtagctgaggagaagcaatgccaaagtgacatgggtccttggtgatgagggagcacagagccacttgcagagaggattgcctgggagggggaaggggaagaatccagggttgtcatcaccactgagtatggatttcacattctaacacattagaagctgcaggatgctgaaattgcaaggctgatggaagacttggaccggaacaaggaccaggaggtgaacttccaggagtatgtcaccttcctgggggccttggctttgatctacaatgaagccctcaagggctgaaaataaatagggaagatggagacaccctctgggggtcctctctgagtcaaatccagtggtgggtaattgtacaataaattttttttggtcaaatttacccttgcgtcctggcttccgaatgatttctgttcctccttggcttagtgggacaccagccattggaagatttgctcacggtcaacctctgaaaatgactcattgactcgccaggccagaggacccaccctgacaaggctgcctctagcacataaggtgcctttatgtgaatgaggagagatgcccctcttggcaacgccatcctaaggaaaggctcaagtggtttccagtagagagagtcctgggatgagcttggagatggaaatggtccctgggccgggatgtgatggggtttgggggcctggaagtgaggca

SEQ ID NO: 56194 - DNA, 1053 bp, Homo sapiens
ggggggttttgggcatgggccgtgactcacagagtagatccagatccgcctgctcccctcatatcctgttattcagaaggctgtatccgcttagaaagtgtcttttgtcctggggtgagagggtgacgcatgtgccctctggcagtctgctgctgtgtccagagtccgactccagctgggctgtaactgggcttggcccccgccttaggtaacgatgtgtgggtgggggtgttcttgggtcctgctgtgtatttagggatgggaataagggaggagaggctagcagggtgtggcggggtgtgttgggagagctgcacaaaatctgatccaattgatctggaccttgtcctttcccataaggggcagccaggttctgagacccgggactcactgtcctggagcccggcaagggattggggaaggcctacatcttcctttctgctttgttgcctggggctggggtctcagccagtcctgggagtgggaggcagtagcctctgcccctaacctccatggctcatcccagctgtcccagccatgcttggccccgggagaggtgggccagctgtggagcagggtgggagaacaggtggactcttctcttcccatgagagcctcttgccccgtagggctctgacactagggatcttgctccctagggctggaacctggtgcctggggctggggcagggcctggagaacctgttgaggcggttgagctggggagcacctggattagaggagccgcatagttctcattccagggctcactctcccccacccactctgttccccttttcctgccaccttcttctccagggaccagaaacaaggcaggaggagggacccagggcctagggtgggtgtggaggaggaggaggtatggcctgtgggtgtctcttctcatctcccctcctcctggtgtccaggccccgccagcaggcgaagcagggagatgtcagactgctacacggagctggagaaggcagtcattgtcctggtggaaaacttctacaaatatgtgtctaagtacagcctggtcaagaacaagat

SEQ ID NO: 56195 - DNA, 1039 bp, Homo sapiens
aacctccgcctcccaggttcaagcaattctcctgtctcagcctaccgagtagctgggattacaggctcccaccaccatatctggctaatttttgtatttttagtagaggcagggtttcaccatgttggccaggctggtctcaaactcctgacctcaagtgatccgcccacctcagcctcccaaagcgttgagattacaggcgtgagccaccgcacccttcctgcttcttctttcttaatacttatttatttctctttactgattgaatgcacccccaatataatgttacagtagccatccttgccttccactggcagtgcttatagtattttataattaaacgtggttgtaacttaaaaaaaagtcttttttagttcttctgtgaatcagctttgttccctttagagattcagtgagtcttctctgtctgcatccaaatgttggttcaaaccttgagcctcacaccctgcctgaggcacccttctctggtttgatgttgaactattgttcaacagtcaactttttggttgtgcttgtttatctggcaacaggtccttcgatcaggacatccagtttactgttgccattgatttcacaggcctatgagagataccctgtcaagggcccctaaaaacccagatactccatgcccttgccattcccctgatctagtgacccagctggataaatgaaaagacacaagggttgtgcaaatgagcagctaagtactgggagcttctccagctttctgagaaagaggagggtggccccagaaggctctgactgggtccaaccctgcagcatctccctgagatgctggcattccttgggccgatcccacagcagctgcagtggtgtgctggtgagagaagattgtgtggatttctttccagctttgtattcagcgacaacctgtttgtggtttgtaagcagccatcgtggaagtatttacacaacggcaagcactaggactcaggcccccccacctttctctgctggtgctccttggagaggcaccccgtggcggtgcagttttggg

SEQ ID NO: 56196 - DNA, 1567 bp, Homo sapiens
tgggctcccaggtccctcccccagagccagctcagacaggaattcaggaaggagctttggatgatcgagcaacagcgcgtgcaggagtgtgtgacggggtggacagaaaagagaatgcctcttccagccccacccgccgcaccccagggggttgtgagtgcctgtactaaacccgtcctggagcagggagtcagagacgccccgttccaggacccttgtcaccgggagacaggagcggggaggatctgtggggtcctgggttcagcactctgccctgctgccgctgaggagaggtaagggtggagcggggcagagaaaatgggtctgttcagacggagccagctctgaccacaggggacatttgccagaccctgtgcttctctgctgggaggagcggttagagtgtgtgtgggcggatgcgagtggccggagaccagggcccaacataaacaagctttggagacaaacaaccttatgacctgtgagtctgggtgagacaagaagggattcttgagacagacacgccacagaggggccaccagacttgaaggactccaagaaggaccttcaactgaagacctcctctcaagtagaggggtctccagatcgagggatcaccacagaggggtccctaagccacagacatttaaaaaggatcccggattgtgagacctacagaagagggggtttctggagctgaatctcctgcccccaccaaaactgagatgccgttgcctggtctgctgccccaagctcaacccctgtcctctccctctttccccatatgccccctccaggctgagactgatgtgataacaccaaggcagggaccttctgaaccattcctgcatcttggggctccctgactctccctctctgctccttctctcttccacaggtcagccctgacaaaggtcagctagccccttgaggacatcagctttggcctcagggtcctaatggcagcagaaccactgacagagctagaggagtccattgagaccgtggtcaccaccttcttcacctttgcaaggcaggagggccggaaggatagcctcagcgtcaacgagttcaaagagctggttacccagcagttgccccatctgctcaaggtaggcagaagtctgggactgagattttgtgagatgatgattatgggacactgtgtttaggacgtgatggtgccgagtacggtgaggtgaccacaagaaagggtgtgggtggctgcatgtgtcaatggttgcaggttttcttttgttttttcgagacaaagtctcactctgttgcccaggccggagtgcagtggtgtgatcttggctcactgcaacctccatctccggggttcaagtgattctcctgcctcagcctcctgagtagctgggattacaggtgtgtgccaccacgccgagcctatttctgtatttttagtagagacagggtttcaccaggttggccaggctggtctcgaactcctgacctcaggtgatccacccgcctcggcctcccaaagtgctgtggttacaggcgcaagccactgcgcctgacccggttgtgagttttcttgcct

SEQ ID NO: 56197 - DNA, 3984 bp, Homo sapiens
tagctaggacaacaggtgctggccaccatgcaccgctaatttttttttttttttttcttagtagagactgggtctcgctttgttacccaggctggtctctaactcctggcttcaaaccatcctgtgcccttgccctcccaaagtgttagggttacaggcggtgaaccaccatacccagccaccttgaagttataataatctgaggtaattgccatagaaacttaagaacttttgctgggcgttgggtcccagtgatcccaacactgggaggccaaggtgggaaaatcctttgaggccaggagattacggctgcagtggccactgcattccagcctgagtgacagagcgagaccctgtctcaaaaaaaaaaaaaaaagaaatttaagcacttgaaatgtgccctcgtgtgctctttagtcatcagtgataaggcctttttatttatttttggcttgggccttgccacttatagaaatgatgtcactattgtgatttgctcattttacgtattgttctttgtagattctcgggattcgaagatggctgcacagtcagcgccgaaagttgtgctaaaaagcaccaccaagatgtctctaaatgagcggtgaggcagccaacagcaacttcaactccttcctaagaaaacattacttaacttggccctggggtccaatgcacaaagccaattttaagctaaataccaacagaaggctacagacctctgttcttagttgcatctcatgtggtacacaaaacaaattgggcggttgtttcaaaaccccttatcagtagacttttatgttaagctgtctgaagtatttatttggtgggatgtattttaaaagactcctaacactcttccttttcacatttttttacgttgatactggggtcgtgcagcacggtagcatggtaccctggctacagtaggcttgctgcccagtccaaggccagcagtgttgtgtctggcctgtaagaggcaggtagcaagccatgaatatgtccaaaggcccttgaatgtcattcttgggccttgtaagaggcactcgctttgctccatttcactttctttccattctgcttttagtttggttttgttttggattcttctacagttaagtgttcttctcttccattccattatacttccttgacagaaataatgagtctcttcacaggctcataaatgatcaaactgatgtaactttgaaaagtaactacttggagtcagaaaaagtgatgattggagactaagaaaagtaaagatattcaaaggcagtttctatctctgacaactttgttcattaagagtgcctttgtttaggcgcggtggctcatgcctgtaatcccagcactttggcaggctgaggcgggcggatcacgaggtcaggagtttgagatcagcctgcccaacatggtgaaaccctgtctctactaaaaatagaaaaattagctgggcgtggtggcgtgtgcctataatcccagctactcaggaggctgaggtaggagaatcacttgaacccgtgaggcgaaggttgcagtgagccaagatcctgccactgcactccagccagggcaacagaggacagagtgaggctccgtttcaaaaaaaagaatgcctttgatcagtgatttcattaagttgactttcgaccactgaaatttacttaatgtctatttttgcctcttctgaggcatatgtgcttctctccttatctctttggctatgataagctaattatttatgtttgcataatatttatgtttgcatgttagtgacatatattttaaaatgtgatacactcctgtaatttatgagagtatgttcattgctgtgagctttgaaggtgctctaatccttcctcatatttggccttagaatgcacctcggatcccccaaggtttaggctttcttcatttgtctttgaaactatatcttctgtctcttgtcatatctgcttattgcgtgtttttcataccttccacctctctaaaagccgttacctgagccctcgttatcacttttggttgaatgtgctgcacttagctgcatttctaagtttctgattcttgcaagtttgtggaaacagaggagtctttaacccacatcagccttgatctaagtgtaccactttacttaaaagttcgtgggatctggagctcctggtctagcaagccatgaaaatgccaataaatgtttgtaataaagcttttatttaaacatccattttgttcgaccttgaagctttactaatatgctgaagaacaaacagccgacgccagtgaatattcgggcttcgatgcagcaacaacagcagctagccagtgccagaaacagaagactggcccagcagatggagaatagaccctctgtccaggcagcattaaaacttaagcaggtgagagaatgggtcttaatgctccagaagcagctggtgatctctgtgagggagtccactgaggctgtcaggacgtgatggatgattgcaaagtggctcagggcaaaaagctgaaacttctctggaagaaagagaagttcagagaattccaattttggcaggtaccaataagtaactttttactgtctttctcttttagggagtttgccatctatgtggcctgtttctgttaccaatgagtattaatcttttgttttctgatccttaacccttaacatagattaatggcttattccacaaagaaactttatttcagctttagataatctcacagcatcctttactctctgttaaatgatttacccaacagggaaataattttattctttttcccatagtgcagggagtttgcatggccttagtcaaaggttttctttttttttttttttttagacggagtcttgctctgtcgcccaggctggagtgcagtggcacgatctcggctcactgcaagctccgcctcccgggtccataccattctcctgcctcagcctcccgaacagctgggactaaaggtgcccgccaccacacccagctaatttttttgtatatttaatagagacagggtttcaccatactagccaggatggtctcgatctcctgacctcgtgatccacccgcctcggcctcccaaagtgctgggattacaggcttgagccaccgcgcccagcagtcaaaggttttcaatgctaaaatatacagagtagagtgaccctcatttccacagcacctaaagttttaccagtaaagtggagcaagaatactgagtaatttgagttaggggttctctttttcaaatttacagtgagagataatcctattcagacctgaaataaaacctgctctttattattcatagaatttatatgcaagtccggacagtggctgtggaaggatatgtccaagctgtggctgggcgtctggagggcagtgccatgcaactgtaagggctttggtagcattgcatggctatgcataaattcagcagttaaatataacacccttacacccccaccctgaaccattgggctcactgaccaaaaataaacaagggtgtctgcttcggctaccttaagccttggagtgactggattcctccctgactcaggaaagcagcaaaaggcaccattttccaagagtaaatggaagttgctgaagatgaatctctgacagatcattccaaaggacctttcaacaagaagctttaagtataggctctgcaggaagtagtccctatccagagtagtactattaaatagaatttttttatgtttttggtttggtttggtttggtttgttttgagacggagtcttgctctgtcacccaggctgtagtgcagtggtgcaatctcaactcactgcagcctccgcctcccgggttcaagcgattctcctgtctcagctacaggcgcccgccaccacacccggctaatttttgtatttttagtagagacggagttttgtcatgttggccagactggtcttgaactcctgacctcaagtgatctgcctgcctcagtatccc

SEQ ID NO: 56198 - DNA, 5592 bp, Homo sapiens
ggcaacagagcgagactgtatctcaaaataaaaataattgaaatagccacatgtagctatagaggctgccttacacagcacacctctagaagggaaactaagtggtatagttgacatccttaacttccctgttaatattaaaggccggtattggtggcacttaaggattggaatgggtaaagaacttcccagcactgtacagttcttttaaagcacaaagcttgggagaattaatatatgcaggataactgaacgcaagagacttgtggaatgcagttctaacctgataattgtgtgttaatcgggagtaacaggacaggccgttacggttggttacacctacttatgctagatgcataatgtttggagccttccccactgatgagaagcaatttatgatcttgtgctagaaagttaataatgcttcacagcatctttttgagaggttgattagaaaacacacacatacacgttggtagtcacttgtgggtgaagcctgaaggggctatacaatttattttctttcagattgactgatggctttatggacagccaggcttactaggagcttggttgtgttcagggctattgctgtccctttttcctttgaaggaatttaattctctgagatgtagtcttaatggttttcttttgagaacagattcttaaaaataccctatctctgtagtgtgtccttgttcttatatatggccctgagttttgtgatcacctgaataattctaacatacgtttggctggctgactgtggagatacatttgagttacatgtttatttttaatttaaggtcatcattgttttaaaggagctgtttgcaagtgcaggcatggaattagggatttttaagaaatgtaaggaaaggagatttgactttcttgtgtttatttacatcttaaggtaaaaagtggaccgtctggaaatagattctcagaggaaaaatggagcacacgggcctttttgagaaatcaatcttgttcttaagtcacaagaactcaagtgaacttgtaatttaagttttgcccagagtgtgatgaacttcctatggtgtttgagtaagcctttgaagacagtggtagtccatgggcaggtatgaatcaagtcatataattgtcaacctgtagttcaaaagcagtacaatccaggattgaactatagaatgttcttacgaaaacttaagtttcaactggcagtgtatgacttctgtagccaaactagtgaggtaatttgtggagatgcccatttcatgggaccacacttgagcttcttggagtttctgctctggatcaaaattctgctgcttgtataacatgttctgaggcaaaggcttgcttctggtttgggatccttttgacacccacaacaggtttatctcccttcacaccagcatctcacttgcttctttttctctgcactttgagttgccaaatcctgttggattgcttttttgatctcaatcccctaacaccttttcttccagaagagcttaaagcagcgcctgggtaagagtaacatccaggcacggttaggccgacccataggggccctggccaggggagcaatcggaggacgaggcctacccataatccagagaggcttgcccagaggaggactacgtgggggacgtgccaccagaaccctacttaggggcgggatgtcactccgaggtcagtgctgtgtaccctgataattgtcgggccctactcccttcccttttctcttgggctgcttatggacacgtttgtttaacatctttaagcctgaatttgtattaatataataacttctgaaatcacatatttttaatagtgctgcatgtcttttatcaataccattccttttctgataatgtgcaatggtgagaggctatgacctgcgtaacaacaggtaattcatgtcatctccattccattttaaaacaccctgctgttgcttgaatcaaagcacattcaagttctagaaacaagtcaaacataagaaatttataggtcttttggcctatatctctttgttcctggtgctagtaaaacactgatacagctggaaaaagaggacaagttgacccacagcacttacctatatatgttcatttggggcactattactctgttccctgtatagttcttgttccctagaagaatctgttgagatcaggaaccatagcatttatttttaaatttaccataatgctaggcatctatctgattattcagtagatatttattaaatgtatgtacttactaattgaattaactcccaacttccaaaaatggatttgtggtcagacttgttgaattgattgaataaagagtagcttaatctgttcacagtatgcagcttgccccagccaacctaaaaactaactgaattaccttcatttaaccctcaccgccttcctttggttagaatctactttgtgtctcttggatttacctgcatatacattgtatgcctcctctctaaggtcaaaacctgctccgaggtggacgagccgtagctccccgaatgggcttaagaagaggtggtgttcgaggtcgtggaggtcctgggagagggggcctagggcgtggagctatgggtcgtggcggaatcggtggtagaggttagtcagctaccaacttcagagagtagctcccccttactttcctcccttaaaaactcagagccacctttctgcacagcttcaagtcataggcaggcttctttgtttgtcttgttttgttatttgaaactggcttatttttcaaattaccatgctggtagtgcaaaagtctcatgatttttccaagaatcaatcaagtgcatattatagagccagattatatgccatcttcctccaagctcttgcaaatttaaattgtatagttgaaaataccccccaaaatggtcagtttagggttttgcctttctctgcccctgtcccaccaccatcaccaccacataccaccctgtagctccaaatcctggtttgagtcacatgagaatatagaagagagagagagatacaaagatgaagtagagttaagagggtggtgagacttggagctgggcattggctctgaaaccaaataaattcaatgtcacatttggtgcctgtggagaaccagagatgactttttttgcttaaggtagagagcaagatggaattattatcagttaactaactggctcttattgataatcttgcctttgaaatttattgatgtttgtcttgtgacctcatgacccagattgggaaagagtttaatgatgttgctgctgttaatactaaatctcatgggagccttctggtttagagcttagtggaaaactcccaacacctgtccagaaaaaaaacactattgaagcccctgtgtatatttgctttggttctcttaaaaggtgtcttgggtcttccataacttatgaccttgaagttgccaaggaataataactgttaggaaagaaaagttgataaccaagggcttgttttcttctctcccattatatgatacttactgagtgaagtgcaagctagtttgggtttcaggatgaaataacatgtttccaaattatcttgacttggatcctgagagacatcacgagggtgggagagactaaaatagcttttcaaaaagctgagtttgttttgttaactgaattcacactgcttctcagataaccacaattgtcagttgtcataaggtaactagaattaaaggtagaaatagctaggacaactcaaaatattttttcaaatctcccctacattgttcctgtgtcagaaaaactcagtctcctgacacatgaggtcagctagctcattagacttgataagtttaaggacaggtgagatgactttccagaagggtctccaataaacttaatttgaaaactgtcttgtcttcacacccctgatgctctgtgctcttgttaccacctccctatcttaccaaatggggttatctgtcatgtattttaattatgaacttagtgaatctcaaatgttaggtaattttatcttaggattgattaaggttttttaaaattatagttgccagttaattattttcctttattgatagaataaaatttgttaaaatagcatttagagatgatcatgtgatagaggattcattatgtgtgctttccatgtgttgctttctacccattgtgtttcctttttttccagatttctcctctttgccctgcccttcagcttttctcagctaggccccactgctctaaggggcatttactacagcacctattaaacttacttgtaactgtctctttttttttttttttcccctttgggccaggtcggggtatgataggtcggggaagagggggctttggaggccgaggccgaggccgtggacgagggagaggtgcccttgctcgccctgtattgaccaaggagcagctggacaaccaattggatgcatatatgtcgaaaacaaaaggacacctggatgctgagttggatgcctacatggcgcagacagatcccgaaaccaatgattgaagcctgcccatcctcccatgagagactcttgttagtcaacacatctgtaaataaccttgagataacagatgagaagaaatctgattgatgctggatggacctatcacaataggctgtggacttacttgccaccagcttgtgcatttagtgtgttccttttactttttgatactgtgttgtatgaaacccttttgtcctttgatttggttttttgtttttgtttttttaggggggagggggggtttcccctcctttgcccagacttctctttgaacacaaatgcattagccttgtggctagaacaccctcttcctacctctgtctcccctcacttgtcatatgctctgacatgctaacatttcttttgttcatccctgttgcccccacagaaacatcccagaaaaaccggtcagtgttccttcctccctgatccttaggtttctgaaatagggttctgttacatcctcttcgatagcctgtttaaaatgtttagaaggtctggagctcaaaaatgcgttcttccacattgataatttagtaaactgagaacattgacatcactacagggcagcataagaggttgcttacatgtggtagcagctctggtttgattcaagttgctaccatgtacattgacagcacatataccataaccagcgtgttgggttgaattgcactttctacctttgtatgagatttacagactttccttctgggtttgtatcatgaccagaggggtactatagggttggtttatactgcaatatagaggatcagaagccatttgatttggtaggtgtgtcagaagggagaatgatggcagacgaactgctggaagaggtcagaagatagccatgctaaaatgcaattatatcctcatgtttatcccaaactaatcttggacttttccactcattagctttgttttgcccttgtttcccttgaaggtttaagttcaaccatattctgtcaactgttcagtttcagtggaatcttgtatttctggttcattataacaaactgttcgcttaaatccacccaggactctctttatttgaggtgcctcaaa

SEQ ID NO: 56199 - DNA, 1049 bp, Homo sapiens
tgtcttggtggagacagcatttcccgggcgccccctcacggggcggggcagtgcggcgcggctccggttcccggcggccctcgcggcaggtttcgggcttcaggacaattcgtgatggcgggggctggttccgccgctgtatcgggggcagggaccccggtggcggggcccacaggccgcgaccttttcgccgaagggctgctggagttcctgcgacccgctgtgcagcagctcgactctcacgtacacgccgtcaggtgcccgggagggaagttgggggcggggcctgtctctctggctttgtaggggcggggccaagaaagtgttctggctgggagtgggcataaatttaggaaactgattcgaggcggggaggacaggcgggaaggccgcaggtggagggttcagcggaggccggcttctctcagtacttggtaaatacgtaggggagttcgtttcctgagctccggtaactgcctgaccttgtaggccttgtacctctttgcagagagagccaggtagagctccgggaacaaattgacaacctagccacaggtgagtgagcatccctgtgtacccggaattcttcagcccactttcaggaccttaggtttttgccaacccctgggctgagtttctgtcacttgcttccagggcatcagggctgccaaaggactcctcctttcagggatgtcttaaatctctaatggctgtggcccgtttgggtgcaagtgttttccatcccattaccagcctgctttccctcagaacaagagataagccgttagatcttagctgcaccttacttccatccccagaactgtgccgcataaatgaggatcagaaggtggccctggatcttgacccctatgttaagaagctacttaatgcccggcgacgcgttgtcttggttaacaacattctacagaatgctcaggtaaaagaatatcttaccaacagtgattctttgcccttttttgtaagtcctcaacacagtgaaagccactgtaattttaaaattctttggggaaagggaaattcacttctcc

SEQ ID NO: 56200 - DNA, 1228 bp, Homo sapiens
atcttcctgccacttcctcctaaatggtgctgggataggcatgagcaccatgcctggcctacatttttttttttttttgagatggagttctccctctgtcacccaggctagagtgcagtggcacgatctcatttcattgcaacctccacctcccggtttcaagcgattctcctgcctcagattacaagcacccgccaccatgcccagctaatttttttgtattttttagtagagacgggttttaccatgttggtcaggctggtcttgaactcctgacctcaggtaatccacccgcctcagcctcccaaagtgctgggattacaagtgtgagccaccatgcccggcctacattcttatatatacttttgaagactgactttgaggtagatcacgcccggtatttttcagcacctagttcacttacactctcaagcctttcacagtggttaagattccaaaccttccttgtcttgtaggaacgactgagacggctaaaccacagtgttgccaaggaaacagcccgcaggagagcaatgctggattcgggaatttacccccctggctccccaggcaaataacagatgagcctatggactcagtagcacaagtactgttccccagctgccttgtttcaacagacatgcaaagatcctaggagacagtccccatagaccttcagacattaaaaagggagccgtacagtttgtttgaagcacttcgtcttacccatttatgtaggggccccaggaaacctacacacagccagaatgaggttcccaaaggacttacattaattatggctcttgcttcctttcacaaatgagctgaggcctctacttttttttttaagctgcatacgtgaggcttaccttcttcaggactagttaaccagaggggcttcctttgtatgttacatgcctggttacatgggcctggacagcatgtcctctacctgtgacttctcattttcctgtttacactggggatttggagggggcaggcaaagtcaaagtgaatgacctctgtccacccacttttttattgcactggcttgaatacagtagcagtgttgatagaatcattttattcaataaatacttaaaatgatattctagtttactctggtatatggaaaggttccaggagtttgtcctttaattcaaagacagcttcaaattgtgatctgagtatttataattaaatgactcaattatcattttcaacaaaa

SEQ ID NO: 56201 - DNA, 1969 bp, Homo sapiens
cctgggcaaaatagcgagactctgtctctacaagagaaaaaaaaaaaaattagccagttgtagtggcttgaacttatagtcctagcttctcaggaggctgagtcaggagggttgcttgagcccaggagttcgcggttacagtgaactatgattgcgccactgcactccagcctggatgacaaagtgaggccctgtctctaaaaaataaagttctagttatcagaagtgccattttgatggcacacctactggatttattatttttcagggccattatgctgtgatgaacaaccccaccagacagcctttggccctaaacgttgcatacaggtacagcatgctttgggtttagggttggttgtaaactattttgtgcattcctttaatacctcatacctccctgtgttctaggcgctgcttgcagattctggctgcaggactgttcctgccaggttcagtgggtatcactgacccctgtgagagtggcaactttagagtacacacagtcatgaccctagaacagcaggtattgggacagatatgaactgagttgttttgccccactcttttgaatactgctgctcagcaggcaaagcggaatatggtctttacgggtcaggaatttggggattctgaaagactttggtcctgagatttaaaaagctgtcttaatctctgttttcagaagggtattactcaaataaggtcctttgattttccttgcttactctcactttgctttccttcaggacatggtctgctatacagctcagactctcgtccgaatcctctcacatggtggctttaggaagatccttggccaggagggtgatgccagctgtgagtgaccactgtgggtcaggggttttgtattgtaatctggtacagagaagctgtacactacttaaatgtctttaatatttccacagtgtaagtaatgacttttatgctgggctactcgtctaaatcacctttttctctttcctagatcttgcttctgaaatatctacctgggatggagtgatagtaacaccttcagaaaaggcttatgagaagccaccagagaagaaggaaggagaggaagaagaggagaatacagaagaaccacctcaaggagaggaagaagaaagcatggaaactcaggagtgacattcccttcactccttttcctacccaagggggaagactggagcctaagctgcctgctactgggctttacatggtgacagacatttccgtgggatagggaagatagcaggaagaaaagtaaactccatagaagtgtcattccactgggttttgatattggcttagctgccagtctcccatttgtgacctatgccatccatctataatggaggataccaacatttcttcctaatattctataatctccaactcctgaaaacccctctctcaactaatactttgctgttgaaatgttgtgaaatgttaagtgtctggaaatttttttttctaagaaaaactattaaagtacttcctagtagggctcttggtctttctggttggtgttttttgtttgtttgtttttttgcatgtggcaaccttttttgcttttggctttgtgtactcttttgttgaaaatgataattgagtcatttaattataaatactcagatcacaatttgaagctgtctttgaattaaaggacaaactcctggaacctttccatataccagagtaaactagaatatcattttaagtatttattgaataaaatgattctatcaacactgctactgtattcaagccagtgcaataaaaaagtgggtggacagaggtcattcactttgactttgcctgccccctccaaatccccagtgtaaacaggaaaatgagaagtcacaggtagaggacatgctgtccaggcccatgtaaccaggcatgtaacatacaaaggaagcccctctggttaactagtcctgaagaaggtaagcctcacgtatgc

SEQ ID NO: 56202 - DNA, 2179 bp, Homo sapiens
tcattttctgtcaattagtggaagctgttgctgccctggggaacaaagtcgtggaaagcctaagagcacaggatccttctgaaggtttgcatttgttgctgattctgtatttagtagccataggaaccaggtcttgtaattgtaagtacactttcaacaaaatcagatcagaccagatggaagagtaaatgcagagttttatgttgtgggagtttttggcaggggcttcaggtgttcaaggtgttcaagggagatctgtttgatctcccttctaaagctctgtattctaaattctcattctggactttgtgctgttttaaaaaatccacctgttcccccccaccctggatttaactttgatcatctaatggaaatgtgagttatagtttttgtttattctgttttttcagttttaaccatgctgaccaacgaaactggctttgaaatcagttcttctgatgctacagtgaagattctcattacaacagtgccacccaatcttcgaaaactggatccagaactccattgttagttcttttttttccattgctggaaaatttaggggatattcaaaacatggtattgttgctgtttagtttacttagcttgttgctattccacatgcagcttcctgggaattgaagaacttaggtttattctgaactttgctctctccctctgtaatttggaaatagtttatcagcttgctagtggaattttcagatggggtgaccaagaaagcatttggaggacttaaaaaggactgagaaaatatttatggagggggataggcttttgaagaaaacagatcttgcatgtttctagtgatttttagacaagtgatttgctgatatgagaaacacagggtggcttaaagaattgcagagttggtcgggtgcggtggctcacgcctgtaatcccagcactttgggaggctgaggcaggcagatcacctgaggtcaggagttggagaccatcctggccaacatgatgaaaccccgtctctactaaaataaaaaattagtggggcatgatggcggttacctgtaatcccagctactcaggaggctgaggcaggagaattgctcgaacccgggaggcggaggttgcagtgagctgagatcacgccactgtacgcaatccagcctggacaacagagcgagactccgtctatcctgccctccttccaagtttttaagactgtagcagtggtaatgagtagcttgtttaatgaaaatgtttcatcctggcatatcatgcttgtctttttagtggatatcaaagtattgcagagtgccttagcagccatccgacatgcccgctggttcgaggaaaatgcttctcagtccacgtgagtccctctctaaccatttggattaagataaactttttaactgcagtgaatagcaggatacccccatacttcctctgacagaactattttgcctgtgacctcgtgtctggatttttatttttaccttaaggaagcaaattaagatttagagaaagcagagaatgtatagttctggaaatagcatagtcagcttcaattctaccttaggcatggaaatacatgatcgtattgattttaatgtttgggtcactattactttcagagttaaagttctcatcagactactgaaggacttgaggattcgttttcctggctttgagcccctcacaccctggatccttgacctactagtaagtaaagatgggcaattggagttcctcatcatccttatttactagtagtagtagtagtagtagtagtagtagtagtagtagtaactctgaaattcaccagagtctgaaatttggtgaagcttaaaagaaattttattggtagacaagtaatccaataaaaattcaacatttacatgactcagagacatttgtttaaaaaaaaagaaaaaattcaaagtttttttttttttttgtatattcaatgaaatgagtagttactgagttatagtgtcccgttttcttctcatgactgctaccatttaatcatggtagtagagagaaatgagtgagcagccatttcagaattgcttctgaacatgaaaattttggctagacttagaccttaatgaccagttttcctcgtgatcatttaaggttttagtttgatgcctgtaatcccagcactttgggaggctgaggccagaggatcact

SEQ ID NO: 56203 - DNA, 1431 bp, Homo sapiens
ctgatgaaacttccttcagtgaggccttgctgaagaggaatcaggacctggctcccaattctgctgaacaggtatgttcttttggctgtcttccagaaatgtctctaaagcagttaaaagtattggtaaagagtaactgttggtaaggttaagaatggtgttaacagagcctgaaatccacaaagggtttaattgttctccttatttctcattgtgggtggagatagccaggtggatatataaacaaattacatatgcattcttatttttactggggacaaagagttgttctcttcccatatattcaaggccagaatgaagtgtttttaaagccctatgtcagtattgagtcagcttgtatggaagggattaggagaaaatattcaaattctgagaaattgcttataatttttcattttcaagtattgtttcatactgtttttcaggcatctatcctttctctggtgacaaaaataaacaatgtgattgataatctgattgtggctccagggacatttgaagtggtgagtttttgatgatttagttttaggaaagggcagctttggtagtgtggaaattgccttggctcttgacttttaattttcagttgtctattatccaaagccaagcctaaaatgagaaagtacagtggaatttctttgtagtactgatcttggggacaagacttgtatcattgttatgctagctgtgatgtatcaggctttcatgtggtggttttgggggtgatttcacctctgctacttcttaatttgggtaacaggtagctgtgttgtaacagttctgggaggacctaggcacctttttttcttctaaattgtttttccccgaaatcctttttccaacagcaaattgaagaagttcgacaggtgggatcctataaaaaggggacaatgactacaggacacaatgtggctgacctggtggtgatactcaagattctgccaacgtgtgagtgtgcctgtttctggtcatgggaacagaacatagcacttggattaggggtttaggtatctttttttgttttgagacaaattctccctccgttggccaggctggagtgcagtggtaccattgtagctcactgcagccttgacctccactacagcaagtgatcttcccgccttagcctcccgagtagctgggactacagatgtgtgctaccacacccagctaatttttgtattttttgtagatacagggtttcaccgtgttgctcgggctggtctcaaactcctgagctcaagcaatctgcccacctcagcctcccaaagtgctgggattacaggcgtgagccactgtgcccagcccttacggatcttgaaagctcaaatttcttgtgagaaaggatgtttgtaagacaaatgtttctagtttttgtttttgagacggatctcactctgttgccctggc

SEQ ID NO: 56204 - DNA, 1052 bp, Homo sapiens
ctcactcagtttcctgccaggatcccaaaccagcacacctttccctcttcccccgaggagaccaggtaggaggcgagggaaaaggtggggcgcaagtgggccccggttgcttccacacacaccctccgttcagccgtcctttccatcccggcgagggcgcaccttcagagggtcctgtcctccaaagaggtaggcgtggggcggccgagaccggggaagatggtccacggggaagcgcgcgggctgggcggcggggaggaaggagttaaagatcctggattggctcttctgtcactgagtctgggaggggaagcggctgggagggagggttcggagcttggctcgggtcctccacggttccctccggatagccggagacttgggccggccggacgccccttctggcacactccctggggcaggcgctcacgcacgctacaaacacacactcctctttcctccctcgcgcgccctctctcatccttcttcacgaagcgctcactcgcaccctttctctctctctctctctctctctaacacgcacgcacactcccagttgttcacactcgggtcctctccagcccgacgttctcctggcacccacctgctccgcggcgccctgcgcgcccccctcggtcgcgccccttgcgctctcggcccagaccgtcgcagctacagggggcctcgagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggc

SEQ ID NO: 56205 - DNA, 1021 bp, Homo sapiens
tttgtttctttatgcactcctggtaactcacagaacagaaaagaggttggtgatgctcactgggaattaggcaatgaagggcaggggactgcccaggggcgcttcgccaccagcaggctaaaaagataagaaaatgggcttgaggcgggaggaggataaagtcccacagcctggacaggacttggagaaggcatcccattggatcccctgctttggaatgggcatcacttcatgcagggcatagggtccagtttgaccttgagctaagcagagacgcagctctgggaggtgggctcccaactgttggggccccacagtactagggaatagtcagctcccaactctctgctctccactgacccctttctcaggctgccaaaatcattacatataaagacccagataatcccgagtacttggaattcctgaagcagttaaaacacctggcctatgagcagttcaacttcaccatggaggatggcctggtaagaaggggtcccgggaccctccagcgtggacctccagcccccactccatgaccctctgccagcctccatccttccctattcccagttctccccttccttccctcccttcccattgttccatgtttctcgtgatgatggaggaggacactggcaagttcagcctctgaaactcaggtcatcatcagtaatatggagacgatacatcctgccctgtctacctagtaggattcaggaagtgatgctaatccaaaggcatcgtttaaatagtaaaatctccctgtgatataggggtgttattttctcccatcctcttccaaaatcccagtgcctcttgttcccttccccacagctcccacctccatgcccttcatatgcccaccccagccgacctctgtttgcccctacaggtgaacaccatcccagcatccttccacgacgggctcctgctctatatccaggcagtgacggagactctggcacatgggggaactgttactgatggggagaacatcactcagcggatgtggaaccga

SEQ ID NO: 56206 - DNA, 1031 bp, Homo sapiens
cacattacacagctctgcaagcgagcagggacaggaaggcgctgaggccaatggccacaagggacaggtcatccagagaaggcctcctggaagacgggcacatggactgggcctgcgaatgtaggctaaggtgaacattaccttctcctgttttctaccaagaaaataagtagagaaaaatcaatgcttggttggtacttcaaccaagattataaactccctgagtgtagagatcgggttctaaatggagttttctttataaaccccttgatagttttcaggtgtttccacttgagtactatgtgtgtggtatgaggtcctgtgtccagttgcagtggggacttggtaagcaggtgacaacccagatatatatgtaggctctagaagcagagctggggtaggtgggaggtgagactgctgcactcacagcatgccttccccgcaggccctggcctagccaccactcctgctctcccttaggttgtactgaactacaatgggacttcccaagagctggtggctgtgtcggggcgcaaactgaactggcccctggggtaccctcctcctgacatccccaaatgtggctttgacaacgaagacccagcatgcaaccaaggtgactgccccttgccttccaggcctccatcccagagatgctgcatccttcccctaagcacagtcgagtaggtgctcctgtcccatgctgagggctttctggagaatgactcctgcctttttcttcccttcatccatcatcccagttcactgatggactattagaaagttcttcctcctgctgtctaacccaaatctctcttgctgcaatatggactctctcctgcagatcacctttccaccctggaggtgctggctttggtgggcagcctctccttgctcggcattctgattgtctccttcttcatatacaggtgagctgtgatgtggggggttgagtgaggctgggggacccggagaaccaatagcagaggaggcggtggggacccagagggaagagggcaggggtgaagggg

SEQ ID NO: 56207 - DNA, 1016 bp, Homo sapiens
tttgtatttttagtagagacggggtttcgccatattggccaggatggtctcgaactcctggcctcaagtgatcctcctgcctcagcctcccaaagtgctgggattacaggtgtgagccacagcacccagcctgaatttttaactgtatttagtttaaattaatttaagttgaaacaggcacatgtgattagtggctactgtattggattacacagctccagagttctaaatgagaggctaatgtggtcacgcactacattcagggggtggggcccctctgagctagagggcttcctggcccaaaagagggagagagggtacctgtccacctgtccacccccacagtccctggtctcttttgcctctactttcctgctctcctctctcacattgctcaccttcccttctcccctgtcctacccagccctgaagatccacttgtcttctgagaccaaggctgtcctggaggagtttggtggtttcgagctggagcttcgaggggatgtagaaatgaaggtagagggagaagcctctgccctccccaccttttggggtcctagagggagttacccttctcaagcagccaatgccactcccatccctaaggctctcatctgactggggaaagggcatgtgccactccccagcccatcctcttttttccctccagggcaaaggcaaggttcggacctactggctccttggggagagggggagtagcacccgaggctgacctgcctcctctcctatccctccacacctccctaccctgtgccagaagcaacagaggtgccaggcctcagcctcacccacagcagccccatcgccaaaggatggaagtaatttgaatagctcaggtgtgctgaccccagtgaagacaccagataggacctctgagaggggactggcatggggggatctcagagcttacaggctgagccaagcccacggccatgcacagggacactcacacaggcacacgcacctgctctccacctggactcaggccgggctgg

SEQ ID NO: 56208 - DNA, 1029 bp, Homo sapiens
ccaccccccgcccttccactatggccgcttctgtgtggtgtggggagacgctggtcctccccgtcctcccatagcgcttattgcctcaccctcaccccctaggggccggatccaaaggcgctgcactccccaagccttggggcatcagccaggaaggtttcctacctcctaattcaggggcaggactcctcttttccccccacggggaaaagaggcagaaacttaggggtttccctcctttcttagggtcagacgctcttagggtccacttcttcaggggcggaagcctctcctacccttcccatagggacacaggcctttaccccactgtacttcggagccaacgcctttccctcagcactgccaccccagagtcaggacccagaggactgtgccttcgcccccaacgcaggcgcggccttttggagaggagggaggagtggagaggacaggggcccttgctctcccctccccaacttgttcctcttgccccccagtccctggcaatccagagatcccgatatctaggactgtccatccatccactccctgaccttttcccggctcctggctgcagccatggagttgcagaagggaaaaggggcggcagcagcagcagctgcttcgggagcagcgggaggtggaggaggaggagcgggagcaggagccccaggaggggggaggctgctactttcaaccagtttggatgccaaggatgagttagaggaggtaggtgtggggggagggaagggagttaagaaattgggttttggagggatactggagcggataccgggtgggaggacggggggtgggggcgggggtggaggctttcaagttttttgtgaagtaacacaaacactgctccagcttcctgctcctgagggaagaaatgtgggccaacttcctggacaggttgtcatagtaacagcagccactagtatgaaaatgggtggggggtgttggtgaaggaagggatacaacatccaggtttaccgaatttatttttgacattcctttcgacataca

SEQ ID NO: 56209 - DNA, 1336 bp, Homo sapiens
cctgcctcagcctcccgagcagcagggactacaggtgcccgccaccgtgcccggctaatttttttgtatttttagtagagacggggtttcaccgtgttagccaggatggtctcgatctcctgacctcgtgatccacccgccttggcctcccaaagtgctgggattacaggcgtgagccactgcacctggctgcccagcaggcttttctgcctcattaaaggataaccagtaccttttccccactctgtgtgacagaacaagggataggttgggaatgcaggacccctgtggaaagaaagtgtccagaatgaaaagtatttcattgctactcggtgtcttattggtgttatttaagtttaagggattagagggcaaggggtccactgtgggtggggtgaggaccttatcctcagcttgctggctgatcacaaactttacttctcacagtgttaccgggacttagctctggtgagtcgtgatggcatgaatattgtcctgaataaaatcaaccagatacttatggagaagtacctgaagctgcaggatacctgccgtactcaggtaaggccagaaagaaaagacaagatccagctcaaagagagaggatggatcttctctctgtcaggaacgggaaagaggaatcagggctaacacacccctatcattgtgtgtctaaattgtaatgtgctcctttcagttgtaattgaattagctcccttctcaaactcacagttcctgctcttcatctgtttttccctctttcctttagttggtgtggttggtacgggaactggtgaagagtggggttctgggagccgatggtgtttgtatgacgtttatgaagcagattgcaggtgagtttgatggcaggagcataaagaagaaaggaggagagcccagagactacatagagacaatggagaatgattaagtgccaaagggatggaattcttggattgcttagactgtttccttctgatacagacatcttctggccacatatgttgtagaaataaattgattgaaaaatcatggggggccttttaaagcagtaagtcttgcctcattttctttcctgctaaacccagggcttgacagaatatttggcctattttagccagtcttcactctgagattttatagcatttcagagcaggaagaaatggggagagaagtgagggcaattaatttgttctcaagtccctgtgctttcagaaacctagacatcttccctggctccacccccattatctgaacgcttgctccctaataattaagccctttactggggccagaatgagggacaaactatgtcacagaacagaccctgacattt

SEQ ID NO: 56210 - DNA, 1045 bp, Homo sapiens
ttggatggtgttggtctggaagtatctttttgtttgtttttttacctttttgctttatcttggttgatttcttctgacagttgggggaatataagaagagggaaaccagatccttttccttatttagtgttactatttgtgatcacttagggtctgtttgaggaaaaactttccacaagaaggtttggagagtctaggctttggataatggtcctgctaggtcagcaccaggaaattctcagttgatgttgagtggtgaacagacccagctcttactcttgaagaacatttcttgctgttcaccagtggctcaagaaaatgagaaaaggttatacttctgactggagagtcagtgaccagtgcaaggagtaaagagccaaaaactggactgaagttgcagttgggggtaaatgtagcctgaggtcagtggcaagaatgactgtaacatcagaatgcagggcaagctagaaattttcagcattttttttttaatcaagaagttctcctaaaggaggggagacttacgagacagtatgagctaatgaatgaattgtggagaaatagaggtctagggcaaacctagagttaagtggtgctcgttttcctctggccaaggaccccacactgtcttctaaggtctttttcttgcttcccctttccccaggtgcgatttggtcaacaaaagcgataccaagattggttccagcgccagtacctgtcaactccagatagtcagtctctgcgctgtgacctcattcgctacatctgtggggtagtccacccttctaatgaagtactgagttcagatatcttgccccggtgggccatcattggttggctcctgacaacgtgcacggtgagggcaaaagatactgggtggtgaagggtgcctcttccatggtgttcccatgtttccattcttcttcctgactccagggccacttgacccctaagggcccttctttcactctggtcttccagagtgtctcagccttcacttccctttgtgtctctagaaatttacttacactcattattttccatc

SEQ ID NO: 56211 - DNA, 1050 bp, Homo sapiens
tgctgggcatatgtcttcttggctcttagaggaatttctctcctgccatcgtattacaaaggtcttcaaatgccttcatgttccctgttgacccccttcagggatctgagtatggtccagttagactgattgtgcttagacctatctcaactccatgttgagttagaaatgagaagctctggccagacacagtggctcatgcctgtaatcccagcactttgggaggccaaggtgggcagatcacctgaggttaggaatttgagacctgcctggccaacatggcaaaacccgtgtctactaaaaatacaaaaattagccaggtgtgatggtgcacacctgtaatcctagctacttgagaggctgaggcacaagaatcgcttgaatccgggaggtggaggttgcagtgagccgagattgtgccactgcactccagcctaggtgatgagagtgacactctgtctcaaaaaaaaataaaaataagagaagctctgatattgaccttcatcatgttccccatttagacacctagctcccctgtttgacaaccctaagttggataaggagctgcgggcaatgctgagagagaagtttcctgagttctgcagctcaccctccccacctgtggaaggtatgaggcccgcccattccatcacctgtgtcaaaagaggggcaagacaaccaggccttcaggccagagcccctttcaggatgtcccacacagttctccacttccgtgacactgtccatcacagtttttccttcctcagtttatcttttttattcatttttgtgttgtctgtcttgattctcttgctttatctaatcttatttgacttgctcatctttcttgttctcttaactcttttctcctagtaactcctgctcagtagttagaaggctttcatgtaatatttacaatatttatctcactttaacttgcccatctctcttcccagctctaggccctggcctctgatgacagtttgtcatgttgggcctcaaaccttactctcaatacaactgccatctccttaccacacatacacactt

SEQ ID NO: 56212 - DNA, 1731 bp, Homo sapiens
tcaagtagtattttccaacttggttttaaattaaagagcacttggaggctgggcatggtggctcatgcctgtaatcccagtactttgggaggctgaggcgggtggatcacttgaggtcaggagttcaagaccagcctggccaacatcatgaaactccgtctctactaaaatacaaaaaaatttgtatttggcgggcacctgtagtcccagctactcagaaggctgagacatgagaattacgtgaacctgggacggggaggttgcagtgagccgagatggcgccactgcactccagcccaggcgacaagagtgagactagcacttcggactgtccctgatcttactctagttaccaatcctaatgagctgagcatagaggagtcatgtccagtgttgctcttattcctggcaacatccctctgcaggtcatggagggttgtgaggacaagaggtttgtcaagaggtttgtcctcccagggtcagtattccatttagatgataaactccttattctctcacttgccctccattctcccttcctagaagcatggggcatgttagaggacccaggaggccattaaatgccttatctttttttactcccaagtcaaaattgaggagccagtttccatggagatggacaaccatatgtcggataaggatgagagttgctatgacaatgcagaggcagccttcagtgacgatgaagaggatctcaacagcaaaggtgaggccatcagcaagggctagttcagggttgtgtcagccctgagaggaccagttcccagaagcagcctctctgcactcttcctgtcacccttattcctgtgagttaaagttttgttcacagggtatctggatgagactccagaatgcagagccctgtacttaacactcaaggcaggaaggaaaaaagaagtggttcctgcccttgtttgcttgtaagagctagtacatgtgcacagtcagggagatgcttcaggcactcacacagcattgaggaaacaggtgcacacttagggcatgtgaggaaggggataagtcattgaggggactgtctctgttgctggcatctgggcaaactgacttctttcccaaatcactccctttaggaaagaagagggagtttcgcttccaccctatcaaggagacagttgtggaggagccagttgatatcaccccttaccttgaccagttggatgagtccctgagggacaaagtactccagctacagaaggggaggtgggtacagaccttgttctcaacttcaggaggttcagccccaggctctctacctggtgcttaatgggtatagcaggagatgggggttggaggcaaacatgataggagtgtgtggagaggtagctgaagcttcatgagggagttcttctgcactttacgttagggagtatgagctgggagtggggcagcctcattccgtaacaccttgagttcccactctgcagattcttgggagaagaacctctgagaaccaaggcaggattggtggggattttccttttctttgggcctctgcccagagagcagccaattctgccctaaagcctccccatccaagctgggattttacacagagctcctttgttttgtctctgtgcatgtgagtgtgcttgtgcactgttctgggtgtgtgtcctgccctctgctatcatttatgtccctgggatttcctctcatttctgtcctgcagtgatacggaggcccagtgtg

SEQ ID NO: 56213 - DNA, 1746 bp, Homo sapiens
agtggcgcgagctccactcactgcaacctccgcatgctaggttccagcaattctcctgcctcagcctgctgagtagctgaaattacaggcgcacaccaccacgcccggctaactttttgtgtgtgtatttttagtagagacagggtttcaccatgttggccaggctggttggccaggctggtcttgaacttctgacctcaggtgatccgcccttctctgcctcccaaagcgctgggattacaggcatgagccaccatacccggccaactttcaagaatgtttttaagattttgttgcataccaaaagtgttctttatatattctggatgcaagtctcagacataatgatttgcaaatattttttcttccattctgcgagttttaacttttttgatagcatcttttgaacaaaaagtgctaactttttatgaagctaaatttgtctatttttttcttttaccacttgtgtttttgttgtcatgaagatttactcctgttttctcttctacaagttgtgtggctttaattcttacatttaggcctacaagccattttgagctaagtttgtatatgctgtgaggtgtcactgccctcatggttagagcccagaaagcaagagagaaagccttctccagcctgacctgagccctccctcttctgttcctgactctcatccggcagtagcttcactcactgatcgtggttggagcccttttgagctctggggaaggatggacagaaagaagagtatcccctggttcccctgagttatcaagcccctgtgggaggcagttgggagggacatgaggcagattagcacagggcatctggagccagcaaagcagttttagagcgggagcctgcttcggggatgcttgaaggtgggcactggggtcaggctgctggctcaggcccagctggtcttgcagcaaagccgccgcagggaagatgaacctgtacgagtcatttgcccaggctacccagctgggcgatctgcacacctgcctgatgatggacatgaaggcctgccaggaggacgatgtgcggctcctgtgccacctcacgccctccatctacacagaggtcagtgcctgcatccgtatctgtgccggggggctcacaggaacacacctcagtgaacactctgagtacacacaaccctgaaccctcttttgttcatccccactaacctaggtgggccattgcttcccacactcacagctgtcccctccttccacttctctttattagtggttgaaacatttctaaaactccctgaattcctatactttggtgtaactgatgtgcgttggggtctgagcctatatacttggcttctcagattgggccccatcatctggacccaggacagatcccacaaaccagatccatgttcatatgtcccaggccctcttgtcctctgatggctcacccttgcttggattctctctgatagttcctgatgaccagggcttctgtagtggagactcactttcatttcccctggttcactcacactctaggaactgggacataacaggtatcggccctttctcctcttggtagaagttcccaggaagagggaaataaggacccagggcatgacaggaggaactgtgatctcagccgagtactggagggaggaggggtgcagatcctggacacagggtactttcctcccccttctctagatgaggccctgcctaccccacacacctccagacataaactctctacaccacctct

SEQ ID NO: 56214 - DNA, 1023 bp, Homo sapiens
agatatgacacttcctatacagttagggcaaggctgaggcctctaggcttctaggatgagcccagatccattgtcctccttcccaccaaagtgcacaagggcaggctctctgtcagccacttttgttctttaggtgagtcctgtgggcccaccatgagccaggctctgggctggggctcaggtggctcagggactgataggagtggggtaggggattcttcctggctcctcatcaaagactgtccttattccctccagtggctgttgggggatgagagaggtccccagattccatcctggaatcataccttccccctgaacagcctctgcccttccctcacagagcacccagaggccctgtcctgcctactgcttcaactccgaagagaaaagtgagttccacttctggggctctttagccctcaattttaacatcccaagagctgctgtggtctaaagggcttctgtcctcctccttattgccatattttttcctgtcgttaacatctgcttattctgcccttcccccaacgtgacttacaaatgagcagctcccctgggatctgggcttcctctcgactttacccccctgcccaccaggagctgccctcggaggtggggaggtggggaccggacatccctgtttcctgctgccacagcagttctaatccctggtggctcctgctccccgccgcgccccccccaccgccccatgctcctgctggccaccgcacagctaatccaagaggagggagggtcagggtagaggggtcacgcaccatcctctccctcaccctgtgcagagcagagccagctggacctactgtgccttgacagggtggggcagagagggagagggtggcagccccctcttcccgcaaagccctttagcaacatcccccgataaatggggcagcagctgtgtatcttatccttcctacctttctgccttccttccaccctttctgctctcttgcctgagagactataaatggtacagagtgtcctagaggaagtgggaag

SEQ ID NO: 56215 - DNA, 1029 bp, Homo sapiens
atgcagcccctagccccttccctcctcctggggcctccagcccctcacactgctgttcccagtgatatttgggatctgactgaagccagaggctctgtaaaatcagaccatagtggaagtcctcagccccctggccccttccgcaatctcctcccccagtctcccaaagagccatttcaacagagaagggaaatgacaaaggggcagctggccagataagctaggatgagagcagagactcagtgtgtgggtgtcccttcctgcttccccttcaggtcttggtttgttctgaagggacgttttatagtcactatccacatgccagtgtgaaatgggcatctatgacgtggtcagggtgtccattcctaatcatggggcagatgccacaagcattcagaaaggagtctgaaagggtggccacagccccacgtggtgtgccctggaggcttaggttggtctgaggttggcacctcaatctacaccagagcccagggagtcccagaggcaagtttcacagaattgtcaaatgatcccatttccttgagtctgtttttttttttgtttttttttgttttttttttggcagagataatcgtgtcttaaaagttgtttttaaatgacaataaaacaagccagaatgtcttttgtgctggagtgtctgctggcatttgccccgtgcatgtatagcttggtcttgatttgattggcacccctacttgtaaccgcagaacatccccctttcccttcctgttctgcccccacttttgtctagagcagaagggacttggctttggccactacccatccttcctgctgccactggaggtgggagccaggcactgatctgtctatgcagaaccatcccccgtaggatgaggcctgtccttactcatttctcaagaaacaagatgcttccaaaaggtctgtcatcctccagttgaagtctgtgtgcctaccaagaatggccggaggactcgctgcttgacgggagggatgctccagcttggtctccagggacaactgtacctg

SEQ ID NO: 56216 - DNA, 1039 bp, Homo sapiens
ccgattcctcaggctccaggtaaccggccacttcccccgccggcccctcaccccatatatcctcaccccacatatccaccccgtgtatcaacttaggagtttgatggctcccaaactccacaaagggacccccaacgtaatacactccgtgaagagaaaaaacacggagacacaagctcttcaccccacttctttccttatccctgccttcttctggcctggctctttctcctccctgtcacctcctcccctaaaccttgacctcacactccctttcccaagacttgctccttaacaaaattcaggcaactcccctgaaccacgtgggcagagtccccttccctccaaatccctgaccctcctgtccccaggagtctttggccaccacagagaccttcaaacagcagaaagttcggatggcaaatgagggcttcgaccccagcaccctgtctgacccactgtacgttctggaccaggctgtaggtgcctacctgcccctcacaactgcccggtacagcgccctcctggcaggaaaccttcgaatctgagaacttccacacctgaggcacctgagagaggaactctgtggggtgggggccgttgcaggtgtactgggctgtcagggatcttttctataccagaactgcggtcactattttgtaataaatgtggctggagctgatccagctgtctctgacctacagtatctgtcattatctctctgtggaactgctttttccttgagagttttctcctggcgtggagccacaggccccacattcctgccctgactggctgtgggccagagccccgtatctggaccttggtgttttcctctcaggagaccctgtgtgaccttcgtccttggagaacctctggtgactgatgtttgtctgtgctcctgtgtagctcgccccagttttactctccgagtgccaggctcccactgctctgtcttgggaactggaggacccgaggggtcggctcaaagggcagaggtggacagaagcacacagaaatgccacctccggcagccagc

SEQ ID NO: 56217 - DNA, 1790 bp, Homo sapiens
ttgttcaaccgctgaggtttgatttcttaccctttcttctccccattttcatactcttcccagggattagtgatggaggtgaggtctccctaatcatggtaaagtgttaaccttccacctcctcccttccctcctccttcctcatccttctgtcttcctcaattctccgtctcttttttttcatcactgattgccttgtgtccctccaagtctacttgttactatccatctccaggctctgggccgtgtagacactaaacctcatgccctaaggacaggaggaaagaccctctgtttggagcattattagtagagtgaggatcccaccagttctgcctggcttcctccatccccagaggcactaaaagcagtattttaaggttggtgtcttactccctggaagcctgaaatgggtggaatagcggtaaggcttgagtaaaactaggggacagaggttcttatttgtcgattttattttataatttgaccacagcatctgaactccctctctccctggaataagtatttttcccacatttttggatatatgtatggtagacaatttttttttaagacacagagataaatgttttcctgctttggttacctttcctttcccctttaaaaggaattagctatagaactgctttgtaaagatgcttcttgatattttacttttgttccttttccctaatcattcccttttctccccactcctccagaaggcataacccttctctccacaccccctacccccacccccgtcctaggctcccatcctttccatcaagaccttcattagcttatgatatttgctgccgagatgttataacaaggactcgttcatgtatataagctatttcttgatccatttaaaaggaattgtacattgtgtagaaaaaaaaaaaaacctgaaaaagagaaaaaaaagccctagccatggatattgtgaaactgtgttatgtcattttgtaatgtgcccgtttgtgtatgatccgtgcaaaagggtttctggggaaggggagggggtagggaggcagggctgtggagggtgggtaggggagtgggccgggcccagcacactgagactggcagctgctccaaccccatccctccttagagatgccacctcccccaccacccacccctaatttgtgccttgcctccccaccctggagtagtccctccgggtcaccagcactgccttggcagagcccactccctaccctaacctgcccaccctccctatcccccagcattaggttgatactgtggggaagtgctgggggctgggaggtagccgaggaatggggcagttcccgggggcatcgaaaccaagtattattatgaattgtaattgtatttgcactgtttttttcctctgattgcatcagcatatatacaatatacctatataacaaaattcagtgtcaagctttcttatgcaagggatttcccccaccccacctcctcaaaaaagaaagaacctagtcttatgggcctttgagggtggattgtcaggggatgatagaaaggattttaataagtcatcctgaggaaatttcacctagtgagagccacatccatctgcacagccttaggctgcgtgaaccgaggtgaggctgagctcctgtgaaagccaagacctcctggtccaggactttgtagagtaaaaagaaccaccaacacaaaaggggttgagggggctacaatctggagacctggggtctcctactaacttgctatatgatctttggtagagttaattttctgagtatcaattttcttat

SEQ ID NO: 56218 - DNA, 2194 bp, Homo sapiens
aatagccgggcagtagtggcacgcgcctataattccagctactctggaggctgaggcaggagaattgcttgagtctgggaggcagaggtgagcggagatcacaccactgcactccagcctgggtgacagaatgagactgcatctcaaaaaagaaaaagaaagttgctgttgaaataaagctaaccaagtgtgaccagatactggtaaattctgcttcctttccatctccaactctgcagcccgagggtagagtggaagggaatgttatttcctcttttaatacctgccctccacttttgtctcctgggtccaggtgtcaacattgcatacttgaatactggcatcggaggacacaaaggccccagtttggcagaccgacagcgtgaataccttttagacatgatccctccccggtctatatcgcagtccatcagtggacagaaataacgcctgttccacttgtactgccccatccttgaatcctttatccctttcctctttcattcccccaacttctgtcgcatgcagtgcctgtactggtgcctaccatacacggaaagcaaaacagaaaaacagaagacaaaaaatagagatcagcaagaaaacacacgccctgccctgccacctcccctttatttcacactgctgcgatctgttcttctgccgctctgtcttctctcttcagttttctttaacagtgaggtggatctttacctctgatagaggtcagaatgaggtcctggggagaatctaagccctccgatgtgtgtttctaaagttgttttatgctataattattaccatttttaatgatgttgtgtgtcctccctttgttcagtggacggttaaaccttcccccactcaaccaatctttttctttttccttttcttccttttttttttttttttttgtaaacacaaatgacattcagttcaatgatacgagcattgcagattgcagtaggggtcccagctgccaagtaggacatgactaggagtgttaggggcagaagttttgaatgcacttaaccggaggagggcgcagggtggggggtatcaaagaaggacgaatagcaccctacctgtgggtgtttgggggctggacaatttgggtggcagtgtttggtactgaagttgggctctaagaatgaggggaaagagcctggggaggagcttaaaactcaaccactctggaatttacccatagaagacgggaagaaagaggtatgaagatgggctcaattatgagccagggaggattgaaactaggtcctgcctttctgtatcttggggaaataagaccgatctcctgaccccattgggaacacggaagtctattccaggccaaccagcccaaaattatttcatcttgtattctttgtaaaattctccctcaccccaccctgcttttaaaaattctaatctatcccctctaaccatagccccatctataatacagaggaacggctgttccaaggctgtttgctgggtgtcccacaagttgggtggacataaatgagtcaagtgacaacaggaggaaatagacttagacgaaagaaaggatttctcttccaacagttgagattcgcatatttgcctattctttcaccctctgagtgccaggagatgagaggctgggggtacacaatcaggttggagtcctgtccttactctgctgcaccagctgcagaaccaactgctcaaagccaaacagctcatggcaaaaccagcttaggacctctgctgtacaaatagttgcttcccactgccccccgcccgcccccagaatgatattaattttgccttttttttttttttttttttaagcgctactaatgtagagaatgaattgaattgtgcaatgttgctgttctggggactggggagattagcatcccatttgcccacactgtgggaagacggagtggaccaggctgtttttgaagtaagggaagccccttaaaggtacgggtttctgctcttctcatagtgtacacccacctgcctctctggctccagaagctgccagagtgcactggggggaatgttctcagcagagaagaatgaggagaagtttaatattttgcccttgaaagtcacctgaggaagtttccccacttttattttttaaaattaagtaattttttaaagaaggcacttttaaaattaacacacacatgaactgcacaccttc

SEQ ID NO: 56219 - DNA, 1899 bp, Homo sapiens
ctgggattacaggcgcgtgccaccacgcccgcctaatttttttgtatttttagtaaagacgggttttcactatgttggtcaggctgttcttgaactcctgacctcgttagccgtccacctcagcctcccaaagtgctgggactgtaggggtgagccaccgcacccagccagaagctacatttcttcgacttctgtcctcatttgtaaatgaggatggtactgtctgaattccctaaagtgatactgttataatcagatgaaataaaagtattttgtaaattatagaatatcctttttgtaaagtctctttctttaattcaacagaataaactcctggaaaagatctatttgattaagagaaacagaggagataggaaatgtaaagccactgactatttttgttggtatctaggcaaaagctgtgcctcacttctgcgggttgaaccctttgtatgtgcccagtgccgcacagatttcacccctcactggaagcaagaaaagaatggtaagattctatgtgagcagtgtatgacctccaaccagaaaaaggctctaaaagctgaacacaccaaccggctgaaaaatgcatttgtgaaagccctacagcaggaacaggtaagaattctgactgctcactggccacctgtcccagtttgttttttccaaagggtcgcgccttctagtttgcaggagtggttcatgtgatccctacaggtccacaggttccctttttgtctccttatcattgtgtcctatttccatttgagcgagtattctgattaagaacatggtaaaatataatggctgaggttaacagaaagggacagaaagcttgggactcttggcttttccatagcactctattctcatcttcattttttcctaaaacaaataatagattttggtgggaggaatttatatttgtgctataaatctctttgaaacagttatttgcagtgcgtgtttgataagaaatgacgaaagaaagagtgaattatgaagtagcccagtgaagagtagtggttctagagtatgtgaacatctcatgtagcagttataggatgagaatatcttagagaaggaaaaatgtgttgggaaactcagatccttttcttcctatttcccactccacccatcagagtcccttgtttgagtagcatcatggactttttggaagatcgggtaggcaggagtcaaaaataaaaccccatttatgctctaggactggtggtaaaaaataaataaataaaaatttttaaaaagagaaaagaaaaagtgataaaataaaaccccagtaattcatcagccttaattatatcagttggttcatcacctccagccaacttcttagagccagctttcctggagaaagagaggaggatcccttgatcattgaagcaagttagctgcttatacccagaaatctcagtgtaccacccccaccaaactcttttgccttttccatattccaccaactagccaacaacattagaggtaagaacacctccaggttttctggttaggaaattgggtgggccaggtgcagtgattcatgcctgtaatcccagcactttggggaggctaaggtgagaggattgcttgagcccaggagtgccagaccagcctgggcaacaaagtcagattgtgtctctgtttaaaaaaaaaaaaaaaaaaggaaattgggtattgggtgctgtcctgctcaatcacctgatgtgatgactcccaacaggaaattgaacagcgattacagcagcaggcagccctctcccccactacggctccagctgtgtccagtgtcagtaaacaagagaccatcatgagacatcatacgcttcggcaggtaaggaactttttgcctgatcctgatttctttagaagatttatcagccatttatc

SEQ ID NO: 56220 - DNA, 1050 bp, Homo sapiens
tataggattagatagtttataccaaaaaaagccaaggacttcccagccactaatcagggtttacaatgatggtagatttatcccatagaccattaaatgaaattaccaagtctggctgtgttcctgtgtttctacttagctatgtattataggcagtgttttcccttttgcattttgtgctgtattatacacagcgtacaacctgtgattagttcttttcctcttcttcccctccagggtcacagtgtcatccgttcagctaccaataccacccttccacacatgttgatgtctcaacgtgttattgcaccaaacccagcccagctacagggtcagcggggcccgcctaagcctggccttgtacgcaccacaacacccaacatgaatcccgccatcaattatcaaccggtaagagagagctgagccctaatgtggaaacagagaaatccctttgtttgctttgcttgtcgaaagggccataggttttaagtttttatacatagataaactctaggacaaaaatggttattttggtagggatttaattgagagcagtcccaaaagtagaagctttgaggaattatattaaaatagtagtggaggagagaggttatacagcagagcagcagtaagctaaaaatctgcctagaagagagtgatctagggaataagaagcacaaggatgtgtgacagaaagcaaaatcttatttctgtctcttttttgtttgtttgtttgtttgttttttgagctggaatctcactgtgttgcccaggctagagtgcagtggcatgatcttggctcactgcaacctctgcctcctgggttcaaggaatttccagctaattttgtgtatttttcgtagagacagagtttgaccatgttggccaggctggtctcaaactcctcacctcaagtgatctgcctacctcggcctcccaaagtgctgagattataggcgtgagccaccacgcgtggcctttatttctctcttagcaatgttagctcatggtcatcatcattctcctttcctatgtgtcagagttcttttt

SEQ ID NO: 56221 - DNA, 1021 bp, Homo sapiens
aaaattagccgggcgtagcggcacatgcctgtagtcccagttactcaggaggctgaggtgggaggatcgcttgagctcaggaggtcaaggctgcagtgagctgtgatcgggccactggactccagcctgggtgacagagtgagaccctgtctcaagagggaaaaaaaaaaggaccaaagaacaattgccctcgacctatatactaccaactacgctgacaatctcaaggaaagtaggatctgggaatgtatctttgaaattagaggagaattagaagatacagtcacggatttgggaacctgaggcagttagagtttccggaattcttgttacctaggtcttaagcagtatgtgccattttttatcatcttacacaaataagcatgatgcttttaaggctaaccccagaatgacctaaatgagagttatctagtaaataggattaggagtaagaggagtcagtgcaggagatttagatttcaaagtaatttctagactctttttgaggtaagatgctggataaaactctggtaagtagatgcaagttcaatatatttggttctggaggtttaatccttttctgtaaggctgtagacaatattcttggcactattccctcaaattattaatacttccttcttttgtgtactcttcagtacctactcttgacaggatagactattcttttttttttttttttttgagacgggaacctcgctctgttgcccaggctggagtgcagtggtgcaatcttggctcactgcaacctctgcctcccaggttcaagagattctcctgcctcagcttcctgagtagctgggactacaggtgcgcgccgccatgcgcagctaattttttatttttagtagagacggggtttcaccatgtcggtcaggctggtctcgaactcctgaccccaggtgttccacccgcctcggtctcccaaagtgctaggattacaggagtgagccaccgcacccggccccccttggatttttttaattcagcatagaagttttct

SEQ ID NO: 56222 - DNA, 1048 bp, Homo sapiens
gcccacctctgcctcccaaagtgctgggattataggcatgagccatcacacccagccaaccctagcttttaaaacattcagtttaggctgggtgcggtggctcacgcctgtaatcccagcactttgagaggccgaggcgggtggatcatgaggcgggtggatcacgaggtcaggagatcgagaccatcctggctaacaccgtgaaaccccgtctctactaaaaatacaaaaaatttgccaggcatggtggcaggtgcctgtagtccccgctacttgggaggctgaggcaggagaatggtgtgaacccgggaggtggaggttgcagtgagccgcgattgctccactgcactccagcctgggcgacagagcgagacttcgtctgaaaaaaaaaaaaaaagtcagtttataaatagttcagaaacagctgatagctgtgagaattagtcttcagtgttgagttgccctccaaatgaccttgctgagtttgttgtaggactcatccaaagcagaatctctaagaagctggactggtggagaatgaagaagaaagaaatggttataactttacacatgttactttctctaccttttgatgtctacttactggtcttgtcccaggattattttttaaaaccatgctccataagcaaacattattcttggtagtaacattaaaaactcttagtaagcggtggctcacacctgtaatcccagcactttgaggccgaggcgggtggatcacctgaggtcaggagtttgagaccagcctggccaacatggtgaaaccttgtctctactaaaaatatgaaaaaattagccaggtgtggtggcacacacctgtgttcctagctacttgagaggctgaagcgtgagaattgcttgaacccagatggtagaggttgcagtgagctgagatcgtgccactgcactccaacctgggcaacagagtgagactcttgtctccattttaaaaaaaagcaaaaacaaccacaaaaaaacctcttaggaaacctcaggcagattccctagaggtcctggaagaggagaa

SEQ ID NO: 56223 - DNA, 1240 bp, Homo sapiens
gcacctgagttcttcattttaaaaagcatcttaaatgtcttcagattttgaatctgctaaccctggtgacatgcagtttacctatataacaaacctgcacatgtacccttgaacataaaataaaagccaaaaaaaaaaaaagattttcaatctgtatccatgtagaattaagggcacgtgtcaacaggccttgcttatgtagatttaagtttacttaaattgctgggttgaatgcccagaaatctcctttaatataaatgttctaggacaatatcaggtaggacatagcttagttaactttgaactttgtgtgtgtgtgtgtgtgtgtgtgtgtgtgtgtgtgtatgtgtgagagagagattcttgttaataacttcaccattccacctttttaaaaatggactatttaagggactttattctgatcttacttgtatttttctttccataggatggatagaatgacagaagatgctcttcgcttgaatctgttgaagcggagcttggacccagcagatgagcgagatgatgtcctggcaaagcgactcaaaatggaggggcatgaggccatggaacgtctgaaaatgttggcattgctcaaaaggaaggatttggcaaatcttgaggtgccacatgagttacccaccaaacaggatggcagtggtgtcaagggctatgaagaaaaacttaacgggaatctcaggcctcatggagacaacaggactgctggaaggccaggcaaagaaaacatcaatgatgagcctgtggatatgagtgctagacggaggtatggctcagttcagctgcctccagggatagggtcgtctcataaagcctgtgaaaatggaatgaattccaatgagaggagggtgtttttcatcctaaagattcttaaaagaagatatatcatcgagtttgaccataaattcattttatttccaaatgaaaccaggtgcctcaaaaactgcttagcctacagagaatcgtagttcttactcttaagagaaaaaatggtcatttctagataaagggggcactagagagctgataggccaaatggaagtgagttaatatataccttcattctaatcttcatggccgtcttaggaggagaaaaatagtctttttgtcagataattccaggagttttaggatgtatttattgtggagtcccagcttttattacatccaaaaacatgggcctagcttttcttgtgtcagaaagcaaattatcttcatg

SEQ ID NO: 56224 - DNA, 1014 bp, Homo sapiens
gagaattagatacttggttttttgttgttgctttctttctttccttttcctccctccctctctttcatctctttcttttcttcttctctttctttctttcacagggttttgctttgtcacccaagctagactgcagtggcacaatcatagctcactgaagcctcgacctcctaggtttaattgatcctcctgtctcagcattccaagtagctgggactataggcatgcgccattgtactcagctaatttttaaattttttgtagagacaaggtctccctatattgcccaggttggtctagcatttctgagcttaggctctcctcccgcctccacctcccaaagtgctgaaattacacatgtgaacctaaatactgtttttttggttcttagctctcaccattccgataatcagcattcattcagatgttaatccttctcctgtatcccctctcaccaagcccccaatacataccttgttacttgtcttccttttggagtgcactttctcccaactgtcctcagacttgtgtgatgaatgtatcacttacaacatgttttgtctgggaagaagaggctctcaagtatgtgtgtgtgtacaaatttgagatcatgcttttcagagcattgtgaaggatctctgttcaaaactctgctcccctagtgcctattattattacttccatggtataaaggataaaaagaattttttgtttttctttcatataaaaaatattcctaaggaaagcctacatccgttctactttgcatgaagaaaaacaggatttttaggccgggcgtggtggctcataacctgtaatcccagcactttgtgagatcgaggcaggtggatcacaaggtcaagagatcaaggccatcctggccaacatggtgaaaccttgtctctactaaaaatacaaaaaaattacccaggcattgtggcacgtgcctgtagtcccagctactcaggaggctgaggcaggagaattgcttgaacttgggaggcggaggttgca

SEQ ID NO: 56225 - DNA, 1102 bp, Homo sapiens
aaatttttaaattgcagtaaaatatacataacaaaggcctaagctgtttttaaagaatgcatgggtactgtcttgactactttgctgtgaaaccttgctatgctttgtgttaggtgcggattcagctgccctgaacggtgtcaatggatcgggttaaatcagatgtcctatctgtgggacagcttcaggaaaaaagaaaaattagtgaatacacctgctgtcttattagtacctgttccctagcactagcaatagggataaagaaaagaagtttggtgggcagtatgtcttcattttgttataatttggggtgtgctttggtattgatgctgtgatttcctatcttggatgttggctttggaaactaaacagttaaagcatcatgatttgagaggaaactagctctcattcatgaagacaaagtttggcactaggctgcaatgatggggggatagttagggtggggagactaacagacttttttgtaccacaaatgacttttaaaaattaagagataattccatgtcctgaggttataaaccggctacaactggtttttctctccctccctcctgtccccgctaggcatcatgggtaaaagtaagcatccccctgtttcttttgtttaatataacagtacaccatgtgattggcagggcagtgcccgcttggagaccgggtttgtgcagggctctcaagggggctggcacgcatgggggccacctctgtgctacagaaagagcttctcttacggtagaaaagagacgatagaacagagaaagaaaggggaccctccacacacacacgaccctccacacacacacacacacacgaaaaaaacctaaacccatctcattattttcctcctttttctgttctctttctctatttcttatctctctcacttttctggaagctagaggaaggaacggaaaaatgtatacctctaagtagttttaactgtcttgccctccccaatccttatttttctttgctaaaagcagaaactcgaaatctcttctgagttctttctagtagtttttggctatgtgtagaaggtaatatgctgaggtttctaatgggattgaagtaataaacactg

SEQ ID NO: 56226 - DNA, 1035 bp, Homo sapiens
agctatatatttttttcttttttgcattgtttatgatttcagaggataaagataagagcaaccttcacaacagaagtgaaagatgagaagcttaatgtagagtaaaatgtctgaagctctaagtgaaactgttgataagctgggatttctactcttggaacgctagagaggaagagacacttagatacttagtaacagcaaaaagccaggccaaaaagtagaactcaagtgcttagaaactctgtggcaaaagagataaacgtgactactaaaactactttctctttcgtctgtggcacttagttgataacagttgttagcacatttagatgttcaagtttaatttttgttgtcagaaaagtatgaacatttgtgacttgcctaaaaagaacttggtccccctgcaaagatagagggaaggtacagatcggagtgaatgaaaataatcagcaatcaagtattaagaaatgaagtatttgcacacctcatcactgggaatcaatagcatgctgctgatacaggatgagaataagttagggatttaggactattctagttaggtactatcttgtagacactactagagatactttgtcttttggaagacagaaattattctgtaggtattaaatactaatataatgctccatatgattttcatggttttttttccaaggataggcagtggaatcccccagttgccttaggaaaatgtataccacccttacagaagagattggcctagacacatcttgtgctgtatgataaatgaaaaagttgatctgtttattttctctgttcctgtatgatgattaagtcattgagtagtgtatggcagtaattttttttttttttttgagatagagcctcactgtgttgcccaggctggagtgcagtggcgcgatctcagctcactgcaacctccgcctcccaggttcaagtgattctcctgccttaacctcctgattagctgggattacaggtgcctgccaccatgcccggctaatttttgtatttttagtagagacagggttt

SEQ ID NO: 56227 - DNA, 1028 bp, Homo sapiens
cttattttgggatattgccttgatcgcttacacatctgtttatagtcttactctctttttcttttttttttttttttcttgaggtggagtctcactctgtcactggagtgcagtggtgcaatcttagcttactgcaacctccacctcctgggttcaagtgattgttctgcttcagcctcctgagtagctgggattacaggtgtctgccactacacccagataatttttgtatttttagtggagacgaggtttcaccatgttgccccaggctggtctcaaactcctgacctcaagtgatccgcccacctgggcctcccaaagtactgggattacaggcgtgagccaccgcacccggctgtcttattctcttgtaaactctctatcatcgtgccttcaaaatagtctaacacttactgattattctactttcctcatcttaaaagtatttagtagtttccagttattaaaagattaaaatgtaaactttgagtggtattcaaggccctttatgttgttggtgtttgccttcctatccagccctacttctgtaccttatagttaatgtgtgagcaaatacagtggtttttcttttcttttttttttttttttttttatatagacaagttctggctctgttgcccaggctccatggagcacagtggcacgatctcggctcactgcaacctccacctcctgagttcaagtgatcctcttacctcagcctcctcagtagctgggtctataggcctgtgccactttgcccagctaatttttgaaatacagttctttttaattacaggtagcttctgaatctcataaagaatgccacttcttctgggaaaccttccctgacttgcccaaagagagttagatacattttcttctttgccctcataatttttattaagtttatttttatttatttattttttgggatagagtctcgctctgtcacccaggctggagtgcaatggtgcagtcttggctcactgcaacctccgcctcccaggttcaagtgattctcctgc

SEQ ID NO: 56228 - DNA, 2222 bp, Homo sapiens
tggggattttggtggctccagaatccttgaagcagcaacctcctttctttgtgtagcagtgatgaaagcttctgaagaataggtctgatttgaaacagacccctcctcatgttccatcttttaccttctcccttgtggatatatgaaatattcctgtatagcttgaattcatccagtaagaagggagtgtcccagggtcattagggcttttaacctgtctgaggtatttagatggtggcttggtaatgtttgctgtctctcacaaaatcccccttacctttgccatttacctaggttgccatcagctggcaagaaactatcaacagttttgggttatagtacaaaaagcagcagattactaagaacacatcattcgttacttttgagatatgaagtggtcagatccagacctcaaagaatcatagtaactgcagaagcatctttgacaatgtgtgaacttgttattaataataactagtaaactgctaaagaaattaagggaaattatagcaattccatattcctgagccattctcttactgtttttcacacctggctagttccattttattttattttattttatattttttgagatggagttttgctcttgttgcccaggctggagtgcagtggtgtgatctcagctcagtgcaacctctgcctcctgggttcaagtgattctcctgcctcaacctcccaagtagctgggattacagtcacctgtcaccatgcctggctaatttttgtatttttagtagagacggtttcaccatgttggccaggctggtctcgaactcctgacctcaggtgatctgcccacctcagcctcccaaagtgctgggattacaggcatggagccattgtgcccggccttagtatccatttaaaaaaataattcaggttactgttacctaaagctgagagtcgtactttaaatcttttgatcaaagctttcttcggcttgtctcatttcaagggagggtggaatttataatctttaaaaatacatgctggaatgttagtaggatttagattagacaccaggattaataaattctcattataattgtgaaggattgcaaatgttaactgaaagacttgtgcatctcttgcccagaggatttttataatgttagcatttttagagtatttaaactcaaacttgctgaaagagaggggatgaactaatatgtggcagattggactagtggaacacaggttgtggagagccttgaagtcctgggttgaattctagctttgtgatttattagctaactgattttgggtaatgctactaatttttgaattctcatttcttgcagacagagtaatgccagtccttgcaatagcctttaaggctttacatggtttgccctccccaacctcttccatttttgatcggctgtcatcttccctcttgctctctccattccagccacactgacttgctccttgaatgctgatcagtcacactctatcttagaaccttggcaggttcctaagaccaagtgattccttctagtgggaaaacagctaggtttccccacagagaatggctgattgcctcacctccttaacgtctttgcttaaatgtcacctttttaatgaagtcttatccttcctttctttaaaattgtattgtcagttcccatccctcatgcttatccttgcctgctctattttctttttcataggacttaacacttttataatatatttatttgttacatttattgcctattggttctctttctatgatgtaggtcttagaaggcatggatttgttttggtaatttgtttagtgcctagtacagtgcctggcatgtagttaataataaatgtttgttggccggggttggtggctcatgcctgtaatcccagcactttgggaggctgaggcgggcggatcacatgaggtcaggagttcgagaccagcctagccaacatggtgaaaccccgtgtctactaaaaatacaaaaattagctgggcgtggcagtgggcacctgtaatcccagctacttgagaggccgaggcaggagaatagcttgaacctgggaggtggaggttgcagtgagtcgagattgcaccattgcactccagcctgggtgatagcgtgagactcagtttcaaaaaaaaaaaaagatatgtggggcatggtggctcacacctgaaatcccagcactttgggaggccgaggcgggtgtatcatgaggtcagg

SEQ ID NO: 56229 - DNA, 2652 bp, Homo sapiens
tggtggcggaggtgggggaagggaaaggtggaggggcggggggaggggaagcgcccgcgagccgacgcccgcccgcgcgcccccgccttgcgtccccctccccccaccccggcacggcgcgcccccgcctcgcgctccttcttcacctcatcctctccccccttggcgcgcgcgacccggtctttcacttcggcctcgcgcgcccccagctcgtgtcccttcatttcgtctccttgtactctttctcccctccctcacgccccgtttcccccgccatccccgctttcactccctgcctcatgcccgccatgctcccctcctttcctctctagcgcgcccccccctttttttttttaactctctccacccccagtggtgccctcagggtgcgggggccgctccctgctcagtcttgtgtttgcgggcggatgggacgaatggggaatctaagggtaaaggaagcaccagataattatctttatttagggaaagggatcaggagcgcataaccttacccctttatttcgtcgtccaccgttcgctcgccctcccgtaggggaagagaattgtctcaggctatgtgggcacttagcttctacagcgactgggcttgtgggacacactggatctgtcttccagttcagttcctgagggtcggtggaacttacccttccctaaccacaccgggacttagagtacttttggcctccctgctctcaattacattgaggagcgagccactcatgcgagtgcagaggttcaggtgccattcgcgcgcccggtacagctttcccgtttcataaaggtatggtagcctctttggattcttccccagcatcaacttccaaacacaagatgttagctcatagggctggcagtgaggtggagatggaggcttggtggtgggtggcatgtggatgctaactgagctagctagcaaccttttctctgttgtcccctggaaaatcaggtagcctcctgagaaccagttttctcatttctgataaatgcttatttggggggcgtgtgtgtgtgcgtgtgtgtgtgtgtaagagagagagagagatggggggatacttaatacatttcagcagaggcgaaggatacttaatatatttcagcaaagggcaagagcagtgttttcaggccagactgcaaaagagggatttggatttgtagctgatggaattaaaacaggtttaacagatctgtgttggagaagagctgatgcttttgtagtttttaggacattttttctaaaaatttatattttgagtagaaaagcatgcatgtggttgtacaaagtgaaaagtaagcttccttcccatctctgtcctccagccatctagtctccttcccctcctagcacagatgactttgatgttttctggcagcagcatggtgcctatatgttgttggtgattatcctgtttgggagtttagtgctaactttattgcttttcatttggtatgctgacctgaactcttccttgcagtctgataacttggattcttattttggtgctggagcagcctttcaagtattgtcctagagtagtatttctgtcagtacttagttgggaaggaggccacttctggaggtgctatggaggagttcagtatattttgagggaaggcccacacttgttggatcgtgctgctttttttgtgacggatatctagtccctggccatttgggaatggactgggtcaaggatcggattcatataagcagatagcttatatgaataactagttgatggtaaggctgtcttcactttttaggggaatagagtttttttagtccagtggcagtgatagtcatcatggaacaaggtagaaaagtactaatcagcaggaatcagaaggctgaatctataggctgagtgacccagtttgagtagaggtgaggcttacagacttttgtcctgcctattattccttacttgagaacactctccatgaggtgagagtgatttgtagttgacagcagcatccatctttatgacactgtggtttgccttccctgaccgtatgtgatgtgtgttaacttcctgtttagaggcagtcccagtagggtctgaatataggctgcactcaaatacttttctaggaacagtgttaaccaggttccctgatcagcccttcaaatctaaattctggcagtaacttttactgctgtgcttagcatagggccacagggtggtggcagagggaagtgtgaggaatttgttctgagcctcacaaccttaaagtactttcaaaagcttgtatgctgtcccccattttggggttttgcccccttctcccctttttttgccagacgggcaaggctggacctccaggttgaattttggggaccattgtgtcagtgaaggtatcctaatcatgtgttgagacctctgaattcatctcacctttaagcagtgagtcttgtgtgttgcatgtaaagcattcctcctgtttcaatttactgattcttcttcctttcctcccccacccaccaagctggaggtgcatgtggaggaaaacagcagctgtgctgtcctgatttctagactctggagcatattccatgttagccaccccattgggagtcatgctgacaagcagcccctctgcgcttaacttagaaggctcatgttgcttggc

SEQ ID NO: 56230 - DNA, 1147 bp, Homo sapiens
tggttcggatccttgccgtttcactttaccactctgagcctcaatttggtcatctgtaaaatggcataagcacctatctcactgggctggtgtgtggacaaccttgtgcagagcctggtacctaaacaaatgattcattcatatttgtctattcgttccaccagtattgagtgctttttatgttccaggcacggttttaggcactaggtatgtagcagattacaaaacagtccctgctctcaagagcttacattcttgtgggggataagaattcctttcccacttctctttggctgtgtcctgtaatggccctctgtctctttggcatcacctgtccgtttcttgtcctctgcctcccattcgttgagcctaactgtctccactatcttggctcccccaggccccatctccttggctaacccctgatccagcctctgttcaggtacggctgctgtgggatgtactgacccctgaccccaatagctgcccacctctctatgtgctctggagggtccacagtgagtctggtatttggcctgggtggggagggtgggtcccatacccagagggctcagtgattctggtggccttctttcctttcatccaggccagatcccccagcgggtggtatggccaggccctgtacctgcatcccttagtttggcactgttggagtcagtgctgcgccatgttggactcaatgaagtgcacaaggctgtggggctcctgctggaaactctagggcccccacccactggcctgcacctgcagaggtatggtgctaccatctgggtgatccctggtctgtccggggctccacaccccttttctctcactcatacacttctgcctccactaaaggggaatctaccgtgagatattattcctgacaatggctgctctgggcaaggaccacgtggacataggtgagattgcaggcaaggggctgaggagtttagggatctggggccaggtgtgggaggctgcggtcctaacatgttgacttccaccttcttccctagtggccttcgataagaagtacaagtctgcctttaacaagctggccagcagcatgggcaaggaggagctgaggcaccggcgggcgcagatgcccactcccaaggccattgactgccgaaaatgtttt

SEQ ID NO: 56231 - DNA, 1589 bp, Homo sapiens
aaggtgctgggattacaagcgttagccaccgcgcctggctttttttttttttttgagatagttttgctctgtctcccaggctggagtgcagtggcgcgatatcggctcactgcaacctccacctcccaggttcaagtgattctcctgcctcagtctcctgagtagctgggattacaggtgtgcaccaatatgcctggctaatttttgtatttttactagagacagggtttcaccatgttggccaggctggtctcgaactcctggcctcaagtaatccgcccacctcggcctcccaaagtgctgggattacaggcgtgagccactgtgtctggcccccagggccattgtaaacacaactctatatcttaactgtgactgggatggcacttctggagttatacagtgcacaacctgtgcagccacacacagctggccccgtacatgtaatgtactgtcctcccgttcctgacgccatcttcccaggctgtgtctctttccttgtggatgagctttcctgggagatgccatcgtctagacaccctggctctgctccatgcccaccatctcaacacttgctctcttaaaatccttctccaggtccacccagagcaggagaagcctgagccgacacccttagtggagctagaggagctgtcaggaagtgagctcactgtctttatcacacctcccgaggagcctgccttaccagagggcagtgaatccactccccagtactggtgagagtctcttagccttcacatgttccagggtcccatagactggtccagtccaactcgcttcgccctgtgctgactgccccgatgttgcttctctctgcccctccagctatgatggattcccagagctacgggctgagttgtttgagtctcttcaagagcaacctggggccctgcctgtgccaggcccttcccgtagcgcccccagcagtcctgctcctcgccgtaccaaacaggtaagcagtgggtggaccgcactgagggacccggatcaggctgaaggctgctgctgcttcagtttcctcatctacaaaatgggtataacaataatacttaacccatgaggttgttaggagtttaaatgtgcttggcacataagcaaccctgtataaacattagttgctattatcactgtcattatcatcatcatcatcacctccgtcttctgagcactctgggaatccaggggctggccatgtcttctagggcacctgcccatgctcaagggccagcctctctgcacggggctccaggcagggctgcagcctgtgaagtacagcatcccttctcctccttagagcacagacccttcctcagagaaggtgctacttcttcccacaccactttagggtctgtcctggtggctcatgcctttaatcccagcattttgggaggctgaggcaggcagatcacttgcgcccaggagtttgtgactagcctgggcaatgtggcaaaaccttgtctttacaaaaagtacaaaacaatcagtcgggcttggtggtgcgtcccagctacttgagactgaggtgggagaatcgcttgagcccaggaggccgagtctgcagtgagcca

SEQ ID NO: 56232 - DNA, 1857 bp, Homo sapiens
gctttgggcagacgcttgccagggtcacggccgccggccgaggaggaggggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggcgggagcggcgcccaagtcgggtgcgccatgtctggggccgggtagccccgccgcccgccggcccgccagctcgccctccgagccacccgccagcgggccggccggccgggaagcgcgggacaggcaggtaggggctggaccgggctgggcggcaggcggggacgggcaggagggagcgcgggcggcaggcggggtgggggatggcccccagctgctgtccctcactgcacatctggttccggttcctctctcctggggaagtgaaagtggaggggagggcacctcccgcaattagctcgccgtgcccggcctcctgcacccccttctgctcccgtgggtgccggagtcggagccgccctccctcccgcttgggtcacgcggcggccggcgctgctgccgtcacgtcctcggccgccggcgcgcctgcttctctgccctcctgctccttcctcagcctcctccccctcggcgcgccctctgccccaacccgaacttcccgtcacccggcacgcgggcgtggggacccggagtgggccctgtgcccgttgtcttccctagggagaaagggctgctttctgcaggactcttccctggcttggtgaggggaggccccggtgcgcaggtcctgcggatgggtgccacccacttgcccctcagaaggtcccacctaatggcctctgcctgctgccttgggcatagggctcccattcgccctcagtggatgagggacaggtctgtgccccagaattaaatcaagaggctgacgctgactcctggctttacctcccagaagtggagtctaaatttagctggggttggtgtgtgtacgtgtgtgcgtgtgtgtgtgcgtgtgtgtgtgtgtgtgtgtgtccagaggccaggtgatgaagaaagccagcctggctctatgagattccttattccctgttctctgggggaacagcaggaggttagcaggactgcacatcctggaaccattctgagcctcctctgccttgctcaggatcctatagtctgagattccaacttggcgtaatgctgtgctggcaccttcaatggtaaccccaccaccgccaccgccaccacacacacccataggctgacttcctctgagttgcagcttcccctccactgtttcaggaagtaacctcccttcccctctgaagcaccccccacgcttctgggcccctgctgcgagctacccaccaggctttttcccagcttctgcaccctggggcgcctcaggacccttggggctcctactccccggggttgggccatggaggcaggtgagaactaggctgttgtgggcctgtttctgtctctgggctccatggtggagggtgtgggatggccgggacttgtctctcacaactgctttggatctaacgagctacctaaggatcctggaggtgtgagaacactggattttgggccagattggtggagttaagctaggagaaaggacacttgggttcgttgaaaagactcttaaagcttgggttttgtgggctttctcagaaacccatggggtcctcttaaaaacctaggag

SEQ ID NO: 56233 - DNA, 2056 bp, Homo sapiens
aggtaggtttgagcacctgagatcctgctgtgatcacccacaccgcctgtcacctctgcaccccaggattccctcacggcagttctcagccagtgataactggtaggtgtggtgtttcctagaaagaagaggaagggcagtccccagatgggcagtgctgtcagggatagagtagggaggacgttgtgttgccgctttcatagtctggtcactgccacccattctgggtggaaaggggctcagttcccatcagtaatgttggcatctctggttttttgtctgtgcctgcaggacttcattcacctctcagccacccatccctgcagtcctccctaagcaatcccaacctccaggcttccctgagcagtcctcagccccagcttcagggctcccacagccacccctctctgcctgcctcctccttggcccgccatgtactgcccaccacctccctgggccacccctcactcagtgctccggctctctcctcctcctcttcctcctcctccacttcatctcctgttttgggcgccccctcttaccctgcttctacccctggggcctccccccaccaccgccgtgtgcccctcagccccctgagtttgctcgcgggcccagccgacgccagaaggtcccaacagcagctgcccaaacagttttcgccaacaatgtcacccaccttgtcttccatcactcaggtatgcgtggctgccttccctgcatgtctgtctcccttcccttttctcctgccatgttgtttccctcccaccctcctttcctgaaatacctactctatactcatccccttccattcctctgtcctccgcctgccccatcttttatccatcttgtctcctcttgcttcacagtgcaaacccaaacgctgtggttaagcttttttagcttcaaaccctggctccacctcttactagcagtcaccttggacaagttatttaatttctataagcctcagtattttcatttctaaaacaaggatggttcataaggatcaaatgaagtaacatacataaaatacttagcaccacacatagcccaggtatgcttgacaaatagtagcttaccctttccttttatttgcctcctctgttcctgtctgttttatatctgtcttttatctcatgcctctatcttgtcccgtctcctcccctgtatcccctcctaatttcatagaattcgtagaatcagtcaatttcctactgtggagcccaattccttcacttaatagatgaggaaagtgggacctagagggaaagtgacttttccaagtttacccagcaagttaggaagagttgagactagaactcgaagctcttagtttagggctttttccacagagatgaaattcttagcccttgtctcccttcctgtccttttcttcttgttctctatctctactcctcttttctttcatccaaatgctcttttccctctcctctgcccaacttttcctcctccattgctatccctggaatgtgtgttctgtgttccatctttactcaggtcccctcttttgtaggaaagactgaggccagattagcaagggctctgttcccagagtgtggagtgagcttgacttcccttcctttctttctccttttctttctttcttttcccaccccctctggcctcttcaaggctgtagaacagcagttctcaaccttagttccttatttactaacaataaatagttcaagtatcaagatttaagaatggtttacttctaaggctaggcacagtggcttatgcctgtaatcccagcactttgggaggccaaggcgggagttcaaaactagcctggtcaatatggtgagacccagtctctacaacaaataaaaaattacccaggtgcagtcgcgcacgcttgtagtcctggctactggggaggctgagatgggaggatcacttgaaccaggaaggttgatgctacagttccaactatgattgcaccactgtactccagcctgggcaacagagtgaggccctgtctcaaaaaaagagaatagtttacttctggagtagatttaaaattacccct

SEQ ID NO: 56234 - DNA, 3183 bp, Homo sapiens
gcccaaaaactgcgactggcatacacaaggagctctcattatggtgggtctctgcccaatgttaaccagattggctctggcctggccgagttccaggtgagtagaccccagccagggaggagtggagtttcttaggctgcttcctctgctgacttctgtcctttttggcagagccccctccactcacctttggattcatctcggagcactcggcaccatgggctggtggaacgggtgcagcgagatcctcgaagaatggtgtccccacttcgccgatacacccgccacatatccttcacaggggacttgggagtgtctgaaaggtagtgggatggggttcctcagggactcataggaagcacttgaagtgttgtgcgtcccttccttctcttggagctcttctttacccagcttccctgaaaagcgaccatagcccctgcgtcagcacctgctcctgtgacaaggagttttgctcctgaggctgtgccccctgtctctggctggctctggctgtcttcacatcagcttgctgccagaggcaagccttccttgtctcctgctaaaggagattgggtctcttctcagatttctaagttttcagtctcagagacctgcataactgtctcctccaagccctgcctgaacattctcctggattttttcagcccctttagacctgattccctttttctcttccattctttgatcctattgttgtcccttatagaagaggagaaaggtatgagtttcttgaaacaacttatctgctgccttcattgttctttcctcatttggcctctctcatctgtcctctctacttttttccttaactggtgctgttcacattgacagctctccctatagtcctgcctacttatctcctcccccagagtctagctggcgaaggtaagtgtccagggcgggcagaagctcctgcctactctctgacgtgtttctggaaggagttgccccttctgggttggggctgggattactgggctaaggtttcaacagtacctcttcctataacgccagggctgagagaggtggagacagttggagtaggtgggtcagagtccagccttggccatgttgacactagtggtcaagcctcccagtccagccagagcagaaccaatgggaaccatagccaggctggggtgtgtgtgtaagggggaggggagaatggcagaggggcaggtgaaaatggcaaccttctgtcaagggtgggtgcaagatgtagtgttctggcacttttagatttcttaaactctccccttgtccatctcactttcaatgctcatacccaggaatgctgctgggctccaagattcccattcagctggtcctggcagagagaagtttccagctctcttagattgactgggggaggggtcaatcataggcaggagaagaaccagaaagaaaaggggatgatctgggtgctcagccatctttacttccaccttagctgccccacattttccaacccctatgcccaccttcttgtccactgccagccttcctcctcatgactttgtttttctaccccaggacgatggcctggggcaatttccctgcagagaaggggcagttgtttcgactaccatctgcacttaacaggtgatggcttttgccttctttaggccagatctcttatctgtagtttctggggccctgctccctcacccccaccctgttccagaccagctagtgttttcccttgctgggcagggcttagggaccaggaagactgtcactggtgtcagctcattcctgctccccccataggacaagctctgactctgcccttcatacaagtgtgatgaaccccagtccccaggatacctacccaggccccacacctcccagcatcctgcccagccgacgtgggggtaagtggccctgtcccagggttgggagtaaccatggagctatttatttatttatttatttatttattatttctttcttttttgagacggagtctcactctgtcgcctaggctggagtgcagtggcgtgatctcggctcactgcaacctccgccctccgagttcaagcgattctcctgcctcagcctcctgagtagctgggattacaggcatctgccactgtgcctggctaattttttgtgtttttagtagagatggggtttcaccatcttggccaggctggtcttgaactcctgacctcgtgatccacctgcctcggcctcccaaagtgctgggattacaggcatgagccaccatacccggcctccatggagctatttaaagcaggtaggcaagtgagcactgcagccaatgccactgtatcccttgcaggtattctggatggtgaaatggaccccaaaggtatgtgttcctcactgctgtgggtactgaatgccaaagaatttctgggctggtgttgggattgtgtgcaggttcagggagcaggactccttcccacctgcttctgcttcctgtcctgccttactggctctttctccaactctcccatcaccagtctttctctttcaagtacctgctattgaggagaacttgctagatgacaagcatttgctgaagccatgggatgctaagaaggtaggaggaggccaccgggtgtcacccactagtctctctgctatccccttgccatggggcaggccttccagggttctctgctgagcactgtcctcattttccatattctcccttctctcctcagctatcctcatcctcttcccgacctcggtcctgtgaagtccctggaattaagtaagtactccctgaggttggctgagaggtgggggaaggaagtacagggagatgtaggagactgatctctgctcttccctgaccactgcacccaccctcctatttacatctttctttttctctccttcccctagcatctttccatctcctgaccagcctgccaatgtgcctgtcctcccacctgccatgaacacggggggctccctacctgacctcaccaacctgcactttcccccaccactgcccacccccctggaccctgaagagacagcctaccctagcctgagtgggggcaacagtacctccaatttgacccacaccatgactcacctgggcatcagcaggggcatgggcctgggcccaggctatgatgcaccaggtgagtgactgtcctggccatgtgcccactgggtgctgcc

SEQ ID NO: 56235 - DNA, 1034 bp, Homo sapiens
ggtcttctatgtgttgagaatattcattcctaggagttcttgaaagaactttcaggcctctgccaggctgcctctgaagcccccctggcttggtttcttgctttccaaggctggaggtcagagggaccaaggggtaggagtccgcctaggtggtatgcagtcttaatttagggacacattcttctaaaacaacagtaggtaaggatattgcaatgattcctcatggcagagagctagaaggaatttaaggattgatggtggaacattactacaacatctctagcctttttctgctggtctgactgtggttgcatttatgactgtgactctggttgtatttttgtgtgtatcccccttgactctgttacttttttttttttctcgtcctttcccctttgagtctctagggactatgtgccctagtttgtgggagtcagaagttaggtggggaggcaaatctgggagggtgtctgtgcacgcatgtgcacacttaaatgcatgtgtgtgcataacccactgtaaccattgtgaggattattatctaactgtagactgctcccctttaggagctttttcatcatgttggggacagagacaggaagatgggaggctgatcttgatagcgtgaggccctgccctcaggactgtgattctagcagaggcatggtgggatcttagggctcgtatgtgcaaagaaaggctgtgcgaaactcaaaagctggggcttctctttacggtgcctcgatctcttaaaaggccccttctacccaccttgctcctattggttaatttctcagctacacagaaaagtctagtgggcatacatggccaggggacccaaaagtctagagctagggacaagagatctgggactcagcctgttatctggccaggtgggagggctcatttgagacagagatggccatgggaggctataccactgagatactggggttgccatatatgagacctcaagtggtcttcaagtggtccagaggtcagcacagtgctcactaggctgacctcctggaaca

SEQ ID NO: 56236 - DNA, 1049 bp, Homo sapiens
gtcataaacctagagtcagtgtcctgttggtcctagcccatttcagcaccctgccacttggagtggacccctcctactcttcttagcgcctaccctcatacctatctccctcctcccatctcctaggggactggcgccaaatggtctctccctgccaattttggtatcttctctggcctctccagtcctgcttactcctctatttttaaagtgccaaacaaatccccttcctctttctcaaagcacagtaatgtggcactgagccctacccagcacctcagtgaagggggcctgcttgctctttattttggtcccggatcctggggtggggcagaaatattttctgggctggggtaggaggaaggttgttgcagccatctactgctgctgtaccctaggaatatggggacatggacatggtgtcccatgcccagatgataaacactgagctgccaaaacatttttttaaatacacccgaggagcccaagggggaagggcaatgcctacccccagcgttatttttggggagggagggctgtgcatagggacatattctttagaatctattttattaactgacctgttttgggacctgttacccaaataaaagatgtttctagacatctgtacagtatctgattcgtttgttttgggaaaggggtgggcatgtggccagcctgagagggcctgagtcccagatgtttacagctgttttaagattcttggtctcactgttttcactcaggacccgatagtccccttccctgaagatgacctaatttttcctcctttgtgtcttggtacttctttcccggtctccacccctcggcttcccttctcttccctcccctccctcttcctttcttctctcttcaatccctctctcctttccgttcgtagtctcagggctaatttagaactactcttcccagcttgcacctctcagggagtagccgagagggtggagccaagtccccagtttccggagtcagcagggctgctgggaagtggagtccgtttcctcctagtgctgcgtgactggggatgt

SEQ ID NO: 56237 - DNA, 1026 bp, Homo sapiens
agaattatctggcccaaaatgtttttgtttgtttgtttttgttttgttttgtttttgagaaagagtcttgctctgttgcccaggctggagtgcagtggcacaatctcgactcactgcaatctctggctcctgggttcaagtgattctcctggctcagactcctgagtagctgggattacaggcatccaccaccacaccctgccaatttttgtatttttagtagagacagggtttcaccatgttggccaggctggtctcaaactcctgacctcaagtgatcttcccactttggtcttccaaagtgctgggattataggcatgagccactgcccctggccccaaaatgttaatagttccaaagctgagaaactttggtctacacgtaacactgtgagtgacaccataatctgtgtgtacgtatcattctgtgtcagtgttaccaattcactctatctttgtgtgactgagagtagccctgtgtctgtgtcagaccctaggtctgtgtaactgggctttcaccagattttgcatctcactcttccttccctgaacattttgctgctgcttctgcccacagctccagttcccactgcaagagttcatcctggccatgggcttcttcctggtcctggtgatggagcagatcacactggcttacaaggagcagtcagggccgtcacctctggaggaaacaagggctctgctgggaacagtgaatggtgggccgcagcattggcatgatgggccaggggtcccacaggcgagtggagccccagcaaccccctcagccttgcgtgcctgtgtactggtgttctccctggccctccactccgtgttcgaggggctggcggtagggctgcagcgagaccgggctcgggccatggagctgtgcctggctttgctgctccacaagggcatcctggctgtcagcctgtccctgcggctgttgcagagccaccttagggcacaggtggtggctggctgtgggatcctcttctcatgcatgacacctctaggcatcgggct

SEQ ID NO: 56238 - DNA, 1052 bp, Homo sapiens
gacaactaaaaatatccccagacattaccaaatgtttcctgaggggcaaagccacactcctagttgagagtcactgatgtagacatacatgaaaaggtcacacattgcccatctccccaaatactcatacatagagccacatatcacaggacattcaggcttatacgcagtcacacggaaacacaggtcactcagtcacagacacacaaagggatacatccagtgttacttcctcagttttagaggaaaaaaggaaagagcccaggatgactttcctgccccactatccaacggcctcagtttttcctataataaaccaagtcctatgccgtggacttgatcattcctcacagcccacttccttgggccaaagcctaaaaaggttagcaacaccaagacccagggaatcgcttcctatccttctcaggcctacagagacctctatctccagccctttaggaaagtggtgagagagtgaagatgattcttggagcacttgctggtagctagaactgagaacccatagagcaagtcacacacctgagaaaaagtgtcttactgtctcaacgggaatgtaggggtcacacagggaatggggaagggggagggaacacatagaaagaattatgccccataaccaaaaatcacaattcataccacatgccaaaagtcttccacacagtcatggagtggcacatgaatcaatctccacaaaccaacactcccagaggtgtgtgattcccctcccgcaagtcacatgcccaggccagtgctcaccgtcacgtgcaaggctgccagggcctcatctatggcagccaggtagtcaggcagcaggtccaggagacaagtggccaaaaagacgccccccgcgaaacagcttactaggctcagggctttctggcgggaagctgggtaggggtgaagcacagaggggaataagcaaacaaaccccctccagggccgaccaccccaacccaaacaatggctacccttgcctttccctcctcctttggtcactccccgccagccccagagccctccctaagccaagc

SEQ ID NO: 56239 - DNA, 1146 bp, Homo sapiens
agccaaggtcacgccactgcactccagtctgggtgacagagcgagacaccatctcaaaaataataagaaagaagacgggatttggagccaaattacttgaacccaagtcccagctctactcctcagcactatgttattggccatattttctcatcagtaaaattggttaatactagctctgcttatccagagaataaattaaatgatctatttgagagggatttatgtactatacacacaatagaagcctggctctgatttcctcttgagtgtatcctggctaggctgaagtagaagggaaattagagggagaagctgtctggccttccttgggaataactattccttcctgccctcagctgccgctcagctttgatggaacaacgcttattttggaagttcgaaggggctgtcgtgtgtgtggccctgatcttcgcttgtcttgtcatcattcgtcagcgacaattggacagaaaggctctggaaaaggtccggaagcaaatcgagtccatatagctacattccacccttgtatcctgggtcttagagaccctatctcagacagtgaaagtgaaatggactgatttgcactcttggttctttggagccttgtggtggaatccccttttccccatcttcttctttcagatcattaatgagcagaataaaaagagtaaaatggtttccttcccttctgtaacttggagcaggaagtcatgggggcagagagggaaaggaggtggttacttaaggccccaatctaccaagtcttccccaccacttctcccttgttttccccctcttctactacttatttcaaacttctgggatacaatttcagctaaaacgtttatttctcactcaaaacttatttcccctcaaccctatacccaaagaagaaataaaatcacagatacataacagaagtatttgaggtaccctctcatatatgcaaacaaatgcagactaggcctcaggcagagactaaaggacatctcttggggtgtcctgaagtgatttggacccctgagggcagacacctaagtaggaatcccagtgggaagcaaagccataaggaagcccaggattccttgtgatcaggaagtgggccaggaaggtctgttccagctcacatctcatctgcat

SEQ ID NO: 56240 - DNA, 1808 bp, Homo sapiens
aaacaatgtaatggatgatgagttgggcataagtgcaggaaagacgggtgtaatagaggaaaaaaatgttatctgcttttctttcaggatgctataaaatcaccacggtctttagccatgcacaaacggtagttttgtgtgttggctgctccactgtcctctgccagcctacaggaggaaaagcaaggcttacagaaggtaaatggtttactaatgtgatttggggctttgagtttgatttttagaaatggaaacatttcttaggatttttcggtcttaacagtgacagggatcatctataatgtaaatttttagacaagaagtgttggatttggttgttttaactagatactaccaaaagctatgtattaatctcaaagcactactgtctaaagcggggataaatgggtgataaaagggcttaagttgataggaagtaaccagtgatacaaatgcgcaggtagctaagagttgagaaaaaagatgtagctttctgtgggtggatcatcatgcatctgcttttttgggagaggtgggcagaatacctgtactgatgacagctaatctctgaatctttttcctccaggatgttccttcaggaggaagcagcactaaaagcactctgagtcaagatgagtgggaaaccatctcaataaacacattttggataaatcctgtttattgtcttgtttaagtgttaggaagttcctgtctcaagtattctggggcaaccaggaagaggagaatattagagtcatttggggcacgtaagtggccaagtactttaaaagtccctttgggggcatttttaaccacctaggctcattggataaatttgttttttttttaaactgtgatactatctcaagtgttgtgtttggtgtttttttttttttttataagagagatggaatcttgctctgttgcccaggctggagtgcagtggcacaatcttgactcattgcaacctctgcctcccaggttcaagtgattctcctgcctcagcctcctgagtagctaggattacaggtgtgtaccaccatgcctggctaatttttgtatttttagtagagacggggtttcaccatgttggtcaggctggtctcaaactcctaacctggtgatccgcctgcctaagtgctgggattacaggcgtgagccaccgcgcccggccgacagttaactctttacaatacagtctgacataccagttttaagaaacagcttaggatgctttatttatagttctcagaagccttatctggaaacttaatgtagaagttgctgttaggcttcttgtcgaggactagaaatcttcattcccctgcagttaagagaaacttgtccaagcagaggttagtgccttatactccataaccaatgttgcagccgactttgggccaatggaggttgtagactcatgaagtgagggggagaacttgtggagttaaaaaaacctagaagaagagggaaaagttgagtgaattaaacgtgtgtatctgagcttttcaaagatgaggacagaggcttttttacctggctgtggtgttcctagagttggtacatacacaactggaactgtttgtatcttgtttaggaaggcattgtatgctggaaaaaggacaggaaatgtcacaaggcatatctgaggaaggccttaaaaggcaaagtcaactctagaatgagaatattgctaaaaataattcttaaaaataagtaatagtaatggcactattacaggaagtttttatcccaatttaacccattttagagttactttcagcttttggctgaaagggggaaaatgg

SEQ ID NO: 56241 - DNA, 1722 bp, Homo sapiens
cagggtcatatgggtacatattggcatggtcagcacaaaaacccagttttcaggccgggcgtggtggctcgtgtctgtaatcccagcactttgggaggccgaggcgggcagatcacgaggtcaggaattcgagaccagcctggccaacatagtgaaaccccatctctactaaaaatacaaaaattagccaggcatcgtggcacgcgcctgcagtcccagctacttgggaggctgaggcaggagaattgcttgaacccgggaggttgtggtaagccgagatcacatcactgcacttcagcctgggcaacacagcgacactccatctcaaaacaaaaacaaaaacaaaaaacagttttttcttatgtatttccccattgagagtttttcctcccctgcaataaagcaccatttggaaaaactgtggcagaatgtggttttctagaaacacttgcgtattctacatgttattgtttctcacagggtatttttctgcatgtttccaggtcatcagatccttaaagtacatcagataaaagggactgtactgattggagtcaattttgtgggctattcagagaagaaaagcccaaaagtgagtggagattataatgtaagaaatataaattaaataattggaatgtaaagctcttctttaaaagttgtacaacttacataaagctgagactatatacctctgtaattctgttattttggcccttgagagagtcctggaaacttctcccatagagctgaagaattagacattgactttattattattattattattattattatttgagatgaagtctcgctctgtcacccaggatggagtgcagtgacatgatcttggctcactgcaacctctgcctcccgggttcaagcgattctcctgcctcatcctcccaactagctgggattacagacacccaccaccatgcctggctaatttttgtatttttagtggagatggggtttcaccatgttagccaagctggtctcaaactcctggcctcaggtgatctgcctgccttaccctcccaaagtgctgggattacaagcgtaagccaccgtgggcggccaagaattagatgtttatattcacttttgtggttcttattatatttctaggaaatttccaacttgcccagatctgtagatgtggaactgctcctggtagatgatgtaactgtagtgcctgagaatgccaccatctataaccaccctgatgtaaaggtagaagctgtatgagtctagttaaatggaatcatattggaggggaagttattaaaattaatagcataacaattaaaaaacttacttatgtgttgaaaataattgatacatatatgtaaaacacatatataatagttgcactgtccttaaaaattgtactttaataattgtattttgtcttttgtctattcactttaatctttttatcccatattctttcttaggtaggtagaaattatttcctttgagctatttataaactgaagcaaacagaatattgtttgtctgatttttccataggaaacatttagccttgtggaaggatctggttattttttagtcaacagcagtgagcagggtgttgtcaccatcacttacatggaagcagaaagctctgttgaggtgagctctagagacagtcccagattgatggtctcaggccaaagctcattctgaggagattggaaaaattccattttgtgtcta

SEQ ID NO: 56242 - DNA, 1106 bp, Homo sapiens
tggatcatgtcccccttatgttgaggtgaccacttaattgctttcctgcctccttgaaagaaagaaagaaagaagactgtgtttttgccactgatttagccatgtgaaactcatctcattacccttttctgggtttgaagctgctgtctctagaagtgccatctcaattgtgctttgtatcagtcagtgctggagaaatcttgaatagcttatgtacaaaactttttaaattttatattattttgaaactttgctttgggtttgtggcaccctggccaccccatctggctgtgacagcctctgcagtccgtgggctggcagtttgttgatcttttaagtttccttccctacccagtccccattttctggtaaggtttctaggaggtctgttaggtgtacatcctgcagcttattggcttaaaatgtactctccttttatgtggtctctttggggccgattgggagaaagagaaatcaatagtgcaactgttttgatactgaatattgacaagtgtctttttgaaataaagaaccagtccctccaaccctcagacctatttgacttttatttattaaaactaaatgtgctttctccacagaagctatgaggtttgggttaaaaatagcatctttgtgggtggtagcaacaggatttattctttattattattatttttgagatgaagtttcattcttgttgcctgggctggagcgtaatggctcgatctcggctcactgcaacctccgcctcctggttcaagagattctcctgcctcagcctcccgagtagctgggattacaggcacctgccaccatgcccgggtaattttttatattttaagtagagacagggcttcaccatgttggccaggctggtctcgaactcctgaccttcaggtgatccacctgcctcagcttcccaaaatgctgggattacgggcgtgagccaccgcacccagctggagcaacaggatttaatatagagcaaatgtttagttttatcatctgtaaaatggagataagtattgtcagagtaaacatgaagattagaaagaacacttaatgtgctgggccttttataggttaacactgacatctcaggctga

SEQ ID NO: 56243 - DNA, 2507 bp, Homo sapiens
atctcattggttaaaactggatcatatgatcacccctagctgcaagggaggctgaaaaacaacaggatagtcttgagtagcttataccagtaatttgccttccctgggactaggcacactatttgttgactcttaacaggtttggggttcttttaaagaagaagaagaaattgaatatttattggctaggccactgaaatgggtctatcacacaatatctgtaacacaaagcattagaaagtataggagtgaatgagtgtggggatatttctcccagtatactgtttataatgctgtcttgaatgctttcacagaaaaatgttcagctgttcacttccattcctttcaaaccctgattattgtgaacacatttcttcgaagccaactgtattccttcctttgccatttcccttgtttcagtttctcaacccagggaataaatattgtgaaggaagcattttttctccctcaaaatgttgtcctaccaacttgtcagtctgaatttcctctgttggtctttccaccaactgactgactcttattgccctctatctgaatcctccttgcatccaccctgccttacagatgcatgttatatataccagctagttgaaagactcataatttacttctggtactctactaactttccctttttctctttctcctcctctttttcctctccttctcttgtgttcccctcctctccgttgctgctgcagagcgtctctacagccaacttgagcgaaaccgcctgctttctaatgagctgaagctaacgctgcatgatctgtgtgactgatgggcagggctcaatgatgcccattaaactgagcttactgctcacaccactgacctggaccccaacaaaaagctgattgtctttttaaaagttattattttgccctgagcaaattgcattttaattggggcagttagaatgttgatttcctaacagcattgtgaagttgaccattgtgaagtttctgtccctttagaagagattatgggtgaagaagggaggggcctgagagattatagtgagaaaacttgcgagaattttgttttccacccttatttgctgctctttcacttgggcactgactgtaggatatgttcccttgcatggatgtttttaacaataaaaggactgacttgacaagttgttgtaactgcttcatcggcaggcccaggaatgggtccttctgactgggtggaaaaaagggaagtgaaagaaaagttgtgggatatgaatatgggtctgtgttgccatcaccttctctgagttgaagatttgagtattttcctcacctctttagagcagtcagagtggtttgcttgctagacagattagattctccttaatgttcagctgctgattttctttctgacttttgcgtcctttttctggttttatgttaatttcaagtaactgtcacaagctagttctgttcaatagctctgcagcaatctcaaggtttgcttacaactacttgtttcagtagtattcttggctttgttttctttagagattatttgacttaactgtgagcgcccttttatttatcccatcagttattactttggcctctactttttcgaaaaaacatgtagtgcatgaggatcttcctgtgctctttataatctgagattctgatgtttctattgtttgcaatgttcaaactccggtgagccatttcaagagggtattgttatgtgggcaaaacctagaaaagtggatggctgatggttaaggcttgctctttcattgactgaaagctgaaagtgttggttgggtgtgggagggagaggaaatggctgataagggccctaactccctcacccaggaagtgcagcaacacctacaacttcagtaggcaagccaaaggccctacaaaactgggtgatgtaatagctcacttctgtggctgagaaggcagctgctttatcagtctgcagcttctctgcaacaggagcaagtctcaaagagcgggtagaccttgaaatttacttctagttcttgtaacttctctcctttacccccattagataaactgaaatgcaccaaagaggagcacctctgtacacaaaggatgctggaccagaccctgcttgacctgaatgagatgtagaacgccccagtcccaccctgctgctgctcctccctctgacccagactccgcctgaggccagcctgcgggaagctgacctttaactgagggctgatctttaactggaaggctgctttctcctttcaccaccccctccttccctgtgtctttttcgccaaactgtctctgcctcttcccggagaatccagctgggctagaggctgagcacctttggaaacaacatttaagggaatgtgagcacaatgcataatgtctttaaaaagcatgttgtgatgtacacattttgtaattaccttttttgttgttttgtagcaaccatttgtaaaacattccaaataattccacagtcctgaagcagcaatcgaatccctttct

SEQ ID NO: 56244 - DNA, 1647 bp, Homo sapiens
gatttttctatttgcttctcaaatttagtcttctcagaagggatactgctagaggtagaatccatacaactaaggaaatagggcccacagagccagtaacttgggccctgacacattaagacaaaattcaggcctcctgggtgtgtttaattggttccctgatattaaagttcagggaactacccaagatgggaaataccaaattcacctaagaattgagctgagtcccagaagcaagccaagtgataaacagcaccaaaaagagttgttggggcttcatctgtttgctgtggatccctgatccttgatgctaatctgcctctttgtatctttcccactaaccctgaaaagaagccacatttctcaggctgaagtgtctggctctcttttattattcctgctgccacctcttcctttttttcctcttcctttttcccagtttgctatctagattgatgctagtccttctcacctagagtatccttactttttcatacagataattatcaccgtttctgctctgttctggatctgccccctttactcctcggggaacccaaggccccactctcgctctggattccatttgggtcagcctggctggtccccaaggcattaggatgggggagcaaaaagcaacttatgtattttcttccacccccaccccaaattaaaatgttaagctgctggaaacctcatgccaccctgcatttgtgtcattgacaaagctgttgctgtccctaagaaggagccttgggggtgtgatgtggggaagagctattgtaggctccccctcctctgacttatgtaatcaaagccacttttgtgtgtgtctattttttcttgacatttaaactcagctgatctgattctaccagagtgatggatttagtacaggttactcaggatagtaattttagttatactcctcaagctgaacaagattaaattccttatttccaggttcttaaatcatcctgcctgcagtgtttccattctctcttcaggtattcctcctttggtgtggtgtcattgagaagccattgaagtgactctcaatacacattctgtacccttttaccggtggttcaaatggtgcatcctcagaacacccagtgaacccaatacattattgctaagattgactaattatgtcaactccagtcacagaaaaatacacaatggatagaattctggacggtttttttactttttcttctttaaacctttcttacatatttgagacttgctaccatttgcctgctagtgtgtgactagtgggatataagataagtgataaattattattgggaaaactaaaatgaccaatcatgcatatttcaaataatgtgcatatgaggctaatgatttattacatacataaatttctgctagtaaaattttccttggttcatattgtggaattaaatatcaacattttagaaattcccattataggccgggcgtggtagctcacgcctataatcccagcactttgggaggctggggcaggtggatcacctgaggtcatgagttcgagaccagctcggccaacatggtgaaaccccgtctctactaaaaatacaaaaattagctgggcatggtgggtgggtgcctgtaatcccagctactcgggaggctgaggca

SEQ ID NO: 56245 - DNA, 1551 bp, Homo sapiens
gcacatttagtgcaagaggatattcaatgtaagttaaatgtagggaggggggtattgcctgtgtgactaatttctactctgaaatttttaatctacttatcttacagtactctcaaaaagaagataaatatgaggaagaaatcaagattcttactgataaactcaaggaggtgagctgaggggatttatagggcagaacccaaaacatttagaggtatataaggcattaatatggatttaaactggctggtttgggttctgaaaggtccagaagtagaaggtggaagaaatagagattgttcttctttgtcttcatctctggttctgactaatttcatatttcccccaggcagagacccgtgctgagtttgctgagagatcggtagccaagctggaaaagacaattgatgacctggaaggtatggaacctggagtagggattgaaatagagaaatatagaggaagactgcccattaaccattaatctctttttctgtacaccaaaggaagttggtagtgacttggcatgtattaatatcatgtgcactgtcctatgccacagctaggcaaagtgggtcaaactctagaattggttttttaaatttaatcttttcctttaagaagactttaccaaatagtctgcaatttgtacccttcccttttgaggagaatgataatggctgcatttacctccaatttattagtcttaaacctttagtctgtgggtttaaatggaagccatgatttcagaagggcaagatgtatgtcatttcatggctactttccacagttctttttgccactcaagttgtcgggtatttatccaataaatgaagttgtggaataaccatatctgaacattgaccaatgtcaggagctttctaaatactttctgtccctgcaagttggtaactgccatccaccctgacaagggaacgtactctttgctttgagaactctgatgtatgctcctttggtacactctcttggcagagttgcaggggcagcctgtggagcagaggggccactaataggttcacattttgtaggcagagaagtgtctgaatatggatatatactctctccctttgctatttttgttcaattaagtgttatcactgctaggaattgggtacctggatgggagtggtatcctcttgagtgcttttggtaataggaatttctagttatgactgtgcccaggttctcagcccttgctgcagtcgatttggagtatcaagaaaggaagttggtcataggagagagtagatctgaaaatgtccagtcatggttgccagagtagatattttcctaactgtggtattagacccacagtcacactttcctaatttctaatgattccctctcttcatctgcttctgaaactcttcactctgtcccctcattcctccctgtggttcctgtgcctgtccagatgagctctatgcccagaaactgaagtacaaggccattagcgaggagctggaccacgccctcaatgacatgacctctatgtaactatctgacagtagagtggggctgggatcttgg

SEQ ID NO: 56246 - DNA, 2358 bp, Homo sapiens
tacagttctgagacccttggagtggagctgacgacacactcctcagggtgtcagtattgcttttgtcctatttctggcagaggtatgaaggttattgaaaaccgggccttaaaagatgaagaaaagatggaactccaggaaatccaactcaaagaagctaagcacattgcagaagaggcagataggaagtatgaagaggtaagtgaccttctgttagtccctctcgtatcggccttttacaaagcataatgcggtaaatggctcctttgcttcactaagctatactgggatcttttcctgtaggtggctcgtaagttggtgatcattgaaggagacttggaacgcacagaggaacgagctgagctggcagagtcgtgagtatctagctccccaaatcttgtcattaccaatttatcccttcccctttggcttgggcactaatatgaataaattagcattccttcaaccttgttaaacagggcctagggaatgggagtcatctatagtgcttttttaggcccaagaatggttttaggcttccttattctcctgactagtgacaagtgacaaaagaggctttcttattttttgttggtagggtttacaaattgagagcaaataaggactaatacatggtgaacagttaattggaagatcctactgggtccttccacctggggtggaagacatcaaagtggctatcctgatttaagatctagtgtctggctgggtgtggtggctcaaacctgtagtcccagctacttagtatgccaaggcaggaaggttgcttgaacccaggagttggaggccagcctgggcgtcatagggagaccctgtccctaaaacaaataaatttaaaaaaaaaatctggtgtctgttttggccactttgccaatctgctagggaaccttagggcaagggtagatattaactgctctcccgtcggtaccttctgggccttgattaacaaagtcagtgctgaatgcatatgtatttgtgcttccctcttacattcccgtctgccagacataacatatcatgaccatggtggtgttctcttcccattttttgaatttttttttttcgttttgctgcttgttttcttgctgtgttcctttttgacctttctccctccccacaacctggcttgtgccatccccgtgactatcactaacagccgttgccgagagatggatgagcagattagactgatggaccagaacctgaagtgtctgagtgctgctgaagaaaaggtactaaccattaagcccacagcaaggttatatatgtggtgtggttttgttttgttttgtttttgttttgcagctgcctcccctccacttgattttgttgagtgctgtctcatctcttcatggaatgctccattcttttccacttacttggcatctttcatctcttctttcctagttgcttcactgcctctccacagggtctccttcctttgggtgatttgggggactgtttgggttgggcatttgttcccacctccaccccaggtagcagttatgacttgttcctggtagtggatttctctcaagtgctttattagtattcaaacatttttgagcccaggaaggtctagctcctgacacgttctatggtagagggaggagggttgatgcttgctcaggttacttgggaacatctcttccccagtatgccttccaactctctctacatataggttcaattcacgtctatgtgtctctctccctttttttattctcttccttttcccttttcctctcctgtggtatttaaaatattcacagtaagtgttctgagctggaggaggagctgaagaatgtcaccaacaacctcaagtctcttgaggctcaggcggagaaggtaggggctggtttgtgaaagtgacaggctttggggcctgggcccagccctgcccttgatgaaagactggagacacgcattccatatataatccagtgaggcgtgtcctcttcctacctccttaccatgtattcaggttctgggtttaatgctattttctgtgcactttgattgctttaattaaaataacttcttggtctcaggttactggagtcatgtgctccttaggctgatactgctgtgctgaaaagcaataatcaagggccctaacaggctttctagcagacagatgggggcaacagacagaatcagctctgagacctaatgagcaatcaagacagatgacttcactttgccatcatgtgggtgtgtttcagtcatgtgaccttggggtgctactactcttgctcatcaagcaggggaaaggaaaaacacctccttgggttgatctgaataatatcaaagcttagatccatcttaaaaagtcat

SEQ ID NO: 56247 - DNA, 1273 bp, Homo sapiens
atccaggattccctctttttttttttttttttttgaaatggagtttcaccgtgttgcccaggctggagtgtagtggcgcaatctcagctcagtacaacctctgcctcccgggttcaagggattcttctgcctcagcctcccgagtagctgggactagaggtacgcgccaccacacctggctaatttttgtattttttattagagtcagggtttcaccatattggccaggctggtctcaaattcctgacctcatgatccacccgccccagcctcccagaatactgggattacaggcatgagccaccacacccagtcaggataccctctttaagaaaccttgcttttttttttttttttttcctgctttatgagacacttgaaaggttactgaggatgagacatgcctccaagccagagctcaggcagaaggaacccttcattgactttcttttctgactccagtgtgttgaggaatttgaactgagtccaggaagtgggtggtactaactcactgggctgggcaaggaactgagttttaaaacactcttcctgtggaacatatgggagttcgttgatgggaaagggaggaaatatatatatataaagttatgtctgctagatcttttaacagctgagctaagacaagttctaccctgcgagactctggctttttcatggtagtcaaccctgatcttaatgtcatagttatttcttcttttctccatgcctctgcttcccttgtccattctttccttcaaatgcaggctgaggctgaggtggcctccttgaaccgtaggatccagctggttgaagaagagctggaccgtgctcaggagcgcctggccactgccctgcaaaagctggaagaagctgaaaaagctgctgatgagagtgagaggtgtgtagggaagcctgatggagtgtggattttaaaagttcataatagttctgatcaagatttccttatagacctgttttctaaatagcaattctggctgcgtgtgatggctcacgcctgtaatcccagcactttgggacgctgaggcaggagggtggctcaagcccaggaagttggggctacagtgagctctgattgcgccactgcactcctgggtgacagagaaagaccctgtgtcaatcagtcaataaaaataaaatactaactccatcacacaggatctcctttctattctgcatattctgtccccttgaagacagtaagggtaacttagatgttgtgacccttttgtaattggtatttccttacaaattg

SEQ ID NO: 56248 - DNA, 1975 bp, Homo sapiens
ctttccccagtactagaacacacactcacaggggagaggcagatagccctttacccctgcttaggctccgcctttgtttactgtggggcagatagctctactcccttccaacttgcctcccctttggtgaagtttaaattccccaaggacacggtatctccctgggtaatgcatttgtgagcacagtgaactcaaatagtcctttactcacagggctcaagcctaactttctgatactctttcatttgaattttatctgtggcttttatctaataagagaaaccccagtgtggcagaaagccagatttaggctaatccccttctgtccttggccctgttctgcctgagagtaccatcacactgtcagtttcttgcctggaggggttgacatatttgggaaatctctttggagtggaggatagccgaaggtgttgtcagccatctggtaatgtgactgagttgctggggcattctactctttccccaatccctcacccaggatctttgcttcctgggcagtggagaatcctattattacttgaagggaagaaccacagagtactgtatatcctccacactgggcagagataggtcagctgaaacaccaaaaccgcatctggatgggcatgctaaaacctaagatgattaggaaagtgcagagcttaacgtttcccagggccacaggtagcctggtctgcaaaaagtaggcctgttcaatctcttggtacccattggtattatttgacctgaaagggacaggcactgtgcatagactcatgagggaaaagtcagcttgtcttccttgttcctttaaacaaagtatcagatcttgattctgcaggcttttgtttcattgtaaagagaactgatcctctgtgctaggagaaaagagaaaggcaaggtcccattccctaccactccaccctggagggggtctctgaagctttttctaggactcccatctcaggttctgcttttgatacaggcttgttcatgtgtgcatgctcttaggagggcaccaagatgtgttttccccctctcccttttcagccttgctaagaattctattgtaaatgctgatttgtgggagaaactgcctgagccagcttgctgtcatggcaactgtacacccccgccccatagcctgttatcttctactccagtttgggtaactactggtgagctgcatgatgtcttacatttcatgagcttcctctaaatctagttgtatttttcgtctgaggggggtaagtcattttactagcagtgtctcctaggtcttgcctgatagcctgacttgctcttgatccatggccttgttgggtttgtgaggagaaatgtgtgttgttacagagaacatctatttttctggaagaggcagaagcagagaatacttgtctttgtggtgttttgagtagtgtagttagaggcacaaatggtttcttaatgatttcagcttatgttgacttctcgattttctttgcctggtggctagattgtagccccagccctctgcttcccttcctagtctcttcagcttctcatgtttgtatgtggaagtttttgtgccagtcctgatggttaaaaaggagtcttttggtctatattcttcctcatcggagctagtggcccaggctgtttctatagctgcaccaactcctgcctgccaggaagaaatcagggtaatagaattcaggcacaatctgggctatagaagagagatcgtgtttaccaggcacttggataagcatctgaactgggtggtgtgcggggcatattaaattcttgtatactgttgcagtcagggtacctcccaccagtaaaggtagcggggaggcagtcatggaaagaggttttcctaccattagaatttatccatccacctgcaggctgcctccttctttccttgtttcttagagaaaacccatccaggatgggtttacttggactctaacctatatacttcattgtgaga

SEQ ID NO: 56249 - DNA, 2030 bp, Homo sapiens
tctgttcggggaggggcagtactgaaccttctgtgaaatggtgagggttttggggtgggaaccgtcggaaagaccccggcctgcctgctggcagcttttccgctccctcctcctgctcaggaaatgaggcagcagttggctgagaggaagcgcggtgccctccctccctggaggagctcgaggccacaggaccgcctctcatcctctggccaggggccctttcctcttacggggtgctcttgcagctgctacacccactctctgaatctacgtgaaacggcaggggaggggatagtacttctctcaacgttagtgcaaatgtaggagccaaccaaacttgcctggccctacccacaatgacctggaaggcaggaacttctgtcagattcaggcctttattgctgaagtgtgatcagtgcaagccgaactggttaagaacatttcttccgagcagagctgataagcgagtgtatggcagagaatcagatggtgtgccagtctcaaggtttctgattgacttgggcaatttggtggagacaataatgaattccaggtgactctagtggaatatttgttcaactgaaagtggaaacataaaatgttggtggagtgaacagtgattctagtgatttctttcttcctttcttttttttgagacagagtctcactctgtcgctcaggctggagtgcaatggcatgatctcggctcattgcaacctccgcctcccgggttcaagtgattctcctgcctcagcctcctgagtagctgggattacaggtgcccgccaccaagtctggctaattttttgtatttttggtagagacggggtttcgccatgttggccaggctggtctcgaactcctgacctcaggtgatccacccacctctgcctcccaaagtgctgggattacaggtgtgatccaccgtgcccagcctattctagtgatttctttaaacgtctttctgtttaaaagtggctgattagttttagtgtaagccataagattttccaaggtctagggtgcagtctaatagatggagctgatacgagttgaggctttgttttggaggatcttgagagagtaaagtaactgttgctaaaattcaagatccagtgaaagtactcatgtggtttattctttgttctttgttctttcccttggtaagtttttgtttttgtttttctttttggctgctcctctgggaaataactgagaatgtttttgggagggggaggggtggatttcagaaaaggatggtaattgggggacagctgccctccagtttaaatacttaaagattgttggaatactcacttatttttataagtggtcatggagatgctgggatgggagcttgttgtcttcctcagacacctttttctaggtagatttttttcctctgttcagtttgccaacaacttcttattatctgtgcaagtgagatggactggctgggtgactctttatggccagtggcactttctcatctcctttgttctggagaccagatagctttaaaggggaagacagaggaactggccatgtgttgagctgcagaatcttaggctcagtatttaaatatggacattctaggagtagttctaaggtgggtgattcctgcctcccatcccccctctttttttttttagatggagacttgctctgtagcccagcctggaatgcagttgcacgatctctgctcactgcaacctccacctcccaggctcaagtgattctcctgccttagcctcctgagtggctgggattacaggcatccaccaccacactcggcgatttttttttattattttatttttttatttttagtagagatggggtttcaccatgttggccaggctggtttcaaactcctgacctcaagtgatctgcctgcctcagcctcccaaagtgctgagattacaggcatgagccactgcgcctgtcctggggtgatgtttcttaagctactttcactcagagcctgccaaatttgcttattgagctgaggtctagtgaggaagtcctca

SEQ ID NO: 56250 - DNA, 1090 bp, Homo sapiens
tcaaaaaaacaaaaaacaaaaaaaactgcctcttagtgcgtatcacttgcctctcggtacctctctctctcccggggtccccacttggtgccatgtaaccatctttgtatcccagttacttagtagagttcctgtttcatggtctgttctcagcaaatatttgctgaacatagggctttgcctgtggagaaaaaaattggataggcttccctctgctggttcagcctctctgctaccacccagctttatgtcacagctaagtccagctccaagagaacacaaataatgggaaaacaactaggaagaaagaataagaaagggtggtaaacagaggcaaacaacacactctattctgccctctccaccaggtccgtcaagctgccctgcaccagctgtttgaaaaggagcatcagcagtaccagcaggaactaaatcagatgggcaaagctttttatgtagagagattctgatggcatccaaaacactgctcttccattctcaacatgcctgctaacctagccttctagaacctctaccaccttgaacctccttcccaaaacatacctggatcttgctatctgtcagggacttaagacagcacttccactctcacttctccactctctcgttaatcctttgccgctatttgggaaacaatctatgaaacaacagtaacaacaagagtgacgccttgtggtcatagtgggatttactatgttgatgtaagggggcaggggtggggaggggtggacaatgagagttgagaatcctgatttggtataacaaataaatttacttcctaaaggctcaaacttagaccactgggctcattctttcatgtctaaatcttgatttgtttcaaaagtgcttatttttcagctactgtaatcttaacctcctggatttcacttgccatctctcagatatcactttcacttatcttttatttatatttggacaaattgttctgaatgtggctattaatctacagacaccgtagtgcttgagtgaggaggcctgcattttgggttttgagtcagctagttattgtgaaactttggacaagtctctttccactgggcctgaattc

SEQ ID NO: 56251 - DNA, 1026 bp, Homo sapiens
tcttctaacagtggggcagaggttccaggtgaagaaacagtcttgggccaggcgtggtggctcacacctataatcccagcactctgggaagccgaggcaggtggatcacctgaggtcaggagttcgagaccagcctgaccaatatggtgaaaccctatctctactaaaaatacaaaaaattagctgggcatggtgccaggcacctgtaatcccagctacttgggaagctaaggcaggagaatcacttgaacctgggaggcagaggttgcagtgagccaagattgcaccactgtacaccagcctgggcaacaagagtgaaactctgtctcaaaaaaaaagaaaagaaaaagaaaaaagaaacagcctcactctatgggttttttgtctctactcctaactctaacccacccattcaacccccacctctgtacctggagcaggtggcgaaattcacatactcactgtctgtggcaaatggcattgggccagagaagaaacccgtatgccaccctaaggatgcaggacaccatggtacaggaattggcactggccaaaaagcaactactaatggtgagttctagcagggcaacctgaagtctcattcactactgctgtgtgcctttgcccattgagttttccaagctcttagtgtgtgtcattgcacatttatcttgtttgcctctaggttttcagcattacaccagagcaacacaactctaactccattgccaaaactctttttcattaagtgattctttgcatccaccttacaggcggcaggcacatgttaaagtcccaaagtatactctagttcctgctcctttcatcttggtgagactcaaaactgcctcttagatcgggtgtggtggctcaggcctgtaatcccagcactttggggggccaagacgggcagatcgcttgagcccaggagttcaagaccagcttgaccaacatgccaaaaccacctctctactaaaaacacaaaaattggccgggcatggtggcacttgcctataatcccagcta

SEQ ID NO: 56252 - DNA, 1046 bp, Homo sapiens
tcctatcactttgggaggctgaggtgggcggatcacctgaggtcaggagttcgagactagcctgaccaacatggagaaaccccatctctactaaaaatacaaaattagcccggcatggtggtgcattcctataatctcagctactcggaggctgaggcaggagaatcgcttgaacccgggaggcggagattgcggtgagccgagatcacgccactgcactctggcctgggcaacaagagcaaaactctgtctcaaaaaaaaaaaaggtctatgtctctcattagaatagaggttctggagactgaggcagatcaacagaactaccttttcttgcagagttttcaaaaggccatgggacttaagaagacggtcgacaggtaatctgcttctatcccctccctttacctttgagcttgacctttccactctgctgtcttccctgagccacctcccaactctgctgcatctctttaggggctcatcaagaggaaaacagatgcggaaggggtgagaagcagccttgtcctcaaagcaaatgagatcagcctcttagtgcctactaggttaggtgatatagattggtttttattgtcccctgcctcattctctggagaaaaattgaagcatgtttttattttctttttttatcaagaattcaagtatttgttgcctggctttgtactaattatgtggttggtagtgcagtatttgttgaaccagtgaatgagaagattcacaagactgggctacgtatccttttcaccctgatgaacttttgaaaaaactgatgcagccgggcgcggtggctcacgcctgtaatcctagcactttgggaggctgaggcaggaggattgcctgagctcaggagttcaagaccagcctaggcaacatggtgaaaccctgtctctactaaaatacaaaagaagttagccaggcatggtagtgtgcgcctgtagtcccagctactcgggaggctgaggcaggagaattgcttgaacttaggatgcggagggtgcagtgagccaagatcgcaccactgcactcca

SEQ ID NO: 56253 - DNA, 1957 bp, Homo sapiens
ctgggattacaggcacccgccaccactcccagctaatttttgtatttttagtagagacagggtttcaccatgttggccaggctggtctcgaactcctgacctcaaacaatccacctgcctgggcctcccaaagtgctgggattacaggcgtgagccaccgcgctcagcctcttgtatttctaagctactagatggggttttagtaactagtttacaaaataggacagataggacacaaataactatttgtgactattgctgcatttatggcctgggataagccctgatttctttgattagtcctcattctgtcaatgacctcccctctctgttcttcagggttaaagcacgaattgggagctctcagcgacatcaccagtcagcagccaaagacctaactcagtcccctgaggtctccccaacaaccatccaggtgacatacctcccctccagtcagaagagtaaacgtgccaagcacttccttgaattgaagagctttaaggataactataacacattggagagtactctgtgacggagctgaaggactcttgccgtagattaagccagtcagttgcaatgtgcaagacaggctgcttgccgggccgccctcggaacatctggcccagcaggcccagactgtatccatccaagttcccgttgtatccagagttcttagagcttgtgtctaaagggtaattccccaacccttccttatgagcatttttagaacattggctaagactattttcccccagtagcgcttttttctggatttgcattcaggtgttattcttaatgtttctgtcaaagcttcttaaaaatcttcacttggtttcagccatagttcaccttccctgttccaggtttatttaattccaaaggtgagagttggagtgagatgtcttccatatctatacctttgtgcacagttgaatgggaactgtttgggtttagggcatcttagagttgattgatggaaaaagcagacaggaactggtgggaggtcaagtggggaagttggtgaatgtggaataacttacctttgtgctccacttaaaccagatgtgttgcagctttcctgacatgcaaggatctactttaattccacactctcattaataaattgaataaaagggaatgttttggcacctgatataatctgccaggctatgtgacagtaggaaggaatggtttcccctaacaagcccaatgcactggtctgactttataaattatttaataaaatgaactattatcaaataaaacgtatgaatcagtcctttatagttgtcttttaataaaacaggcatttgataatgttatctgcacatttctaacagggtatagggcatgaggatttgcctccagagaattggtgggactgtgtgcataccctggacctacgaccatacacatactccttgggaccctagcacaagaaatcctaaaatcaggactgtggcccttgctcatagatgcctgtgtcaccaacagaaggctgcagaacaaggattctctcaaggtttctggggcaacaggccaggtggccaatcaactcctaggcccagggttattgttggaggtgtaaatgttactatgactactgaaaccttggttactgaactaaacagaggagcctgtcagtctcctcagactgtatcaagcaaatctatagacatgtctgtggaaaagatgacaaaagtagaagaggtatgcagagttggaaggaggggctgggttgaagtttgatgaagtttccagatcaatttactataagtgcatcttttactgggaaaggcttttgatgtaacaagggtataatgtagttagtaacaggagtgggaggctgtgtctagtacacagtaggtattcaaatatgtgttctatccaacccctgcgtgttttctttgatccattctgaaagtagagctttcctctccctatttccccccag

SEQ ID NO: 56254 - DNA, 1134 bp, Homo sapiens
ttccccacttgacctcccaccagttcctgtctgctttttccatcaatcaactctaagatgccctaaacccaaacagttcccattcaactgtgcacaaaggtatagatatggaagacatctcactccaactctcacctttggaattaaataaacctggaacagggaaggtgaactatggctgaaaccaagtgaagatttttaagaagctttgacagaaacattaagaataacacctgaatgcaaatccagaaaaaagcgctactgggggaaaatagtcttagccaatgttctaaaaatgctcataaggaagggttggggaattaccctttagacacaagctctaagaactctggatacaacgggaacttggatggatacagtctgggcctgctgggccagatgttccgagggcggcccggcaagcagcctgtcttgcacattgcaactgactggcttaatctacggcaagagtccttcagctccgtcacagagtactctccaatgtgttatagttatccttaaagctcttcaattcaaggaagtgcttggcacgtttactcttctgactggaggggaggtatgtcacctggatggttgttggggagacctcaggggactgagttaggtctttggctgctgactggtgatgtcgctgagagctcccaattcgtgctttaaccctgaagaacagagaggggaggtcattgacagaatgaggactaatcaaagaaatcagggcttatcccaggccataaatgcagcaatagtcacaaatagttatttgtgtcctatctgtcctattttgtaaactagttactaaaaccccatctagtagcttagaaatacaagaggctgagcgcggtggctcacgcctgtaatcccagcactttgggaggcccaggcaggtggattgtttgaggtcaggagttcgagaccagcctggccaacatggtgaaaccctgtctctactaaaaatacaaaaattagctgggagtggtggcgggtgcctgtaatcccagctactcgggaggctgaggcaagagaatcacttgaacccaggaggcagaggttgcaagccaagattgcgccactgcacttcagcctgggtgacagagcaagactccatctcaaaaa

SEQ ID NO: 56255 - DNA, 1745 bp, Homo sapiens
agagggagggtaaaagggggatcgcggatttaaaggggccgcggacaatacccggccccgccgcgctgccgctgccgccgccgccgccgccaacgccgctgcgctcccaactttacctcagtctcctccacactgacaccccgggccgcgccgcccctgtcacgtgatataagattccctcttccccaccccctccctccttttccctctcgcgctcgctctcgcgccttcccccgcccacttgccttcctgcgtccctcagcgcgtgacgctaaaaggggcgcgcacgcaagcgtgcgcgtgccgcctcgccacgagacacctctttccggctccgcgagtccaccccgcctccttcacggcggccctgcctccaccacgtgacgcacggatggccgccgcttcctcttactgtcgtagttccgcgtctgagcgctcgacgctcctgggtgccattgcctgcctgagtcacgtgtcagggggaagctggaaggcgtcgttctcctttcccagctctcctgcctgtccgccatgttttcaggccgggtctggcttggtcttcccccgtaaggaaatggccggggagctccaggggacccaggcgccgtcgcttcggcggagcctgggctgaccagccaggacagcggggtaaacccgaacaattctgcgcgaggtagggaggccatggcgtccggcagtaactggctctccggggtgaatgtcgtgctggtgatggcctacgggagcctggtgaggagattaccccaccccattcctgctgtcgcatcttacccagtagagaccctccttttgagctgtaccccgtctgcattctccacccactcacctgcgcctatccgggctttgactccttattccaggagtaggtgggagtttaagtcacttagtcgggccgacccgccctcgttagtctagaaccctccctttaacgctagagcacagaccccacgcctccctgctgctggcttcttagatccacccccatcataacggccttgctttgccccaagttttaccctgaaacattcctgagagccggaatctggggatttggaatgaaggcatgcttttttaaaaaaaaaacaaaacaaaactgactttttattaaaggatttttacatctttttggacaggtgtttgtactgctatttatttttgtgaagaggcaaatcatgcgctttgcaatgaaatctcgaaggggacctcatgtccctgtgggacacaatgcccccaaggtaggtccttagggcacaagttaaacatacttctccagatcttttagggtcaagaatgagatttcctctgcctttagtgatgactttaattctcatgtttctttgcgtgcacttgtccttgtacttactaagttgagcaggcactgtgcgctttggaacttggcttacctgctcagtgctgtggcaagcatgtggctcatcctggaacttctgtttttgtatctgcagaatgaagggcttgggtcgaagttcccaactgtttgtagtaaaatatttcccagctcatcttaaactacccagtgttttttgtttgattaggatggggttgagatcattaaggttaacccaagagcaatgagaagggttacctttacataattttagacttaagaggagctccataaatcatctaattccaccattcatgttaccaagaagcccaagaaaaggaggcagtttaccagaagacgtataggaagtgaataaccc

SEQ ID NO: 56256 - DNA, 2389 bp, Homo sapiens
cccacaccgtgtgttcccccactgtacacccccccccgagtcatgcgagccctggcgccccccacctcgagtcggcccccggaggttttgtttatggttgggttcgcggcctagtgggccgcgccagagccggggcctcgatttgggagcgtggccggggcggggcttggagcagccgtaggaagggggggccatgcggctagagcctgagaggggagagcgagaaagagcgcgagcgagcgaggcctgggccttgcctgaggtagggctctctcttcaccccggccggtgcctgcggaggagagggcctcctccctttccacccactgcgggcctcctctgatccggatccggcctggtttgggggtggcgtgggggagggagggcgatggggtggagctcccccaaactcccccatgtggccctcagtttggtgtgcgaaggattaatttgttccggctgggaggtagggaggagattggccccgtgggctctcgatgtggcgctgaggggggtgagcctcccatcctccacccgtgggcttgcgtcccctctccgtttccaggctctttgtcagctcctcttattaccctcccttctttctcaccaacccagttcttggaatatgtttttgctgctgtctttagcttcctgtttatactgtagtttgggtaccccaaacaattgtgttatttgggaagctggacatggaggcccccatagggtgtatttacgcttaagggacgtcactagagcactggggtatttgttcactcttctcataatggtacaggaatgcccagtttcttcaaacccttaaccttgtggacagcccttaaattgctttgcaaactgatgtcacaaactggagactgctccttttccaccattcttgaaatgtagccacctctggtgtaggatgttgtggaaagaaaaacaccacagtaacaggcgtttttgttattattgttaacgtttttgcctttgactctccctgattattaaatggagaaatcctttttttttgtcttctctcccatcctaccttcctccgccgcatatcctgttttggggatacctgatgtgacttgctgggaggtgatggacattactagtaaccagcgtttctagagaattaaaacattttggctgtgtatcagttgataaaactgctttgagatctgtctccattgtacttaaagattagactatcccaatgattacagagaattaaaacattttggctgtgtatcagttgataaaactgctttgagatctgacaccattgtccttaaagattagactatctcaatgattgtttcctttgtgaatgggaaatattgctggcacataaactagtgatgaaaggcctaaaaatgtcctgttttgtttttcatctttaaagctcctccttgctatgtcctaactgggaagtactcttactaactagatatcaaggtggtggggaaggggatgcaggggccatttcaacaaagcatctacagaaattagttgttctgttagaggtagcaaattttacccaactcagtctagcttcagtttctgaattgtttcttaaattagattgtaagctccctgagggcagctactaagtcatactgcttttgtattttcctgaagtattggacacatagtagattctcaataaatatttgttatttagttttttcagtgaaatttctctggctatttttttaagtagctagttttcaaaaaagagtcaagggcactcctgtgttgaaacctctgtttactctcgcacgatttccttggtctccaatacttctcaccctacttcctttaaatctttttattttctaagaaagagcaagtaagtaacaagattcttcatctccagtgtgatagctgggaatgggtctgcttgctactaattctgtgccctcaagtgatccattccagatcacttacttttgacctgttgctcagtgttgtcactactaggtggtaaaaattttcttagtcacatttcgaagcacttgtaagagggaaatgttactagcaagagtgattaggagaatttttttctttcttggttaattatatctttcaagatgactttttaatatgtttacatctgactggtacagtatatgcaatagtgtatagctagtcatgcagtttatacctgcaatataacttatcctcacaaatagatatcacatgtggagtagaaaacagtcaatatttgtaagttacagtagtgggttggaaatgactatgccatattagaaacttcatcttagagccaattttaaaacaaaatagttttcctctcgtctttatatatatacgtatatatgtgtatatgtagtcttgttgatttggattcggggtacttggttaaaca

SEQ ID NO: 56257 - DNA, 2333 bp, Homo sapiens
aatgggctactgtgtagcaaataatcctttctagcttgaaatacttatgggcttttgtgtgccaatatgtgtagggggaagaggtaatgggttaaaaattacctgagaagctaccttaaaaaaatctttcttgatacaaagacctatgcaacctattgacgcaacttggtgaagaatttatgcacagaaaaagtcagctttctctgtgacatccaagaaagtcagatgaaattcacttccctaatagttaatccttgcatatttctttagaagtccttcctcccactcaaatccagtaatatctctgggcagtctagaattacgttgtataaggtttcattaacaagaaaaattaaatatagagcagaaaagtataaacttaccctctttggaagggaataaatgcagagtaacctattattttgaacactctatcatatgattaatgttttcttttttactaaatgcagcagctgagattgtattataaaacaaagtatgaactaaaggaacttgaattcagtagaatccttccttgttagaagtcttgtaacaaaaactatattctggtttggggaaggccctgtgtgttctgtgtctctttaaagactcaactaagtcatcttgccagcattaaggtctcaagtttaaaatgatttcttagaagcactttcttccaaataaaactttgtgctagatgcttttggtttgagacaaatttgagattccctgtatattaaggtgagtggtggagggtaattgccattttggtttcttgaaaatgtggactaggagaccaagagaagcacctgtaaaagcagtgtgttggaattattttccagagaacagagattctggacaaagtcattggggctaatacgtaccctgttgaaggctgtggtttaaaaaaacaaaaaacccccacaaacacaaaacaaacccatagcatactgagagagatgaaacttgagggacaaagaagagtctagacttgaacttgtcctttcccaagcaatggaggtcacatgcagcttacataaaaaaggttgtaaggcaggtaaggctgttttcttaggtgattgaatacagtatttaaaattatttctctggagtgtagactaatctccttcctggaaggtttttgtttccagactttactgattatctttccttctgtcaaaggtacttcagatacttgcatctatgtaaaaggcttttgattattagttaaatgtaaagtctgcttatgggggactagtaaccaaactgctgtaacttcttaaaaaaatccatcacttacacatgctttatacatttcttgttacataaaaatggattaacagccatagctccttaaggaatttatcaagctaattatgttgtaagaataaatgaatcttattgatttgttcctttgaagaagtgaaagtgtttggtggtgaaggtgctgatgagagagttaaaaacatattttgcccacatttaatacctaattttcttttaaatctttcagtattctaccttgtaaatactgttatttgtatatactgtaaatgatgacatcggtgggcactaaccgagcccggggaaactgggaacaacctcaaaaccaaaaccagacacagcacaagcagcggccacaggtaaataatccaaggcatacggattcatggatagcgttgcctgctgatactggtttccatgcagtacagcatcattctgtgctttgaactgttggtttaggttccttatttttgttttctagtccttggctctttttttacttaggtcctgataactgttcatgacatgctgtaaggcaagatgcttacttttttgttgtttaatactgtattatgaggcttagcactttattatgggtcctgtgctttttatcttttttttttttgttttgttttaagataggagctccctttgcctaggtcaaagtgcagtggcacagtcaccattcatttgtagcctcaacctctggggcttaagtgatcctcccgcctcagcctcctgagtagctgggactaccagtgcacactaccatgccaggctaattttaaaattcttgtagagatggtagtcttgctgcattgcccaggctggtcttgaactcatgggattataggtgtgagtcactgcccggctctataactcttaagatagcatttcccttctcttacctgggccattttagcaatacctttctatttcttagaccttccaccttgatatctctctcttttgtttttgagacggagtctcgctctgttgcccaggcttgagtgcaatggcgccacttcggctcactgcaacctctgcct

SEQ ID NO: 56258 - DNA, 2330 bp, Homo sapiens
attttcctctctggttccattgagaccttacctgattattcctttcccatgaggagctggcaacttcactatgtttcttcaaaattaaatgaaacaccttagagcattgctcaattttaagttttaaagagtaaattaacctcttggatattaactttgatgtagatatattctgtttctcataccaggttgatgttagttggtatgtaatgtgaatgaattacttatatttgattatggtcagataaatcgaatatgtaagattaggacatcccccttacgcatttttctttcatctgtgttttcaagtggatttctagtagaattataatacttagttggggcagtaaaattcctagtatctgaacatacactggatatatagaagatgtgttgagtctattgtcagacttgtattctaagctctaggaataagaggatggcgttggttattacagaaataagaatagagtttacacatggctttgtgacttaatatgaattaaggggcagatgtttcagagcggttctgtgattctaagacggaagtccctttaactgtgaagattggtgaatgagttccttactctttctgtaacagtttcactcaattttttgtcattttactgatttaagcatctttttttttgaggtggagtcttgctctatcacttaggctggagtgcagtgccactatctcagttcactgcaacctcctcctcccagattcaagcaattctcctgcctcagcctcccgagtagctggacctacaggtgtgcaccaccacacccggctaatttttgtatttttagtagagacggggttttgccatgttggccaggctggtctcaaactactcacatcaggtgatctgtctgccttgggctcccaaagtgtggaattacaggcgtgagccaccacccgcacctatccctgatcccccattaagcgtcctaaatggtgctttattacttgctcatttgttacaaggaaaagaaaattggggcagtggaggctgacgaaataggttcctgttctctaaactgttgcctcatgattatgctttcttgatctcatctcaattcctaggccactgcagaacaaattagacttgcacagatgatttcggaccataatgatgctgactttgaggagaaggtgaaacaagtgagtgtatcactaatttactgtacactatgagaaaagataccagtattaaggcataatcaaatactgtagatggatgccaggatactttctactataggtattgaaagaattttgacctgaaatataataggtcaggccaataaataagtgctttcattctctaattttttgtagccctttgttttgttttttgtttttttttcagatgaagtctcactctgtcacccaggctggagtgcagtggcatgatcttggctcattgcagcttctgcctcccgagttcaagcgattctcgtgcttcagcctcccgagtagttgggattacaggcgctcaccaccatgcctggctaattttttgtatttttagtaaagatggggtttcaccatgttggccaggctggtctcgaactcctgacctcaagtgatctgcctgcctcagcctcccaaagtgctgggattacaggtgtgagccactgcacccagcctattgtagccctttggatagatactttgtttggaaattttatcttaattttaacctcttgcctgttgctgatgccattttgtagaaactgagcagttgtgggtataggaaatgtggaaattcatgctgaagcctgtgtgtttcagagtttgattctgtatttgatgcttaattgctttgtaaatacttttgacctcatccctgaaccacagatgttaatatttggcttttggaaatagaataccaaaattctacatgttttcctttttggcgggggttgggggggtggttctggaaaacctgctaggcaaattctacatcatttttctttctttcttttttgtttttttttttattttgagacggagtcttgctctgtggtccaggctagagtgcagtggcgcaatctcagctcactgcaacctccgcctcctgggttcaagcaattcttctgccccagcctcccaagtagctaggattacaggcgcccgccaccacacccagctaatttttgtatttttagtagagacaggtttaatcattttggtcaggttggtctcaaactcctgacctcaggtgatccgcccacctcagccttgcaaagtgctgggattataggcgtgagccactgtgcccagccctcatcttttgctttttaaacttgtttttttcaaa

SEQ ID NO: 56259 - DNA, 1090 bp, Homo sapiens
ctatcaatgttcttctggaaggaaacccagacacggtagagtgcttatagagtgttctaggacatgggtcctcaattgggaggctagtaatgttctaaaagtagcaaatggcaacataccttaaagcagagcacctttttcttgaagtaaagttgggaactttcttggagattgttcaccacaggttataaatacttaaaatttatgtgtactacatcctttttatgaggataatgctcataggagaaaacagtgaaatcagtctctgctaattggcctggaataaattatttattccaggctagtgactgttttcaggctgtggggttaggctgaattagaggtgcgatttgatagccttggatattgctgttgaacaaagtcacacactatacttgattctgtttttttttctttttattttattttattttatttattttacatatttgattctgaattcaggacattcccctcaatatcagcttcgcattgcacactactgtttcattgcctgaacttccttctgttgaggtagcagagaaacaagctttgtagcctgctgaccatccctggagatgataggggatatcttggaggatctcttgccctggaatttagacaagtcgctttcacttctccttcccacttcatgagaattctgtttttatgcttgtcttatgtttgtaccaaattgtaatcctctgactgccttattgatcttcagaatgttcctgcagtgcttactagagaaattttgtttttttaatgagcagtgtattattattattattattattttgagccagggtcttactctgtggccctggctggagtacactgacatgctgcaacctcctcgtcctgggcttaggtgatcctcctacttcagcctcctgagtagctgggaccacaggcatgggccaccatgtccagctgattttcccatttttagtagagccagggtttctccatgttgctcaggctgatttcaaactcctggactcaagctagctgcccgcctcgtcctcccaaagtgctgggattatgggcatgagccaccgcacctggcccagtgtattattttgaa

SEQ ID NO: 56260 - DNA, 1114 bp, Homo sapiens
tggaccacctgtggtcaggagtttgagagaccagcctggccaacgtggtgaaaccctgtctttactaaaaatacaaaaattagccgggcatggtgtcgcgtgcctgtaatcccagctacttgagagactgaggcacgagaatcgcttgaacctgggaggtggaggttgcagtgagccaagatcacaccactgcactccagcctgggcaacagagcgagactctgtctcaaaaataaataaataaataaatataaataaataaaaaataaaggactttactttttgtagtgatatgtataaaatatttaaacagaagtaaaagcaaactaatggaagtgttttagacatggatgctgagtggagaatggttaagtcaatcagtcatcccagctttcatctctagtgtcctgatagcactccatattgattagatatgaatgctctacccttctatagcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtgtatgcatggggctttatcaaaaccagctgtgggtcagtaatgtctagactctagggatgtgccagggccctgctagtcaggacctaggaaccattatattatccttttgcttttcttgccgtcgtctgttctgagaccttgacatctcttgcatgtggccttttctaccaactgccaccagtctggcatgagattaccctgtagtcatttataaagttaaatttgacttgcagctctccattaaggcacattaccattccctgagaaacatgttcccatccttccagctcattttctcttcgttgtttttttaattcccaataccatattacataccatttatatatttgtatatatcctgttgactgtgctctggccatctgtggtttggtttttttgttgttgttgttgttttaatttttatttttatttcagttcgaggtcaggaaaatggattggatggcaccaagagtggagggccttctgga

SEQ ID NO: 56261 - DNA, 2033 bp, Homo sapiens
ctgagagcaaaagaaaaatctctcaacagtaatgattgtcctactctattactgatgtgtaacatgggacagagagaaagaacatctgatagtatcaaccactttttattccagagctgcctcagctggcagggtagttttttgtatttttgaggcaaggtttcactgtcacccaggctggagtgcagtagtgcggtcttagctcactgtagcctctgcctcctggattcaagtgatcctcctgcctcagcccctcaaggagctgggactataggtgtgtgccaccacactcagcaaatttttgtactttttatagagatagggttttgctctattgcctaggctggtctcgaacttctggatgcaaccaatccgcccgccctcagcctttcaaagtgctgggattaccaccgggagccactgtgcctgcctggcaaggaagttttatatcaacttctaaaatacatctctcttctctttttctcattctttctttaggtggctctggtaggcgaggaggaaggttttctgctcaaggaatggggtaagtttcattgatctagtgtcttaattttttttcccttaaaaattactgtaggcagccttaaccaaaatgatcagaatgatttctagactggtcagaaagatatggggacttagggctcatttcttagggataaacctttaccacctggatcattacctatattttatatatctttatttgaatcaatatacctgttcttttctcagaatatcttagatatatgttgagattataccatgaaattttgggtagagtgataagtgagaaaaagtagatgacacacaggattatagaatggggccatgacagatttgtactaggaaggatgcagtcaagattttgattctttgagttaatatttgccaaagctgcttagaggtcagagactcttaagttttattttttccagaacctttaacccagctgattatgcagagccagccaatactgatgataactatggcaatagcagcggcaatacgtggaacaacactggccactttgaaccagatgatgggacgagtgagtgaccatttatcattcatttcttgtctctgggaatctaaggaaatagttttttctgattatacttacattaaaacgtggaagaatagtgtttggttatggagatagggtgagaaagggctggcagttgtattactgtgtgtactgtttatgtaacgtgcatatgggcacattacacatgttatttcgcttaatgctgcttgatattgtatgaaataatcattatttatcatcactttccagatgacaaaactaaggccgaaagagaggttataaatttgctagtatttgaactcagcattgtttgaccctgaaagtccatgccctttcaactatgctatgtcactgctattaggtccaagtgtattttctagtgtttatgttagggtagtgttgccttttgaaaagatagccagaattaatcaagccactgcttgtaaagatgaacaaggcctagaatcaaagtccacactatccatttatttgttttctgttactgagataagaatatcctttttttccctttatttttgggacatgtcagtatctgaacaagaagatttcgaaatctctctagcctttctggtgccctgttgaacagccttcttggtgtgatggagtattcagggtttgaataagattacttttttgttaactgactttggtgcctgcgtctgggctggatataaatgtttaaggatatgttaagctgtggtatacacctaagatgtgtttgggggtggatacgtgtgccactttcaataagagcagttcattttagtaagaaaactctggagtgctttcttgaacagctgcctcattctggctgagctaacacatgagagcctaaggctttttttcctcttacaaagggggatgagtagggcctgaaatgtttgactccttacctgtttaaatttgccttgtcacctttcacagatacgtgatctctgggccttta

SEQ ID NO: 56262 - DNA, 1186 bp, Homo sapiens
tacaggtgcacgccaccacgcctggctaatttttgtatttttagtagagatggggtttcactatgttggccaggctggtctcaaactcctgacctcaagtgatccacctgccttggcctcccaaagtgctgggattacaggtgtgagccaccacgcctggtcgttgttaatttcatgatatgaacataccttcatgcatggtttctttttgtgttttcctgatagcaaacttgagtttcccctttaaattaaaaaaaaaatccaaacctacctttaaaatatccacaggtacaatggggattatgtattggggcagactttctcatttacaagcaaaatttcactggttgttttttcttttcttttcttttttttttgtttcaggacttgatttcattggggttgaggggtcaaattatcccccaaaattatcccccagactgctcctggtatgatacatccaggtgcctaactgccccagatatttttgtagatttttatgagctgaaatatctgtggatatgtcatttttatgtctttctgctttttctctttctgcctttttctctcatttttctgtgtccacttacctttctgttcatttaatgaatatttgacagttacactgattgctttctgctaatggaatggaaaccctagtctgttgtttagagcatttccatctattctgttccttaatgcttcctcagctctctctcttcctcagccatgaccgtatatcctgaataggaacataccagttaggtgtctacgttcctcctttccatcccagttgaagtcatcagtgtgcagaaaaaaattcttgcatcaagagcctagattaaataacctgttagatcatgtctaactctaggattgtgtataagtgctaatgcaacttggattccatcgagccaggataagatggatgtcaatgagaagaaagtgtggtatcaatgaaggagaaaagaatgtggtttgtaacttgtctgtactgagattggactttggttttgagaatattgtcattattaagtggtttaggatttccctggtgcaattttaatattttcctgggaaagtctttacaatgaatatattttcctctaagaaagaagatttttgcattattaaatgtttagaagaattttagatgggctttgtattagaatacttctaatgtggt

SEQ ID NO: 56263 - DNA, 2554 bp, Homo sapiens
aaataagggtgctcttgtcccttcttcagacaggttcttgtttttactgtgcctttggctgaagggaagaatcctggttcttgttagaaattctcacccttattttttaagaaaggacatttttttttttctgaaaatatatgtatacatgaagcacaaaaaaggaatgtggaaggtggtttgattgcttttggatttctccagtagaaactgtatcccagcttccgtattaccaacaaacacaaggacagtgtatactcccgttgtctgtgccatgaccatagcaggtcaggtttcaagttctatatgagtaaggttaggacagtaactatcattcatacctgatttttcagtcttgttcattgtcttttgaagaggacagctctataggggcttttcttatacagttaaaccaataagatctataaacttgacttctgctgagtatgcatttttaatctaattctcatagcagatagttttcaatgccctcagttcgggtttcaaacccacccttcttcactgctctttcactaaccattatgtggtaaccatttgtgtttctctatcagtgctactatccttcttcagactgcctacagtattttttgtcttatactagataaataggtgtagtttgcatgttatggtttaaattggctgctgccatttcactgaattgaccactaaatcaacctgaggaccttaaagatactgctttgagcattgggtggttgtctgtctgtccccccccccacccccattcctgctttgtaacaaaaactgaaagtagctatgaaatcataatcttattaaaaccctggtactctgagatatccttttctaaagagtgtttccttacctttgaagcccaagaatttctttttttttgttttgttttttgtttttgtttgttttgagacagtttcactcttgttgcccaggctggagtgcaatgccgcgatctcagctcactgcaacctccacctcccaggttcaagccattcttctgcctcagcctcccgcgtagctgggattacaggcatgtgccaccacgcccagctaattttgtatttttagtagagacagggtttctccatgttggtcaggctggtctcgaactcccgacctcaagtgatccacccacctcggcctctcaaagtattaggattataggtgtgagccaccacacctggccttctgattactaaattttagtcatacttttggctgccaaaaaaattaatacattgatgttttctatacatgctttgtactggcatttaatagtgaagttacttcactatttttctttattctcaggtgcatggaggactgcaacagaggagtgggggactgaagattggaatgaagatgtaggtattcccaggtcattcctcactaatgccttctatccctaagtgttgtttagggatagaaaatgggtatgtttctacccctcaaaattcacccttaagattctgacccaaaacttttacatccaaaatagtgttctgagccagaacatttcacatatgttatatgaaggagactgggcatgaacaggactctgtggaaccacactatggaaagggcaagtgcacttgtgtaagtccaatatctgattgtcggatttatcccaggaagagattggtggttgggtagggcaccagaagtggagttaggcaggtagtgcattgagtaacagctgctggtggtacatgactacttggtgcatttaagtatttgctataaggtcctgtaatggattggcagtggatccaaagcgagtgttgtggtaccaaatcctcaaacttgtaatctggttgactctggaacccttgtatttatttgaagcccaactgtataattgtgattgagatgaatatctgtagaattggctatctgccagcttgacttaacttggaaacctcatagatgggtggcacgtaaacaagctctgtgaattcatttgagtactacctgagtaagaattttgctgattcctggtcacagtcaagcttctgctgtgaattatggttttcagtgatcatggataaactcttgttttaacatttttaatctatgtacttttctatactttcatgtagttaggcaagacagcttttgtgataagaggaaatgacatgtgaagactgttttggttgccaattctgggttttttaaatttcagaggcatcagcatcacagggtgattattttctattgtataatcaatgaactagactgctttgtgaaaatgggcaaattatgttcctttctgagatttggcttgtccgcttaagcaactttcagagaatgataaatggtgttgggcattgaggggagagtggattttctgtgctttagcgattttaatcaagaaataaaactgaaacccaaatcaacttttgaatagtaggaaaagttaatccctgcatttgcttacctaagtttgatgccttaatagtggaaggactagatgtcacaaagtcaaatattaaggcaaaaataacatctagttaaaacgatctcccataaaaaccttaattca

SEQ ID NO: 56264 - DNA, 1048 bp, Homo sapiens
tctgtttttttagtgattactatgtgccatacatgtattaagtgctttaatttatttaatcctcctacagctttacttttattcctatttccagatgaggaaagagagattaaaaaatagtttttccaagcttacatagccaggatttcaatctaagacagtctgactctaggtcctatactctagtggactatgctgtatactcagtgtgacagtattctttacttgcctgatctatactggctctcggtctggataagtgtctttatgagtagctgaacaaggttactggctgtaggtttctctcatctctttgttgatctacaggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatggtgagaagatggaaagtgacttgaatctttaaagcattggagcattactgtcaagaggctagcagggggagggggtggagaatgtgtcctgaagtgaagaaaaggggcagctagttggttaccttcccacatgtatttcccctaatcaaataagctgaattcaagaagttggggaataataaaatttgaggctatgtatttctcatcacatttagaggctgggcatggtagcttacacctgtaatcctagcactttgggaggttgaagtgggaggacagcctgagccttaggagttcaagaacagcctgagcaacatatcaagactccatttctaaaaaaattgttttcaattagctgagtgcggtggtgtgcacctgtggtcccagcccctagtgagggtgagctagtgtgaagctagctttccgcaaaaaaaaaaaaaaaaagaaaaatttttaaccatatacatagttgcagtcttctgttgattggggttttaattattattattattctccttagat

SEQ ID NO: 56265 - DNA, 1033 bp, Homo sapiens
gtggcttgatctcggctcactgcaagctgcgcctcccgggttcatgccagtctcctgcctactcccaagtagctgggactacaggtgcccgccaccatgcccggctaatttttttgtatttttagtagagaccatgttagccaggatggtcttgatctcctgacctcgtgatccgcccgcctcgaccttccaaagtgctgggattacaggcgtgagccactgcgcccggcctagatgtttttttaagattaattcttaattcagatctctggcgctatagaaggtagggattcctagtgttatcaggaggaaattttggtagattcttctatttgttgctgaaaaatttcttcttgattcaaatcaagttattccactagtagatctccacgatttccttagtatgagtagatatgctctattttgtttctctgagatttttctcttcgttactcacagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaaggtagtggcttcatgaacccttgggaattggttaggagaatagtgggcaaaaattccttaaatattagtgttttacttttcagcaagtggtgctaagaaactttggaagtagtgattgagaatttgaaaaaggcacacatctgtggctagtgaattaaaagttcttatcagcaaacccggagactgaagagccaggaaaccattctctttgtactaaaaattcattgcctctagtagaatcagtctcaagtgcctgtcctgtcttctgggaagatgtgattgccagatttctgggtgcgtgtcagtagacctcaccttgctaagtcctggcatggtgagggagacagcatgtgccagaggtgatgtggagtgagtgtcagatgca

SEQ ID NO: 56266 - DNA, 1999 bp, Homo sapiens
tttgtaacaactattaatagaattaagctgagcctgtaaagggaaggacccattttggacaaaagtatcagatttgccggaagcctggggaggtatgagggctaaggctcctttaggagtctctattcaaatacacagtttcagatttaaagtcagaattgtggacaggtgcagtggctcacctctgtaatcccaacactttgggaggccaaggcaggaggattgcttgagcccaggagtttgagaccaacctgagcaatatagtgagacctcatctccataaaaattttttgaagattggccaagcatggtggtacattcgtagagtcctagctactcgggaggctgaagtggaaggactgtttgagcccaggaggccagggttgcagtgagccaagattgcaccactgcaccccagcctgggcaacaggatgggaccctgtctcaaaaaaaatgtaaaatcagaatttttgctttttcctagtccacaaactggtctcaactagtaaagaaaagttggggagagaaagctgtgatatattttttacatctcaactctctctgttcctttatcagccagtgttagtctctggggaatctgtctccatttgctttactgtctttctgaacaggatgatgatgtgcagtgagtctgttaccattcttgccagatgagtcttgaggaatatgtagctggagattatttctaactactttagcagggtgtactttggtaccttgcctacttggcctctttaattaggaagttgacatcataatatattcagcaggagggattgtcttatttttcctgacctatgatgctgatctcttttcttcttctctcttccactgctcccccttttgaagcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggtagccttgcataagcagatggcattcctctgggatggaggaggtaagtaattgtgtgatgggataaaaatgtaatttctcttttaggaaaagctcctcccaacctccctcctggggtcccgccgttgttgcctaatccgtatattatggctccagggctgttacatgcctacccggtaagtgggactaaaggatcttcttcaaaaggtgaggatgttgtggctactctttttatagctctggcttcagatggacccctgtgaataccaaaacttgcacatactcaagccctgcagttggctctgtggaatccatgtatatgagttttgcattctgtaaatgtggccgtatttttgatctgtgtgtctggttggaaaaaattcatatataaacagcgtgcagttcaaacctgtgttaagggtcaactgtaattaaaatataaaataaatgagggattgccacatgtaatcaaactggtttttaatctttgcagttttggaaaaaatactaaactgaggccaacccatctattgtgtatctgctttggtttatggtgcacacatgtatgcatgtgtgtgtgtgcgtacaatgtgtatgtatatgtgtgatgagaatatctgccctgtttgaaacacagcttctgggcctcagaagccaaaggccagaatgttcatctggaatcctttttggtttcttagataattatgactattattttattttttgaggcagatcttgctcttttacccaggttggagtacagtggaacgatcatagctagctcactgcagccttgaactcctgggctcaagcaatcctctcacctcagactccccaagtagctaggactacaggtgtgcatccccatgcctggctaagttttaaaaatttttttagagacagggtcttcctatgttgcctaggctggtctca

SEQ ID NO: 56267 - DNA, 1173 bp, Homo sapiens
ctgtcgctcaagctggagtgcagtggtgtgatcttggctcattgcaacctccgccgcctgggttaaagcaattgtctgcctcagccttccgagtagctgggattaaaggtgcccaccaccacccccagctaattttttttgtatttttagtagaggcggggtttcaccatcttggccaagctggtcttgaactcctgaccttatgatccacccgcctctgcctccctaagtgctgagcttataggcatgagccgccgcacccagccttttttttttctttttttaaatcagagttgtggcatcttagtaaatacattttaacctattctatagcccagtaaagtactctggagcactcagggtgctttctgtttgtcccagacactttaaattatcgaatgatctgttttctcagtagaataagcttggtataaactgatagggatgacacctagagggttgaaaatattggtcctcgtggactttgatgtattctcaagtgggcatacccgtagaccttgtctgactgtgctcatggccaggcaggggggacagtgtatgcaagagtaatgtggagtttgtgctaactctagccagcttaattagtgactggataaattgcacaactctcacattcttctgttttttcctccgtggaaatagtactcatgctggggaatgagtgacattgaatctctgctcttttttcccctcttttctaggattactacagcatcccatttcccacacccactactccgctgactgggagggatggtagcctggccagcaacccttattctggtaggattgggatgggactaaataaataaaaagggagatagtgttgggattgatggcagacacctgattggtagcaagaagggatgtgataaatcaggattggtagattcaaaatcctgctaaagttgggcatgtcatggcttttcctattcatcccactttgtgttgtctccctgtgatttctagatgatatcttagccaggcatggtagcacacacttgtagtctcagctacttgggaggccaaggtgggagaattgcttgagcccaggagttcaagaccagcctgggcaacatagcaagaccccatctccaaaaaaagtgatatcttgacttagtttcaagccatttgctagctttttccaggaaa

SEQ ID NO: 56268 - DNA, 1904 bp, Homo sapiens
aatcatgtgaaatcagaagaggtaattctgtattggtattggggtgaaagaggcaggtacatttagcttctcctgtcacaggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtgagtacctggctttggtcactccttgtggtgaaggatcctagccctggacactatcctagctgcttttaagggtcaatgactttaataatggatgaggaggaacagtttccacctctggcctgtttttggcctgatgcagggtggtgggggaatggggctggaattggtggaattaggatagggattgcctagtcttagaatttgccaaagggagaatatgataccatacagctttgcttcactcagattcattcattccctgctgccattgtccctttttcttcctccaaactaccatttcttgacttcattagtagattctagaacagttagtaaggagctaatttcactaagcaaactgtagtcaacttgcatcaggataggtagccatctgaatggccagtacctggagcaggacaagtgggacagatggtattctgctgccaagtcactgcaaatctggcctttttgctctttaggtggctcctacctcttccaagcagcatggtgtgaatgtcagtgtgaatgcatcggccacccctttccaacagccgagtggatatgggtctcatggatacaacactggtaagctgaccttgtctctggctcggtgttatctgtggggtgttattggataaatttcagggaggaagacttggtgcttgagaaaatgggattggtgagggtgtgccgctgccccaggtatgattgttaatgcttggctgacttgggtatctgtgggagcagcaccaacagaggagcttgatactaggacatgtgtccactatttgtgacgggaatgcccaagagtatgtgttggtttttagaatatgttggttggccaaaagtgtgggtggaagtagggcaaggagccccaagattttgctgaaatgtcagtggaggcaagtgttaatagtatgtatggcactgatagtacaaaaggggggtgtattcactgagtagaaggattaaatgggttcatagctagcagcctacgataggtttggcttaaatcactttgtagcactacttttcttatgtgtccttttttattccctagctagaagacctaaactgtggagaaaaaggagtaggcgtgaccatacttaatagagtgggaattggactgggagagttgggcctttaggttccttcatttgtatggctggtctctttgcaagtctttttgcatatgtgatggcagggagggaattgtaggaatcctctggatgggtacttacctaaaagatactcagcctctcccttgcttccatacctgacatctgtgctctacttttggaggacagggagtgagaaggaatctttgaataatataattgtaccttttcagcgacttgtagatgaataggggaggagtaggtttctctgattgcttagggttggggatgggggttgtccttcaaagctgtcagctcagttacagtttcatggtgatttggatagagcagcatgtgtttttcacccttatgtgggctctgggtgggtcagttgcccacagttttcaataattgggaagagcacagaaggcagtaagggctaggaactgatagccaagtggagctttgaactgtgctgcatgag

SEQ ID NO: 56269 - DNA, 4057 bp, Homo sapiens
cagaattcagaaacgtattatatcagcccttgagaacccccagttcccaaccccacaaagggcttttgtcattccattcatttatttttatgtatttgattccttttaggaagaaaatatccacccccttacaagcatttctggacggctgagagctaatttggcccaaggctgggggctgtgttttgtgtgtgtgtataaatttgcactgaagtcttgtttcagaaaccagaccactgaggagagcctgctgagctgaggccatggcctgcgtggcttggggaaatgagttggtggataccttctgggcttttgaacttgcccctcccccatttccctctcccccatgtgtctgaccctgtcttacccatttcaagttcaagcggtgcagcaccttcgaagcatcaatgcacacacctgctgttgcttttgatttctggaaggcatgtagtttcaacttgtaacaaaaatatttgtagtcttcaataaactgtggtatttctttagctaactctggcgttctttccgtgcatgtctttgtggacactaggaaccaatgctgtgctgtggatgaagggtggagggtggcctttttaatcaaaccccagcatagccaaagaactattaatttttcagtatggtggttttatgaaggtggggggaggggaaacagcctcagtttcccacctgttgattagttggtaaaggaaactatttgtagaaatacctgattctccatgcttatgttgcttcatttttccatttagatctttcctttgcctcttacataagcagtgggggaaaggacaaaaaagtttggagtgtcatgtcatggtgaaaggcaaaagagagagttttcagagctgttagagaagtatctttcaaggcttaattcccacatctatctggttcctaaaggccaagtggctaagatctgataaagtcattagtgataagctagttgatgactcaggctctgtggcgactgtgctatcctggaacattgttcttagtcccttgatggcttttcagagatcgtggattaccagttttgcatttgtgggtataagctaaggatgtgcaggagcggtttggtcagatatctccttgactatggaaattctaattccctcccagtccagctagcatacaacattagccctttgtttataaagttaacgtggacagtgagatcaccaccctgggtgaattagaaaccaaagtattcagctttccttgtatttgttcccagccctttggagtaattttgctctgtggagtgtgaccacctttcccaggggctgccatggtgggagagatagattcatgtgtctctgccctgctgcccacgtgattctggtattgtcactgtttggggataagtagggggtgttgatgttggaaggaaagcaagagaactctgtagtctgaagatcttcctaataactggtgaggggtagtgaaatcagtacccattattttctaggtctctaatactgtaattgagattattatggctactacagagtattatggttcctgcattctcagtcccttcaacctcatatcaaagataaggcctctggactagaagctgtttttagcctaaactctggaaagaatgagatcaggtaggggcacactggagctgaattcctccctaccactcggcttgagaatccagttagtcatttcttccatccaatataggcagcctagcctcactgcagaaggtgaccaactatgctattttttatttttttattttttttttgcctttgcagtaaagataaattctctcttttggtttgacttaaaaatgttctacttatatcctgtttattccacctttactctccacccttccacatgaacttactagcttaagccttttccataactgaacttcctattcttaaaagttatgcctgttactcagtgatttgccagatgggcacctcgggtttgaaaagggaatggaaaaaataccccattagccctttaagatactcctgtatcgttcccttcttttacttcagtgtctttagacagttgatgcttcggagatgaggaagtattttctcttgcttggttttctgtagttccgttatttttcctagttagtgtttgcccctcccaggaactatctggacttaggatgttgggaaggttttccagattaagataccacttcaaaagtgactgttcaaggtgggcttaactttggaaggctgcctttgtctgaggcattgggaggatttaggttctagagtttgaattgtgggtgaatggaggattccttatttgtgatttggccactctagtacactgcttctaaaactcttttccatcagtgttcctgatagcagaggagaaggaaatgtgtacctctgatgggaaggatccaagggcatagacaggcaaagtttttctgaagctttgttttatttttataaaaactaatatatctttttaaaatcatgctttatattcctagttaaattacttacttttcttcacatctttgtttcaaaatggaaagtataaaagatgttaggttatttatttcatggcttttcctatcttcttgacccgatgccttataccccaggtgatggaatatagtatgagtatttatttgtttgaggagtacaaattagaatgacatgttgtactactctggtttctttaaagttgtagtggttagtagggagtttttttcaacaggaaatatgagagttggggtatgagagcttttatcttacggagaagctgaagttgtatactgaaaatgacgtggtttttgtgttccacctaggctataggagatggcctactcctgtctacctatccctccccaccccgctacacttaggcttaaattgtgtacatggaaattgatcttgatactagacctttacatcttaagtttgaagatttagcctagatgctccaagactaaagaagctggactaattgagctgaggctctgagaatgagagtgcccttggggattaaagtggactgctcctctagtacttatgcagtggaggcatggattttgagcccagaaatgtcacttcaggaagagagagggccagactgccccagtctccaggaataaaactgagtggcatttgggtggattgatttgaaatggacattaaaattaaaagtttattatattcctgctagactttggcacagaagtgttttgaaaacagtgtatgctagtgaggtttggtcatatccccttgcccaccaaaaaacaacttacctcactctctctcacgtatactcaacacgtacctgggaagggccaaagaacccttagggagcttttgtttcatgaactcttacctctcaggactaacttgaagctggaaaaccgaccaaaattcccttgcattggtatagctagaaaggctacagatatcacctcatctcaggaataagggccaggtagctagctgagctaatcctcctgtctgtttcctcctcccccaggtgtttcagtcacctccagtaacacgggcgtgccagatatctcgggttctgtgtactccaaaacccaggtaggtgcctggctctggataaaagtggaaaagagatagacatagaggaggtggagttgcaatggtagaaataacagtggacaagaagaaccctaggagaggtggcaggaaacccatcctactttttctaaatgaaaggtcttctctagacttcacttcctctaagaagttaaaatttagccctctgagaaaaaaaacgagaaacgtaataggaaggtaaagcgtggcaaattgtttatcgtgtcatgtaatttactgtgcaactctcctggccccttttcctacctactcccaacctttttcataacttttcaagagaataagtatgagagtgacaggaaactagttcattccattctttgagtaaatctataacagtgggagtgggaaaggagacgacctagtaactaatgaagcatttgagtgatccacaggtttgttatgttgcttttatcccccatcaccataaatacttaaagttt

SEQ ID NO: 56270 - DNA, 3229 bp, Homo sapiens
gggtaattttgtgtttttagtagagacggggtttcttcatgtttgtcaggctggtctcaaactcctgacctcaggtgatccgcctgcattggcctcccaaaatgctgggattacaggcatgggccactgcgcccagcctttttttttcttttttttcttgagatggagtctccctctgtctcccaggctggagtgcagtggcacagtcttgactcactgcaacctccacctcccaggttcaagtgattctcctgcctcagactcccaagtagctggattacaggcgcccgccaccatgcccggctaatttttgtatttttagtagagacggggtttcaccatattggccagactggtcttaaactcctgaccttgtgtgatccacccatcttggcctcccaaagtgctgggattacagatgtgagccaccatgcccagcctatttggtctttacaacaggtttgtagcatccctgttttatatctgaggaaactgaggctaagagattgagtagtatgcccaggttcacacagttcttaaataagagcagagctgagactgagacctgaatatgtgacttcaagtgtactgtgccttctgtgacaccatgctgctttctgagggtcagggagcttgagctcaggaaaaatcccaagactagtttgctgatcccttttactctgtctcctcctggcctcctggatagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggtaatagcccttccccttctctcctttcccttcctcttccttcctatcccttaaaactgccttccctttccttttcttacccttcctcaccaccaccttcacccaatccctccccagcgccagtcatgggcacacagcacatacagacacaagcgcacataacacgagcggccggcaaaggaaatctcagagaagggccgggttgaaaccttttttgcccaattcctttggtgcccttctcctcctgtgccacagttgtcctcatcccatcagacctgggtcacaccttccctctttcctctcccagccttccctcttccctgacattttagctttcccttctaatggtggagttctattgtcaaagtttgtccctttattttccatatatcctggttctgcctcagctaccatatttgcagatgattctctgttgccagcgccagcaggaggagcaggtaatgaaattgaatgatcatatgcttgaacccactccttttcagtccccatttcaccttcacagcctcagggaacttgaaaagactgcgcggtcacaaatcgggatacacaaacacaaacaccttgctgagctctctggcctccccttcctctctcctcctcccctccccaacaccctctttatctttgtacccttccccagctgtggaaaacattcggttaccagaatggaaaagattcttggggcagcatctggagcctgaggcctcagactgcctctcatacctgcctgaaatgggctcacagatgtgatgtgtggtaggggtggggatctgtggggcgatgcaagtggcctcttgagagctccattataggtggctggagctagaataagggcttccttcctcaaagacagctttccaaattgaggcattaatggggatcaatggaaatgaaattgccttgtgatcacccatctccaagagcaggggagagagggggtagtgtgagaatgtagaattgaaaatgagtagaactcactcactaccttgtctctaaaggtatcttgccctcttcatcttttccctatttaaaagtcaaaaatgccttcctgcttgtaagaaaggggctttagcagctatgcagaccaaattttctatggttctaatagtagtgaggggaatgggagagcaagacagtttgcacatctccacctgaagatgttacaaatttgtaccactaactagacacctttttcctcctcatgatcctcccattcccctgcagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgttttttttttttttttgtactgtgtcctcaaatttaatggattaatgtgtcttgtatatataaaaagaaaacctctaccttcagcctctgcctattcttgctccgtctaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaact

SEQ ID NO: 56271 - DNA, 1050 bp, Homo sapiens
gttcaagcatatgatcattcaatttcattacctgctcctcctgctggcgctggcaacagagaatcatctgcaaatatggtagctgaggcagaaccaggatatatggaaaataaagggacaaactttgacaatagaactccaccattagaagggaaagctaaaatgtcagggaagagggaaggctgggagaggaaagagggaaggtgtgacccaggtctgatgggatgaggacaactgtggcacaggaggagaagggcaccaaaggaattgggcaaaaaaggtttcaacccggcccttctctgagatttcctttgccggccgctcgtgttatgtgcgcttgtgtctgtatgtgctgtgtgcccatgactggcgctggggagggattgggtgaaggtggtggtgaggaagggtaagaaaaggaaagggaaggcagttttaagggataggaaggaagaggaagggaaaggagagaaggggaagggctattacctggccatcctgctgcaggtgatggtgaaggatctgagaatgcggctgctgatggggggtcagaatgtgcataaagggggcaggtgggtaggcagcagctgtggccggattgatggggcccccacttcctagggctgaaggcaagttgaaggaagcagcaggagtaccggaatgaaaaccttgtttctcaaaggactgctatccaggaggccaggaggagacagagtaaaagggatcagcaaactagtcttgggatttttcctgagctcaagctccctgaccctcagaaagcagcatggtgtcacagaaggcacagtacacttgaagtcacatattcaggtctcagtctcagctctgctcttatttaagaactgtgtgaacctgggcatactactcaatctcttagcctcagtttcctcagatataaaacagggatgctacaaacctgttgtaaagaccaaataggctgggcatggtggctcacatctgtaatcccagcactttgggaggccaagatgggtggatcacacaaggtcaggagtttaagaccagtctggccaa

SEQ ID NO: 56272 - DNA, 1074 bp, Homo sapiens
ttaaagggcgaagatttcattttattccactgccttcaggggcctgctagaggaggcccagttggtacagtaatacttattcaccaagctggtcatcgacgaaattgaggatgtcctagacggagcaagaataggcagaggctgaaggtagaggttttctttttatatatacaagacacattaatccattaaatttgaggacacagtacaaaaaaaaaaaaaaaacaaaaaaaaaaccacttcaactaattcatctgacaatgctgttcatattcatgacgccatttttttgtttgttgttgttgttgttttcctaataataaagaaggagacttagggctgttgggctgatatatgtttgggggtcccacctccccgcctcatccgtacaccaccagggtgaacaggaggaagcaaaggaagtgcagggcccatagcaaagtttcataatcttgaatgcaagaggggagaaggaatggaagggggaaaaaaaaggagaaaatacaaatcctataatacatacaacagggtggggatggtataggaatgggacagacatgaagctgaggcatggggtgggccgctgggggtggggggcagcggaaaccccccacattcctttctctttgatgctgtttccatagtttccaggctgagaagccctctcagaagatgggaccgggagaagagggtcagggcctcagttggccccccagctgtagctgttgtaggcagacttgttggtctggggcttctgcgggatggagctggtctggctacgttgcccgctgcccgtctgcaggggaatgggaggatcatgaggaggaaaaaggtgtctagttagtggtacaaatttgtaacatcttcaggtggagatgtgcaaactgtcttgctctcccattcccctcactactattagaaccatagaaaatttggtctgcatagctgctaaagcccctttcttacaagcaggaaggcatttttgacttttaaatagggaaaagatgaagagggcaagatacctttagagacaaggtagtgagtgagttctactcattttcaattctacattct

SEQ ID NO: 56273 - DNA, 1053 bp, Homo sapiens
ctttgattaaaaaaaaaaaaaaaaaaaaagaactgtcagccattgtattaatgttttgatgtggcagccagtcctccgaccctctccctagcttcccagaccccttgctcttgtcccactttgccacccatgagttgatttaatggcttaaatagtgctgaaatattggtggccaatctgcctccactctcagccacagagatcccttttttggagggatgactcgagatgaagatgatgatgaggaagaagaagaagaagggggctcatggggccgtgggaacccaaggttccatagtcctcagcacccccctgaggaatttggcttcggcttcagcttcagcccaggaggagggatacgtttccacgataacttcggctttgatgacctagtacgagatttcaatagcatcttcagcgatatgggggcctggaccttgccttcccatcctcctggtgtgtggctttccctaaggggcaacctgtggtttctggtgggttggtgggtgaaataaagagcctgcagggagtagctgggggatgggaagtgtgagaagactgatgatttcagagagattaatagagcccaagtcctttcccatcccagcaaacacctgccacctttctgcagaacttccaggtcctgagtcagagacacctggtgagagactacgggagggacagacacttcgggactcaatgcttaagtatccagatagtcaccagcccaggatctttgggggggtcttggagagtgatgcaagaagtgaatccccccaaccagcaccagactggggctcccagaggccatttcatagggtgagtatcccatctggtcctgaagtgagagcttgtgagagaccactaataaagtgcaaagactggctaggtgcggtggctcacgcctgtaatcccagcactttgggaggccgaggtgggcagatcaccagaggtcaggagttggagaccagcctggtcaacatggtgaaaccccgtgtctactaaaaatacaaaaaattagccgggcatggtggcaggtgcctgtaatgccag

SEQ ID NO: 56274 - DNA, 1093 bp, Homo sapiens
gctattcgggatgctgaggcaggagaatcgcgtgaacccaggggcagaggttgcagtgaacagacatcacaccactgctctccagcctgggcaacagagtgaaactccatctcaaaaaaaaagaaaaaaaaaaaaaaaaaagaagaagacactgtgaatccaaagttggaacctaggtctgtctgctttttccacagcaacacactatgtctcaaggctccacccaagcacaccgatgcagtgtgtatctggggtacaaacaggagaggtcctgagtggagatgagcccccagaggacttcaggtgggggatacaagaggatagcagctgcccttcgtgccctgccattgatttctgtctaggtgagccaagcattagtgtgaggaagcaggatggagagatacagaaagaggaggggctggtggggccaaaggcttatttcagtctgggacactgttcaaggggataatgtccacgagtcacagaaggatttgcgtttccaccatcaccagacagacaaactggcatgcacatcccacgtgctctgatgaccagaccccaccctcctcacctgagacgttaccacccacgtagatggctatcgtaacggccagagagccagccagaaacatggtgaagaagttgcctttggtttctccactggtgacagcctgggccacagctccttgggtgaggagctgctgagaagaggagagatgaggaacagggagcccaggagaccaacagggagaaaggttgggaaggccaggggagcagccaaggagatgaatgagcacagaagacaagcaagggaaggagaaaagcagaaggagggaagggaaaagaaatggggaaagtggaggaagaagaaagggaaagaatgtgggaaaaaagaaaagaatttacccaactcataggcatttgagggtacaaacccatggcagggctcagctttaaaaagtcttatctaagattctttctatggaagagttccatcaaagccaattttaaaagcctatgtgaaaaataattattcttgctgcactttatacaatcatcaggccaagtataataaagcacattggtcttacca

SEQ ID NO: 56275 - DNA, 1453 bp, Homo sapiens
ttataagcctttcgagaagggtggagcctgcccaccctgtttcctgatgccctgccaggtgtttcctggctcatgttccctccaccccaccctttggggaaactgctttctagtaagcacaagcactactcattgccgccagaacacatgagagcctccattgtccctgggatggataccttgagagctgttccccttttttcaatatctggcctcttctcctttccctacaggcatgggcttctgtaaagtctcagccccccatgtcacccaaggcaggggcatgatgggaggtggtggggaagtcccctctttcccaggaacccatcatggcagtaagaggagagactgggagaaggaggctgggggaggggcagggtcagagctggagaagagggtcttcaaaagaggtctcatgaggggagggaagggttatcctcagcttcctgacctcattcgtctgtcacttcttgcagggtctcccatgggattgctgggatcttgctgggtgagatggcagtgtgtgcaaaaaagcgccccccaggtaagacaggcaaggaggggagatcccgggaaccatcaagagtgggtgttgttatggctcagggagcaaaaggaaaagggacaactggtatgggtctgagggagggtagcttacagcagcccctacccagcttgggggcagcctaggaaaccgaattcttccgcttgatcccaaagctgggttatctgccaggacagcgcagagcaccagccccacgccccgaaacacctgcagtcttatcttcgggcacctgcagctcctgctttctggcctagggagctgtgttctcatctctgcttggtcctctcaccccttccctgctcccctcgtttttccatctaccggttctcctggtttttccgcgggcgggggtgtgtgtgtgtgaaagcggttgcccccgacaacgccggcagtccgctcacccgcattggcccggcccgggggtgggaggggaggcggggctcgcgcgcgagctttcgcctacgcggcgcgctggcaggctgcggctcctgcagtcggggagcgggcgggggcggaaccctgggcgtgctcggcgtgtccggggccactcagcgcacgctggcatccgccggggggcatggggggcggcggcggcggcgcagctgagctcgcggtgtccccgagcgccggcggccgggaggatggcctgggctgcgggtggggcgcgcgcccgacggctggggctcccctctgagcggctgcggctcctgcacctccccggggagccgccccgtcgatgccactaaggccaaggacatatagacggtctgccctcccccactcaaaccgggatcatgacggtccccaaggagatgcccgagaagtgggcccgggcccaggcgcctccctcttggagccgaaagaagccctcttgggggacaggtaacg

SEQ ID NO: 56276 - DNA, 1620 bp, Homo sapiens
ctgtggcctgggttttgttactgcagtgtgctctgcaggggtcctggggtgtgtagaaagggttctggaatgctgtctttggctcccggacaggcttaaggcattaggtttgctgcctaaccaagttacccctttttgcagcatgaggtcatggtgacccccggggagacgggctggggaatctattataggacagctccttgttctgggacatgaatttgatgcctgcagtcccagacctgcagaggtttcagataggtttagctagataggtgtcactaactgagtgacagatgagccctttaaagctaaatgtgtgcagatggtacaaggaaggtccagttagagagcaactgtttcaattacatttcattcctccctcctctatctctatctcagtctgcatgacccatatccctgaaacgcaccccccacacctttttctacttgaagatgagctttgaaataaggtgatgtcatttcgggccagtcagaagcagttgctggtgacatgtgacaaccagaggctcctgtaggggggactgcacatggggctgggatgctcccgcagagcagctccagggcacagggagcctccttcttgccacctaccccactctctaaataagggagagagcagtaccgcgactagatctgcagtggtccccagggggaaggaagctttgcgttttcagcgctactccttgattatgacaatgtatgcattagtaatagcagcaaaaggggctggggaatcccaggactgtcagtggctcagattcctctggagtgggggtgggggagacaaactgggtgcttccagtggaagaccttgaagtttggtggtgaggaaaagagaacatgtcctgtcctgtgaatgtaacctggagagccgtgtggtcaggctgctggtgagaggtggactggagggaagaatttgatgaccccctcagttgtggagctaactccttaaaatgatattctgtggaaaaaaacagggaaccccccagcaaagtgttggtccagacctcagtttgctcctcctgactgcagcatcattttgttgcagaagaagaaaggagggcgcgggctaatgaccgagaatacaatgagaaattccagtatgcggtaagcgactctagaccacctgttccctctctctgtttggagaggggaatggggcaaggacaacctaccgttgggactgagggctgcctgggaagagtgcttgggggaggggaagcaacctcctcagccactctccatctgctatcgtgctgaatttttcatgccttcacctgtcagtgaagcagaatacattgacccccttgagactcccttctctcctcctctttccccctcccacacctgtgtttgctagcttttggggtagaggtctggggaagtataaagatgggggaggcagcctcagtctggttctgggttgggactggagactgctcattatcttctctcctactgccatagagtaactgcatcaagacctccaagtacaatattctcaccttcctgcctgtcaacctctttgagcagttccaggaagttgccaacacttacttcctgttcctcctcattctgcaggtaggtgacccatagtag

SEQ ID NO: 56277 - DNA, 1164 bp, Homo sapiens
aggaagaggaaagggaatgaaggcatcagatggggcctcagaggcatacttctctttctttttttcagttgatcccccagatctcttccctgtcctggttcaccaccattgtgcctttggttcttgtcctcaccatcacagctgttaaagatgccactgatgactatgtgagtggttttcattcttctattttgtcccagtcacccacccctactcccagccccacccccatctcatggccaccttcatccagcacaatttcttggtgaccttgacatcccttacccggtccagctagatccatgatgtctttttgctgagcgtggggagagggaatcagggagtgaactggtttgtgatggggtgtgtatgaggcgttaaccagcatgctctgagttctactgatcaacgaattccttcgaggcgggggaaggtgtcttacctttcagttttcttcttttcagttccgccacaagagcgataaccaggtgaataaccgccagtctcaggtgctgatcaatggaatgtgagtgcctgttggagacaagagctctggggacgaagggggtcccttaggaacctctttagctcctgacagcctcttcactgtcttctcgttgcctcagcctccagcaggagcagtggatgaatgtctgtgttggtgatattatcaagctagaaaataaccagtttgtggcggtaagggacagggtacccctctaggcctgtaggttcttcctcttctttgtgagaaaaggatgaatctttcctgatttactgttgcctcttaaacacccgtggcaggaatctttctcacaccaggggcttctgtgtcatgctgatatgcctggaactagccatttatgcacctggaactaagcaaaccaagaatgcttagtggaaggagccaccattacagcccactgggggtggaggtttgcatatttggacttctcattagtttttctctctaggcggatctcctcctcctttccagcagtgagccccatgggctgtgttacatagagacagcagaacttgatgggtaagtggcatgctcagtgtcagccctctccttctgtctctttggaggtaaaaagattgtctttgaatgaggttctcaggcctgggctctgtctgaatttggaaaaattaggggtaaga

SEQ ID NO: 56278 - DNA, 1022 bp, Homo sapiens
ggtaaacaagaagcccaggggaggcggtgctgtgcgttgtgcccagggctcaggtgggggtttctggaccatttagacttgaatccctgctccccactgccgttctggaagaccacaaccgtatcatttccacctcgacaggaaagcccgggagaagatgatggactcatcccgctccgtaggcaacggcttcacctatcaggacaagctttcttcttccaagctaacttctgtcctggaggccgttgctggggagtacgccctggtcataaatggtcacagcctggtaggcatcgctatccttagcttgggcagtatctttccagtgagcacttctgtccagggcttttatatcttgttctaatttcccctgatttcagagaagactggtctcaaaggggactgggaggagctgagactcccaggtgtctcctggaaagactggctctctcaggtttctctgtgctccaggcccacgcactggaggcagacatggagctggagtttctggagacagcgtgtgcctgcaaagctgtcatctgctgccgggtgacccccttgcagaaggcacaggtggtagaactggtcaagaagtacaagaaggctgtgacgcttgccattggagacggagccaatgatgtcagcatgatcaaaagtgagtgtgggctgtgcaggtgtgtaggctgggcttgaggctggggaggggcccactgaggtctctggactgcagaagaatgacgggaagggggttgtaacttggtaggctctaaagtgtgtggccggtggccatcttcaccctcttgtcatctcttgtctctgcagcggctcacattggtgtggggatcagtgggcaggaagggatccaggctgtcttggcctccgattactccttctcccagttcaagttcctgcagcgcctcctgctggtgcatgggcgctggtcctacctgcgaatgtgcaagtttctttgctatttcttctacaaaaactttgctttcaccatggtccacttctggtttggc

SEQ ID NO: 56279 - DNA, 1002 bp, Homo sapiens
ttgcagggtttttagttggagcaactgaatgggttgtggcatttcctgagttgagaaagaccaggatcagatttggggaaaggaaacaatagttgagtttgggccacgggaaattcaagatgcctggtatgtcaagtctggcagttgaagcagcaggtctggagctttgggggagtttggagctaaatttggagatttacatttggagggtgagcctggagaagcgggaagccagaggtgacttaggctttgagagtagggaagtggagctgccagaaatgggaacggggaatgtctgcctcgtgactcccaaggccactgactcctcttcatccccagggaatgcccagaacaccttggcccagcccacggtgtggctgaccattgtgctcaccacagtcgtctgcatcatgcccgtggttgccttccgattcctcaggctcaacctgaagccggatctctccgacacggtgagaagccaggctacctgctgtgggaggcagagatggggtggctggaaaggcctcatgtgaacactggggggctctgtggggccatgtggctgttcagtgtgttggtgcttatctgttcttcctggggacagacaccctgtgcagctggccacagaggcctctgcgtcagcctggtcccaggtgctgtgggtcggaggcctctgtgtcagcctggtcccgggtgctgtgggtcccttctccttggcgatatctgacacctccacgctgacagagggctcttccctgtgcccctctgcaggtccgctacacacagctcgtgaggaagaagcagaaggcccagcaccgctgcatgcggcgggttggccgcactggctcccggcgctccggctatgccttctcccatcaggagggcttcggggagctcatcatgtctggcaagaacatgcggctgagctctctcgcgctctccagcttcaccacccgctccagctccagctggattgagagcctgcgcaggaagaagagtgac

SEQ ID NO: 56280 - DNA, 1371 bp, Homo sapiens
gtagccccagtggcggtgccgacaagcccctcaagggctgaaggccgaggatggatgccctgtgccagtgaccagagcacccagggctggccagtcactgagggaacagcgtctcggaactgctggtcctcattccttgcttcccgtccccccggtagactctgtcctgctggtcccaccacacatggctgggacatctgttcccagctgtaggcccttccaccagctggggagctagagggagcaggcccaagggcagagcagaggctgaggcacggggagccagccccactcggggaccagaagtggaaccaaaaacaagaaaaaactgtgagagattgtgtctgcccctgccctgcctgggacccacagggagactataatctccttatttttttactcctactccccagaggggccctagtgcctctgttcctgaattacataagaatgtaccatgccgggaagccagagacctgcaggggcctcggcccctcacatcgtgtatgtctctccttgatttgtgttgtgtccagtttggttttgtctttttttatttggcaagtggaggaggcttttatgtgacttttatgttgtggttggtgtcttaactctcctgggaaaaggaggctggcacacactgggatgccgcagcctggccggctgtggggtggtttgggaggatccatgtcggctctgcctgcagtgaccagtgctctgtggggcagaggagctgaccagggagggaggtacccatgagcagagggtagtgggagagtgtaaaggagggtttggtcctgtctgcttcctcaccttgagagtaaagtgctgccctctgcccccaacacacacacatatcaattcctggattccttagtcctgctggccttgggctggagcctaggaaagtggcccccaaatccttagtgagctaaagctgggtctgaaatttggtcagtggggaggggtagttttcttttcttttttctttttctttttttctttttttttttgagatggagtctcactcttgtcacctaggcaagagtgcaatggcacaatctcagctcactgcaacctccacctcctgggttcaagcgattctcctgcctcagcctcctgagtagctgggattacaggcacacaccaccacgcttggttaatttttgtatttttagtagagatgtttcaccatgttggccaggctagtcttgaattcctgacctcctgacctgcccacctcaacctcccaaagtgctgagattacaggcgtgagccaccacacccagctcagggaggcgtagttttctttaattttaaatttaaacccaagtttattggcagactcccttttgacctccctttgcctcc

SEQ ID NO: 56281 - DNA, 1112 bp, Homo sapiens
ctgtggtggggctgcagggggaagctgtgcacctgagatgaggctggaacgggaattggcctctctgctcccttcttcagtaagcaaggagccccgcccctcaggcccagcctctggcaagaggtggtggaatccttgtgccgggtagtagaggaggataagggcaaaaccaggcccaggccagtgcctggcttggtctggatgggacactgtcagagtttggccacagcctgtcctttacttcatccacacctatgaagctattccctaaataaggcatttcccaagttagtcgctacctaatcagccttgagaagaatcctttcctcttctttgatagtgggtcgggggattcttcaggaatggtttggagctgggagtgggtagggggattttaaatgttccatatgggagccccaaaggaactggatgggctgcagtgaggtgggggcgggtgggcagggaatgggagaggggaagtcttggcagggaaatcccttttggccacacagtttacaaacccagtatcatgtctgtctgtgtgtctctcaaggtgagagtctgatttttataccaaagaggaaatgattttttttcatattttgtttgtctatattatataaatatatatatacagttatatatatatatattattttttggttctctctcgttttttagggagggaagaaagtaccaagttgcattgagctgtaattaaggaacattataatttatgacacatttctatacttgcaaaaattatatcattttatggatataagagaaaaatgcctttttataaaatttcaatttctgagaagtgtgtaatttgtctcttttctgatgtttaaccaagactggtggtgaaagtaaagacagaaactgtctcttaaatgtaattgagtgggtagatctgggatatcttggacaaattggaatctgactggtgtgggatagcacctcatccatttgcagacctcccgggatctgagtttcagctgaagatgaagacggggcagtgggtggtactgagcggcatatcgtatggactttggctgggtgcctaggaccttgagctgtttacctttctccaaacgcaggccaacctg

SEQ ID NO: 56282 - DNA, 1052 bp, Homo sapiens
ctagcactttgggaggccaaggtgggaggattgcttgagctcaggagtttgagaccaacctgggtaacatagtgagacaccatctctattatgaacaataacagttaagaaaaaaaaaggcaggcaggcggttatggtggttccctcccatcccaccacataaagtttctgagacttgagaacagcaaaatgctgttaaagggaaatattaagaatgagaatctgcagtaagggtgattctgtgcccacagttcttcaattctttataccgttttacccacatgtggtgttaccaaagccgggcagaaccatgctagcggaagatgtgaaatccagatagctcattattgccaagagctaggcagctttgatctccaaattgttattgctttcatttttattgtaatggaattgctttgttttgtttttttgtttttgtattgaagagggttgttttccctttatttttcataagctaatgtaaatgaagaaaaaatgtcttctctgggctgtaggcctggctcagcgtacacaggtatacatcctaagctctctatgttctctaatctgtggtgactgaacatgtgtctcaatgcacggggcatttctacctgtgtttctgcagcacccccactgccttgagtccccagcagtgctgttatttgcctaacacctgtagccatctgccacgcagccagacgtgaaacgctgagacagagaccatttaggttaaatacgacagcttatcctgctgggtggggaaagtaaaaaatatgctggttcaaggcctaaagtaaaatgatcaataatgtttgtagcattaatgaaatattttcaagaaatgtgtccaggggtagcactggctatgttgacgaggcctttggtaactcagagagctcttggccctgatggggacttgcccttacgctttctttatcaggctctgagttcacacggagcctctggcacttccctgctgtcttgggagaaaggaaactggttgccgcggcaggttgtggaatctgttgctggaaccaggctggaagcccacc

SEQ ID NO: 56283 - DNA, 1028 bp, Homo sapiens
ggagttcaggagcatcagagttctctagaaatgtgcctacttgttacctggaatacctggtctctaaacaaaccaacaaaaaatccacgtggcttttccacatgatggtgcagactggaagaggatgttatattggactcgttattggggaaatgaatgagcgggagaaaatgtgaatgacgggcaagaaggtggtctttctccctcagaagtcctaattcagctctggagttcatggaaatccgcaacttcagagtgtggcctaaggattattttgttggtcagcctttccaagaaagtgtgtgttctctcaatctctgtggattttctcattttttagcaaatcagtgagataagcataaataggaaggaagataccccaggtttaagaatcaccaatatcattaggcattggcatcattattagaattctgaattatagaataaaaggtacaacaaaaatttcatttctgaattttaaaattctggaaatttgcaaagctccacaactgtttttttactgaattaattacatagaacttcgatgtcttttgtttcatcatcattgggcattttagttgctatggaataatttttaatttttgtctctaaaattagatttgctttgtagtaaattttttaaaaatgcaaccctaagatctgattatatgaactgggtctctaaagcctacaaagattctctcgttctgtaccaagcagactgccttgtactatacagaagtgtttgaaaagacctagaggttttctcttaaataccattacttaagattcatagtattaggatctttatgatttatcatgagcttatatcaccagtttatttactgtgaaaaaaaccatgggaatggcatactgtgagaagagtactatggtgaatggctccagaattaaaattcagcagatgtgtctgtattctggggttggtcatttgggtctcaaaactgccccatatgcaaatgtactgactgtcatcaatgaaaagttaacctttgtagcttataaataca

SEQ ID NO: 56284 - DNA, 1185 bp, Homo sapiens
gtgttacttctaaactctttggagaatgtaacagaggttgtggagcaaggcctggagcttccttcctgagaagggtcccctaccctctggtgttgtcacccatgttgtcacacaccacctcctcaggtgccttctatttttggaaagatggatgctttctgacacaaaataggggatcccagatagggatcaaaaccctatctggtctgtagcctgtgacagtcagtttgcctgtgaattattgaacgtagaacacctacaatactgtttagtactgacctacttctcatctatgaagcctgtgtctttggagctgtgatccactccttgaggacaggaagcatgtcttgggtttattttgactccttcacagtgcctagccagtgctggtggatgactgactgactcattatgactgtactgctcagctgattggagtttaaaaaactcaattcataaagggtatgtggtaaagccacataccctttatgctctaaagccacaggtagccttcactccccacatccacccctgccaccctctaacccagaaaatgttttattgcttggagaaataaagggaggtataaagagccttggggataagtgaaagagttagatgaattgttgcaaatcaactgtacaaccaaaaaaaacaggtgtttgtctaactgggacacatgatcaagtgcaaaagctatctggaactggttatagagattttgacctccttggatatgcaggagatgtcagtagccattttgataccattgccattttggtatacggtggcccttagcaactgtcctctcttgttctttttcaggtcatcattttagaagactatgctgacccttatgatgccaaacggacaaagggtcaaagggatgcagagagagtcggagagaacgacggttacatggaaccatatgatgcacagcaaatgataacaggtttgtaagcaggctctacagaatagagactgaaatctcacactcagtgagtgttgtaatatagtaaccggtgtctattggggaagagggataaagcaatttacccagatcctgctgacttgaagaaacagaaattagaccccaaactaatgtcggactatttaggtaacttcctgtatgatttagtatccttcagagttttagaatttacaggagtcttcaaagtttttcta

SEQ ID NO: 56285 - DNA, 2393 bp, Homo sapiens
gccactggagacgtcttcagggattggggcaggacagggagggtgggcctgaaccttcacctcactgaccattccatttctttgcaggctggtacacacccccaaaagaagacggctaaccctggagtatcacccttcctccctccccaggcaccactggaccaattacctttgaatgctgtatttggatctcacgctgcctctgtggttccctccctcatttttcctggacgtgatagctctgcctattgcaggacaatgatggctattctaaacgctaaggaaaaaaaacaaacacagaactgtttcaagtactcaagactgacttacagaccaaccaaccaccttgctggaacccttgctagcaggcattcttataaaagaaactttcgagcctccttatattgctggaaactcagctgtgctccagactagagcctccttacctatgctatggatttttaatttattttctcttatttcatgtacactgctttttttggttacagtgtatgatggatgtgtatgaaaaaaatgtatctttgggaaaacaattacagtttgttaatttgaagatgctggtcttgactcatctttatttttattcgcacatcccaccccatcccctgaactacttgggaggtggggaggggtacgagtccactgttgctttggtagagatgagaggccgcattttgctgctaaagcaagagaaacttggagctgaagcacacacctggtctgcccctagatttctcctcaaggcctctggagcaaccagcacttgcccccttggaatgcagagcctggcctgccaaactacaatgtggtaggctgaaacgatggtgttaattcttaggactacttttctagtcacagatgttttcaaatttctaagaaaaagaaaatgaggctcaagaggctgcttcgtagaattccttttgaatgaattgagtggggatggggacacagtctccaagtgtgtatgtggtcttttctgatctcagctgtgtggctgcaactcttcgctgttcattggttcctctcctggaaagtggcttctaaccagcactggatggtgatcattggtaagctttgctcacctccctctctcttgcttcatttggctttatcaaaaagaacagacctagctctgaatttgtttggcttgggaaattatggattctttcaagccactcccacaaggtgggtcctactagaaagggttagcattttaaggggggttgttctatacacctgtgtccttaccccaggctcaggaactgccagggagggaagatgaggtggggagtctgtactgagatggaactgtcagtgctgtgttgtatgtacttgctgttgtaaaagtttgggcatgactttgcatctagcgggtgctgcctgcatctctttgtctgtaagcttgctctgggactcagcctcttaggacctacgatgccagcagctctcattaacagtgaaatgacagaggccaaagatggccaagtgaagacccaagtctcagaaaacccagacttgggacaactgcctgggaactaggatgctagagcagttctgtaatgctttgagacacagcaattttcacattggccattctttcccctcccctaccccttttcttttgagggacttttaatgtttgctgctttaggtggatggagagtccaccagtcccactcaatgctgctctaactctacccacacccacctaattaggggtgctaataaaacatgctgaggttgagataaagacgggacataaggggaaaattcattccatagagctgaaatctggttttcaaggcctctgtggctttcttctgaacttaccaccagccctggctggaatgtagattgtgtttttagtaatgtgtactgtgagctgtcttctgtataatgtattttgtaatgtatttttctcatctaccaaaggatgaaacaaataaaattatttaaatagtttggctctaataaaattatttgaagaaacagtggggttcctgttcacttgacatagagggaaatgcctgcccctgtgagttgcataacaccaactaactctaagagaatcctccatttttcttgccaaacccagcactcccttttatgaccttaagtttagggttctaataaagtacaaagtataaaaaagaaacaaggccatatcatcatgaaacaattttcttctctccacttagaaggcaaggagaaataatgaaactaactcttaggttgttcccctacacttcaaacatgtatctatatcccaggcagggtttgcatggcccagagcccacactggcaggctctaatctcactgcagcagttttagagggcacggcagggcagtggaagggtggctggaaagaagt

SEQ ID NO: 56286 - DNA, 1047 bp, Homo sapiens
tggagggtgagtggctggcatgcggaagagggcatctcctctggcagagggcggggaagagacttggagattttgtcaggcacagctgactaacctttctcatgcaggtatgttctgggcggaggggccatctgcatggaacttctcaccaaacaggtgagcctgtctctcctccttggccaggccggcctgggcggggattgtctgagctttacagcacacacccctacgggctgggtgatagacatgatgtggccctttcattctgctgggctgggtctgcacccactgacctagacagacaggtggtggcagtgctgggggcaaagggcaagggccctcctatagacacagctgattgcccagaggacaagcatgagggttctctggaagctccatctggacctgcttgccttgtccttcccttcacccagggctggagcagtgcctactccatagagtcagtgatcatgcagatcagtgccacactggtgaaggggaaagcacgagtgcagtttggagccaacaaagtaaggatcctggtcctggggctggtggggctgggtggagccaagtacacttggggccactagcaggccaaggctgccttctttagaggaatgagcataaggcccccgggctggtggcattggatgagagggcctagggtgcccacaatggaacaactgtgccttggcccctaggggcacccctaggacttttgggaggtttcgggtctggaaaaggaagactatgggattatgcctccaagggacctcgaaggtggagggtacttagtgttttactagaccacagtgctgggagctgggactctggggtctctgggtgacagcctgcagaaggtgaggggcagtaaggccacagctagccatggcctgatctggtggcttcctctccccagtctcaatacagtctgacaagagcacagcagtcctacaagtccttggtgcagatccacgaaaaaaacggtgaggctggagccaggactcaggagattcggacacttgccacacccaggttttcact

SEQ ID NO: 56287 - DNA, 1407 bp, Homo sapiens
atagccagtgtagtagaggagacagggcacccatatccaaccactgaagacaggtgcagcgcggttcaaaccaaatactgggtaagttaatttcaaatggctttggagtccaacaaacctgtgtttgcatcctagctatcctaattgaggaattttatgtaatctcactaagctacagttttcttatctataaagtaggattataatacctactgcatatggttgtcttgagattaaatgaggtgttatatataaaatgcttcagatgatacatgataaatgctaaacaatctatctgatatattctctaaaaacatacagaatataaaatcatggttaggaatttgagctttagagctagacagaacttgactgaatcttagctctgctaagagctgtgactttgggcatgataattgacctcactagactcagcttccgcatctataaaatggataatgatagaataatgagtgatggtggtaagaatgaaatgagctagtatctgcggcacctaggacagaacctggcatgtaataaacactcagtagacattacctgctggtgtggtaattaggtatgtcctgccagaaatggggagatcactctgattacttttatttcctagcattagattaatatcccaggttctataaccgtgtaaggttcttgagactggcaaagggctgacgacatgaaatttactcctcccagatagtggacagccctctgggccacacccccaacatctggctgaggggctcaaccctacataggttctcctccttccctatgctcagtgagctagttgcttgctcacttagagcaggatgaataaggggctaattctgttcttgacctcttccatatatctctctggacatcctttctcatttccatctggcagtgcgtgcctctgcatacctgattcatgccttgcatttgtagcgaggagaggagatgtaatgattcaggtttctcctttaggcttggggccctgagaactcccgggtgcaatagtcacctggtgaaacatgagctttgagtcacagggtcaggcccaagtcatttctgctaggaattagggaagagtttctgctgccaagggagttttaggaacagttggagcagggtcagtccaggaaacaagagggctaagtccctgcctcgatctcagctgcagctctgctcgtttccgaagtccttgctgtagcttgagagctgaagatttagactgtggagggaatggggctggaaattgttctaaaaatggaaagcacgttgcgtttataagactgctagatggactgcttcactttaacttttggctcttcgccaaatgggactgggaaggtgatggtcattctctaacctgtgtcggtttttttccttttcttttcactccca

SEQ ID NO: 56288 - DNA, 1107 bp, Homo sapiens
ccatgtggagctcagaggagggagcttggctggaaatagaaatatgggagtcatccccctatagggtcttcatggccatgagaatgcataggattacctcaagaaagcggggaggaaatgaagagtgcggcacaaccaagccctgaggagttgacagatgaggatgccaaatgctggggtcccctcctgtctagctggcagttgactctgccttgtccactggctccttctctcctatcctctcctgtctccttactgtctcttcgcatccactccattgcgttcaggccacgtcagcagtcatcatggtggtcctgaaaccttgctaaataccctaaagtatagacacagttaccatggagccggtgctccactcctaggtatatgctgcagagagatggagatctgtgtccacacggaaactaatatgtgaatgttcatggcagcattactcacaagagccaaaaaagtggaaacaacccagacgtccatcagctgatggattcataaataaaacatcaaatatatccataaattgaatattattttggccataaaaagaagtgaagtgctgatacatgcttacaatatggatgcacttgaaaacttgatgccaaatgaaaaaagccagtcacaaaagatcacatattgtatgattccatttatatgaaatgtccagaatagacaaatccatagagacagaaagtagatgagtggttgccagggccaggagtgggagagttggagagatgaggagtgactgcgccaatgggtagaaggtttctttttggagcgatgaaatgttctaaaattgactgtggtgacagttgcagaactctgtgaatatactaaaaatgactgaattgtatgctttaaatgggtgaactgtatggcatatgaactatatctcagtaaagcatttttttttgtttttttttaaacccgatagtggtttcccactgcactgcatatacaagcaaaacctgctgtgatcacccggcctcctctcatgccactttccccatccctcgcatatgctctgtccacactggctctctgtcaggcgcctgaacagccaatccgctggctgccttggggcctttgctt

SEQ ID NO: 56289 - DNA, 1072 bp, Homo sapiens
tgatgccttgtctggtacatttccaagctgttttgctccaccatgctcttccctctgtgtttggaaattaccagccggagcggtagaagccacctccctgctccacttgggcactttattgtcagcgcagctcatgcgcccaagatccattccttaccccagagttagcttaagcctgccaggagtcaaaaaaacaactcccagcaaaacctgggtccctggcctaaggccgaccttgacctaatgacctctccaggtcaagtccccttgagctaataggaagtaaatgagggaatggagttgggcgctttaaaaatcagacagtgtatgaagtaacagtgacttgtggggagaaaggtagtcccttctgatttctgcttaagaagagagtccaagttggtgctagcatttcgttaagccttcctcatacttcataatcttcctttatagtaaggacaggctcagagcctttgcaggtaacagtatctagtcagaattttataacatgattttatcatattctgttttacagccaccttcaatatgtggcaagtgatactggttttccatttacagtagtgaaacaaagtttcctatttcagtgtgtttacatttttatctcttttttcatacctagtattacggatatttacatttttagagtctgtttgtttattttagagatggggatcttgctgtctcgcgcaggctggagtgcagtgatatggtcatagctcactgcagccttgacctccagggctcaagtgatcctctcaccccagcctcccaagtagctgagactataggcacagaccaccgtgcccagctaaatttttttttttttttttaagagacaggggtctcgctatgttgcctgggggattactatgttgcccaggctggtcttgaactcctggcctcaagtgatctcccaccttagctcctcaagttgctgggattacaggtgtgagccacaatggctggctctaagaagtcaatttagagaaaaatattaattaatagtccaagtaatacctggatgtggcacaaatcatgtggtgattcatgaatg

SEQ ID NO: 56290 - DNA, 1043 bp, Homo sapiens
ctcctgtcaggttccaatactgtgttgcagtgggagcccaaactttccccagtgtgagtgctcccagcaagaaagtggcaaagcagatggccgcagaggaagccatgaaggccctgcatggggaggcgaccaactccatggcttctgataaccaggtagggcgttttcctactcaaaagatacaggtcatttttagcaactgagtggtttaagattgccagtgactccctcaacatttcctgaagtgtttatggctcctctgtttgatggattctcctttagcctgaaggtatgatctcagagtcacttgataacttggaatccatgatgcccaacaaggtcaggaagattggcgagctcgtgagatacctgaacaccaaccctgtgggtggccttttggagtacgcccgctcccatggctttgctgctgaattcaagttggtcgaccagtccggacctcctcacgagcccaagtgagtgtcctagtcctggctaatgcatgtgtcaccagttggggatggtctgtaacccagggaaaacaagggtgtgctttagctgtgtaggacagaaggggcgagttgagggaaacaagtccagccctgtctccacggcctcttagaagacaatagacctgccaagagtgaatgcgttcactcttccagtaagcatgatcctttttaattttttgactagttttaatttttaaagaaatgtataggtacattaaaaaatcattcaggccagacatggtggctcacgcctgtaatcccagcactttgggaagttgaggcaggtagattacctgaggtcgggagttcaagaccagccggaccatatgaggaaaccctgtctctactaaaaatacaaaaattagctgggcgtggcagcgggtgcctgtaatcccagctactcgggaggcagacaggagaattgattgaagctgggaggcggaggttgcagtgagctgagatcgcaccactgcactccagcctgagcaacagagcaagactccatcttgaaaaaaatcattcaagctgattgaa

SEQ ID NO: 56291 - DNA, 1270 bp, Homo sapiens
gtggcaggagtctgccacagagaggtgttgattgcctttcctcacatttccaggaactgagtatctaccaagatcaggaacaaaggatcttaaagttcctggaagagcttggggaagggaaggccaccacagcacatgatctgtctgggaaacttgggactccgaagaaagaaatcaatcgagttttatactccctggcaaagaagggcaagctacagaaagaggcaggaacaccccctttgtggaaaatcgcggtctccactcaggcttggaaccagcacagcggagtggtaagaccagacggtcatagccaaggagccccaaactcagacccgagtttggaaccggaagacagaaactccacatctgtctcagaagatcttcttgagccttttattgcagtctcagctcaggcttggaaccagcacagcggagtggtaagaccagacagtcatagccaaggatccccaaactcagacccaggtttggaacctgaagacagcaactccacatctgccttggaagatcctcttgagtttttagacatggccgagatcaaggagaaaatctgcgactatctcttcaatgtgtctgactcctctgccctgaatttggctaaaaatattggccttaccaaggcccgagatataaatgctgtgctaattgacatggaaaggcagggggatgtctatagacaagggacaacccctcccatatggcatttgacagacaagaagcgagagaggatgcaaatcaagagaaatacgaacagtgttcctgaaaccgctccagctgcaatccctgagaccaaaagaaacgcagagttcctcacctgtaatatacccacatcaaatgcctcaaataacatggtaaccacagaaaaagtggagaatgggcaggaacctgtcataaagttagaaaacaggcaagaggccagaccagaaccagcaagactgaaaccacctgttcattacaatggcccctcaaaagcagggtatgttgactttgaaaatggccagtgggccacagatgacatcccagatgacttgaatagtatccgcgcagcaccaggtgagtttcgagccatcatggagatgccctccttctacagtcatggcttgccacggtgttcaccctacaagaaactgacagagtgccagctgaagaaccccatcagcgggctgttagaatatgcccagttcgctagtcaaacctgtgagttcaacatgatagagcagagtggaccaccccatgaacctcggtaagagac

SEQ ID NO: 56292 - DNA, 1029 bp, Homo sapiens
agtgggccttgggtggagaagggaactgaccatgagatccaggtggggtgaggaggtgtgtgaagtcagagtggggaagaatcagggtggcttactggcagcttcaccggggtcatgcgaggagcaggttccaccagagtaaggagtgaagttgtagaaacacagggaagtcaccatcagaaaagagcaggagtcaagaaactatggcccacaggtacaaactacctgtttttataaataaagcttcatggtaaatgaattgtaaataaagttttgcatattgtgtgaggctgtttttgtgctacagtggcagagctgtctggccctttatagaaaaagtttatcagccactggaaaagagttgcaggatttgaggtcttggtgtgatggcctaggttagagtcatagtgagattgaaggagtagctagacaagccaattgtgtggcagaaaggtagggatggagatcactgggttaaggatccttgtagccaggacaccatgagagtgattgacaagaatgctgaaatcccctaagtgtgtcaggatgtggaagagtagaaggctagagttatggaagaaagggtcccacctctacctgtgcagcctccaggagagtctgaggagggggcggtgagtgtgagtaaatgttgtcagaatccctcctcccagtctacaagccccagggaaaggaagcaaggtgtttactgacacccccaggcttataagtacttcctggctccatcaccctccagtgaacagccctggggagaagacagtactggtttgcaggtgggtgggtggggaaaggggtcacaggtgcttggtgttctggtaaatgtgcatatgagaacatggggttgcttgtgccctgtccgtcagggttcagaagaacgtgcagtggaagcagctatggggaagtagctagggaaggtaggactggtctgaggtggtgaggagcagatgctgccagctccacacatccaggagagcctgggtggtttgggcaaaagtctctggcatcccttct

SEQ ID NO: 56293 - DNA, 1367 bp, Homo sapiens
aacagataaactgaaatacatccacataatgggatactgcttagtagtgaagaggaaatactgttacaagtaacaacacgggtgactcgcaagtgcgttatgctaagcacgagaagccagactcaaaaggctgcatactgtatgagtccatttatatgacattctggaaaaaaaaaaccacagttatagggatggaaagtggatccgtgggtgccagggactgggtatcgtggaagaaattgattgttgagtggcatgaaaaagctttttagggaaatagaaatgttctatatcttgattgtggtggcgattgtcgaaattcatagatttatacacttaaaaggataaattttactgtatctaaattatatacctcaattttgttaagatatatatatatttttttttttttaagcactcctttgaaaggattaaggacgcctaacttgaaggaaaagcatttctgcacaggtgtcagtgtattgcactgtggaacctgtgtggtaaaggcaaagggggtagtgcttatctcttgatcctaaatatgtgagaccagattaaagtgaaatctgggaggcaatgaatgttaaatgagttgttatgtaatttgcatagaggtgatgctgagagatttagaaaggatcactgtgggttgcttgctcactttcttgctctcctattccgtagctttccaaatggctgtactcaacggtggcttggtgtttaggggatttaaggggggcaaaaagaaagattaataatctcctcctctccctctaaccctactgccctaagatatccttagcaaacttacatctcctttcttttctctgtgttcattccattgtgcgcacacatacacattcatggattttctctttttgtttagggaaaaaaattataatgtacatactattctacaactttttgttgttttattgaacattatatgattcctaaattatccccaggtgaatacaaatagatatgacacattttaaaaaaataaaataactggccgggcgtggtagctcatgcctgtaatcccagcactttgggaggccgaggagggcggatcaggagatcgacaccatcctggccagcatggtgaaaccccatctctactaaaaatacaaaaattagctgggtgtggtggcgtgcgcctgtaatcccagctactccggaggctgaggcaggagaatcacttgaacccgggaggcggagattgcagtgagctgagatcacactgcactccagcctgattgcagtgagccgagatcatgccactgcactccagcttggcaacagagcgagactccgtctcacaagaaaaaaaataaccgtgtgagtactattccatagaatga

SEQ ID NO: 56294 - DNA, 1026 bp, Homo sapiens
atgataattgtgattactgaggcatccatcttccctagcagactagctaaaggatggcgctcttatttgtgtcatatcctgggtgcttaacacagtatctgccacataattaggtgcttagtaaagttttgttaaatgatcgaatggggcgtttttagcgcagtgtgcaagtgccctattaggggtaggcgcccagtaactcgagaagcatggagtaggaaaccacaaacagcacctgctccccctcctctccccctacctgctgtggggaaggcctcccttgtaaatttgaaaggttgattcacgggaagccgtggaggaggtgcatgctaggccaacgaatagaatgtgcaaaggcccagaaggaagacagagcccagcctgcaagggaatgttaatttggagtgactaacaccatgaaagggcatcagctggagatactgctataaagggactgccttgtaatttcataagcatgggggtaaaattaagattaaacacagggaaagaacattctcacaggtgaggatggtgttgaaccctagaataatcgtttcccagataccttgaacaaaaatccagcagttagagaagcctgaccatgaagcaaatttgacttttgtccctctagataacaaaagttatctttttgaaagtaatggtgtaatttgaatgagtgtagagaagcgctgaagactgagctttactaaagccttcagacctggatttggcagcagcgtggccttagtcaagcctcggtttctacacctgcaaagtgggaataatgcctaccttggagggctgttgtgaagattaagggagataatacatgtaaagtacttaaccatttgcctggtggggtagtttttatgacctagatcctaaattgttcactgctgctgttgctactcttggtactttttactggctggcatctgcttgcttaagtttataacatagtaggagcattaacaaggtcccacggtggggaccttggtcgtttgacgagatctgcgctcccgccca

SEQ ID NO: 56295 - DNA, 1963 bp, Homo sapiens
ataaaaactggtcaattaagactagggagatttaagaaaaaagtaaatgcaacatattggttgtttcgtaaattggttatccaaggaattgaccatttggcaaactgactttcggcaaattggctgttggtgaaatcagcctatttccctgagaaacactgcagaaggcagggcagtggctgccttgagcctgcccaggacaggactgtgactgtcccctcctgctttctacaagccatggagataggggcattgctcttgcatgaggctggggctgagagcagccccctacaggctggatctggatcctagggaagaagaagatgggagatctccccctttgggtcctgactcaatagaacccaaatgtaggccagtagcggaacctctgtgctagccagagtcaggccagaagtcagtcaggtgctgcatccaagaacaatctagcatcggagaagcggcttaagggtgtcagaatataatgtataaaaccacaagttgtatagggtcaccccgtggggtagttatccgactgaatgtacatttattagttatacatacttgcaaaagattgcacacaggcctgttagtcattattattagtattattttacatatgtaatattattgcaaatgttatatctttattatataatacttaagcctggcacatatagctagttgataaataccactttttttctttgttactagataacttactggagtggataaatgcacttaatagcttttggagacctctttttcttctgggggtacctgaggcatttcttgctttctttttttttttttttgagatggagtttcgctcttgttgctcagggtggagtgcagtggtgcgatctcggctcactgcaacctccgcctcccaggttcaagtgattctcctgcctcagcctccctagtagctaggattacaggcatgtgccaccacacccggctaattttgtatttttagtaaagacggagtttctctatgttagtcaggcgggtctcgaactcccgacctcaggtgatccacccacctcggtgtcccaaagtgctgggattacaggcatgagccaccgcgcctggccacatttcttgctttcttgtaacttcaaaagccagttttagctgggagcaatggttcacgcctgtaatcccagcatttttggaggccgaggcaggcggatcacctgagatcaggagtttgcgaccagcctggccaacatggtgagaccccacctctactaaaaatataaaaattagccaggcatgatagcgcgtgcctgtagtcccagctacttgggaggctgaggcaggagaatcacttgtacctgggaggtggaggttgcagtgagccgagatcatgccactgcactccagcctggataacagagtgagattctggctcaaaaaaaaaaaaaaaaaaaaagccatttgtgatcattaacatcaatagaatatatgtcagcataaatactgccacagagcactactcagccagttgggcaactcactcttctctaccaaaagctttacaggttatcaaagcaagtgggtttactgtgggaggctactgtgaattttggaaattaatgttgagggactagcgcagtggctcacacctgtaatcccaacattttgggaggccgaggcaggcggatcacgaagtcaggagattgagaccatcctggctaacacggtgaaacgccgtctctactaaaaatacaaaaaattacccaggcatggtggcatgtgcctgtagtcccagctactcgggaggctgagacaggagaatcacttgaacctgggaggtggaggttgcagtgagctgagatcgcaccactgcactccaacctgggcaacagagcgagactctatctcaaaaaaagaaagaaagaaagaaaattaatgttgttaggaactgttgtagtggaataaaaactcagtgataaag

SEQ ID NO: 56296 - DNA, 1049 bp, Homo sapiens
cactcataactgacattgtatatttatttgtttatttattgcctgtctctcctcattgactgtctttcattagcttcatgagaacaatgtggaaaggaattttctttgatcaaagcaaaacaaaactaccttgaggcctaggacagtgcctcatactggcatatagtatatgttcagtaaatgtttattaaatgaatgaatggaaatcttcccacaggaagaaaacactggcattatgttgatgaacattccagtctgcatgatagatacacttctcactgtaaagatctgaaacttgagtaccatggcatcccaggaaggtagcacacctcttcccatatgtgtttgaacctgcagaggtcaggcccaaggagcctccagctggaaattctaccctgtgtgatgtttcactcctctcaaacttttctgaactttgataggttgtatattaaggccttctccatattttggggccctttccttggagtatttatttttaaaacatttatttaagcacttacaaggtgacaggcactgttcttagtcctttataaatagcaactcactcttggactggagtttggggaccaagggttgtcaactttaaaacttttttctttttaagtaccaaaacactcaagaacagaaataagactactctgcatctagtccatcttgccctccagaagtagagctatctaacagcctgatacaggtcttgtccctgccctttcctcaggtttttacagccatagctagtaaatataacatactgcatctcatcgcctttgtttggtcttcacccaaacgcagccacgctctgccgcaggatatgtggcagagccaggtggggaatcagtggctcagagcccactctgcttttcaggacataggctgctcaagcatctgtcttcagccctctcccagggagggcctaaacccacatcctcaggcccctgcagagcacatccatcttcctggttacatgttatgccttatctgtgggaaccctagccacgccacacccacacctcaacacatgaagaaag

SEQ ID NO: 56297 - DNA, 2872 bp, Homo sapiens
gagtagctgggatcacagatgtgcaccaccatgcctggctaatttttttttttttttttttttgagacagagtctcactccatcgcgcaggctggagtgcaatgatgcgatctcagctcactgcaaactctacctcccgggttcaagtgagtctccctcctcagcctcccgagtagctgggattacaggagcatgccaccatgcctggctaatttttgtatttttagtaagacagggtttcaccatgttggccaggctggtctcgaactcctgacctcaggtgatccacctgcctcggcctcccaaactgctgggattacaggtatgagccaccgtgcctggcctatgcccggctaatttttgtatttttagtagagatggggtttcaccatgttggccaggctggtctcgaactcctgacctcaagtgatctgcgcacttaggcctcccagagtgatgggattacaggcatgagccaccgcgccaggcctttcgcttctctttagcacttgctatgtacctgacacggtgttgagcactttacatatactaacttatttcatccctctaacaactgagtgcactaaatattatccccattttatagatgcagaagtgaatcttggctaaggtcctgacattaattaacggcaaagctggaacttgaagccagctgtgtggtttgagtcttgctctttctcagtgtctagcaagtcttgctcttgcccttgctcatcaggctatgtggtttgagtcttgctctttctcagtgactagtatcccagcaatgtaaacctggtgcagtgggggaaaggaggcccagacagagtttagtgggccaggattggctgcaagaataacatctcaaattgtctaatgatacattatcttttattttacattttttactcagcattgtccagatatgaaccaaggtttggccttttcacccagagaaaaaggacaggctcatgggtacactgtgctgggatgacgggcacaaagtaggtattcggaaaatgcttgtggaaaaaagaaatcctgaggcattgttatttctgccagaaggaggcccagtgcttattacacacaggctccttaagccagctatttttatactataacacactgtaatatgagcatttttctgattcatggatttaaagatttgaagccctgtttcagaccaagattggtagtattatctgtgaccaactgattagagttctcaaatatgtgaacaacagaatctgagcttttgggcttctgtagtaatctcttgagatagagcaatttgttttgctataacatctgttagacttggaccttaatgggtacaactgcttgagttttctggagaacactggatgattgtttgacatcagggataaagagttcaaaatattaagtttgtctcaaaattaaatatttgggaaagacctgtgattgatgtgcattcattgtaggaatagtacactagttttaaacagatgatattcctggtatttttgatgagctattctgtgtcttaaagatgtttaaagatgacttgtagttgtatagtgaactattaggaacatacaaaatttatataacccatccatatagactgtgacttacacccccctcagttcctccacccaaggaggtctagttgctgcttctataccctctggttaccttgaagctacctatttcaccatctttatcagactttatcagacttaataggtgagaccctctgacatcagcctccctttccttctgtaccaccccttgccacatgcacacagaatgaagctcttctccaaaaggactgtatattaatctacttgcaagtggcacaaacccagtgtaaattaacttaagcaaaaaaaggttttttcctccctttgattatttaactagaaagtccaaaggcaagcttcaggcatggctggatcctggggctaaaatgatgtcatgagggctttcttggcccttcctttttcggctccgttttctttattgacttcattctctcttgctgctttctttttctttttttttttttgagatggagtcttgctcgtcttgctctgtcgcccccaggctggagtgcagtggcacgatcttggctggcggcaacctccacctcccaggttcaagtgattctcctgcctcagcctcccgggtagctaggattacaggagcccgtcactacccccggctaatttttgtatttttagtagaaatggggtttcactatgttggccaggctggtcttgaactcctgacctcaggtgatccacccgcctcagcctcccaaagtgctgggattacaggcatgagctactgtgcccggccttcttgctgctttctctatgcatactgaaaaagctccctgtcagcaaccccaagcctatgacctgatggctgtcttttagcgttgtaaattaaccattgctgacaaggaaatagggagaccacaattggagaggtctacatcataggctcactcttgggatgaggaagtaaactgcccgtccataaccttatgggatggggaagttcagaggtcctaggcaggcagaaacagcacatgactactgcaggggtgtgtgtatgcacacatgtgtgcttacatgtgtgctcttatctcacttctttggggtccttctagagccttccaactggaatgaatccagtgggttgtgtttgtccatcaaactttgactcccactgtggcatccattatgtgctctccgtcctttctgtacctttgcatctgctgtttgggttgcccttccccattgcttcatctggctgatccttctagattcaggtcatgcttctcccagaagccttccttgacaccttccttaatgagcta

SEQ ID NO: 56298 - DNA, 1056 bp, Homo sapiens
ccaagaaggaagagcattgaagaagtaatgattttaatatagtgggggatttcccccttaaatttttataatttccttgtgaataaacaatcatggaaaagaagaaacctagtcatacaaaatcagaataaataaaaatcttaagactggatccacatctttggccaattcatataagcacctaatacatcaatttctctgtacttaaaatgaagagaataattaatattcttaagtacaatgttttcaatagagaacaaatgaaatcacctttgtcatcaacagcagcccagactgactgtatctagatcacaccttgatgttacgtttgaatgcagtcagtagttaccaaaaagtaattagtgcacattaaatagtggtaaaatcagcagggagaaatatgggattagcacgtagttccagaaccttcctcctcctccagagtgcaactcaacaaacagtacactccaaattaagaatcaatgtttcatcccaggacaaacggtgttgctcccatcacagtaccacaactgagatactgtgaagtcattgcactaccagtaggttactactcttttgaagttactgtttttaaatcctaaaatatgtccccagttttctacattcattcttcttcccctaagagttgctagaagcagatgaaggatccctattgactctgcagggtttgatttcagtaccttagacagctatctggtgacttcccagtaggcacgaacaaccccttctctccccttgcagtcggtgggcttgatgacgccccagacagtatcctttccttctctactgccgccaaaataaacattagggaaatgggatcattaacaccactgagaaaggagtttacagggatcgcaatagtaactgtctgcttgtggtagtagaaagcttgtgccaggctgcatgaatagaaattaatgttaaactcctgttagacgagtaatatgtagatttttattgaaacagaccacagcttattaaaaagtactcagtgcaatggtatatacatatatacagatagaaaaaaatataact

SEQ ID NO: 56299 - DNA, 1048 bp, Homo sapiens
actcagaatgtggccagaactagctaactacctgaactgaaagcaccccatgttcagattcagaccaactcaaaacacatgtaaggggtgcctattgtatgcagggtaaggtgtcaagtccctttttatttggattaagctcaaataagaaaggacctgaagcgaacgtgggatgtgtatgtgtgtacatgtacacgtttgcaaacacacaggtttatgtgggtattaatatcgagtggaaaatctggctttttatttgtctgtgtctttttttttttttttcagtctgattcgagtatatctgttttggcaagttgtgggcagctctcttttacttttgtcacccagaggcttccgtagacaaaaggaaaggagagaggtgtgttcaaagacccccatggcgaagagcccatcccccaagcctgacacaaccctccctcccagcggacccctcttctggactggcttcgctgttggctacttcagtgcatctgacccccaccccccgcgtgaagacctgagattgagcgtggatttctgttctccaccaactctgcagcaagggccctgccagaggcgtcgcttcctgtcatctcctcttcccgctcccaagtagaggcacctaaacagagattagatttctggtttcaaggcatgtcggaccaagcacgctgaatgaacatgagttagttaattagctcggtctctcttctttccgttccctggtctgaatgtttcttgatggcaaagcgaccaggagagagttgatttgcatcttaagacctatgggtaatgcttctggagtggggagatttatttagcaactgcttgaacttgtgtacggggtcgggaaggaggtggagctgaccccaatggggctatcggagattggggtgtgggtggtgcccactgccacgctgacaccccgggcctcgatgatggcagacaggagctgctgctgctgctggcgcagggtgtcggcgatgagcagcggcagggagttgaagctggcggtgagatgctccagcttcgactccaggctgccaat

SEQ ID NO: 56300 - DNA, 1013 bp, Homo sapiens
aaacctcaaaggagacatgtggccagactgcaggaaggaactgactcgaactagacctgggaagcccccacaaccaggaggtctctcaccatttcttctctgtccttctgtttaagtgactgcttcagttctctctccctctccctgtctctctcttcctctccctttccctgtctctctcttcctctccgtctccctgtctctcttcctctccgtctccctgtctctctcttcctctccctttccctgtctctctcttcctctccctttccctgtctctctcttcctctccctctctcttcctctctttctctccctctctgcctcctgtccccgcgacagactgtaacaggctccaattcagagagtacatataatagttttagccacaggtaaagactaattggccccctactagtcttaattctaaattctcagaatagaagaaatgattggccaatttgggccacgtatccaccctgggaccaatcagcattggccaggaagagggtcatatggagcaaacagggctaggggcccacctgtgagcttcaggaatagcccaacaaactgccccaggatgtttcttccatgagtagcagtatttcctgtttctcctctcaccttgcaggacatgctgtgactgatgttccctggggacatgaggcaaaccaaactttcttttttttttttttagttttattattattacactttaagttttagggtacatgtgcacaatgtgcaggtttgttacatatgtatacatgtgccatgttggtgtgctgcacccattaactcgtcatttaacattaggtatatctcctaatgctatccctcccccctccccccaccccacaacagtccctggagtgtgatgttccccttcctgtgtccatgtgttctcattgttcaattcccacctatgagtgagaacatgcggtgtttggttttttgtccttgcgatagtttgctgagaatgatggtttccagtttcatccatgtccctacaa

SEQ ID NO: 56301 - DNA, 1144 bp, Homo sapiens
cctttcaggcaagaaagtactagaggtgggcagttaagtcatttaaaactattttcacagcagatctttactgaatttttaaaaagcaatatttatgtcccttagacatttctgagaagacttagctgttcttttaaaaacatcacttcagcgccaatgaaaaatataatccagccttagtaataaatttttaaaacatacacacacaaaagttatcagcctgcaaaacaatgtttcctaggcttcccacacatctcagtattttaacaacatcccatctgttgatgtcagtctgaagaagcaggtctatattctctaattttattaaaatcctttctggctagtaacctgatttctattaggctggcctacttatttccaggccccaggcctgtggacacatgccagtctgcatggctgacagaaatggggatggttaatcaaaaatctgcttagcatgtgcttaataaggaatgttttctgttgctcttgttactaattgctgaagatgtctgtgtttggattaaaactttgtcccctgccatctggatgccattgatatgtctcagctcagtcatgagcctggtgatatcagtggtttccatgtcaatggatgacagcgtcatatgttgaaacgtgtgattgcagtgcacagtgaaggagccagccctggggaagaggaagctctggtttcacacctaaatatcttcactgattttcagacattgctctgaaattatttcttttttgtgccaattacatttacatgtacaattgcagtgcaaatgtttttggccatttgggaaaggagacaatgggctcgttggtacctatagttccaatcagtgggaaagacattttctcaaagaagtcttttaaaatctccagctgataggaaatctgtttactctctgaacccaagcaatgtaccgtatacacgaagtggcaatctcaggcaaagctcggaagtctgcatgtaagggcagcaatggtatatcgctagctattttccaaggggaccccgggactcaaggtctcgctcatgcagcctgtctaaatatagcatcagcaacagcagtcaagagatagtattgaaataatcaagaaggaagaaagaaagaaggaaggaaggaaggagaaagaa

SEQ ID NO: 56302 - DNA, 1003 bp, Homo sapiens
aggacagatatgatccctgccctcatagagcttccaggctagtgggaaggcacagggacaggcaataacaaggaatcaatcaaataagtccgtgtaaattcagatgcagacaaagaacggaatgtggcagtgatggggggtcatggaggaagaaatgaattagggttgtagcttcaagggcgacctctgaaagttactttggtattgtgagatttatttctattaatacttcctttcgctatgtactacagtattatctcctcaggaaagtgaggctcagagaggttaattaacttgcccaaaatcacacagccagtcagtggaggagtcagaattcgaaccctactctgcctgactccgaagtccaggttttttccaccatccttgattatctacagaaattaggacaacctactacagaatgtcaggtaatatggtaaccattagtatgagcattaagggaccccaaggccagacctgtgagcccagcctcactgctgtctctgtctcctgttctagggggagggacgaggtggatattctagatggtcttaccctctcctctccttcggagactggcttcattgggagtgagatgacactgtcgcagggctagctttttgtaggccactagttgtcgcaggctgctgatgaagccaagcagatcacccccatgtccacaagcacaccgggattagatacatttaagtcctagatcccaaacgcctttttcatttctggttttgcatttgtttccattctactatcttcatttggaaaaccctttcattcctcaagaaaacaagccacacaatcaaaaaaagatgtgtcttatcctctgggcgctgcctcattgcctgccccattattgaccaatgccaccggagtgccttgcacagcttggccagcgttcgctgtgcacatcgaccggtgagctggcatgctgacagcggcaggggcccccagcttcagacacttctgaacccagctgctttacggacac

SEQ ID NO: 56303 - DNA, 1057 bp, Homo sapiens
taattgtctaattatattcttatatatatatttgtatccttattattgtatatttgtcaccaccatccatctccagaactgacttttgtcattttctgtgtggccttgtgtgcctccaccaaggcttgtggtgagctctcttcgcacatcatctccacaagcatctcccactttgtcagcccctaaacttacctttaccctgtcccatcgccctaacgtcacgggccggggttctgattccaagtttcgattggggaagtggttggtaatcccacaggtggtaatagtgtcgcctccatctgttgatctcttgtgtgctggagactgtgcctttactttatcatctcagtgattcttggcgacagtcccgtagttaggctctgtattcataccccctttatagataaagcaactgaagcagagaaggtaagagatgtgtccacagtcatgtggctggtgagggcagagggttttgaggtcaactgtttgagttgaccatctccaaagctagccaggttgccctgcctgggggagagaggcccgtcctcaaattaactcttctacccctggttcctacaatggctagaagcagcctagaaggtgggctgagtcatggggacttccctccaacaagggtgaatattaggaagcctagggctgaacagtaacccagtgttggtccaaccttgcagcagctctggaggccctcatcccagccacacccccaccttggctgtgccttgtggtggctcctctgcctattaaaatcccttccttctcctggtttccctattgtcctccccttgggtccaaggcttgcctcaaggatgaggcccagcacccttggggaggtagaagggcagccatctcagggtaacctgcccagccatcagaactgggacccgcttcagtttctctgccttgccttctgatcccaaggaaggctagggtcttccttgaagcctcactgagccccatactgggtcttgttctttcttgcctccctgccttctgaggggctgacttctacttctgctcgcctggagtcacagtgtcc

SEQ ID NO: 56304 - DNA, 1065 bp, Homo sapiens
tctcctcacttgtacgaggtaccttctggctgctcttccggctgctcaacactcaaagaaggaaggtgctgggtgtccttgtttgcatatttttctggcacggacacattcttcttggagtttcttgacattagggccacttgaaatgctcaaggtaagggctgctctgcctggcagacatgcgtcaggtgcctttggctcctccctggcaagtctgcctccagacgccctcagatcctgtccccatgcctggccatggggctatctgaccactgatgccagagggtcacactcatcagtctatacagaagacttggaaatgttttggcaaccctgtgttagaagagtggggtttcctaactgtatggctttgggtaattgcttaaatcctcccagccttagtttttccatctgtgggttaggagtggtcctctctacctcccagcatcaaataggaaactgtgcaagaaaatgctttgtaaacaggaaagccctaaactgacatccaggacacagtgactcagtagcaaatatattctgatattcagccttttccatggttacagcctcctctgtgccaagaaattcaagtcaccaagggttaaagcaagcaaggcacatggccgtgattgtccataattgatgaaataaaccttaaaggagtgacatataattaattgcaattaatccaggcactgtgacaccaccttgctaaaaatactgtctactaacaattgctttgatccagcagaatgatgtctgcccatgagcctggcaaagtgtctgctaatggagtgcacatagtgggtgtggaagctggcaggtgtgggggcagagggcgggaagggggccccaattctctcagaccctttggcagcaaatactacatatatagggtgatcatatgattcattgtctaaactgggacacttttgagattattatattaatgattaccattcatagtaataattatgccagataacaggcatacactggactctcctgggtaaacccgaatgtatcgccaccctctgcataggctgttttaagcccgtgggaacc

SEQ ID NO: 56305 - DNA, 1008 bp, Homo sapiens
ttggatctgggatggaattaatctcactcaaacgtgtggctgctataaaatacatgtgggtagttcctaaaagaaaatattttatggagaagagggcaattgttgctggtggtgcaaccagcaattgccctctgtactcttgtggtatttggtatactaaactcatgggcacttatgtttgccactccaattcttcttaattttggtgaagtccaatgtattatgttttcttttatggattgtgcttttagtatcatatctaagatatctttgcctaacataaagtcacaaagatttttctcttatgttcttttctagaagttttacagatttaagttttacatttaagtcattgatccattttgaattaatttctgtatatgatattaggtatggattaaagttacatttttgcatatgtatattcaattgttttggcatcatttgttgaaaaggttgtcctttctccactgaattgcctttgcacctttgttgaaaatcagttgccaatacgtgtaggtctatttctggactctattctgttccactaatatttttctctttttgatgccaataccacactcttattattgtagcttgatcatgtcttgaaattaggtagtgtaaaccctctaactttctttttcaaaattattttgacttttttttaggtcatttgcatttccacataagctttatttatttatttatttattgagacgaaatcttgctctgttgcccaagctggagtgcagtggcgtgatgtcagctcagtgcaacttctgcctcccaggttcaagcaattctcctgcctcagcctcccgactagctgggactacaagtatgctaccatgcccagctaatttttgtattttcagtacagatggggtttcaccatgttggccaggctgatcttgaacccctggccttaagtgacctgcctgcctaccttggactcccagagtgctgggattacaggcatgagccactgcacccagcctaaataaa

SEQ ID NO: 56306 - DNA, 1249 bp, Homo sapiens
cagggtggtcagagtaacctctcctgccttgggggtcctctgggtgtgggaggccttgcaagtgcccagagccagatggagtgatgctgtttcagcaaaggcgccaggaatttggggatgggaaggggtaagggggagagaaaggagacacaatctccgtgggatttgggatgggggcaaacaatgctagtgggaggacatggagtgcaggattttttttcccccctcagatttcccactttagttgaaggctaagcctttgcccaggggatgcaaactaatttcagtattagtttaagccagaaataattgggaaggtaaaacttgcaaaagagaaaccacgccacatatttcaaagacaaattgaaacaatttctggattatccccagacctttcttctgtctaccagtgatcgggatttcttagttgctgagactcttgcccttgcagacctttgtcctggctgaaacctcattaatccttgcatcagccctgggggaggcaggtgagggtgagggatggctcttccgctgttttaggagagaccactgaggttgaaaggccggtgacgtagacataatgtcctttgggcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctgggtaagagggctccatggcagcatgaagaacacctgtttccctagctcttcgctgtgtccatctctctctgtctccactgccaccatcctggcccaagcccccaccatttctggcctggacagtcgcagtagcctccacactggtctctagctgtggctcttgccctctgtggtctattcattacacagtagccagactgaccttttattatttatttatttatttatttatttatttatttatttatttttgagatggagtctcacacttgtcgcctgggctggagtgcagtggcgcaatcttggctcactgcaacctctgcctcctgggtttaagtgattcttctgcctcagcctcccaagcagctgggactacaggtgtccaccaccacgcctggctaatttttgtatttttagtagagacgggttttcaccatgttggccaggctggtctcgaactcctgacctcaggtgatccacccaccttggcctcccaaaatag

SEQ ID NO: 56307 - DNA, 1050 bp, Homo sapiens
tgtgttgcccaggctggtcttgaactcctggcctcaagcactcctcctgccttggcctcccaaagtattgggattacaggtgtgagccaccatgcccaaccagtgaattaataaatgatatatgttatggtgaccaagtcagtggagacagatacctctggctatgagagaattagtttagggtctgggcaataacctaatccagctagaatattgtgcgcctgttcacactgtaattagcactttataggttttacctgttagtttcagggctcttttatattctttagagtttcataataatcctgtgtgggagacagaacagaaagtgttatccccattttctgatgaggaaacaggatcagggacattgagacctaccaaagttacataataccagtagtagaaatgggacttcaacacaggcctcttgactccctttctgggacatggaagctcctggaaattctaggctaactggattctgatctccctgtcctgcagacttggagctgatgtctgtgctgtcctccggctctctggtccactcaaggaacagtatgctcaggtaggtggtgctttgtggcatccggtgtgttgggcggggccggctccaggactttggagctgtggctgctgcctgagtcactggcatgattcccgtcaccactgctggcagggtggtggccagctcttggttttctgtgagtggacctttcgggggcattttcagcttatatttctttcctaatagcctccctcccttcagagtgagttcaggaaggtgtgcccaggaaaggctgtcgacactcgagttggcagctctgatgctgtgtgattagtaaggacctgcctgtgcctcctcacaccaccctctcactcagctggcctgacacagcccctagaactttgctcctagaaatttagtacaggccgagcacggtggcacatgcctgtaatcccagcactttgggaggccgaggcaggtagattgcttgagtccaggagttagagaccagcctggccaacatggtgaaaccccatctccgt

SEQ ID NO: 56308 - DNA, 1035 bp, Homo sapiens
gtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcggccccgcaccgccccctgcgccgcccagcaccgggaggaagcagggcaaggccggtgagcgcgctgcgaggggcgggggctgaagaggcccaggacttgggaacctcagaggggagggatggtgggcggggggtgtttcacagtctgaaggcttgaagggaggctcaggtgaaaaggatgggtgggtgtaatcctccaggggttgggggcaggtgtcacacattgaggactctagggtttggagccacatggaattcagtactcacttggagcttgaggatatcgaaagatgggatatctttcatttaaaggaagacgtagctgagagtatgatcatcttcacaatctatttttcatattgcaccccttgttagcatttgttgaataaataagcaagtatgtattgacgttaaaggagttcctcagagcatggctgagagaaaagaggttggggaaacctcagggaaacttgtctgcgtcttccttttgccgctcttccaggtctgcaaatgaagagtccagaaaagaagcgaaggaagtcaaatactcaggtgaatggtggttggtggtgggtttggttcccagcagccccttggcggcacactgtctactctgccattccagtatctgtttgtatcttgtatcagctgcagggaggagagagaaaactgtctttcttgctttgcttcttgttctttcgctgaaccttataacaagtttaggggaaagtatcctctcctaagagatgattcgaccaaagttcttaccacgcagggttccagtctcctccatgtttcctgtcctggtttcctcctgatgataacgtaacacc

SEQ ID NO: 56309 - DNA, 1499 bp, Homo sapiens
ccatgtttaaactttgtgcctttgaccatctcttaggtctaatgatattttatgcaaacagttcttggacccctgaattcaatgacagggatgccaacaccttcttggcttctgggacctgtgttcttgctgagcaccctctccggtttgggttgggataacagaggcaggagtggcagctgtcccctctccctggggatatgcaacccttagagattgccccagagccccactcccggccaggcgggagatggacccctcccttgctcagtgcctcctggccggggcccctcaccccaaggggtctgtatatacatttcataaggcctgccctcccatgttgcatgcctatgtactctacgccaaagtgcagcccttcctcctgaagcctctgccctgcctccctttctgggagggcggggtgggggtgactgaatttgggcctcttgtacagttaactctcccaggtggattttgtggaggtgagaaaaggggcattgagactataaagcagtagacaatccccacataccatctgtagagttggaactgcattcttttaaagttttatatgcatatattttagggctgtagacttactttcctattttcttttccattgcttattcttgagcacaaaatgataatcaattattacatttatacatcacctttttgacttttccaagcccttttacagctcttggcattttcctcgcctaggcctgtgaggtaactgggatcgcaccttttataccagagacctgaggcagatgaaatttatttccatctaggactagaaaaacttgggtctcttaccgcgagactgagaggcagaagtcagcccgaatgcctgtcagtttcatggaggggaaacgcaaaacctgcagttcctgagtaccttctacaggcccggcccagcctaggcccggggtggccacaccacagcaagccggccccccctcttttggccttgtggataagggagagttgaccgttttcatcctggcctccttttgctgtttggatgtttccacgggtctcacttataccaaagggaaaactcttcattaaagtccgtatttcttctacctctgcctcttaacccttctgggaagcctattgtgtacgccgcgggccctcagcggcagacggggaggcgggaggtcgcggccgcccagggaagctgggggtctgcagagtttgggtgcggcagagtggggcgtttcgcgccaccgtccccatggggatgtcgtgtccgcagagggggctggctccgggtgggtcgaggcgggagccgggcctgcccggcgccccagcaccggcccccgggctacctgggcctcccgggtgcgccttcggctcgcgcgcgcccctccgcggcggctccaccgcccgggatggtacggtccggcagccgggccgcgcgctgccgcccctcggtgagctggtgtgggccgccgctagcggagacgaccctttccactcgcgtggtgccg

SEQ ID NO: 56310 - DNA, 1141 bp, Homo sapiens
tcccctccaaactctctccccagtgtgtgaggtccttctagcctgccttttctttttctcctcattccctgttgtctttcaccttggttgtgggatgtagccacgggaagtgggcagaacttcttcctctttacttcccttagggaccatatgggtaaagtcctagggccctttgtgaaggggctggggtgggggagccgctgacctgctgtcctcttctccctccccttagtacatgggttgtgtggaggtcctccagtcaatgcgtgccctggacttcaacacccggactcaggtcaccaggttagtggggagggagtggattgtgggagtcctgggattagtgaggccatgggaaacagaggaggggagtgggtcacttgggtgctgctgctgggggctgatctttgcgtagtaaaggggattgagagaaagctgaggtagtgattccgcctcttactgaaaggaggcccctttggcccggatcctccttacctatccagccttgggagttgtggggaaggtggcagaagcagctggcaggtggagctggagtagaaaaggggggtagatggaaggttgctgctgcctttgggaagggaatgggacatttggtagctggaagggggtggggctatacccattgaggccctaacccaatcagccaggaagtggcctctcagtgtcatcaaatattaaaggcccttaattcaatccaccatgacaaagagcctggagtgccctgggagtctggcctggctttcccctcccccagccctgtggcagccccagttgagtgggaggcaggcaggcaggcgctgggtctgagtacccctctttccccagggaggccatcagtctggtgtgtgaggctgtgccgggtgctaagggggcgacaaggaggagaaaggtacttggggtccttggggatagggatgctgctgggaaatgtggaggggcagtggggaggcaagtgtggggcatgtggggagagggccaggaggcaaaagtgtggtttgcctgtgctgggaaccctcaccttctgagaccctgggccctaccttagccctgtagccgcccgctcagctctatcctggggaggagtaacctgaaatttgctggaatgccaatcactctcacc

SEQ ID NO: 56311 - DNA, 1109 bp, Homo sapiens
acctctactttcaagcctccgattggcttagatttacttctcttcggatccttattggagggcagttctcacgcttctcaagaacgagcgtgggtcaaaagtaggcgtcttattggccaccactgcctttgtgcgcgatctcgcgctgccattggctaactcgggaaagtgggaagcgtgaaggagggaccctgaggtagagggtcaggggttagtgaggccggaagtgagtgtaataaagtttctccagggaggcagggcccggggagaaagttggagcggtaacctaagctggcagtggcgtgatccggcaccaaatcggcccgcggtgcggtgcggagactccatgaggccctggtgagtcttgacttttttctccttaggtgactcactctttcaccccggaacccctctcccgggaccccacttccggtcttcatttataagtcccgcccctgagacccctctccccggaagtcccacctcccaacttcagggggctcccccgaaccccgacttgatttttattttttgtctccgaccccaccctgtcgcccagtttttctggaagtccccaccccccgacacgttccaagccctactacgagaaacccttcgttactccttccattctccgaaactccgcctcctagcaacgatcctcggctaactcctgtcaaaaggcctatctcccaaaagggcaaaaccctgctcttcaaagaacgattcgaatttgttgaagctccgcccctccgaagccacgccccctccgtaatccacgtctgactgtccagaaagcctccccgcccagaagtctgaagttcgcgtccttaggggaccacgcccccttaggagctttatctttgtgggacctgggtcatcagctgaaaagccttgtcgtcaatccctgaaactccacctgcttatattttcctgtcctttctctttttgggccttgggatcagttttccgagcactctcgtgctcccccaggtgggaagtcaaagttcccatctctggctgtaaggagtgagattaaaggcagccgttttccgttttcctttctatcttttttttttttttttttttttttaagacggagtttcgct

SEQ ID NO: 56312 - DNA, 1116 bp, Homo sapiens
gttccggggtgaaagagtgagtcacctaaggagaaaaaagtcaagactcaccagggcctcatggagtctccgcaccgcaccgcgggccgatttggtgccggatcacgccactgccagcttaggttaccgctccaactttctccccgggccctgcctccctggagaaactttattacactcacttccggcctcactaacccctgaccctctacctcagggtccctccttcacgcttcccactttcccgagttagccaatggcagcgcgagatcgcgcacaaaggcagtggtggccaataagacgcctacttttgacccacgctcgttcttgagaagcgtgagaactgccctccaataaggatccgaagagaagtaaatctaagccaatcggaggcttgaaagtagaggtgtcccgcctcgagccaaacggaccaataggaagtgcgggcggcgtgtttgaaagcgaggccaaagtgggtgggagcgcgtgctgttgggagttgcttggaggttggcggcgcggggctgaaggctagcaaaccgagcgatcatgtcgcacaaacaaatttactattcggacaaatacgacgacgaggagtttgagtatcggttagtgctggcgcgggagcaatagcgagggtcgtgagctttggccgctgagggcacaaggaattagtaacaggaactgaggcgatagaattggcgcatgcgtacgaggtgcgaacgggcaatggtgtgatattgtggaaggcgtaaggcgcatgcgcggaggtgggaggcgctcgtaaaacaaagtggttgcgaatttggagtcgcctctcagtagagaggagagaggggtgggcgtggttagggtactgaccaccctcacccatgaggctttctggatcattctctgaactttatcgggcaaacttaacttgccttgtagagactgtttcacagtaatcttgtcgaatccagtgggagaacgtagcaaaagcggagctggaagtttcctggcgtccctaacaggagagtagcgctgagagagttgaatattgcttattaactcgtgaaaaagacaaggggcgtggttgtctggcttgtgtaaggaaggggatcgcttgggactgca

SEQ ID NO: 56313 - DNA, 1588 bp, Homo sapiens
attatatgatccatgaaccaggtcagtgcactggctaaaaacaaccatatagaactgctacactgagagaatgaaagaataagattgtataacccaaatagggagataggaaatggtttactggttccttccccctccagtcgtgggggatttttttaaaaaaaaactagtgaccaaaaataagactaaaatatctgggaagttcagagacaacctgtcactgaaaaacctcctgtaatctttcattcaatcagagggtattctttttaaggccacatatagcctgatcatagcccctgcctcattctccatcgaaaacattcttggatgtgttctaaataagcaaaggaaagtatatttattgataagacaccagacacccagctgccaggcaaaactaataagggacaccctggggctgtataaacatagcaaaagaactgatattaacaattctgtacttggcagacagtccagacttctgggtctgcttctaaggccatatgcttaagtctttatttagttataaagatctgagtgggtgatagctggggaggtggtagtggaatacactataggttgtacatagaatggtgtgagcttgtctcttagatttccctcactctttcagaacctcacatcttgctgttccggcgcccactacccaagaaaccaaagaaatgaagctggcaagctacttttcagcctcaagctttacacagctgtccttacttcctaacatctttctgataacattattatgttgccttcttgtttctcactttgatatttaaaagatgttcaatacactgtttgaatgtgctggtaactgctttgcttcttgagtagagccaccaccaccatagcccagccagatgagtgctctgtggacccacagcctaagctgagtgtgaccccagaagccacgatgtgctctgtatccagaacacacttggcagatggaggaagcatctgagtttgagaccatggctgttacagggatcatgtaaacttgctgtttttgttttttcctgccgggtgttgtatgtgtggtgacttgcggatttatgtttcagtgtactggaaactttccattttattcaagaaatctgttcatgttaaaagccttgattaaagaggaagtttttataatctagtgctgtaattgtacgggttttttccccctcactcagggtgagcatcatcaatatcatggttctaattatatgcccttcagtttgataatgaagctcagctctttgctgataatgaggtttaacattgagataactggtttttaatctactttaagcagacttgctgtcaaacatctactgaaatatatttcactctaactactagcctgaggtagaggttatatagggacaacttcatctcatccaaacaaatgaactgcttcctacagtcggggtgctgcctttaacatagtcccaatatttgaatggcacacatggataaaaggatgctgtcagtcaggggctgcttgtgtgtcccaattcctaataggaataataggcatatctatgacctattcactgtgccccttggttggggaaggttttcagct

SEQ ID NO: 56314 - DNA, 1095 bp, Homo sapiens
ttaagatgggcacagggtgggagggcttccagcggaccctgaaggaagtcgcctacatcctcctctgctgctggtgtatcaaggaactgctggattaatggtagcagggaactgcctcctctccccaccagcaccatggctggcatcgctcaggtgggcagggtagagtaaacaggaggcatagctgcagcttctgtggcagagcttgccttagcttctcattctcttctttagcccccagcccaattgccatcaagactcctgaagccagctgtgcttgaccaaggatgggccataaacaatgagtaaacagtaaagtgtggatcctgctttgagctgtgtcatctagcagacctgcctcatctctgagcctccttcattcccaacccctgcctctggtggacctctggtgggcaggagcttggactgctctggctaggaccccagtaagattgtggcaagacctggcactcctccaagcttggcacagtgagcccaccagctcagatggttgatcttaccataccctcatagtaccaagaatggactgccccctaagaaacctgtttgagaatcactgaattataaatataatccataggccttgaggcccaagattataagtgtctaaaggggaatcagaaaaagtcagcactagaacggtctgggagcaagggtgcagaccagggagggaaggagcttgtcctgaatagaaccaagattgaaagccaggttttctgactcactggttcctgagtggggagggtggaagacagttcaggttcctctcaatctgtgggtaaggaggggacccagcttgagtagggtcttcatctgtgaggccaagggtgtgtggaaacccagaggacccagccctttcccaaatagaagacctggtccaggcagcttcctgcctctgaggatcttggggaaagcactgcgctgaggctagtccccagctcatcaaggaagtaggaccccatgagctacaagagctcccagctcacatacaaagttaccagagaaagacacctgtgtggccacacaggtccctcaggcttatcatgacacagccctatcaggacataaacagct

SEQ ID NO: 56315 - DNA, 1051 bp, Homo sapiens
cacgggaccccctccctcaagaccctaagtccccaattcacccccacccagcctatccctaacctctcatacccttccctcctgaggtcctgaccctacagaagcccctcttgaaggagagggagcccctgtagggggtgctcgattccctggccgctgcggacactgccccctcccccctcctctccaggttccaggccagcccctcggctccgccccctccctggacgaacgcaaggcgagacctactggagatgagcgggtattcaggccaatgagcggacagggcggtggcgtgcagggggcgggcagagcagcagcaaagggctggatgggggccgggggcggagtttgagttaaggtggactgggagagataggggcaggagaaaggggggggagagagggaccgcggcaggtgaagggagacagagagaaggaaagaaggagggaaaggaggagggtgggaaaggctaggagagctaagtaagagtttggagaagggggcaaaaaaggagggagggacccatctgcgctctgcagggactggctggacgaaggggttgaagtttatgtccttattgggcggagggagggggcctgggggggcgggtgaaaaaccaggaagtgacagagggtgtttctaagtgttggggggggggagtttggggggtggcaggggcggggggagggaggggagggatggggggaaagcaagctggaggacaggtgagacagcaggacaggtgaggcgggccctgaggggggggcgggtgggagccaggtgaatgtacggctcttggcggccgagggggggcgggcggcaggaggaggcagagggcggcggaggaggagccccccagcagcgagcggcgagcaactgaccgcggccttctgaccaggaccggagcagggccccaagcccccgggcctggtgggggacgcgcttcttcccacactgtgagcctcagcagctccagccagcggacccgacggctgagaggtgagtgtaccccacttttgtctcctggctcggggttcactaggctcga

SEQ ID NO: 56316 - DNA, 1077 bp, Homo sapiens
tgtccccaactctccagctctccaattctcccaaacccccagtctccagccttccaatacccaattcttgaatactcttgtcttcgaaacttctgagctactcaaggccaaagcccccaaatttcctagatattctagttcagctgtccagagtactgaccactcaggtattaggaaatgtgtatagagcatgtcctaatgactcaggggctctcctggcatttaacaccaggaccagggcacgttctgcaatgtttgggaatagttctgcaaaaaatgccagtagtatccccattgggaaactgtaaatccagggtgacaactcccagctcaagttaacttggccccagggagagggaccccccaggctctgcctgtgcagattcctgaccagcaggtccttgaacatggcccgtaagggggctgtggagatgcgccaagctgcgcgggtgttgttgatctgcagctccacggtgcagcccagcgatgcgatcacgttgttgagattgtgtcgcagattggctactggccctggagaaagaggccctggttggtcacctccctgtataaccagcactttctcaaacccgctcagcttccctctgcaaatagtgcccatcgcctagaactatacagtggtggggccgagagcctatgaaaggtcaacttgttcaacctttgatttttttcactgtttttttttttttttttttgagacggagtctccctctgttgcccaggctggagtgcagtggctcgatctctgctcattgcaacctccgcctcccgggctcaagcgattctcctgcctcagcctcctgagcagctgggattacaggcacacgccaccatgtctggctaattttttggtatttttagtagagacggggtttcagcatgttggtcaggctggtgtcgaactcctgacttcgtgatccgcccgcttcggcctcccacagttctgggattacaggtgagccaccgtgcctggccttttttttttttttttttttttttttttttttgagacggagtcttgctctgtcacccaggctggagtgcaatggcgcaatctcg

SEQ ID NO: 56317 - DNA, 1066 bp, Homo sapiens
acacatactgtgtgtgcccggccctgtgctaggttgcaggggattaactatatagatgagaagatcaagaccctgccctctgggattccacagactctctggagaacaggcgcaggcaggagagcctgcataaagacaggtcattacaataccaataacaagtgataagagcttttgttgtccttggactctgaattctctatctctgtcacagaccaaagcttctgaatcacttggaggacctgttaaaaattcaggtttctcaccccccaatcttaaggtttctggctcattcattcaatccacaaatatttattgaacactgtcctgtgctgggcacttttccaggcacgggggatgcagtagaacaaaacttaccaaggccctgtccttgctcagcttgcgttctagtaagtctgggctggctgagcccaggaatcttcatttctaatcagaactgatacaggtcgtccttggaccacccactggaggcttttcctaagtcatgcttcgctgtgtttgtggtatggggggtggttcatgcagcattcagtactgtggggagcagccccttccagcccttcccacctgtgctggcttccccaggcagctcccaagaggtggggaagggagtcctgagaagactgaagactgggtagtatgtggactccccccatgcctggcacttgctcctcctggccaaaaaagggaggcacctagcacccactccctcattctttttttttttttttttttaatttttagaatttagagacagggtcttgctctgtcacccaggctgtagtgcggtggcataatagctcactacaggaacttgcggactctaaggatcctcccgcctcagcctcccaagtagctgggactacaggagtgcaccaccactcatggcctttatttatttatttatttatttatttatttatttatttatttattttttgagatggagtctcgctctgtctcccaggctggagtgcagtggcgcaatctcggctcactgcaagctccgcctcccgggttcacgccattctcctgcctcaacctc

SEQ ID NO: 56318 - DNA, 1044 bp, Homo sapiens
ccctttttcttcttcccttttattagttccttctttcctttttcattcactcagcacattgtgagcttccagcgcgcctttctttcagtaggccagacgctagctggggtcgtcgggggatccccagcggtgacgccattgaaaagggtgcgctctggcttccaaatagccaatagaatcccggggcctggggcatgaggtcatcagcggtgatgcccattggttcaggtctggaagtgaggaaggggtccccatagcaaccgacggtgcgtccgagtgcaacctggagagtaatgtttgcctgagctgctgtggcagcttgggtgggtgcttgggatggggtgaggaagctggggtggagctcagcttcccaggtcctgcagccctagcccaagcaagctcttatctctcttgagatcctttttcgttctcaaagtaatggtcagcaccacttaacgcagaaagattaggagtaggttggttattggcaacagcattggggtgcagagctgctgccaccaggaatgtcagtactgagatcctgtgttcatctgcatatcgtctgcatctcatttgcattctcttcatttaaggtcaaattgggcagacatctccacatccccagccctgtcgcctgtctgtttctggaatctatccctgagtggctctgtaatctgtccctcagttctccaccttcataccccacctctcccattctccagtgtctgttggggacggatggggcaaagccagcaacagaagaaaggataaggagtttgttctcccgctggatgtttggtgacagatggggagtactagtctatactgcttggccccggctgggtggagggtctccagggccaaatcacccacatgcctggcggggtgctggaactagggatgcctggttccagcaaggggcaggcctgcccacctgtctggtgccaaggcagcttccttcctccaattaaacactaatgaggtgtcattaacccttaccttgcctgccaaccctcaggttgaactcaaattcgtggtctcaca

SEQ ID NO: 56319 - DNA, 1021 bp, Homo sapiens
aaggcatgcgaggtgagcaggcaccggggcggggggctgcggttccagcagtggccaccagagggcgctgcgcagactcacccagcacgttgatcttcacattggggcccatggtgaactgggggagagtggggaccggcttctccccggagtgcgatgctgcggggtggggtgcgggtggggagagaggaggggagagtcagggccaggattccctccccttgctacggctggggagcaagcccccctcacctgtgccctccgcccccacccccaggaagccaggggagccccaaagcagggagctgaggatgggggcgcggctcggagcctattctactcactggaggcgcagcagacgaacaccttcatcctcagacacttccagtgcaggttgtgagtgggcgtggctggggaggagaccgggcctgagtcactttcgcccaatgtgtgcctgtgccctccctcgacggctctatttctcaccccctccaaactgtccccgtcgggcggtctccttcaggagctcccctaccctttggacacgggtcactttagctctgccgtcggccctagacgcccctttggtcccacccctcaagaaactgggatccctgatgttccaaccccggaatgtccctcacagaaacagcgattctccgcagcccaaacttgggactgtcaccaaactcctctcttggccccacgacctcgtctgagctgaacccctcaggcgtcccgtgcccacgcctcctccctggtctcagccgcgagacctggcgcccgccgcgccggccccgccccggagcctaggggctccaccccccggctgtcactcagactctcgcgttcagacccgcccgcccggccgccgtcactcacagatgtagtagtactcgtggccggcgtggaactcgtagcccagagagaaggcgctgtagcgctggaacttctccgagaacttgatggggctgtgcggggcgtgcggccggttgcactcccagcgcttgaagccctggct

SEQ ID NO: 56320 - DNA, 1853 bp, Homo sapiens
agggcacaggtgaggggggcttgctccccagccgtagcaaggggagggaatcctggccctgactctcccctcctctctccccacccgcaccccaccccgcagcatcgcactccggggagaagccggtccccactctcccccagttcaccatgggccccaatgtgaagatcaacgtgctgggtgagtctgcgcagcgccctctggtggccactgctggaaccgcagccccccgccccggtgcctgctcacctcgcatgccttccctgggggcactgatacttcctaccctgtgggtggtcacgtccctggctccattgctgctgccgcgtgcccctgccctggcgcgcaacccagccctcaccagtctgtctgttcctctgtccacagaagactttgagggagagaaccctcaggtgcccaagcttgagaagagcatcagcgggaccagccccaaacgggaacacctgcccctggccgtgggcatcgccttcttcctcatgacgttcttggcctcctagctctgccccctcccctggggggggagagatggggcggggcttggaaggagcagggagcctttggcctctccaagggaagcctagtgggcctagacccctcctcccatggctagaagtggggcctgcaccatacatctgtgtccgccccctctaccccttccccccacgtagggcactgtagtggaccaagcacggggacagccatgggtcccgggcggccttgtggctctggtaatgtttggtaccaaacttgggggccaaaaagggcagtgctcaggactccctggcccctggtacctttccctgactcctggtgccctctccctttgtccccccagagagacatatgcccccagagagagcaaatcgaagcgtgggaggcacccccattgctctcctccaggggcagaacatggggaggggactagatgggcaaggggcagcactgcctgctgcttccttcccctgtttacagcaataagcacgtcctcctcccccactcccacttccaggattgtggtttggattgaaaccaagtttacaagtagacacccctgggggggcgggcagtggacaaggatggcaaggggtgggcattggggtgccaggcaggcatgtacagactctatatctctatatataatgtacagacagacagagtcccttccctctttaaccccctgacctttcttgacttccccttcagcttcagaccccttccccaccaggctaggccccccacacctgggggaccccctggcccctcttttgtcttctgtgaagacaggacctatgcaacgcacagacacttttggagaccgtaaaacaacaacgccccctcccttccagccctgagccgggaaccatctcccaggaccttgccctgctcaccctatgtggtcccacctatcctcctgggcctttttcaagtgctttggctgtgactttcatactctgctcttagtctaaaaaaaataaactggagataaaaataactgagtgtgtgtgatttcaaggggccatcacccttctgttacactggttaaacctcacagggcacagggcctgagtaggagagggaattctggggccaaagagtcacaacgaggtgttcaaatcttgttctggggctcatcttcattacaaaggcagcgctgcttggaaagagcaagaggggcctccaggcagggcctggttgactttgggcaaatcactcaacctctctgattctcaggtatcccaccagaaaaactggttgtggtatctctctcttagggttggtgtagggattaaatgacgcagggagttaaaggctccatcaattatggtttccac

SEQ ID NO: 56321 - DNA, 1027 bp, Homo sapiens
aattacagcatggaaggggaagaaaaggtggaaaccataattgatggagcctttaactccctgcgtcatttaatccctacaccaaccctaagagagagataccacaaccagtttttctggtgggatacctgagaatcagagaggttgagtgatttgcccaaagtcaaccaggccctgcctggaggcccctcttgctctttccaagcagcgctgcctttgtaatgaagatgagccccagaacaagatttgaacacctcgttgtgactctttggccccagaattccctctcctactcaggccctgtgccctgtgaggtttaaccagtgtaacagaagggtgatggccccttgaaatcacacacactcagttatttttatctccagtttattttttttagactaagagcagagtatgaaagtcacagccaaagcacttgaaaaaggcccaggaggataggtgggaccacatagggtgagcagggcaaggtcctgggagatggttcccggctcagggctggaagggagggggcgttgttgttttacggtctccaaaagtgtctgtgcgttgcataggtcctgtcttcacagaagacaaaagaggggccagggggtcccccaggtgtggggggcctagcctggtggggaaggggtctgaagctgaaggggaagtcaagaaaggtcagggggttaaagagggaagggactctgtctgtctgtacattatatatagagatatagagtctgtacatgcctgcctggcaccccaatgcccaccccttgccatccttgtccactgcccgcccccccaggggtgtctacttgtaaacttggtttcaatccaaaccacaatcctggaagtgggagtgggggaggaggacgtgcttattgctgtaaacaggggaaggaagcagcaggcagtgctgccccttgcccatctagtcccctccccatgttctgcccctggaggagagcaatgggggtgcctcccacgcttcgatttgctctctctgggggcatatgtctctctg

SEQ ID NO: 56322 - DNA, 1172 bp, Homo sapiens
ttttgggccggcgccgcccgacaccccgccccgccctcgccccgcccggcgcgcggctgcctgggggcttgggggctggggaggtggaggaggggcggggtggggaggcgaggaggctgggggtgcaggaaagagcgaagcgcgctcctctgcccccgcagatctgctcagagatgtgtgttcgctcacttgtgggtctgcgtggagctttgtgagcctgtcccggtggtgggcttgcgtccctgggcgcagtcgcgtgcgggagaagggaagaactcgcaagtgcgagtctgcgaacgcgggggtgcgggacacggctttgctgctccgcgcgcggaccttgcagggtgcgaggttgttgacatgccccgcacctttctgagcctcgcatgcccaggctcgggcgcccgcgttcccacactctcctcctcccccatccccttcccggactctgcgcttgactgcccctccccacacacacgcggctgtttgtttttgttgggtttgtcaatgttgtctttgttctggagattgtgtcatcgcctagatgccgggaataaagtgcaacgctttgtgtgatcgagtgtgtaacgtgtgcggccggggctaaggacgcctctgtccatcacatcagtgcctgcccgcaggagcgacacgcgggaccctgggctcgagagggggccgttcttattttagataagtcaaagagcgctaataacctgagtatatgtaacaacacacgcgtacaccgtgcgaacaggctcttgaatatggactgtgagaatctgggcatgaagggtgacaaactgtaaccacacatgaaatacgtgtgatggcgcgctagcatgaaagcatttgtgagtagtatcacagccgcgtgtgtggaagcgtgtgaaactctttgacagacgtatgctaatgtttgtgaacagcgtgtgaagaggaggggagacgcgtaccggcgtgcagcgggggtggggtggaacggaggggcgtttgtgcgcagtcctcaggctgcacagctggagctggcccagtctgagctggggctcccagtcagtcgggccccagtacccggctcaggccccctcccccgcgctgtgtaaacaaacccactggaatttgcctctcggggctcttctccccgcctggatctgctgccgtctggagag

SEQ ID NO: 56323 - DNA, 1021 bp, Homo sapiens
aaggggatgggggaggaggagagtgtgggaacgcgggcgcccgagcctgggcatgcgaggctcagaaaggtgcggggcatgtcaacaacctcgcaccctgcaaggtccgcgcgcggagcagcaaagccgtgtcccgcacccccgcgttcgcagactcgcacttgcgagttcttcccttctcccgcacgcgactgcgcccagggacgcaagcccaccaccgggacaggctcacaaagctccacgcagacccacaagtgagcgaacacacatctctgagcagatctgcgggggcagaggagcgcgcttcgctctttcctgcacccccagcctcctcgcctccccaccccgcccctcctccacctccccagcccccaagcccccaggcagccgcgcgccgggcggggcgagggcggggcggggtgtcgggcggcgccggcccaaaaggcggagtcgctaggcgaaggggccagatctgtgagcccagcgctgactgcgccgcggagaaagccagtgggaacccagacccataggagacccgcgtccccgctcggcctggccaggccccgcgctatggagttcctctgggcccctctcttgggtctgtgctgcagtctggccgctgctgatcgccacaccgtcttctggaacagttcaaatcccaagtaagcctcgagactcccgctggcagcctgggctcccggctggcactaccccaccgggataactgtcccggccaaaccctgagctgagcctagagtagatgaccgaggtaggagggcggctgtagattttcctcccctcacttctccgtcatatctgggagcaccccaccccggggcatgcttgtgtctacttgcatgggcttatatctgcccttcccttccttctctctggcacccctattactctaaagtgagggactcatgctgggcagttcctgccttcagcatagacttcgcccctggcagccagggcccttgttccaggccccccacccccccactgtgaaagcctccacgcc

SEQ ID NO: 56324 - DNA, 1338 bp, Homo sapiens
tttgtttggaggtccaccgccgaaggcgcacaggcctgtgggaacacgagcgttgagactgggggcgtctagatgatccaaggggtaggcagagtgtgagcagcggcaggtatcggggacacacccgcggagccctaggaaggggactgaccgggacatggaagaggtctggaccagggtactgggaaggcgctcggaggagaggggcgcgagttccggttcggcgtcggagggagggtggggcttcggcgcagtttccggagggacggcccgagcgtgcgggggcggagccgagtgcgcggggcggggctccagagccgcaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctgtgagagtgcggccgggctgggttggggaggactaggcagtcaggaaaggagagagaggggacagagacgtggccacagcacctggctcgtccggaaccgggatcaaagtgggatcgggtcgaggggaccggggtacaagggcgaggctggtcactaggcctgaaggagaaggcaggatagctggcgggggggagagggggcggggtctgcggtggtccggaaaggatgacaggcattgggcatccccctctagcactctgcttctcccttcccacccccacccctcccttcggggccccattacagctcggacctcaggcacatgcgaatgacccggagtgtggacaacgtccagttcctgccctttctcaccacggaagtcaagtgaggggccgacggctgcggtagtgggaaaggctaccagagggaggtgggggcggggcaggaggagcaagagtgaaagaggtttggccgggcgcggtggctcacgcctgtaatccctgcactttgggaggccgagacgggcggatcacgaggtcaggagatccagaccatcctggctaacacggtgaaaccccgtctctactaaaaatacaaaaaattagccgggcgtggtgccgggcgcctgtagtcccagctactcgggaggctgaggcaggagaatggcgtgaacccaggaggcggagcttgcagtgagccgagatcgtgccaccgcactccagcctgggcgacagagcgagactacgtctcaaaaaaaaaaaaagagtgaaagaccctttgggtcctcctctcacactgaaccctttgagccatgtccatcccctccaccctgcagcaacctgggctggctgagttatggg

SEQ ID NO: 56325 - DNA, 1050 bp, Homo sapiens
tggggtagaggtaagtgtaggttgaaggctgaatggggagggcgagagatggggagtgggtctcaaatatagagggggtagcaaggtggaaggggcccttccaccttttgtgggcactcaagttcggacctctgggatcggcgattcccctctggccagggctggttttaatgctctccgtgggcgggcttcggttgagtttggtccgcttttcctttctgctcctcaggggagcattgcttccttctctcgcagtgaccatgacgaaattagcgcagtggctttggggactagcgatcctgggctccacctgggtggccctgaccacgggagccttgggcctggagctgcccttgtcctgccaggaagtcctgtggccactgcccgcctacttgctggtgtccgccggctgctatgccctgggcactgtgggctatcgtgtggccacttttcatgactgcgaggacgccgcacgcgagctgcagagccagatacaggaggcccgagccgacttagcccgcagggggctgcgcttctgacagcctaaccccattcctgtgcggacagcccttcctcccatttcccattaaagagccagtttattttctaacttcgtttagtttgagtatggaaaacgggtattggggattctatgtactaacggtcgagaagtgaatgtgaaagaaccaccttcttgaggccatctcagcctttatctttgcatcttgctggtgttcccatttttgctcccaaggaggcaaagaccccttctcaatatttctcaggatggaaatgacatttcactttcctggtcctttcaaccctgtaggaagtacttctttttttttttttttgagacggagccttgctctgtcgtccaggctggagtgcagtggcgtgatctcggctcactgcaagctccgcctcccgggttcacgccattctcctgcctcagcctcctgagtagctgggactacaggcgcctgccaccacgcctggctaattttttgtatttttagtagagtcggggtttcaccgtgttggccagga

SEQ ID NO: 56326 - DNA, 1324 bp, Homo sapiens
gcccaggctggagtgcagtggtgcgatcacagttcactgcaactttgaacttcctggctcaagggttcctccaacttcagcctcctgaatagctgggactacaggcatgtgtaccactgtactacctggctaaattttttttaattcaattttttttttttttaagagatgggtctcactttgttgttcaggctggtctcaaactcctgggctcaagtgatctgcccacctcagcctcccgaagtgctgggattccaggtgcaagccaccacactcaacctcctacctccatgttctgggtatcattaaggtaatcagaatcctcctgctgtagtcacgcttacccttctaagcaggttccccaggattcagagagccccggatttctcctggactccatgtgcagatgcctagtatttccattctgaccgttgccctccttgttcttcttgcctccctagttctcctgtgcctcctgttggctctctttgcatctggcctcatccaccgagtctgtgtcaccacctggtatgttcttgacagctgggtaaggggtgtagcattccgttttttggcattggatcttactgtgatggtgccagagtttttccttccacacctacctctctctctgttctccctccccgttttcctaaacttgaacttggattctttccttgatgctagtgtcttccctaggaggcaccaggctggcagatgcccactggtgccatgacctttctgtcttcaccatatagcttcatcttctccatggttggtctgtactacatcaacaagatctcctccaccctgtaccaggcagcagctccagtcctcacaccagccaaggtcacaggcaagagcaagaagagaaactgaccctgaatgttcaataaagttgattctttgtagctctgtgagttgtgatatgttgtgggtgtcatctaccagtatccagcttagatgtacagaatgttaagacatttgggcaccttctgttttcagaccttgggaatagtgaggctttccttcctcccacattaatttttaccagttatctgttgaatactgtcagtgccactggagtggcatatacttgtgtgagtctcatcatggaagaaaagtacatgaatgttctgcagtcgtgttctttggggaaaggggtaaaggctgcaatgcaggaagtcctgtccgtcagtaccagaagggatcttggagcaaaagagtaaaggaaggaaaggtcccgtatacctacactgtttcacggggttccacgtggtatctttgccactccagctccctgccttaagcaaatcagccccct

SEQ ID NO: 56327 - DNA, 1681 bp, Homo sapiens
ggggaatatggaaaggtatttgacgggggagccatttcttacattctcatttttcattggctcctaattttactcatataaagcgggggattagtttcggaggaaaatgagttcctggttgggagcactaaattttaggttgggagatgttgaggcatggggcagggaggtttgaggaacgtgcactagagatgaaagaaatggcaaagaagacagagatgggatagatgccacaggcatgggcccaatgacttaaagagataagtgcaccttgtacagagtggcagcagacgcaccaggtacgaggaaagcctgaggaccagggcggtggccgaggatgccccctcgacgcattatttcctccctgtcgcaagagggcgctgcgtccaggcactgagaggaagaaagaggagaacgcgaggagtagcaagtccgcggtaagcgctgacgcatgcgcatagctaaccgcacccggttcagctcgcctttcttggccagaggcgccggttggactcacgggcggggcatgatgggtaacaggaccggtggggtccccaggaagtcctagagggggtcggggtttgggtggacaagctttcctcgtcctctcccgacagagctgacgtgtcctgggttccaccgggagcgggcatttccaccggacgggagggttcggggtgtccggggctggggaatacgtaggggttgccgcgcggtgtggggagttggggcgtgtggctgcagtcccgggagttcttggagggggtcggcccaccgagcttccggaccggctgatctgcccgtagcttgccggagggagggcggagcctgactctccgtcccttctcccatcccctccagtggtgggtacgggcacctcgctggcgctctcctccctcctgtccctgctgctctttgctgggatgcagatgtacagccgtcagctggcctccaccgagtggctcaccatccagggcggcctgcttggttcgggtctcttcgtgttctcgctcactgtatcctccctgcagttggagggggcgggccacgtaggcatgtgcccttccccttccccacacagctctgtccccgttgcacaccctactccttaactccctcaaccaggccttcaataatctggagaatcttgtctttggcaaaggattccaagcaaagatcttccctgagagtaagtgaatattggagcttgagtatttgaactttctcctctttaacctcctgaaacatgatattgaatttccagatgcttaggtgaaaggttgttaaggagaaatatatttactgaagctgtctgaagacagatgacgcttttcgattctgcaccttgtatagctcctggagttggagctggaagagaaggcctttgaaagcaagaaactttggtaccttctggccagctcccagggaaggtttgaggggaacaggcaaatttgggctgatgttttgcatctattcgctgggaggcggtccttgttcccaccagaagaagcagcaggaccaagttcactatggagttctgatgtgaagttaactcaatattagagaattctacttatttgagggaattgtgaagagcctaaatactagaggcaccaaatatctatggcagcaggaatcctgaccaaatcagaataactgttagattatttcctgtttggaa

SEQ ID NO: 56328 - DNA, 1027 bp, Homo sapiens
atgtgccaagtctcccttggggacccagctgagtctgggtgttcccattgggttgggccaggcaaggcctctggtgcccgctgccgtccccctgcagtgggctctgctaggcctgtgctgagcaacagctgttattgtcatggtttataaacaataaactgtgatgccaggcacatctctgccttccctgagcgcaatcattcctgtgagtttctgtgctgggtgtggtaggcgggagggagcagggtgctaggctgtggttctaggcaggagcaaccaatggatctggtgcctgagagaggaaggccccaggccaggtgctctaagcctcctgccacacgtgtcctggcccggcctgagcgcatcacagctgccaggggacatagctctctggctgctggtggcaggccccaatcagggcttccaggcctgcagcacaggccctgggggaatgcggtcaagggacaggcaacgtgcctgggcccaaaggggtcagggaaccagaaccacttccccattcccagggtgttgtggagcccaccccaggggcagcaggctggtggggcagccggggtcagggagggggctgggcctggtgccagcgcccggatctgacccagcctctgcttatctcaaccctgttgactctgggctgttatcactgcccaaggatttacttcacacccggacagctaagaatagagccacctggggggcaccatgccagggggcaaggagggcgtgggccaggcgaggagaggggagagccactggcacacagagctcagtcacggagcccagtcacgctagccctccaaagcccgcctgggtttcgtttcctccttcctcttgtgctgccagggttagccagaggtggctcctcaggccacccctactccccaatgtcacctcctcctcacatctcctgcttctcaaacaaactcgctccttactgcctcctggcctccctgtctcctcccccagccccctcacacacattctgaccgccctgctgcccacgggtcac

SEQ ID NO: 56329 - DNA, 1091 bp, Homo sapiens
gctgggggggcggtggagcccggggccggcctggtgtccggggccgaggtgacaccgtgggctgggggggcggtggagcccggggccggcctggtgtccggggccgaggtgacaccgtgggctgggggggcggtggagcccggggccggcctggtgtccggggccgaggtgacaccgtgggctgggggggcggtggagcccggggccggcctggtgtccggggccgaggtgacaccgtgggctgggggggcggtggagcccggggccggcctggtgtccggggccgaggtgacaccgtgggctgggggggcggtggagcccggggccggcctggtgtccggggccgaggtgacaccgtgggtggagcccggggccggcctggtgtccggggccgaggtgacaccgtgggcttggggggcggtggagcccggggccggcctggtgtccggggccgaggtgacaccgtgggctgggggggcggtggagcccggggctggcttgttgtccggggctgaggtgacatcgtgggctggcggggtggtggagcccagggctggcctggtgactgggaccgaggtgacatcctgtccccaggtggcagctgaacctgaagctggttccgtggccggggccagagtgacatcctgtccctgagtggtggaggagcctgaaccggggctgtggctggagagtacgctgctggtcatactcacagcattcttctcagtagagctgggcactgaacttctctgggtagccgaagtctccttttctccacctggggtagagcttgcatgaccagaacccgtaacaactgttgcgggtttaggggctgtggtagctgtaagaagttaaagtcatagggttgggtctttatgaaggaaaaataagagcaagaagaaaatataagctctggccaccagagaaataataccaggaggactggggagtgggcagcctcagtaacccctgggttggccgcctccttccctgcagcagcctccttctctctgcccataggccttggctcatggcccctgcatttcttcccctcttaagccttccctctccctactctcttccccctagac

SEQ ID NO: 56330 - DNA, 1021 bp, Homo sapiens
aggggccccaggcctgagaaaagcaccccccttccctctccttcctgcctccctttccctccctcccttctctctcaggcctggtgagctcaaggggggctggggaaaagcaaggccccaggcatggtggcacagtgcccactggcaccctagcaccaatggatactcctatcctggaatcctggacagggtgaagctctatgagggaccccagcttgtggcggattctggggtgatcattgacacatccatgcgaggggggcgtcttggtgtattctgcttctcccaagaaaacataatttggtccaatctccagtatcgatgcaatggtgaggtggctgattgagatcaacctaatccttcatgccttgtgggagagccacatcctctgaccttacttatttccccttcttcagacacagtgcctgaggactttgagccattccggaggcagctgctccagggaagggtgtgaggaggaggccaccagattcagaattcagaattttagaccctttggccttggggtccatcctggagaccctgaggtctaagctacagcccctcagccaaccacagacccttctctggctcccaaaaggagttcagtcccagaggggtggtcaccccacccttcaggggatgagaagttttcaaggggtattactcaggcactaaccccaggaaagatgacagcacattgccataaagttttggttgttttctaagccagtgcaactgcttattttagggattttccgggatagggtggggaagtggaaggaatcggcgagtagaagagaaagcctgggagggtggaagttagggatctaggggaagtttggctgatttggggatgcgggtgggggaggtgctggatggagttaagtgaaggatagggtgcctgagggaggatgcccgaagtcctcccagacccacttactcacggtggcagcggcgacactccagtctatcaaagatccgccgggatggagagccaggagggcgggggctgccccgc

SEQ ID NO: 56331 - DNA, 1105 bp, Homo sapiens
cagagcaagactccgtctcagaaagacaaaaaaaagaaagaccttgcgtctcttgaccaagaccttacctgtcttcattagtatcacagacatcccccaccaggtcgctgtctgcatctgtctgagagagagggacctgttctcaccatctcctcttgataactctgaagagggtgatctgaccactttccatccaaagggctggggcttcatccatcagtaccctcatccctcccctgtccttaccatctccctgtacctgggtaggattgctcatttcagggcagctgtcgcaagcatctcccaccccgtcctcatccctgtctgtctgtagtgggttggggactttagggcaattgtccaatccattggggatgcctagaagacatgggtagcacaaggttgttactagaacatgccatattctctcttctaggttggtgaaagtcccgaactttgtctccccacccagaggacaactggccaggaaatctgcctgtttcttgtctcaccctctagtccacactctgcctaacactacgccctacctcacattcctattgacatctgctgcaggtaatctctcctcacccaggccaacgtccacaagcctgcctccctatttcacagagacttcctagcttccctgcttcatccccacctgatccaaattctcacaggtcccccagccaccccttcagccccaggcctgcaccatccccatccacgtcgttgtcacaggcatctccttccccattgccatctgtgtccttctggtcattgttgggaacgttggggcaattgtcacaggcatcaccaaatgaatctgtatctgagttctgctggtctttgttggggaacagccggcagttgtcctgggcagaggggtgggaggggaagggtcaggtctcccctaaatcacttgtcatcttgcacctaccttgtctctgtatccttttctaagatcacacccttgtgatggacaaactgctcagtacagtcccacccacccagcctccttgtcctgggcacgaggtttttgcctccctgatttggagtatttggcccttactagagagctgccagatgaggtaagtgaggcaca

SEQ ID NO: 56332 - DNA, 1009 bp, Homo sapiens
gaacgcaatggtgcagtgtcctgccaggtgagctaggcttcaggcgtggaaggaaaagggagggtctggggaaaggagtagggctatgtttagggcctgggttgggggtcttcataggagagaggtgggcctgggcccaggaactgtttggtggggagaataggacctgaagcagggaaaatatagggaggaggggagccagaccaaactgctagctcctaccctttgtgttgccctagtgtaacgtgggctgggctgggaatgggaacgtgtgtgggactgacacagacatcgatggctacccagaccaagcactgccctgcatggacaacaacaaacactgcaaacaggtgcagggagcaggcgggcaagggggcgtagtggggagcccaagctgggtcaggccagaactcatccatcctcttcccctgaactttaggacaactgccttttgacacccaactctgggcaggaagatgctgataatgatggtgtgggggaccagtgtgatgatgatgctgatggggatgggatcaagaatgttgaggtgactcccagactgccctgccccttgaagctcctctcccctcctcctgtcctctctgtgcctcacttacctcatctggcagctctctagtaagggccaaatactccaaatcagggaggcaaaaacctcgtgcccaggacaaggaggctgggtgggtgggactgtactgagcagtttgtccatcacaagggtgtgatcttagaaaaggatacagagacaaggtaggtgcaagatgacaagtgatttaggggagacctgacccttcccctcccacccctctgcccaggacaactgccggctgttccccaacaaagaccagcagaactcagatacagattcatttggtgatgcctgtgacaattgccccaacgttcccaacaatgaccagaaggacacagatggcaatggggaaggagatgcctgtgacaacgacgtggatggggatggtgcaggcctggggct

SEQ ID NO: 56333 - DNA, 2014 bp, Homo sapiens
gtttggtctaacaaacaatagcctcagtaaatgctgttaagtgaggaggaagaggagaagggggctgaggagaaggcaggaattccaagctagagtaggtccctgagacagtccagcctagtaaacctccgaatggagaaaaaaaatgcccaaagagaaaggatctccgcaaggtcacacagccagtgaatggatgagcaaggactagaacccatcacctgaactcccaaccaggcgtcttttcattgctgcattaagcctagaaaactacagcatagggcactgaggccatatcggccacgtacgctctttgactgcctcagtttcccccactgcgcccgtgctgagtagccctggcaaggtttggatgcttggctagttcggccccctccccagtcatcagggcacagcagagggcgccggcgccacccctcaccagcacggccaggctgtccaggtccactgacggcagcccccagccccctgaccagcagaacagctccatgggcgccgccatcttgcccaccctctgtcccggaaacacttccttgtgtgcttctgccctcccctgcctgggcccgccccccgccaccgcccctccgatcgttgcggtcagggggcctggggagatccccggggaggcgaggcttcttctggcccgactggcagctgaactgcgggggactgggccgcgggcctcgggggagggcggccgccggcccatccagaggtggcccacgtagcgggacagcgctgtcggcccggcgcgcctcggagtgtcacggcgcctcgtccaagtggagccccgaacccctgaaggcgcggcaggctctggagagcggggtcttgtgcgcctgggccaggtctgggggctcttgccaaactgcacgtggcctgtactgctccagggccccttggggctcgtccccgagcggggactgcgggggggtcccccgagcagcatgttttccacagcgcgttatgtttggagcgggccctgcgccgcctgtcgccatggaaacaaaacaggggcggtggcggcggccggagcggaggccgggctggggcttgggtgggggaggggaagagaggctcgcaggctgtcgcttaggtgacgggaactcaggcgcccctctgcttcatccgggtcacggcccgtccgctagtacccacagtgttccacagtctggtccttggctcctcgcctgtacccctggtcttctgcgcctgtccctggtgtccctttcctcttttttggtttcttcactctgacctcactgaccactgctttagattctcccttcagttcccgtcagacgcttccagactcccaagctttcctacgaatgagggaaaatggagaaacaggcacttgtcaggggaccccccaccctaataaagagcacttgctccgccagaacagcaaaattcatgccatgtgggcatccctgggcactatagcaagctagttgcggccactcccttggcatcctttcctgccagctgtggaataatgcccactgtctagcactgcccctgccaggggttcttgccttccacaatcgtggcttccagaaaacagtggcattcggtagcgctgtgtgccgagacccccaacaatgatgactgcggagagggaggcacctgggggaggatcattagggagaggtagaaagcagggaggcctccaggattctttcccagtgcccctggttcccagagctgatgatgcctccagggtgattggcagctctttgtttcagccccccctcacccgcctgctggccccccctccaattctgtccctccgccccccggctcctgctctctccgcctagccttttcccctcccagctgcctgcctgccaggggtagtgagccggctgagaggcatggagacgcaggaacttcggggggccctggctcttctcctcctttgctttttcacatctgccagtcaggatctgcagggtaagcctgtctccatcctcttagaccgctctctgcttcttcc

SEQ ID NO: 56334 - DNA, 1982 bp, Homo sapiens
ccagccggggaggggacgggaacacacagacccacacagagactcaggagagcatggaggtcagaagcccaccttgaatcagacaggtgcactggctcagacctgcctgtttcttcctgcccacccaatccaggtacatactttttggatagacaccaagaactacgtagaagtgacccggaagtggtatgcagaggctatgccctttcccctcaacttcttcctgcctggccgcatgcagcggcagtacatggaacggctacagctgctgactggggagcacaggcctgaggacgaggaagagctggagaaggaggtagctctgagaccgggggctattgtatgagatgagccccaaggatgctggccaggaatgggagtgcttaggtgcggaggtggcactgttcccgcagctgcaagcctacctgtgtcgcccctacagctgtaccgagaggctcgggagtgtctgaccctgctctctcagcgcctgggctctcaaaagttcttctttggagatgcgtgagtctgactccaagagggtaatgggtggcttggaagaagatacaggttcagatggagcagctggagctggggctggggctggggctggctcaggctctggataggaggtccctgagacagatactggccctggtgacagtggggctgtgcgtggggccagagccttctcagaggtacaaaagggtagggtgggagggcagccaggcacaggaagggcctgaagagctgtggggcactgagtgtgccctttatgcagccctgggatagagccctattcagggccaggctggcgccacctggggatctctccccataccaggtctagaactgtgtgtcctgtccttccctggtggccgcctgctgcccagagcccacctcccaaggctgactcttcctccagctccatctttaccccttctaccccagtggttctcctccatcccacccttctctctctgctccagccctgcctccttggacgccttcgtcttcagctacttggccctgctgctgcaggcaaagctgcccagtgggaagctgcaggtccacctgcgtgggctgcacaacctctgtgcctattgtacccacattctcagtctctacttcccctgggatggaggtaaggggcagatgggaggggcagccctggggagagtgggcagggatccaagaactagttctcctaacacaccttccttccttgaccctcagctgaggtaccaccgcaacgccagacaccagcaggcccagagactgaggaggagccataccggcgccggaaccagatcctatctgtgctggcaggactggcagccatggtgggctacgccttgctcagcggcattgtctccatccagcgggcaacgcctgctcgggccccaggcacccggaccctgggcatggctgaggaggatgaagaggaatgatttgtcctcacgctcccaagactggtttttctactctcatgcattccagaggcccccgtgcctcctcgttgttggtacagccggacacggggtgctgccacccagaataaagccactcacactgactgggctcaaacattttctcctttaagagctgccatttttcctggctggtgccataggaatcatctgggtgcctgggcacacccgctgctgctttaaggcttccgccctgatgctgacactgctgctccacgggcccagttctgcatctccaggaaagacaaacagtctccagttttgggcccagctttcctagtctcttcttttccttaccctcagccctgatcttgtgtttgtacggacagtgagctcaccctaggcctggacccaggcccagtttccaaagcaagcagcacacagcgcatgttcacataagcatgggggctggggggacactggggcttactgatctttttctaggggcctccagcccctggcaccacctagaggggaaagtgagtcacccaaacc

SEQ ID NO: 56335 - DNA, 1630 bp, Homo sapiens
cagcctgggaggctgagcgagactccatctcgaaacaaaacaaaacaaaactatctaggctgggggtggtggttcatgtatgtatgtgtatatacatatatatgtgtttatatgtatatatatatacacacacacacatacatacacacacatacacacacaaattagctgggtgtggcacccgtgtagtcccagctactcaggaggctaatgtgggaggatcagttgaccctaggaagtcaaggctgcagtgagtcgtgattgcgccactgtactccagcccgagtgacagagtgacatcctgtctcaaaaacaaaaaaaaatctccccaaacctctctagttgcattcttcccgtcacccaactccaggattcctacaacaggaactagaagttccagaagcctgtgtgcaaggtccaggatcagttgctcttcctttgcaggtactgacagacccagaagcagctaaatatgttcatggcattgctgtacattggtacctggactttctggctccagccaaagccaccctaggggagacacaccgcctgttccccaacaccatgctctttgcctcagaggcctgtgtgggctccaagttctgggagcagagtgtgcggctaggctcctgggatcgagggatgcagtacagccacagcatcatcacggtaagccaccccagtctcccttcctgcaaagcagacctcagacctcttactagtttcaccaaagactgacagaagcccttcctgtccagctttccccagctagcctgcccttttgagcaactctggggaaccatgattccctatcttccctttccttcacaggtctgcacacctcattgccccttttgcaactactgaggcacttgcagctgcctcagacttctcagctccccttgagatgcctggatcttcacacccccaactccttagctactaaggaatgtgcccctcacagggctgacctacccacagctgcctctcccacatgtgacccttacctacactctctggggacccccagtgttgcgcctttgtctctttgcctttgtccttaccctagaacctcctgtaccatgtggtcggctggaccgactggaaccttgccctgaaccccgaaggaggacccaattgggtgcgtaactttgtcgacagtcccatcattgtagacatcaccaaggacacgttttacaaacagcccatgttctaccaccttggccacttcaggtgagtggagggcgggcacccccattccataccaggcctatcatctcctacatcggatggcttacatcactctacaccacgagggagcaggaaggtgttcagggtggaacctcggaagaggcacacccatccccttttgcaccatggaggcaggaagtgactaggtagcaacagaaaaccccaatgcctgaggctggactgcgatgcagaaaagcagggtcagtgcccagcagcatggctccaggcctagagagccagggcagagcctctgcaggagttatggggtgggtccgtgggtgggtgacttcttagatgagggtttcatgggaggtaccccgagggactctgaccatctgttcccacattcagcaagttcattcctgagggctcccagaga

SEQ ID NO: 56336 - DNA, 1026 bp, Homo sapiens
cttgggcctgtcaatcttgcccactccatcaggcttcctgttctctcggtctggcccactttctttttatttttcttcttttttttttttttgagaaggagtctctctctctgtcacccaggctggagtgctgtggcgccatcttcactcactgtaacctctgcctcctgagttcaagcaattctcctgcctcagccttccaagtagctgggattataggcgcctgccaccaggcccagctgatttttctatttttagtagagacggggtttcgccaggctgttctcgaactcctgaactcaagtgatccacctgcctcggcttcccaaagtgctgggattacaggtgtgagccaccacacccagctggtctggtccactttcttggccggatcattcatgacctttctcttgccaggttcctggatgcctatgctgagcacaagttacagttctgggcagtgacagctgaaaatgagccttctgctgggctgttgagtggataccccttccagtgcctgggcttcacccctgaacatcagcgagacttcattgcccgtgacctaggtcctaccctcgccaacagtactcaccacaatgtccgcctactcatgctggatgaccaacgcttgctgctgccccactgggcaaaggtggtaaggcctggacctccatggtgctccagtgaccttcaaatccagcatccaaatgactggctcccaaacttagagcgatttctctacccaactatggattcctagagcaccattcccctggacctccagggtgccatggatcccacagttgtcgcttgaaacctttctaggggctgggcgaggtggctcactcatgcaaacccagcactttgggaagccgaggcgggtgatcacctgaggtcaggagtttaagaccaccctggccaacgtgttgaaaccctgtgtctactaaaatacaaaaaaaaaaaattatctgggcatgatggtgggtgtctgtaatcccagctactcaggaggctgagaagggagaa

SEQ ID NO: 56337 - DNA, 1640 bp, Homo sapiens
gtgagatcatgggtccccaggggcgtgggtggaacattcaggagcaactggcacaggtcaggctgctgggttgttctcagctaatggacctctggggtgtgtgtttctgtgtgtgagtgtgtgtgctgggcagcaggctgctgagtggtagtgatgctgttaggctggggtggggaaccagtggctggaatgggcggtaatgtctttgtcctctacttgcagatccactccttataccgccgcacaggtgccagctttcagaaggcccagcaagaatttgctgctggtgtcttctccaaccctgcggtgcgaaccgcagctgccaatgcagccgctggggctgctgaaaatgccttccgggccccgtgacccctgactgggatgccctggccctgctacttgagggagctgacttagctcccgtccctaaggtctctgggacttggagagacatcactaactgatggctcctccgtagtgctcccaatcctatggccatgactgctgaacctgacaggcgtgtggggagttcactgtgacctagtccccccatcaggccacactgctgccacctctcacacgccccaacccagcttccctctgctgtgccacggctgttgcttcggttatttaaataaaaagaaagtggaactggaactgacatccccgtttcctgaatcttcattgggaattaggccttatgaaagagaaaggagagtgtggagtgaggtgggaaggtcggacccggctttagtgtaaactgggagatatgaggggcggggcggtggagcccgagtggctggcgcaggaaggaggtgggaagtccacggaaacgcgaaacccggagacgccagggagccctgctccccacccctctccattaatgacggggaagagccaccgcctctgccgggaacgccaaggaatacgcgggcctggagcctgaaaagctggatggggctcaagtggaggcccaaaggatcactagcagcctagccagggtccagagcgaggcagggactggaggagcgcttatccgactgcctcgccctgccgcgggatcccccaaccccgacagggtctcagtcccgaactacaactcccggggtgcaccgcgccggccctcgccgccatgcccctccttcccgcaccatccccattcccatcccccttctctagtccccgacctgcggcagccggagctcggggagcggagcgtggtggggaggggagcgggacaggcgacacaggagacagcggcgccgcggcctctccccaccaggcggccccggatcctactggacgccctgagggcacaccgaccgcgcctctagagtcaccccacgccgacccctcccctcttctctagacttatttccatccttcccgcttttaccctccccacccctccctgggctccaggccgccgccccctcctcactcctggaccggcccttctcggtgcccctcttccctagggagatgcgatgagccggtgcccccgcgtcctcatcgtcgccccgggcacggtgcccgtccagtgcccgtggtggggagggagcactccgcggtccctccgtgacgcccctcgcttggccccccccacagctggcgtccctcggccatgccccaggggaccc

SEQ ID NO: 56338 - DNA, 1340 bp, Homo sapiens
gaggtaggagaatgggcgtgaacccaggaggcagagcttgcagtgagccgagatcctgccactgcactccagcctgggcgacagagcgagattccatctcaaaaaaaaaaaaagaaaaaaaaaaattagctgggcgtggtggcgggcgcctgtagtcccagctactctggaggctgaggcaggagaatggcgtgaaccggggaggcggagcttgcagtaagctgagattgcgccactgcactccagcctgcgcgacagagccagactccgtctcaaaaaaaaaaatgtctttgcaaggggatcacacattattgacatttgctttctccatctcccctgttgaggattccatgaaggcagcagctgccttcatttccttactctgccatgtttggtgaatattataggatgagcatagatgggaaggagccttcattgcagtccagaagggctcctcatcctgtccctctgccccttaggcagcacgctggctcttctcctgaacttcctcgcctgcctggccagcttctgtgtggaaaccaacaatggcgcaggctttgggctttctatcctctgggtcctccttttcactccctgctcctttgtctgctggtaccgccccatgtataaggctttccggtaagtgtgttagtggtgggagagtgatggagacctgggatgggccccacgtctgcccatccttcagctctaattcttctcccaccctccccatttttttcctctttgtaggagtgacagttcattcaatttcttcgttttcttcttcattttcttcgtccaggatgtgctctttgtcctccaggccattggtatcccaggttggggattcaggtttgtgaggctgttatccaccctcacctttccctctagatccagccagcactgggtgctgggataggagttgttcagaaaaaggaaatgtggttttaatccttgggaggtactagtttaatgagatacaagacatacttccaggatagagcgcagacagcactcttgacacatatagattgaagggaagaatgctgcatttggccaatctaaggtggcttcctggaggaggcatagaaccatggttgaaaggaggaagaagaatccccagatgagtgcctggaagagcttggagagctcagggctaatggttcagaaactggaattaaactatgaagagattagatacagtttgggattgtggtgcttggaatgctgctcgattgacagggagccactgctgatgggaagggtaggaacaggggatgctggtgacataaccagtggagaagctgaggagcccctcttcactggtacatccttccctt

SEQ ID NO: 56339 - DNA, 1205 bp, Homo sapiens
tgcctgtaatcccagcactctgggaggccaaggcgggtggatcacctgaggtcaggagttcaggaccagccaacatggtgaaaccctgtctctactaaaaatacaaaaattagctgggcgtggtggcatgtgcccataatcccagctactcaggagactgaggcaggagaattacttgaacccgggaggcggagattgcactgagccaagatcacaccactgcactccaacctgggcaacaagagcgaaactctatctcaggagaaaaaaaaaaaaaaaaaaaagctgaggtgggagggttgcttgagcccaggaggttgaggctacagtgaaccatgatcataccactaccttccagcctgaacaacagagaccctatctcaaaaaaaaaaaaaaaaaaaaaagagaggatccagggatggagagaagggggagtgattcctttgttggtctctgttttacttctggggtccacctgtttttttgtgccttacagctcgacagaacaattggccccctctaccttctttttgtccagttcagccctgctttttccaggacatctccatggagatcccccaagaatttcagaagactgtatccaccatgtactacctctggatgtgtgagtagtgagaagccttttggaggaagttacaggtagatctcttaactgccctggggtccgctcaccaagaaccaaacacttcacctctatttagaactcaccagcctgctagcaaatgttcttgccctctccccactttttattgtccatatgcaggaatatattttgaattctttagatgtctttgggctgggtgcagtggtatacgcctgtaatcccagcactttgggaagctgaggtgggtggataacctgaggtcagaagtttgagactagcctgatcaacatggagaaaccccatctctactaaaaatacaaaattacctgggcgtggtggcacatgcctgtaatcctagctactcaggaggctgaagcaggagaatcacttgaacccgggaagtggaggttgcaatgagccaagatcatgccattgcactccagcctgggcaacaagagcaaaactccatctcaaaaaaaaaaaaaaaaaaaaaaaaaaaaaaaaaaaggccgggcacggtggctcacacctgtaatcccagcactttgggaggcccaggtgggcagaacatgaggttagg

SEQ ID NO: 56340 - DNA, 1032 bp, Homo sapiens
gaaaagaaaaaaaaaaaacacagttaagtggggagatatggtaaatgagtgatttgagtcctcactaaggaattggatatgagggatgataaggctgctacaggtcatcatagagttctctgacagaaattcaacagaagaactagcttcctaacaaatgggggaaaggctgcttccttacatcatgagttctgggtctaaaggtattcaagcagactctagattcctgtgttatgagggactagatgatcactaaggtcttttcctcaacagccaccaccagcctatgagcctccagcccctgccccattgcctccaccctcagctccctccttgcagccctcgagaaagctcagccccacagaacctaagaactatggctcatacagcactcaggtacaggaggtgtgcaggtgagggctggggagaagggccagtcctggggcccagggctcacatctccgtctgctcacactgggcaggcctcagctgcagcagccacagctgagctgctgaagaaacaggaggagctcaaccggaaggcagaggagttggaccgaagggagcgagagctgcagcatgctgccctggggggcacagctagtaagtaatagagtggggaagagcatctgagagtttgggaggagcaaaaacaggtcttaagggcctgggctcggctgggtgcggtggctcacacctataatcccagcactttgggaggctgaggtgggcggatcacgaggtcaagagatcgagaccatcctagccaacatggtgaaaccctgtatctactaaaaatacacacacacaaaaattagctgggcatggtggcgcgcacctgtagtcccagctactcgggaggctgaggcaggagaatcgcttgaacccgggaggtggaggttgcagtgagccgagatagcgccactgcactccagcctggtgacagagtgagactccatctcaaaaaaaaaaaaaaacacaaacctgggctctggagtcagactgctgagtttgaattttagagatactgct

SEQ ID NO: 56341 - DNA, 2215 bp, Homo sapiens
ccggacttcttttttgagatgtgtatttctgtgaggtaggaaagctcggctcctttgactaactggagataatggagatctcagacctaaagaagctctccctcctttgacccctttgctacatgttacatatttttagagaaactcctttgctacatgttacattttttcagaaaaacccatttgctacatgttacattttttcagaaaaacccatttgctacatgttacatgttttcagaataactatatatctggcacttgagtgtagtcttcagatgcttacagatgtgcacgctgttctataatcatttcttaatccttttgctcccctacttctaaaagtattatgctggatgtggtggaagctgtaaaacaggaatttcccagggcttgtaaggccaggcaggagatcacagtaccttttttaaggctcagaagcaatgtagagaatactggtggaatctcagtctgggtgcagaggttcatcctctttctcctctgctcctagaagcgagatgagcgcagtgtgaagagcacagctgtgcgggtggtagactttggcagtgccacctttgaccatgagcaccatagcaccattgtctccactcgccattaccgagcaccagaagtcatccttggtaagggagggcaaggctgtccaagtgtgtgagatgatgtgagggtggggccacctaagcctcataacaccttttccctcccattctcacccagagttgggctggtcacagccttgtgatgtgtggagtataggctgcatcatctttgaatactatgtgggattcaccctcttccaggtaagtgatgggatgtcttacttgactgcctggcattcttctacctggttcctttgttttctgctgaggacctgcctactcagttctccacattgcctgccttcctggcagctgatccttagcatgcccttttcagtcccatgctcagttctgtttttgtttcccagacccatgacaacagagagcatctagccatgatggaaaggatcttgggtcctatcccttcccggatgatccgaaagacaaggtgaaccttgagggggcactagttaactcttttccttttctctccacagaattggtctatttcacatcattttcttttttctttgatacctcctctccccccagttactttcagatggggaaataagggaattgtaacaagggtgaccttctgattcctcaacctccccttcccctctagaaagcagaaatatttttaccggggtcgcctggattgggatgagaacacatcagctgggcgctatgttcgtgagaactgcaaaccgctgcgggtgagctgggctcgggataaatagtgcccaccgtccagaagtcacttccttcttagggtggtttgccccctggaatgctcttcacaagcagagggttaggaaaggaggggaggaaagctgaaagaagacatctttggtcaacagaggaaacataagagggagtggttttgtggagggaaggaggttagacagcctaaccttgagacaaccagagatcaaagcaatgtcctggattctttaggtcagacagaaaagaataaactacctttgaagagcttacattttaatgaggaactaaagaagattcatgaagttgacaaggatatacaagtagaaagaactttcaaagattatggagtaattgtgctagtgggaaggtaggttgagctataatatcagaaacgttggtcctggtgtggtcgtggttaggtagccttcaaattggttgcaagcagagccttggttctccaagaatgaaaggtagggtcttgaagaaggcagggtttgtaaggcatcctgcctcacctttttcctgccctcctccaccagcggtatctgacctcagaggcagaggaacaccaccagctcttcgatctgattgaaagcatgctagagtatgaaccagctaagcggctgaccttgggtgaagcccttcagcatcctttcttcgcccgccttcgggctgagccgcccaacaagttgtgggactccagtcgggatatcagtcggtgacgatcaggccctgggcccccctgcatcttttatagcagtgggtgtccagtccaggacactggtgcttttttatacaagagaacgagccagagttcactccttcctcctggctctctatatacctgtgaatatgtgaaatagtgtaaa

SEQ ID NO: 56342 - DNA, 1049 bp, Homo sapiens
aacttgggctgggcatggtggctcacgcctgtaatcccagcactttggaggccgaggcgggtggatcacaatgtcaggagttcgagaccagcctggccaatatggtgaaaccccgtctgtactaaaaataaaaaaattagccgggcatggtggtggacaactgtagtcccagctacttggaaggctgaggcaggagaatcgcttgaacaggaggcagaggttgcagtgagccaagatcgcgccactgcactccagcctgggtgacagagtgagacgccatctcaaaaacaaaaaagaaaaaaacctggcagatagtaccattcttcttgggtctggtagaggctactccttagctgaactgaattttggtgttagtactagctggcatggttttacacaagtatgtggaatcaacagctatgaagtacctccttgttggatggctgatgggcagatgggagctcatcagacaaccccccttcccccatctctcttctcagcctctgtgtccagatgtttgactggtttgactaccatggccacatgtgtatctcctttgagcttctgggccttagcaccttcgatttcctcaaagacaacaactacctgccctaccccatccaccaagtgcgccacatggccttccagctgtgccaggctgtcaagtgtgagtggggtgggccgaagtggactctggggcagtccctcccttcattggatctctctgtcggttgtgcactggtgaagcccctaaacagtcagctgtctgttatctgcagttctttgatttactgtcatcttgaaacgtcttctgacttaactccttgactgatgtctttatcgtcactgattgctcttactctacacctagcctagcagcagctagaagagaaagcctttggaatcaaagcacttaattaccctccccttttcctttctccctttcttgggaaagcatcagtcagacagcaaacataaagagacaaaaatacactccttagggtaaaggcttacatttgtctgggatgagatgttcattcacagcaaag

SEQ ID NO: 56343 - DNA, 2536 bp, Homo sapiens
gggttaaggatggtttagagcaaggggggatttcattcaggaaagcttgagaaaaaaatggctctttgtttctttgtatcactgcagcgggaaaaaggccccaatagggagtggttctgcagatgccttttcagaggttttggtgacatggcagatgtgcttgttacctcacttctctggtcccttggtcctctcagtgactcaacaagtgtctgagaacagttttctagcattactctttgtcctcactaaggcaggaccttgtcacagggtatggtagggaatgtgatctgaacagatacacctcattggtatttgttatccaacagcagttatgatgatcgttcgtccgaccggagggtgtatgaccggcgatactgtggcagctacagacgcaacgattatagccgggatcggggagatgcctactatgacacagactatcggcattcctatgaatatcagcgggagaacagcagttaccgcagccagcgcagcagccggaggaagcacagacggcggaggaggcgcagccggacatttagccgctcatcttcggtgagtgccagcccaggcccttcctctccccactcttctgcaggccctctaggactctggtaagtgagcagtatccttgttctcagctgaacattggggcatgaacactgaggtgggcactgagtttgcctactttcttggaagctctccgactcttgaagggccctggatctgctttggagatggatgggcacggagcatttgtgacccccagtgctctccctggcatgttgggcttattgtgttgggagcagcttctccgccccagcggcctccactctttaatggggaccttgcttgtgaactgcctttttcccccaagccctgggctctgtagcccccttggcaggcgggcttgggtgggggcaaggggagatctgtgtctgcccggaagggcattgtgtagagcatggggttgtgggtgacattggcaacaacaccacttctctgctctgcccatgcctctccctgttcctgttttgggtttggggacttgggattatgcgccgctctctcttctcacaccgatccaccttactgcatctgacgtgttcccttccactgtcccccatcatcgtctgtcccccctggctgggcgcctgtgaccggtgacccctctaccacccaccccgcctccctccggcccccgctccgacacctggcttgctccgaccccccctgccccccgacagcagcacagcagccggagagccaagagtgtagaggacgacgctgagggccacctcatctaccacgtcggggactggctacaagagcgatgtacaagccaaatcgtaacaatcctatagcctgtaatggtcccatagccatcctaacgtcccaagccaacctgagtcacagcctcttgccttttctcagtggtgttgtttatctgggtggtttgagttgctgttgagaattgacctctgttgtccactcccagctctcacggcccctgggttaaaggtggtgggaatcacgcaggggttttcttcccctgtgaccatctgtatctgttccccttccttcatctccaccccaggttgctgtccccttttttcttccaactcagctcattccccaccttctctccctccctctccccgaccctgctctctttcatttcagatgaaatcgttagcaccttaggagaggggaccttcggccgagttgtacaatgtgttgaccatcgcaggtaactgtcagtccctccctactatgtggggctaaagagatggttggggttatatggggcttttttgctaattaacctgaggtagaatttcttagtccccctacagccctgttcattttgagacattcttgagaacccagcaaaagcctctcctgccaacttacaggggtggggctcgagttgccctgaagatcattaagaatgtggagaagtacaaggaagcagctcgacttgagatcaacgtgctagagaaaatcaatgagaaagaccctgacaacaagaagtaagcaagcaaggaagtatgtagggaggctgagagccccaacccctacacgggagagacttctagacctggtttaggcagacaggggagtcctagaccttctcatccattcatcttttgttcatcatcttagagtagtagaacatcagggtaggaaagggggggggcccatgacattccttaatccactccccttgttttcagggaagttagattgctctgtcgtttgaccccagcctagaatggcttctgtagagatataccctggacatagccctaggactgagcatcaacctcatcgaacaatgaattaagcttttataagtagaactatgctgataaggccacagacatttatgcagtaatattttgttcacatacattcacagtccaaaaatagaataaggactttaagccaagatatgaggccagtaggtataaataggagcccagtggtagctagtggtgaatgaatatcaggagttgggctggggttggga

SEQ ID NO: 56344 - DNA, 1110 bp, Homo sapiens
agtggaatatcaaagttggactcgggtccaatcaaagctggaggggaggaatacatcaccgtgtcacttggaacatgcaggaagaatttgcctgtaggagttctggattttctgagtaagaaaggaaaaagcaaaagatttcaaacttgagaaaggtaggctagtgatgttttgaggggacagtgctgtgaggccgtttgatggtagtatgtggtgagatggcatttatgtggctatgctgattaggataactatgctgggaaaatcttgtgcttgcagcttggtatgctaccggccccagttacaccaagaatgcatcaaataccaccctcctcaatttggggaggttgggaagaagtgatacagaatggtggtcagacatcggaatcattaaaccttttgcatacgcgattctcatacacccccaccaagacttatgtccctgggcctgtttcattttattgtgccttcctattctcatcttcctggattgtgacagtgatttttctcttttttccttgaaggaaaaaaaggatttgtgaaccatcccattccaattccattaactggaaggtggccagctgtcagctaagtagggctgatattaattaaaaaccacttactggccaggcgcggtggctcacatctgtaatcccagcactttgggaggccaaggcgggcggatcacctgaggttgggagttcgagaccagcctgaccaacatggagaaaccctgtctctactaaaaatacaaaattagctgggcgtggcggcgcatgcctgtaatcccagctactcgggaggctgaggcaggagaatcgcttgaaccctgcaggcggaggttatggtgagccgagattgcgccattgcactccagcctgggcaacaagagcaaaactccgtttcaaaaaaaaaaaaaaaaacacaagaaacagttgttatctacgtcttaagcacaagagtggaggggccagatgggatgctgactgtattttgtggcctactacattaaaacctctcaagggagagttggccaaagatgtgagagatgattaagttaattcaaggggcccgacccagatccctggagctgatagtatttggcgttta

SEQ ID NO: 56345 - DNA, 1055 bp, Homo sapiens
aaaggccaacgctaggccacgccctctccctggctcaggctgcgctccccgccttctttgctaagccacgcccctctcggagttcctccaggatcccggcgtcccagccccgcccggtcttggcgcggccctcgccagggggcgccgcgcagcccgcccgccgcccgccagtctagcacacaccccctccgccccgcgcgccggcgattccgagcctacgacgcctccgctagagcccgcggggctgcgccgactcctgctctggaggggttgcgggtacctgatggccacagagggctctaggaggccgagcgtgtaagcggggtgggcgccatggaggcagagcagcggccggcggcgggggccagcgaaggggcgacccctggactggaggcggtgcctcccgttgctcccccgcctgcgaccgcggcctcaggtccgatccccaaatctgggcctgagcctaagaggaggcaccttgggacgctgctccagcctacggtcaacaagttctcccttcgggtgttcggcagccacaaagcagtggaaatcgagcaggagcgggtgaagtcagcgggggcctggatcatccacccctacagcgacttccggtattgggggcttggcggggagggcagggtacatcaatcccaccctcgcgggcagcgacaccgggacccggcccgccccaccctccacggtcacttcatttccagcccggggtcccttggtggggcgggagagtcacttgcaccagtctagcctgggaattcctgggcgggtatcccctgccggaggtcctccgtgcctggacaggctgggggcaccagaaggggcaagcagacatcaggggatctccagagacctggatttcctctttcaggaacccgggaccccatccggaccaaaggaactaccagagtttgggacccctgcctcctccagtcctgcttgctggagatctaggaaattatattctaagtatcggggccagtctgagggagaagccgagctccgccatctcccatccccacacccgctccttagcacctgcc

SEQ ID NO: 56346 - DNA, 1044 bp, Homo sapiens
ctctgtcctcttgcccctggcaatgggctggccctccagtacaagcaggtggagcagtacatgtccttccacaagctgccagcagacacgcggcagcgcatccacgagtactatgagcaccgctaccagggcaagatgttcgatgaggaaagcatcctgggcgagctgagcgagccgcttcgcgaggtggggctgggttgggcctggaaggggggctcttcagggacctggagtgctgtctggtggtaggggctattggtcagcaggtgctcctatagggaatgaggcctgcagagggccccgtgggaggccaggtatttgggctttcaggggctagggtctttcttgaaggccctttgagggtgaaggatacatgaggagggactatagggatctctgtttttgggggatggtcctgcaagggctcatgggaaagatctgaaggcaggagcttagggatggtcccaggcccactgatgcctccccatcctttggcagaacatgaccccaggggtggggtttctggaagcggatgagctcggtgggatcatctcaggtcaggggcacagcctgcctgacaggcccctcccctgtccaggagatcattaacttcacctgtcggggcctggtggcccacatgccgctgtttgcccatgccgaccccagcttcgtcactgcagttctcaccaagctgcgctttgaggtcttccagccgggggatctcgtggtgcgtgagggctccgtggggaggaagatgtacttcatccagcatgggctgctcagtgtgctggcccgcggcgcccgggacacacgcctcaccgatggatcctactttgggggtcagcaggcctcagggagggtggcagggtcacgagcagacagtggagagggcaactgctcccaggctctgggtccctgcctcagtacgctgcagaatcacagagctccagcccctccccaggcctactcagtgagaatctctgggctggggtctggagctctatagtttttgtttgtttgtttgtttgtttgttttttgaggtg

SEQ ID NO: 56347 - DNA, 1010 bp, Homo sapiens
tctgtctctactaaaaatacaaaaattagatgggcatggtggtgggcacctgtaatcccagctactcgagaggctgagccaggagaatttcatgaacccggagacagaggttgcagtgagccaagatcgtgccactgcactccagcctgggtaacagagagagaattcatctcaaaaaaataaataaataaataaataaataaaaacaaaaaataaatttactagggtagaccatgcagaaagaatgtgcctgggtactgggacctcttctagctttgctccagaaatttggggaaggagtaaagacagtagcaattccagaggctccttgaagaggagttggggttggggaggataaagttaggtggtggttggaaatgggagagagcaaggagaaaactcacagtagctgctgtatggaccctgataccctgtacctctttccttgccctccaggtcctggagtacaatgccattggaggcaagtataaccggggtttgacggtggtagtagcattccgggagctggtggagccaaggaaacaggatgctgatagtctccagcgggcctggactgtgggctggtgtgtggaactggtgagaggggtagggcaagggagaagaagtttcctgcaatggtggtgacttgggtgggaaggggagggatgggcctgaaacttatttctgggttgtgtttgtgtttctttgtctctagtgtgctacggccaaatttagagtgaatcactccaagggttaactaatgtggggagcctcttttggcattaggtatgaagatggctgtagatagttgtagacagtgtggactggggcctcgagactgggcagagaggtgtcagctctttcctctgagcagaggatggctataaaagtgacagaggaggccgggcatggtggctgacacctgcaatcccagcactttgggaggccaagggggaggatcatctgagttctggagttcgagaccagcctgaccaacatggagaaacccc

SEQ ID NO: 56348 - DNA, 1242 bp, Homo sapiens
gccgggcgtgggtttggatgccatcaatgatgctaacctcctggaagcatgtatctaccgcctgctgaagctctattgccgggagcagccctattacctgaacctgatcgagctcttcctgcaggtgtattgcagacagggcccgatgcccagagggtgcccatggtagccttggcctctataggacatgctcatctagctggtttcagggtacaggattgcagcgtgcctggaagggaaagaaagcgaggaagggtgttgggaagtggggttgtggtagtggcaagaaagggcttctctgtcctgtgtaattggaagaaagggtgataaaggactgtgtgtatgaatatgggccttaagttttggggctttctccccttctgttgcctttctgattctgcccagttgtcagctggtatgggatgttgggcttgggataccagggtttcgcatatctggagaaagcctggctcatggaccgtctttgtcttgcttagagttcctatcagactgagattgggcagaccctggacctcctcacagccccccagggcaatgtggatcttgtcagattcactgaaaagaggtgaggggaggtgagggacagcgcgaaccatgtctggacagcgagggagggctcaggatgtgcattgccctcctgaggagtttctcttctccccttactcaggtacaaatctattgtcaagtacaagacagctttctactccttctaccttcctatagctgcagccatgtacatggtgagtgagcctcctcacccctctctgctctgctgatgggggcttttggacagcaaggcatagagcagaaaacgtgaacactgctacccctggtgaaaaactgtgtgaccttgagcaagtcggtctcgctcagtctctttcctcagctggggataaaattcctacttcacaggactgtaaagattaagcaaggcaagggatatgaaagtgcttagcacataataggggaacaatatatcctgtatctgagtatggataggagtgtggagatcatccaggttgagagggagaagagtggattaaagacagtcagtgggattaagtgtctaccctgaccttgcttctctacatttccttttcatcttgaaagaagttggaggtggcaaaaatattaggaaggtggatcagaatgacttggggactgacatttgtgagggaagagacaggctgtgcacctctagaatggattcatctcttttat

SEQ ID NO: 56349 - DNA, 1054 bp, Homo sapiens
tctagttggcaggagccaaagatgttgccaaacatgtagtacacagaacagctcccccagacaggattatctggtcccaaatttcaatagtgccaaggtggagaaaccctggagtagaggatgcctggtatgaggcaatatttgggatagggaagggaagcttgggattttagctacgtagagacacttgaaaattggagggaggaaaggagtgggtggctttggagatgttctggaatatgtgaatgaggggagtggaggggtcctggaggctctggggaaggccaagcccgttttcctgtctttcaacctcttccaggaaaattacgggcagaaggaggctgagaaagtggcccgggtgaaggcgctatatgaggagctggatctgccagcagtgttcttgcaatatgaggaagacagttacagccacattatggctctcattgaacagtacgcagcacccctgcccccagccgtctttctggggcttgcgcgcaaaatctacaagcggagaaagtgacctagagattgcaagggcggggagaggaggctctcaataaataatcgtgtaaccttcttgtggttctgttcttgctcggcccagccagagtctggctctttccagaatgtgcagggtggggtgctgggaggactcgctgcacggaaccaggacccaggggccaaaagcttaggatatatcaaaccctctaggtgggtgacaaaagacgctaaacgctgggggcgggtctgagctacgccacgcccatgcgcgaaggggtgcagctgcgcagcgcagggtaggttgtgctagtgcccctcccctcccgctctgtgccccgccgggcggggaccgtgggagccgcggacaagcccaaggccggagcggttccaggaggaccctggtgaggagggctcggcccatgggtgtagaccgatggacctgggcacgaggggcggggcaggacaagggagcaggagaaatgaatagagaaagggtgcggtggtggctgaacgatggagacgaatgcggagagaatggacataccgctgttcc

SEQ ID NO: 56350 - DNA, 1051 bp, Homo sapiens
cctcccaggtcttctgatagccgtcagcgtctccgttgataaaatcatctcgcatttcggggccgcccggaacttggtgcagaaggtgaaggtggctggggggaggctgttgggatgaggagagtaatggagctccgcggggggtgcgggaatggttggcgggaggtggctgggaggtgtctggagggatctctggagccatcggcatcgcgccacctccaggcccagttgggtgatagccggctgagcccggatgtggggcacctggtgctgaccaccctctgcccggccctccacgccctggtggcggacgggctgaagcctttccggaaggacctcatcaccgggcagcgcaggagcagcccctggagcgtggtggaggcgtcggtgaagccaggtgagccaggagggcgtgggacccggcagtgcgcagggcagggccgggcttggctgactgcaccccacgttctcaggctccagcacccgctcccttggaaccctgtatagccaggtcagccgtctagccccgctgagcagcagccgtagccgcttccatgcctttatcctgggcctcctcaagtgagttgccttctttccagtgcccttcccacgacctgggactgcaggagcgtcatgggtgggacacagtagtagtgcctcacatccccagagaaggccccccctcttccaatctcatctcccatcctccacccagagaggactggagtcctccacctccctgaacttccattccctcttttctcccctagcaccaagcagttggagctgtggttttccagtctccaggaagatgcaggtcagaggttcagatggtagaggatggggctgatgggctgggaggatgggaaggaaagagttctctcctgctggttcccactgctgccagaatgccattaatccagatctccgatcttattactcttctaattaaaactttctaaggaggcccatcgcccataggatgaaagacccaaagccttggctgtctggcctctgccctcttcccctgccttggagggtcttgccaaca

SEQ ID NO: 56351 - DNA, 1791 bp, Homo sapiens
tctctttaaaaataaaatttaaaaagctttgttgtcttttcagacatacatatgcatatatgttttagatgttcttataagagaaaagatggtttttaaatgtgccaagttgtgtgtgtgtgtgtatatatatgtgtgtatgtgtgtgtatatatatatgtgtgtgtgtatatatatacacacacacacacacacctgctgtgtgattggtaagcaatacaatagtaaacatgtccccattacttttttctaatattggaccaatgctgtcctaattgtacatttccccttatggtgacgatgctctgactcgtttaggtagacacattgaccaccttccattccattaaatattttttcctttttcccctttctgtgtcattcttgaggaaaaaacaaaagagagaggggatgccaatgatccccttgagcagagaaaaagcaaaataaatattttattaaagaaaaaagagaattaagaaaatagtttggagtattttcttactgtagagaagcactgtacattactaagagacctgggtataagatactcacatgtggagctggaaaaatcgcatgtccaagcccgtttgagtggtttcttttgtttttcattgcagggagtgggtgggagggaggtgggactaggggcactttgggggtctccttttagtcaaaagcgagaaaatgacaagaaagagattaaaattcaatgtttcctttatagtgttaaacactaaaattttaaaaaagatgaaaaagaaaaaaaaactttgtaaaatgcgagaacagaagcaaaagacactacgctctgtcattttatctttcttttgttgaaagactaaaaaaaaactgaaatgttttttagacaatcaaatgttaggtaagtgcaaaaacttgttttttcttactggtgtagaaattaatgcctttttttatttttcagttattttataataacgaaataaaaagaaccccccagctgccaggcgggttttggtgtttgaaatgcggggcaaagcactacatcactgcaaatagatacagagttagtctgcatgtctgtaggctgtgtgattgcggaaaatataaatgctgctaatatatttcctttttacaaaagcatatctaaatagatgattgttttgatgttaatctttgtaaattatgtattaccaattttaacattggatgtaattgcatacaaagcttgcatctcaatccttgaaagtctagtattaaatggaaaaaacttttcctaactgtggactgatgagcttgctattttttcctccttcttatcccccatttatcttccaagacaacctcatcctgtttccaaggggatctttctgaaacaacatcataaacatgctaggctgcacatgagcacactcactgccgttgactactggataaagtcatttcttcagtactaggatctttctagtctggactcagcctaatcaatcagcacagtaataacacacaccaaatgtccagttgcttttttgttttttgtgtttgagacagagtctccctgttacccaaactggagtgcaatggcacaatctcggctcactgcaacctccacatcccagactcaaatgatccttctgcctcagcctcccaaatagctggaactacaggcatgcaccaccatgcctggccaattcttgcactttttgtgcagacggagtttcaccgtgttgcctaacgtagtccagctgttttgttgggttttttttaatttttttgtttttgagacaaggcatcactgtgttgcccagg

SEQ ID NO: 56352 - DNA, 1009 bp, Homo sapiens
aatgtttggcttccttggaccctgggcattaaataccagtagcataccccaatcattgtaataattagtctcccttcacacattttcatatggcccctagattacgtagagcaactacacaattagtgcttcataaaacatagattgagatacttagcctatcagttttgtcctctaccttcacttttccaggtttaacagctctagttgctttcatcttttttgtatatctgtggtatattgaaatgactaaacagtaagttttgattgagaattctaggttgagaaataagtaggctgaatgtagtaattccagcccttatacattggctttctgctcctatcaggaggttcccatgatccctcggccccactatgcccaacctggctgtgtctacttcatctgtttgctccgagatgacttgctgcttcgtcagggtatgtatacaggagctaatcctacttgtcagaggtgacctttctgaatagtaggaagtctctgctgtctccatcatagtcattgtctccatacggcctcgaatagcaatagaatataagtttttatatctgtagtccttgtgcttacatgcatcacctctccaccaaataatactaatttgaaatgatagacatgttacaaagctaattttaagactgggaaaaacatataggaagctcaagaaatggaatgcctcccttatattattgtcatagtctagaattgattatcatcacttaacactgctgcttttagctctctgtatttatactgtttcagattatgagttctatgtagaccctgagtcagataaacagatgcctaacagaattcatacaagaattgttttatgtttcttctgtgttctgggtcttcctaggtgactgtgtgtatctgatgagggatagtcggcgcacccctgatggccacccggtccgtcagtcctatcgactgttatctcacattaaccgagataaacttgacatctttcgcattgagaagctttggaag

SEQ ID NO: 56353 - DNA, 1022 bp, Homo sapiens
tctttccttctctcctctcttcttgtttttttgttttgttttgtttataagataggatcttgctctgtcatccacactggagtgtggtggcacgatctcagctctctgcaacctctgcctcccaggctcaagcaatcctcccacctcagcctctcgagtagctgggattataggcatgtgccacgtgccaccatgcccggctaattttttgtactttttgtagagatggggtgtcaccatgttgcccaggctggtcttgaactcctgagctcaagtgatctgcccacctcggcctcccagagcgttgggattacaggcatgagccaccacgcctggctctttccttctttctgcccactttccactgtacacttctcacataatctggatcaaggaaaatgacagtatttcatatagtgctttgccttttgaatcattagtgataatacactctattaattgaatcctctgatagagtgaaatatgttaatacatgtagggctcctgatgaagaagtcaaagcctggatttgagccttagtgtccccactaatatatgtgaatgcataactttatgtgtaaagtggctgtaagtaacgcacaggattgttgggaggctaaagttagacaggagtaaataaaacattttgtagctgtattctgaaagcagaatagctgtagcatttacttaaattacttagtaatagttcagtagtctatttgttttcctattctctgtccatctccccattttatttgcccagatctatagattatgagtcaatcggtatacttttgcttagaacagtcattattttgttttcctcctattttaccatttatctctaatttatcattcacccagttatcccttagttcctcttttactttaccctgacctattgctaattttttattctgggctcccaggacactctcaataagtcatagcctccatgttccccaaactgtatgtttttctacaggtatggcagcactgtgattgtatgggagtgaactcag

SEQ ID NO: 56354 - DNA, 1086 bp, Homo sapiens
gataataattgtcttttaaaattttctcatgccgggcacggtggctcatgcctataatcccagcacttgggaggccaaggcaggtggattacttgaggtcaagagttgaagaccagcctagccaacatggcaaaacccgtctctactaaaaatacaaaactggtggcgtgcccctgtaatatcagctactcgggaggctgaggcaggagaattgcttgaacccagaaagcggaggttgccttgagccaagattgtgcccctgcactccagcctgggtgacagagaaagattccgactcaaaaaataaaataaaataaaattttctctaagtatctagtagactaccatatttctattacttcttgtcaggagaagtctggtaccagttatttaaacatggccagataaggaagtccccatatctctttttttaattgctatggttttttttttttaagtagacaattatttgtaggaaaacttttttttcataataaaattatctttaaacttctctttctagctttaatgaagcaccagttgagattcccagtccttctgaaaccccagctaaaccttctgaacctgaaagtaccttgcagcctgtgctttctctcatcccaagggaaaagaagcccccacgtcccccaaagaagaagtatcagaaagcagggctgtattctgacgtttacaaaactacagagtaagtagtagtacctattagctaacatccctttttcttccacatttggaaaaatactttgactatcaaaaaacaatatagattcttttgtgtttcataagcgtgatgattgtgtttttgcactcatgtatgaggtacgcctccctcaaactttgtgtcaaggtcaatacattaccctttctgatgtggggggaaatcagtacaaaagtaatatgcacaaataccagtgttcactgtactactgtactgtcttatgttgtatgagactaattgtctttctgatggttatcttctctctgcctttctagattgagattctaatgatgcttttcttttctttttttgtttttttttttttttttgagacggagtctcgccctgtc

SEQ ID NO: 56355 - DNA, 1022 bp, Homo sapiens
acatcttcttgctatgttccttaggttgatctcgaattccttagctcaggcattcctcctgccttggcctcccagaatactgggattacagacatgagccactgtgcccactctttatccaacatttaagtcccttagcttaactggaccttaatttattttttatttattttttatttttgaccttcatttttgaagaattaaatttttttctttctaatccttacctcaaagtgagagttgttctttttaaatttacatattattagagaaatataggccaactttggttttatcttgttgtaataacctttttcaggaaagtaaaccatcaatttacctatgatgtgtaatcttgctatggaaaatagagtagtactcccttttatctgtgtaaaaacttatttaaataactagccgtgtccaattttgtctatgtgtgatttattgtctctttcagtaaacggagttccctctcgaagtccaagattagttgcttctggggatgactctgtggatagtctgctgcagcggatggtacaaaatgaggaccaagagcccatggagaaaagtattgatgctgtgattgcaactgcctctgcaccaccttcttccagtccaggccgtagccacagcaaggaccgaaccctgggaaaaccagacagccttttagtgcctgcagtcacaagtgactcttgcaataatagcatctcactcctatctgaaaagttgacaagcagctgttccccccatcatatcaagagaagtgtagtggaagctatgcaacgccaagctcggaaaatgtgcaattacgacaaaatcttggccacaaagaaaaacctagaccatgtcaataaaatcttaaaagccaaaaaacttcaaaggcaggccaggacagggaataactttgtgaaacgtaggccaggtcgacctcggaaatgtccccttcaggctgtcgtatcaatgcaagcattccaggctgctcagtttgtcaacccagaattgaacagagacgaggaagg

SEQ ID NO: 56356 - DNA, 1020 bp, Homo sapiens
tacagattaaagggctggcagaaggggatctaattagatagttactagttatggctgaggataaaaagttgagacttaaaggatgagaagccacagtgaagtccaggcgcggtggctcacgcctgtaatctcagaactttgggaggctgaggtggccagatcacttgaggtcaggagtttgaggccagctggccaacacggtgaaaccccatctctactaaaaatacaaaaatcagccgggcatggtggcacgtgcctgtagtcccagctacttgggaggctgaggcaggagaatcgcttgaacccaggaggcggagattgcagtgagcccagatcacgccagtgcaacagagtgagactgtatctcaaaaaataaaaataaaaaaaaagccacagtgaagaacatgttttaagattctcagttgggaaggagtttagatattggataaactgaaaaaagcttcatcgtggtgaaagaggaaatacagagagagtagtgagaaatgtggcaaaagaagagaccaaacaatgtgttaagaattttggattttatattaagaacaaaagacaaaggagtattgattttaggtttgcatttttaaatgatgattttgccttctgcatgaacactggatggagaggataaaaataatttgaaggaaactggttaataggcaattgcagtagtctagataacatgatggtgcttagattaggttagtggcaggcttatgtctgaacatatgggagattggagataacatgcactaagagagagaagactataggaggagcagatttagaggagaacacagtttttttttttcttttgtttttgagacaggctctcactctgttgcccaggctggagtgcagtggcacgatcttggctcactgcaacctgtttcctgggctcaagccattttccagcctcagcctcctgagtagctgggactacaggtgcaagccaccaatgccaggctaatttctttgtatttttgtagagatggggtttcgcca

SEQ ID NO: 56357 - DNA, 5049 bp, Homo sapiens
gtgtaaggtttactccctctttaacttttttcttgttcaaattttaggacccttcaaagttgtacaagaaagcagatgatgttgcagccattgaatgccagtctgaagaagtcatccgtcttcattcacagggagaaaacaatcctttgtctaagaagctgtctccagtacactcagaaatggcagattatattaatgcaacgccatctactcttcttggtagccgggatcctgatttaaaggacagagcattacttaatggaggaactagtgtaacagaaaagttggcacagctgattgctacctgtcctccttccaagtcttccaagacaaaaccgaagaagttaggaactggcactacagcaggattggttagcaaggatttgatcaggaaagcaggtgttggctctgtagctggaataatacataaggacttaataaaaaagccaaccatcagcacagcagttggattggtaactaaagatcctgggaaaaagccagtgtttaatgcagcagtaggattggtcaataaggactctgtgaaaaaactgggaactggcactacagcggtattcattaataaaaacttaggcaaaaagccaggaactatcactacagtaggactgctaagcaaagattcaggaaagaagctaggaattggtattgttccaggtttagtgcataaagagtctggcaagaagttaggacttggcactgtggttggactggttaataaagatttgggaaagaaattgggttctactgttggcctagtggccaaggactgtgcaaagaagattgtagcaagttcagcaatgggattggttaataaggacattggaaagaaactaatgagttgtcctttggcaggtctgatcagtaaagatgccataaaccttaaagccgaagcactgctccccactcaggaaccgcttaaggcttcttgtagtacaaacatcaataatcaggaaagtcaggaactttctgaatccctgaaagatagtgccaccagcaaaacttttgaaaagaatgttgtacggcagaataaagaaagcatattggaaaagttctcagtacgaaaagaaatcattaatttggagaaagaaatgtttaatgaaggaacatgcattcagcaagacagtttctcatccagtgaaaagggatcttatgaaacctcaaagcatgaaaagcagcctcctgtatattgcacttctccggactttaaaatgggaggtgcttctgatgtatctaccgctaaatccccattcagtgcagtaggagaaagcaatctcccttccccatcacctactgtatctgttaatcctttaaccagaagtccccctgaaacttcttcacagttggctcctaatccattacttttaagttctactacagaactaatcgaagaaatttctgaatctgttggaaagaaccagtttacttctgaaagtacccacttgaacgttggtcataggtcagttggtcatagtataagtattgaatgtaaagggattgataaagaggtaaatgattcaaaaactacccatatagatattccaagaataagctcttcccttggaaaaaagccaagtttgacttctgaatccagcattcatactattactccttcagttgttaacttcactagtttatttagtaataagccttttttaaaactgggtgcagtatctgcatcagacaaacactgccaagttgctgaaagcctaagtactagtttgcagtccaaaccattaaaaaaaagaaaaggaagaaaacctcggtggactaaagtggtggcaagaagcacatgccggtctccaaaagggctagaattagaaagatcagagctttttaaaaacgtttcatgtagctcactatcaaatagtaattctgagccagccaagtttatgaaaaacattggacccccttcatttgtagatcatgacttccttaaacgccgattgccaaagttgagcaaatccacagctccatctcttgctctcttagctgatagtgaaaaaccatctcataagtcttttgctactcacaaactatcctccagtatgtgtgtctctagtgaccttttgtctgatatttataagcccaaaagaggaaggcctaaatctaaggagatgcctcaactggaagggccacctaaaaggactttaaaaatccctgcttctaaagtgttttctttacagtctaaggaagaacaagaacccccaattttacagccagaaattgaaatcccttccttcaaacaaggtctgtctgtgtctccttttccaaaaaagagaggcaggcctaagaggcaaatgaggtcaccagtcaagatgaagccacctgtactgtcagtggctccatttgttgccactgaaagtccaagcaagctagaatctgaaagtgacaaccatagaagtagcagtgatttctttgagagcgaggatcaacttcaggatccagatgacctagatgacagtcataggccaagtgtctgtagtatgagtgaccttgagatggaaccagataaaaaaattaccaagagaaacaatggacaattaatgaaaacaattatccgcaaaataaataaaatgaagactttaaagagaaagaaactgttgaatcagattctttcaagttctgtagaatcaagtaataaagggaaagtgcaatccaaactccataatacggtatcaagtcttgctgccacatttggctctaaattgggccaacagataaatgtcagcaagaaaggaaccatttatataggaaagagaagaggtcgcaaaccaaaaactgtcttaaatggtattctttctggtagtcctactagccttgctgttcttgagcaaacagctcaacaggcagctgggtcagcattaggacagattcttcccccattactgccttcatctgctagtagttctgagattcttccatcacctatttgctctcagtcttctgggactagtggaggtcagagccctgtaagtagtgatgcaggttttgttgaacccagttcagtgccatatttgcatttacactccagacagggcagtatgattcagactcttgcaatgaagaaggcctcaaaggggaggaggcggttatctcctcctactttgttgccaaattctccttcgcacttgagtgaactcacatctctaaaagaagctactccttccccaatcagtgagtctcatagtgatgagaccattcccagtgatagtggaattggaacagataataacagcacatcagacagggcagagaaattttgtgggcaaaaaaagaggaggcattcttttgagcatgtttctctgattccccctgaaacctctacagtgctaagcagtcttaaagaaaaacataaacacaaatgtaagcgcaggaatcatgattacctcagctatgacaagatgaaaaggcagaaacgaaaacggaaaaagaaatatccccagcttcgaaatagacaggatccagactttattgcagagctggaggaactaataagtcgcctaagtgaaattcggatcactcatcgaagtcatcattttatcccccgagatcttctgccaactatctttcgaatcaactttaatagtttctatacacatccttctttccccttagaccctttgcactacattcgaaaacctgacttaaaaaagaaaagagggagaccccctaagatgagggaggcaatggctgaaatgccttttatgcacagccttagttttcctctttctagtactggattctatccatcttatggtatgccttactctccttcaccccttacagctgctcccataggattaggttactatggaaggtatcctcccactctttatccacctcctccatctccttctttcaccacgccacttccacctccttcctatatgcatgctggtcatttacttctcaatcctgccaaataccataagaaaaagcataagctacttcgacaggaggcctttcttacaaccagcaggactcccctcctttccatgagtacctaccccagtgttcctcctgagatggcctatggttggatggttgagcacaaacacaggcaccgtcacaaacacagagaacaccgttcttctgaacaaccccaggtttctatggacactggctcttcccgatctgtcctggaatctttgaagcgctatagatttggaaaggatgctgttggagagcgatataagcataaggaaaagcaccgttgtcacatgtcctgccctcatctctctccttcaaaaagcttaataaacagagaggaacagtgggtccaccgagagccttcagaatctagtccattggccttgggattgcagacacctttacagattgactgttcagaaagttctccaagcttatcccttggaggattcactcccaactctgagccagccagcagtgatgaacatacaaaccttttcacaagtgcaataggcagctgcagagtttcaaaccctaactccagtggccggaagaaattaactgacagccctggactcttttctgcacaggacacttcactaaatcggcttcacagaaaggagtcactgccttctaacgaaagggcagtacagactttggcaggtaagagggttattttgttacctgttatttgttaaagaaataggttattttccacaggtgcctgataaatgtagatgaacttttaatatatatatctttttttgttttttaataagtgtattttgaaatctcagtattccttttccttaagatttaagaagtagggaatgtctatattatttttttgttttgagaagagctattgtcaaaaagaaaaaaagaaagaaatatacataacttttggaaaccaggaaaaatcattcatcttttttatgtagacaggttattacacaatttttataaagacaaatggctcataggtctgttagtagtatgcaggatctcccaccaccccctgcccccaccaccccaagaggtaaaaggtaatgctggaaggatttttaatgtatattaatccagtagttataaatgcatctt

SEQ ID NO: 56358 - DNA, 1036 bp, Homo sapiens
cttatgttaatcagtagttgcctcttttctgataaatttttgttatgatctgttctgcagagaaagatgctggtttcgagttttggagatccttgttttttatggaacacagttctgtaaaattttcataagattccttggcaataacatacgcttgtgatggaccctagaaatactgctatgttaggattgggttctgattccgaaggtttttcaagaaagagtccttctgccatcagtactggcacattggtcagtaagagagaagtagagctagaaaaaaacacaaaggaggaagaggaccttcgcaaacggaatcgagaaagaaacatcgaagctgggaaagatgatggtttgactgatgcacagcaacagttttcagtgaaagaaacaaacttttcagagggaaatttaaaattgaaaattggcctccaggctaagagaactaaaaaacctccaaagaacttggagaactatgtatgtcgacctgccataaaaacaactattaagcacccaaggaaagcacttaaaagtggaaagatgacggatgaaaagaatgaacactgtccttcaaaacgagtaagtagaattcctaacaatatgtggttattgacaatattttcatttccctattaatttttatcctatatatgtatttccgggagtttgattttaatctatgttatttccagatagtttgtttttgtgagccttaaaataagccccaaggcttgtcaaagatgtaagttaatagcataaccatgtatgtatttgtacttgtaaaattattttaaaattttatttatttatttttttgagattaagttttgctcttgttgcccaggctggagtgcaatggtgtgatctcggctcatggcaacctctgccttctgggttcaagcagttctcctgcctcagcctcccgagtacctgggattacaggcacccaccaccacaccgagctaattttgtgtttttagtagagacggggtttcaccatgttggccaggctggtctcaaactcctgacctcaggt

SEQ ID NO: 56359 - DNA, 1034 bp, Homo sapiens
cacggtgagtagaacgatttgggccggcattcgggcctaagcactctctcagcgattgaatcctgggctttctgggagccactgtcatctcccggacctggatctctgagagagcagtggtgaagatgggggaggggagagcagggagggggatcctgagcctaccgggaagtccctccaggcggggtgaaggggtgtccctgacaggcagactcccggagggggctgggaagtaagcgagtggaggcggagtcggctgtgcccctgacaggttagtttgtgtttgtaggcatgatcggagcctcccccatagtccagtttgtgtgtgtttaattaagggataagagtggtcgaggacacgatcttgagaggggattttacctgtgtgacaaggtctgtggtgtccctgccgcgttgaacggtatgtgggaacgacaggatgatctcagtgttgtaagtttaataaatgtcactggttagtttgtacatggaaagagatgtttttggtctagcagacagatggtctgttggtgtgtagcggctgtgttggtgtgtgtatgtgaggatggcaagtgtttccgtaagagtttgcctttatttgtgtaagtgtaatggagttccccttataagttagcttatttcttgaataaatgttgggaggttccttgcaggttgatatgtgtgtgtattttagggattgggagcccctagttacttgttgggaaagagcggcaatggtagtgttctgtacagcatgtgtctgtgaggtcagggaggggagaaacttggcatagccagttgtggtcttaagaatagtttgtgcctttggttagagtgagttgtgtaaatgtgaagggccaaaatatctttaacagaatcattactacaaagttgtaaagaatgggtggccttatttgttgtcgcgggtttatagtaatagtttacaatacaataagaaagctctttcagtttttttgtgatactgaatctctgtgaaaatggtaggatgctttcttccattttacaaaatagga

SEQ ID NO: 56360 - DNA, 1058 bp, Homo sapiens
ttaaccctcctcggatttctcgaatttcacaccactgtccatatgcgatgatgtttgtttgcccttgacgcacttactcatggatggtacttcttcagcctcgttagacagcctggtgatggaggatgaagaaaccatgtgcttttcattcagttctggacttagtctcccttttcttccttcagcaagttatttttgttagttccttatcaaaaagtgtacataaaaattaggcaactccaaacatgcctccagggttaatgtgtgaaataataagataatatatgtaaagtggaattagctcctaggcatagggaaagtgcagaatattgccgtgttgtcatttacagttctgttgatgtcgataacgtttgtgggtgtaattggtagtgttctgtccctccaaggagttaataaaacaaagcaaacataggcctgttaggtttctgtggctactgaatatttgtttctcaaaacacttgactgatatttgataattgaatgcagcagaaatacggacgattaaagtccacaaataattccaaagtttacttgatctagtagtttttacctttacctaaagggtaaagcagaataaattaccggaaggatctacttgggtttccctttccttcacatttgtggactcctggggatccaggaagtaattcagaaatgactgttcaaaagcccatgcaaggccgggcgcggtggctaacgcttgtaatcccagcgctttgggaggccaaggtgggcggatgacctgaggtcaggagttcgagaccagcctggccaacatggcaaaatcccgtctctactaaaaatacaaaaattagccaggcgtggtggtggacgcctgtaatcccagctactcaggagactgaggcaggagaatcgcttgaacctgggaggcggagattgcagtgagccgagatggtgccattgcactccagcctgggcaacaagagcgaaactccatctgagggaaaaaaataaaaataaaaagcccttgcaacctccaaaattcaagtagacagtcccaaatttcccctttagga

SEQ ID NO: 56361 - DNA, 1045 bp, Homo sapiens
gcgaagtcccacagtaggccgtgagcaagctgaggagcaagtaagccagtccaagtcccaaaacttcaaaagtagggaagctgacagtgcagtcttcagtctgtggctaaaggcctgagagcccctggcaaatcactgttgtaagtccaagggtccaaaagctgaagaacttggagtccagtgttcgagggcgggaagcatctagctcaggagaaagatgaaggctggaagacccagcaagtcggctcatcctaccttcttctgcctgctttattctagctgccctggcaggtgattagatggtgtccacccacactgagggtgggtctgcgtctcccagtccactgactcaaatgttaatctcctttggcaacaccctcacagacacacccaggaacaatactttacagcctttaatccaatcaagttgacgcttaatattaaccatcacggtgatcttctagattggctcacaaatgctctttcagaaactgcaggatgttcattctggaactgtacagaggcaattgtacagatggttgttttctctggaaacaacagtctacttgagtgataacatatataaaactttaagaactaaagattccattttgctgtaggccaggcatggtggcttacacctgtaatcccagcactttgggaggccaaggcaggcagatcacctgaggtcgggagttcgagaccagccagaccaacatggagaaactccgtcactactaaaaatacaaaattagccaggcgcggtggcgcatgcctgtaatcccagctactcgggaggctgaggcagcagaatcgcttgaacctgggagacagaggttgcagtgagccaagatcacaccattgcactccagcctgggcaacaagagtgaaactccgtctcaaaaaaaaaaaaaaaaaaaaaaagattccattttgctagcttttaatttgcttcaaaaagtacctgtagtttcagctacttgggaggctgaggcaggaggatcatgtgggcccaggaatttgagactgtccggggcaatatagc

SEQ ID NO: 56362 - DNA, 1028 bp, Homo sapiens
aaacaaccctgcttatgtaacatccacattttctgacttacctttcaaacctgccagaaagcagaagtgatatttaatacacttggtatgttttatatattgattctaatgataatgtttagtctaagatggacctgacaaggccaggcatagtggttcaacagcactttgagaggctgaggcaggatgattgcctgagcctaggagttcaaggttacagtgaactgtgatcacatcctgccttctagcctgggtgacagagcaagaccctgtctcaaaaaaaaaaaaaaaaaagaaaagaaatatatatatgagaaactaaagtcatttcccataacttaaaagaggcatagaatatttcgagttgaatacagtttctgcctggcttgttttcttctgcctcttttttttaaagctcatctttgggtgaaaaattgtcgggatcttctgcagtccagctacaacaaacagcgctttgatcaacctttagaggcttcaacctggctgaagaatttcaaaactacaaatgagcgcttcctgaaccaggtgactagactcccagaagttgagtgctaggtagtccttacatggattctttgtgccctgagtaccaatagactatggagaactgatactggagttggaataactgtatcatttttaatttctttcatacgttttgctcacagtggactcataacttgaaactcatttatccatgtgaaataaataggcaacagtaagttgttcccattttgtgggtagcaaagtgaaatccagttgattcattgacttttcaaggtacagcctccaatccctcgcaagcacatttccaactacatgattttctccagacaatatctttttagggaaccagaaatgtattggaaaaattcttctttaccctggtgattcttagataccctgtctagaccaggggccttcaactctggatataaagcagagtcacctaagagcttgttaaaaatgcagatgccagagtctcattctggacattttcatcagaa

SEQ ID NO: 56363 - DNA, 1302 bp, Homo sapiens
agagcgagatatggtctcaaaaaaaagataaaagaggtcaggcgtgtggctcagacatgtaattccagcattttgggaggccgaggtgggcagatcacctgaggtcaggaattctagaccagcctggccaacatggcgaaaccccatctctactaaaaatacaaaaattagccaggcgtggtgacacacgcctgaaatcccagctacttgggaggctgaggcaagagaatcccttaaacctgggaggtggatgttgcagcgagctgagatcatgccactgcacttcagcctgggttacagagaaagaagctgtctcaaaaaaaaaaaaaaagaaagaaaagaaagcattcacttctacattgaggtctcttacagaacctgaacaatagattaaaatgaactcctgttaaccttagcctccaaccttttcaagggatggtttcacccttaggccaagtagccttttttttggtttttattttctttgcttgcttttagataaaagttcaagagaagtatgtctggaataagagagaaagcactgagaaagggagtcctctgggagaagtggttgaacaggtataagaaaaaacactgaatgtgtaacatgcgataacaagagaaggcctctggtagcactacaatccactgtctctcccaatagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccggtaggaaaactgggtgtctctatcttgtttctctgatttctgattccatcagtatggaggctgggtcttagccttgtagaccatgcaatatgttttcttgccctaggaatatttgaagataaacagtaaagagctgggtgcagtggctcacgcctgtaatcccattggctcacgaggctgaggtgggaggatcgcttgaggccaggagttcaagactaggatgggcactatagcaaggcccctgcctctaaaaaaataagaaattagccggtagctggcatggtggcacacacctgtagtcactgctactggaaggctgaggccagaggatcacttgagccctggagttcaaggttgtagtgtggcatgattgcaacactgcacaccaacctgggtgacagagtgaaatcctgtctcttaaaaaatatatatatggctgggcacagtggctcatgcctgtaatcccagcacttggggag

SEQ ID NO: 56364 - DNA, 1073 bp, Homo sapiens
tggggtgagggtctagaagtaagatctcttgggagatgataattacctcagaacgtaatttggatatggtagcctctgactacacgatattctggggaacacagtgcagcaggaggaaactgccacttacctgtgtttgtctccattttagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaagtgttgtgttagattaataatatggaaggagtctttagattggccaaattgcatttctctgatattcctcttgttgcaggtcagaagagatcaattctacagaaatttccagtggttctgttgaggctttatggaattcagcatgtcaaaattcacagctggctgggcacagtggctcatgcctgtaatcccagcactttggaagcccaaggcgggcagactgcttgagttcaggagtttgcaaccagcctgggcaacatggtgaaaacctgtctctactaaaaatacaaaaattagccgggcacggtggcatgcgcctgtaatccaagctacttgggaggctgaggcaggagaattgcttcaacttgggaggcggatgttgcagtgagccaaaattgcaccactgcactccagcctgggcagcagagcaagactccgtctcaaaataaataaataaataaataaataaataaataataaatgtatactgtactgttttacatgaccgacttcagcatctaaggatgttgctacctggaggaagtggga

SEQ ID NO: 56365 - DNA, 1065 bp, Homo sapiens
ccgttatcttcaagaccctcccactttaccgagctccaggaccggagatgaggagctgagcacaacatgccaacactcgaggggcccacgacagttgctcaagagccatttcgggaataggctgctaggccctggagacagtgaggacttgaactgcagcactcctgtcagacccctggatgtggttccccccgcgtcccacagctaatgactaagctgggaaccgaaagatggaatctagattctcctaagccaaggtttttcccccaactagtgtatatcccagaaagcttggaagagccaagtgctggagagatggtgacagcaggttgtcaggtgatcagaggaaggttagctagaggggaagggtgcccaggctttgacctaacattgtctctgttatttctgtacaggtagtttgagctccctaaaagaggaaggtggactctacagggacaaacagttggatgctgcaatagcatggtgtgtaactgatgtatggataagggtggggatcgtgtatgtacgcagaacgctggataactctgatcagagtgcagtttctttgatcaatctccaaactctttcaggcaggggaagctcaccacacacaaagaggaactctatcccaagaacccttatctccaagactttctgagtgcagaggtgagggcctctgtcctgaactttttaacccggtgccacaacctgagggtctccataggggcaggtaaacggggattttaatcattttaaatgtcttagaatgatattttgggaaaaagcactccttttcctaaggactgcgactcggtgaacagaaaggaggctatgcggtgtggccagccaactcaaggaggatgaagcaacctttgcctctaaactgcctggaactaaatgtcgatttttctgacccctcccagggagtgctgagtagtgatggtgtctggagggtcaaatccattcccaatggcaaaggtgagacttctccagatactgatggatgggggcttgggtagagcagaaacatggagaaaggtacatttcctctgcttgtcttcaggt

SEQ ID NO: 56366 - DNA, 1383 bp, Homo sapiens
tctctactaaaaatataaaaactagtcaggtgtggtggtgggcacctgtaatcccagctactctgaaggctgaggcaggagaattgcttgaacccaggagacggaggttgcagtaagctgacacagtgccactgcactccagtctcagcaacagagagagactccgtctcaaaaacaaaaaaaaaagaccagtgaatacagccctcctcctttcttaggtttcccaccgttttcgagaactcatgcagctcttccacactgcctgtgaagccagctctgaggatgaggatgatgcaaccagtaccagcaatgcagaccagctgtctgaccatggggaccttctgtctgaagaggagctggatgaatgagactctgggaatcatctacacaggaccaaacccaacaggcgccctggcaccggggagggggtagttgtactctgcttgtacagtccttgagcccagtttacagatctggagagcaggaggccaggacaaggacaaaggctggaggatggagtaggacccaggggctctgccatcctaggcatcattcaaggtcttttatgaagactttacagatgtcctctgtaaatagcatcgagagtggagttcagctcctttctctacttttttttggtctgatggcacatatttattgttctgtggtctaatcacagtgtttctaaatgtaaaaagtgcatatgttggtgtagctagtcccgcgacattgagctcctctgcatgaagacactgggctcctgcatccagctgtttttattgcaaactagctcctttctcccacactgggaactttagtccacgaggctgtcaccaccctggtagcactgggccaggctttgtagctcctgcagcagctctgctacgtcatcgtgctccactccagcatccatgaagctggcccagcgccgcaagtcgagtttggtgaggtctctggccaaggcttccagggtctggtgcagggacgaagaggaacacagtgccccaaacactgggatgctctccactgctgtggagggagaggaaacagagacctgtagatggatgattattctgccctgggactcgccaaactgataaggaagtccaaccttagtagacttgattgtaaactcaacaaatttggtgtattgtccccttagtacaccagtactccagaggaagaatgcttttcttgggagccatagggtgaataaaggaatgtttaactgtggactttttcagcacttttaatccaggaatggagatagtaaaacctctcccatacttgaaatctcagttttcttcacctcctacatacctgctcccttgggggaaccatccagaaccatacccggtggactgcagcttgagaagaggtggg

SEQ ID NO: 56367 - DNA, 1050 bp, Homo sapiens
ttttattatttatattttcttgtagagatggagtctcaccatattgcccaggctagtctcaaacccctggcagtcccaccactttggcttcccaaagtgcggacattataggtgtgagccaccatgcccagccctcttttttattagaatttttgcacagtacctggccacaggtaatttctcgtgcttaggtgcatcttgaacctgacagtaccctgagatccttattttcctcctaagcaggattggcagtggggagcactttgccatcccctcgagaagtgactgttacagaacggctcctcctggatggcccaccacctcattcaccagagactcctcaatttccccccacaactggagctgtactgtacactgttaagagaaaccaggttgggcctgaggttcgctcctgccccaaggcatcccccagacttcagaaagagagggagggccaaaaggcagtgagtgagtcagaggctttgatgctggtctgggatgcatcagaaactgagaaattgcctggtaccgtggaaccccctgcttccttcctgagtcctgtttcctcaaagaccagagatgcagggagaagacatgtgtccgggaaaccagacactcaagagagatggctgccctcaagcagagctcgggtgaagacaagagacaggacgtgccctgtccatgaatctccatcaggaattgacacctcagagacttctcccaaagcccctagagggggtttggctaaagacagtggaacacaggccaagggtccagagggggagcagcagccaaaggccgcagaagctacggtgtgtgccaacaacagcaaggtcagctccactggggaaaaggttgtcctgtggacaaggtaggtaagggtggatgacgtgtgtttggaaaagagcatagaccacatccatgtggctccctagggttaatcatgatacctgggttacagggaagctgaccgtgtgatcctcaccatgtgccaggagcaaggggcacagccacagaccttcaacatcatctcccagcagctgggaaata

SEQ ID NO: 56368 - DNA, 1103 bp, Homo sapiens
tttaattctcacagtaatcctatggagagattgctcttgtttgcattttacagaagacataactgaagtgcagagaggctgttgtcagggtctcatatttagtaagtggtggtgctaggatatgaactcctcaggtaagccatctgtggagtctactggttgtcactgctcttcaagcagtattttttttttttttttttaattcgtgtttcctgaccaagcgttttttctcttttctggggagaaactgcttcttagtagctgtatgaccttgggaaacgtatttaacctctctttgtttcagtttcttcatcataaattgggatgataatggtacttacttacgtcttgggtttattaaacagtgtcactgagtaggctttccatgggtacaaagttctctctgaaggggattggaagagatgggagagctgaagtcacagagagacagaaacaaagacattatatctcatgatggagctctccagtgattttgcctcagattatgtctgacttaaatatttcttgaaacatctggggcaattgggatatgtcagtctttaggtcatttagggattgtttcagggattcataataggccttaatctagtttgggctattgatttccccaggcgatgtgaggagttgatacataaaagaggatggggtccgggcgtggtggctcatgcctgtaatcccagcattttgggaggtcgaggtgggtggatcacttgaggacaggagttcaagaccagccagagtaacattgcgaattcctatctctactaaaaatacaaaaattagccataggctaggtgctgtggcttacacctctaatgccagcactttgcaaggccaaggcgggcggattacttcaggtcaggagttcgaaaccagcctggtcaacatggcgaaatcccatctcactgaaaatacaaaaaaaattaggcttagtggcatgcgcctgtaatcccagctacttgggaggctgagacatgggaatcgcttgatcccggggagtggaagttgcgctaagctgagatcacgccactgcactccagcctgggagaaagagcgagactccatctcaaaaaaaaaaaaaa

SEQ ID NO: 56369 - DNA, 1765 bp, Homo sapiens
gctaccactgtgaagattgtgagccttggcggtggctgtaacatgatccagcctgtcaatgcggctgtggcccagagtccccagactattcccatcactaccctcttggttaaccctacttccttcccctgtccattgaaccagtcccttgtggcctcctctgtctcacccttaattgtttctggcaattctgtgaatcttcctataccatccacccctgaagataaggcccacgtgaatgtggacattgcttgtgctgtggctgatggggaaaatgcctttcagggcctagaacccaaattagagccccaggaactatctcctctctctgctactgttttcccgaaagtggaacatagcccagggcctccactagcagatgcagagtgccaagaaggattgtcagagaatagtgcctgtcgctggaccgttgtgaaaacagaggaggggaggcaagctctggagccgctccctcagggcatccaggagtctctaaacaaccctacccctggggatttagaggaaattgtcaagatggaacctgaagaagctagagaggaaatcagtggatcccctgagcgtgatatttgtgatgacatcaaagtggaacatgctgtggaattggacactggtgccccaagcgaggagttgagcagtgctggagaagtaacgaaacagacagtcttacagaaggaagaggagaggagtcagccaactaaaaccccttcatcttctcaagagccccctgatgaaggaacctcagggacagatgtgaacaaaggatcatcaaagaatgctttgtcctcaatggatcctgaagtgaggcttagtagccccccagggaagccagaagattcatccagtgttgatggtcagtcagtggggactccagttgggccagaaactggaggagagaagaatgggccagaagaagaggaagaagaggactttgatgacctcacccaagatgaggaagatgaaatgtcatcagcttctgaggaatctgtgctttctgtcccagaactccaggtgagagctggagaatattctcaagtatttcgtggactcagtaatatgtatcacttattgatatgccacctgcttgcttgctgcactatggatagtcctaaaatcatttgtatttgatttgtgaatgcattatgggacatgattgtggagttgaggtgaaatgagatggaaaggatgaaattttacttattatattaaactcgtttacacattaaattgaatcacctgaccatactttaaatgccttaaaaaatagtaataggctgggcttggtggctcactcctgtagtcccagcactttgggaggctgaggtgggtggatcacaaggccaggagtttcagactggcctggccgacgtggtaaaaccccatctatattaaaaataacaaaaattagccaggcatggtggcggacacctgtaatccctgctgcttgggaggcagaggcaggagaattgcttgagcccgagagacagaggttgcagtgagccgagatcacgtcattgctctccagcctgggcaacagagcaaggctctgtctcaaaaaaaaaaaaaaaaaaaaaaaaaaaaaaatagtaaataactgggcacggtggctcacgcctataaatcccagcactttgggaggccaaggcgggcagatcacctgaggtcgggagttcaaaaccagcctgaccaacatgaagaaactccatccctactaaaaatacaaaattagctgggcgtagtggcacat

SEQ ID NO: 56370 - DNA, 1045 bp, Homo sapiens
ggccttatcttcaggggtggatggtataggaagattcacagaattgccagaaacaattaagggtgagacagaggaggccacaagggactggttcaatggacaggggaaggaagtagggttaaccaagagggtagtgatgggaatagtctggggactctgggccacagccgcattgacaggctggatcatgttacagccaccgccaaggctcacaatcttcacagtggtagcaggaacagtgaagataacagatgcagggtggtggataacaggggcaggtttcatacagggagaggccttgactcctcttctctttgagggtctccgtctcacatatggctttcgaaacttagaaggggcaagggagggcagcattaccttgggcacaggggcagaagagagcaaagtctgggactcagacagagggaagcttgtcctggcctcagggggcacagcaggcagtgctgcaggagactcaaaactctcacctccactgacccccagtggagggacacctggaactgtctgtaaaacagtggctggctgtattgggtgaggaatccggagcaccattttgctcggaggggcttctgaatgagttgatcgggctggtgttttcccagggttgaagctgggctggagagaggggctgggttggataaggaggggcttcaggactgatgaacgcttctgtctccaagccttcctggggaaacgggtggcaactggcttcagtttcaggactacacccttaggcaatagcagtgggtaccgagattcactccccaactccaaattgtctttttctaggcttcgatctgagttgatctcagtggttccagtcatatttcctacctctctagcaccatcagccatgtgccgcagttcttcctggatggatggcagactggcctattggaaacaagaacactctgatccagcatatgtcagaatttgggaaaaagaggcttggcacagtggctcacgcctgtaatcccagcactttgggaggctgaagtgggcagatcacttgaggtcaggagtt

SEQ ID NO: 56371 - DNA, 1049 bp, Homo sapiens
tcaggagttcaaggctgcagtgagctgtgactgcctgggtgacacagtaagattctgcctctaaataaataaataaataacataaaataaaataaaagcgaacctcctgccttggcctttcaaagtgctgggattacaggtgtgagccaccatgtccggtctaaaatgctttaaaaatgtgtgtgacatctcccaaaaagcagtatttggcactgctagaacaagcacgtcctagagggctctgctcatctatattgcttttccttttgtcttttgtgtccgtgtcttattatacaagtcttacttcccctaaactcctcaaaggaactacatcttctccttgggatgttctgctgttttgatcccccagagtaaacacttacttgtcctcagccttggtgaagacgatcttatcctggggattctttgccttcagggaacacactggaagtaactctggatacatgaaaaccttgcttgtggccagaatccaagccacttgctttggcaaacagggaaattcattcgctataagaaaataaatctcggataaatcaacttctaggacaaaagagggcttcataaaagcctgtgaatgcatttttgcatttaggtaggagctatccttacctaacttgattccctcccatctgcccaccatccccccaaaagtttccagtctttcttaagctaacattatatctaaagggagtcccattcaatggcaataaaagttgactcattctttcttatgtggaacactttattcactaagtaaaacaaacacttaaaaagcacctagtaaaataaggtgctaacaatagcgtatgctcaaaaatgttttacctccttccccccttaaatacttgaaggataagagaccttcaacaatgctttctttcttccagaataagattccaacttctttaatctccctcacaaatctggtattccaaattttacttttatttgattcttacttaagttctcccagattcctcctgaggctgggaacaaaagaaccataaaaggaaggagacaattcagtc

SEQ ID NO: 56372 - DNA, 1033 bp, Homo sapiens
ttgtgggaatcctgaagtgagaaagttctgacattggctctttctgggtgccagcattattatagtcttgtaatctatagttttcactcttccttcccaatactggagcaacattcagaggcccattccccaggaaaaccctccctttcctttgcccacagttccaagatgagatgggattctccaacatggaagatgatggcccagaagaggaggagtgtgtagctgagcctcgtcctaactttaacacccctcaagctctacggtaggctagttgaagaccttgagatttggaatagaggaaaagtttatttctgaaaaggttttcagaagttgcaattgataatttttcatcccaaaccagcttctgttactgatgtaaggatgcagagccctgtcaggagttaggtgtcaagtgaagtctccttgttatggggcagtgcagctgtaggccaagctatatccgtttgggaagggagaaaaaacagtagctggcatccatatccacttctccgggtgagtggtgctggagaggtatgtaggactcaatgtggccagccacacaaactaccccatattgtaatatcctgtctgtcccttttgttctttttatgtgccattaatatctgctaaatgtgactgaaaatttgttagtcacctaggcattagtggagcaaaccctgaagcacctgcagtaaggagtctgaaacatacgtgctgacctttttgcctaaagttggcacttgtgttacagcatccagaaagtagaggctttaattttttcctcattttgtggtggatttgcatctgcactttattgtattgttatccattgcgagtagcagcatgtagtcattagatggatggctagatgtcaggatgcagtttgtgccataagtggaacaaagcaaagagaatagtccctgtaattcgtcctgggtttgaacctaacagcattactaagcagagagcttgggatccatctgaaagctagacctttagagatttttcaatttagtgaaaaaagataaga

SEQ ID NO: 56373 - DNA, 1073 bp, Homo sapiens
agctggaattaacaggcgtgcgctaccatgcctggctaatttttgtatttttagtagagatggggtttcgccatgttggccaggctggtctcggacttctgacctcaagtgatccacccgcctcggccttccaaagtgctgggattacaggcataagacactgactgcacctggcctttaagtttctatttaaattttattttctgttactgtaactagttgagtgatggattttatttatttatttatttatttttgagacagagtctcgctctgccacccaggctggagtgcagtggcgtgatctcggctcactgcaacctccatctcctggattcaagtgatactcctgcctcagcctcccgagtagctgggattacaggtgcacgccaccgcgcctggcttatttttgtatttttagcagagacgggtgttcaccatgttggccaggctgagtgattgatattttatgattccttctcttgagatacttcagactttgtggaatgaggtaggggcataaatattaaggcgaactggatttattttgtagagcttattggaaagtgatgttgaaagcactgcttcatctccacgtggggcaaagaaatccagattgaggcagtcttctgagatgactgaaacagatgaggagagtggcatattatcagaggtaaatcggcatcatacaaaagagatgttagacataactgtctaagtagattttttaactgtataagtagattatttatccatggtgattctgggctgtcaccctttttcaaagtttcttaagttagtaaacagttcagagaaggctagaactcagtgatagccaaagaacttttctgagttctcattaaggggccaaaaatgtgcaactagcagagtttcttttctcctacccttctcttctttcatatctgtgctttttaatattgtcctaaagccattgttattaatttcccacattttggtaaactaagtagcattctgttgacttctctagaaataggatgaaaactaattagatcaatacacttggtgtctttgtttttatgtaactctaacta

SEQ ID NO: 56374 - DNA, 1062 bp, Homo sapiens
gggcctgcaaccacgcccggctaattttttgtatttttaatagagacggggtttcaccacgttagccaggacggtctcgatctcctgaccttgtgatccgcccgcctcggcctcccaaagtgctgggattacaggcgtgagccaccgcgcccggccttgttattttattattattatttttttagagacagggtcttgctctgtcaccaaggctggactcaaactcctaagctggactcagcgatcctcccagttcagcctcttgagtagctgggactacaggaacatgcgactatgcccagctaatttaaaacaatttttttgtagggagggtgtctcactctgttgctcaggctggtctcaaactccttgcctcaagccatcctcccaccttggcccctaaagtgctaggattataggcatgagccacctcactgagctgtgatttttattgaggatttcctttctgtttttttctccttaggagcctaaaatgacacgctctaaactgaaggaagtagtggaaaaaggagtggtaagtattctgtttttttgttgttggtttttttttagcttggtgaataggatctaattcacccatagggaaaaatataggaaagattgtggtctgaatttgcctctttaaagaaatatttataaaagacagtagaattgtttctacatgatcataagctatgataatcatagtttattttagtagatatgaagcattgctttttggaattgctagatagataaccatttggaatagttgaaatcaataggtgagaccagtttttctatttatgttacaacacatgttgcaaagtgtttagtatttttcatagtgtgttccaggggccagttgcataaaaatcactttggtgtgggatccctcaggcatgcttattaaaaatgcatacttttggctgggtgtagtggctcatgcctgtaatcccagcactttgggaggccgaggcagatggatcacttgaagtcaggagttcgagaccagcctggccaacatagtgaaactctgtctctactaaaaatacaaaaatt

SEQ ID NO: 56375 - DNA, 1374 bp, Homo sapiens
tcgctctgtcacccaggccagggtgcagtggcgtggtctcggctcactgcaagctccgcctcccaggttcacgccattctcctgcctcagcctcccgagtagctgggactacaggcacccaccaccatgcccggccaattttttttgtatttttagtagaggcggggtttcactgtgttagccaggatggtctcagtctcctgacctcgtgatccgcccgccttggcctcccaaagtgctggattacaagcgtgagccactgcacccagccattgtatccctttcattccattctctcatcctttatttggtgtgtctggagatgtgtatggtcttttgtgattgggcagcagcttaaagggggagactactgcctgggacactgggaaaggctctactgagatgaatgacccttccaatttgaaagatgaattgcggtttaacagaaagtggtatgggcacataggccaagaacagtgcacagagatagactggcagaaaaggatggtgacatggttgcttggaacaggtggtgggagatgacttcttttttttttttttttttttttgtgacagtctcgctctgttgcccaggctggagtgcagtggtgtgatcttggctcactgcaacctccacctcccatgttcaagtgattcccctgcttcagcctcgcgagtagctgggattacaggtgcctgccaccacgtccagctaatttttttatttttattagagaggaggtttccccatgttggccaggctggtctcaaactcctgacctcaggtgatccacgtaccttggcctcccaaagtgctgggattacaggcgtgagccaccacgccctgccaagatgactttagagtagtagattgtactaaggttgtgaaaggttttgtttttcataccaaggcatttgagcttttcctgtaggtaggtgatagtcatttaaacgtctaagtagaacacatttatgctttagaaaagataccaacttctcttattcattttttttttgatacggagtctcgctttgtcgcccaggctggagtacagtggcgtgatctcagctcactgcaacctccacctcccctgttcaagtgattctcctgcctcagcctcctgagtagctggtattacaggcgcccgccaccgtgctcagctaatttttgtatttttagtggagatggggtttcaccaggttagccagcttggtcctgaactcctgacctcaggtaacccacctgcctcagcctcccaaagtgctgggattacaggcgtgagccactgcgcccggcctagattgtgaaggtttttgtttttcatactaaggcatttgagcttttcctgtaggtaggtgatagtcatttttttt

SEQ ID NO: 56376 - DNA, 1029 bp, Homo sapiens
acctcaggtaatccgcccgcctccgtctcccaaggtgccgggattacaggcgtgagccaccgcgcctggcccccaaattagctgttaatctaaaccactgaatcttaacctcagttttgagtaggataactccatgggcagagaaagctaagtagtgcctttaaatttttttgccaataactgacgcactaacgttgtggcttcactctgccctaaaatgggatggcgcatagtgttaggcgcatgctccttgatgcactgcggcgcggcgctccgaggctcggggacgcgcacgcaattcgctgttgttggctgacttccggtggtgccaaagccgtttccgtggaatcaggccggctggtgagggtacaggtttgtgtgtggtggggtgggaagaggcaggtgggagctgggacacctggacgaacgatgtccaggttgagaaggtcgggtctgagggtgggcgctgggtgcgtggcggaagttaagggcgtgaagtccagtgtctagttgggaatggggactggagccagccctgggcaccgaggtggaagcgcggttaggaccccttttgaaaatgttttcctaggagagggccgtgccggggctgcctccacattggcattcattcaccctgctggtccgacttgggttcccaaaaaagtggattctgtcgagctactgctgtgtttgaggtgcctggagctgaagtagctgtctttctttccttctttttctttctttctttttctttttttcccctttttttgatctcagtaattatctgtgaaataaaagagctgccctggctactcccattctatttcttataaggtcaccaccatctctcacaggaatcaacgaaatcttcatgttttattgagctttagttactgagttttaattacatcagttgattgaggggatggagaatctcccctaatgtcttggagaaacagaagggaggtttaaaactaactgtaggtcgggcgcggtggctcacgcctctaatcctagcactttgggagg

SEQ ID NO: 56377 - DNA, 1002 bp, Homo sapiens
tctggttttgaattcctggcctcaagatcctcttgcctcagtctcttgagtcgctggaattataagcacgacccactgtacccgggtacattttaaaataatatagataaggagcaaaacattattaacaaaataaatcaaggtgaccatgtctatatccataccgaataataatagtgtttagtctcaaagtattaaatgaaatagcttttagggaaagttttcacaaaatggagacagccttggtagtaagctacttgaaggcaggcaggaacaatatcctatggatctttgaatccctcaagagtctcttgcttctaataggagttcagtaaatatttggttgaacaactaattggattcagttgccattaagaatgggcacagcctaaggaagtggctctccattcatcaatcaggtgctttcctgcaaattgtttgctactcattagtgaaactgaacactgtctctatgagaagaggaacacagcaaactaccaagacaggcatattttttggaatgatcataaagagagatctgaaggcttagattaggagacacctgggcaattcttttggctctatcatagatttattccctgcagcagtgcggtggaggagcggggggcaacccactgctgcttacatatttacaatgcatcaacttttattgttagaaaatggagatagggtagaaaagagagaagatgaagaattctcatattccaggaggatagagaaggaaaagaagagaaacagatgaacgcatctttgaattatctagttgttccccctggccttgtttcctatttttgctgttctttcttcattttagtatttgttaactcttgcctctctccctgaaaccaagacaatgagctagaatcatcaaagatattaaaacctagagctctctgtcttgctttagtccaaagcttggtgggaaatggaagttgaaactaatggctgaagtgagtgttttaaagtagctataaattgcag

SEQ ID NO: 56378 - DNA, 1021 bp, Homo sapiens
gctctggatcttgtatagaccaattacccatcaaaatggactatggggaagaactaaggagccctattacaagcctgacccctggggagagcaaaaccacctctccatcatctccagaggaggatgtcatgctaggatccctcaccttctcagtggactataacttcccgaaaaaagccctggtggtgacaatccaggaggcccatgggctgccagtgatggatgaccagacccagggatctgacccctacatcaaaatgaccatccttcctgacaaacggcatcgggtgaagaccagagtgctgcggaagaccctggaccctgtgtttgacgagaccttcaccttctatggcatcccctacagccagctgcaggacctggtgctgcacttccttgtcctcagctttgaccgcttctctcgggatgatgtcattggcgaggtcatggtgccactggcaggggtggaccccagcacaggcaaggtacaactgaccagggacatcatcaaaaggaatatccaggtgagtaggaagtgtgtgttggggagcaatggtaggttgggggagaaaatatctcaggggataaatggaagtgggaggggagtgggttgggtggcaaagaagggctgtagagaggaagctcttggatgtcaaggataagcagtggtcagagtaagacagagggcctggcagatgaggtctcctctaagaagcaacttcctggtgagagaaggttcaatagctttcaccatttcacttagtggttggcatcctgatgctgtccagcttacttggaacaggctggcctaccatttgtagatccttcattatatcagggatatgggagctaatttcctctccaaaatgatgtgatcttcctccagtgaatttatttttcacagctgagaagctatgacaataattcagtaatttttccctcagcttccctttcccaaccctaacctaggggtgtaaatgataccatgtacatgtcttttttttttttttttttttttttgaga

SEQ ID NO: 56379 - DNA, 1050 bp, Homo sapiens
gtcccagctactcaggaggctgaggcaggagaattgcttgaacccgggagacagaggttgcagtgagccaagatcacgccactgcactccagcctggcgacagagcaagactccgtctcaaaaaaaagaaataatgaaacgttgcttttcccccacctatccttcctctgtatataaagttagaatcatatttaaagactgcatatttagtatttagatactcagtattgaaggatggccccagaaatggatatatcaaacctagctaacattttattattattcatggaaacagacgggagcagtagccaaaacaatgcaaaagtcctttctagatcagtgccgtctaatgatgatagaaatgttctatatttgcaccatgcagtgtggtagctactagctacatgtcgctattgagcacttgaaatgtggctagtgtaactgaggaactataattttaattttatttaatttaaattaaaatgtaaataggcacgtgtagctagtggctactgtattggatagctcagttctgaatgttttggaatccattcaattttcttttccatatgggattacttttcatttgatgtggctaatagtaaaaatgagtttatattcactgattacattctgatttctggcaaaaggaaaaagcccagaagtatactggttggcaagagcaaccagactgtaattcaaaactggctgagggccaggcatggtggctcacgcctataattccagcacttaaggaggctgaggtgggcggatggcttccactcaggagatcaagaccagcctggccaacgtggcggaaaccccagacatggtgattcacgccggtaatcccagctactcaggaggctgagacaccagaatcgcttgaacccaggaggtgggggttaccgtgagctgagatcgtgccactgcactccaacctgggtgacagagcaagaccctgtctcgaggggaaaaacaaacaaaacaaacaaaaacacattggctgagggaccaagcatggtggctcacacctgtattcccagcact

SEQ ID NO: 56380 - DNA, 1025 bp, Homo sapiens
cctgggctacacagtgagactctgtgtatagaaaaaagaaaaattagccagatgtggtggcacacacctgtagtcctagctactcaggaggctgaggtgggaggattgctagagtccaggagatggaggctgcagtgagccaagatcacgtcactgaattccaatctgggcaacagagtgagaacctgtctcaaaaaaaaagagaaatagtcaggatttgaatccaggctaatctggctccagaggtcatgctcataaatccaaggctatgtgggctctccatgcaaattatttaatatcagaattatggttataatgtttcctttctccctccttgttaaataaaatcataacacctttccaggggatgagcatctttccaaaaaacttatcatccctgcacttgtcctcccccagactcttcccactgctctgcacactttttgtgctctgccctgcaccctctgccaggattctcacctgccattttttcctcacagaagtgcatcagcagaggggagctccaggtgtctctgtcatatcagcctgtggcacagagaatgacagtggtggtcctcaaagccagacacttgccgaagatggatatcaccggtctctcaggtagcagctatttacttcaacctatttcttactgtctgaaccatccccgactccttgcctgtggcccagatagacctccacacttcaagatccttgcctctttcacttttaatctgctcctctttctgtagacattctcttcctgatgagtatctacgtccaatagatttccctggctaggaagattcttcagttgaacaaatggggtctttacatttggcaaggtatcctaaataatattcatgccaggtgctaagagagacttctcaaaaaggctgcaggcatttgtctctgtgccctttaatatacttcttggtatcatgggatttcttcagacctaacctgagaaagttgttctgttctattcctgcttggtttccttggcccctcatccaggcaggcag

SEQ ID NO: 56381 - DNA, 1024 bp, Homo sapiens
gagcatgcccggctaattttttgtattttcagtagagatgggtttcaccatgttggccaggctggtctcgaattccagacctcaggtgatccacccgcctcggcctcccaaagtgctgggattacaggtgcgagccaccgtgcccggcctctggttttgttttgttttttttttttaatgggggacaaaagagagggaaagacccctataaatctatatataacaatgtaaccatatacttgcatgtctaatacaaactgaagaaattagcctaactgccaatatcaagttgcagattttaatccatggaaattgtgttttgtgctgaattgtatttgctgattacctgaaattggcttctttttattgggcttctctggagaatttctcccactccccacctctgcagaagaaaattttgctcttataaaacctcatgttttcatcattcccatcttttctttttattgcctcttatatctctgctctttgacctcaaggtctagaggtctgcagtaagccaagaaacaaaggtggggtggatgaggcaaggtttgcaggagaaagaggaattgagaaatggggtatttttgctatcagctcttctgctatgaagtagtaaaaggcagtctataattaactgacagacctaactgaagcacagagaatacatcagacttatgcatccaagacatcagaacttggattttatcaaacttgatgacttctctaaaaggagctttggaaacttcaaattcagctataggatagtaccaatgaacacatccagctgatcccaaaagctgttttcaggtataaggacaaggagaggagacaagtgacgacagccattcccctttgcagctatctactgtagtgacagccatttcttggttgatgggttggaagtcatcagaggtttgaagaattacactggcctttgtttttctggaaatgccgaccatggagatgctttagagtcttctcaaatagcttagatgttgtaatgaggttagctttgctt

SEQ ID NO: 56382 - DNA, 2347 bp, Homo sapiens
tttgtttccaaccaacgtgtatctagaaaagagttagtcgacttattttatacatagcatcagtgaatagtaatgagtggtaggtcatttcaaaatcctgttgcctatattatgtgaataccaggaggtcatctgatacggacttaataaaggttgattttgctttatattgggagctgagccacacctccccttataactctattggtcagtaatggtcagtttgtggctgttaggaaaatgttgccttttagcattccagaactctaaatcctgtagaggtacatgggatattttattctttgcctgtactcataaaaatgaacagaagaaaatacgtttttttcttttcttaacttcttttcttttaactctttaaaaggtgaaatatcagccctcaagagactcacttgctaactttcctttttttctttttttttctttttttgtgtttcttttttctttctctgttttcttacatggttctggtggattcacatttgctgatgctggtgctgtttttcgtgtgatcttcaacgtttttgggtgaccattgaccctgtgacctcaaaatggtgtccaactaaccacttaaaattaacatcttttttttaattaacgaatttatggtatttttttttttcccttggcggggatggggttggggttgttttttctctattctagattatccagccaagaagatgaaaactacagagaagggatttggcttggtggcttatgctgcagattcatctgatgaagaggaggaacatggaggtcataaaaatgcaagtagttttccacagggctggagtttgggataccaatatccttcatcacaaccacgagctaaacaacagatgccattctggatggctccctaggaaacagtggaacagagttttgaccctcagtgactcttcttagcaataatgcatgcatttgatttaacaagactctggggcctgtgctgggaaccatctggacctttgcagaagttagagattcagtgcccccctttcttaaaggggttccttaacaaccacaaaaatccttatttctgcagtggcatagaatctgttaaaatttaattagaatcacaaatttatctcagaagctttttaacagttggtgaaatgtgcttgtccaacaaagcatcctaacagggtcgttcccatacacatttgacctggtcagccttttccaggtgaatagccccagttctgacataaagaaagttttatttgtattttactactgtttggtcaattttgatatataactggttacaaacagagccttactatttattagtggggaaatgattttaagaccgtccttttcagtatttaattctgacagatctgcatccctgttttgttttggattatttctgttttggaaaatgctgtctcatttaaaactgttggatatagctggatcctggataggaaaatgaaattattttttcattgtgttttttaattggggtgatccaaagctggcaccttcaggcacattggtctcatagccattactgtttttattgcccttctaagatcctgtcttcagctgggtcagagaaaacttcttgactaaaactggtcagaactcatcacagaaatgaaatacagtggtctctctctcccagaactggttgcagctaaaacagagagatctgactgctggctataggattttggacttaatgactgaaattgcaaattgtcctttttcttggcattacagattttgccaaaataactttttgtatcaaatattgatgtgtgaaagtgaaggagctagtctgctgaaccaggaatagtttgagatattgaactgtcatttttgcacatttgaatactttgcaggctggctttgtataaacttatcctctggtttcctatatgttgtaaatatttagaccataatttcattataaataaatctataaatattctgcttgtggtttctctgttttcttccacaacccatccatacactgaaattcataaacttttttactcatagcacaatgcaactataacattaccagaaaaatacatatacagaccccaaggtttgcatatagttcccagagttatgtaactgcaaaatgtacccttaaagttcaaatgaaaaggttaaggattattatgctggatattttccattttcatattttagccctcctttatttaacagcgtattaaaaggacttcatgaatgaagcgggttttaaaggaaatatgttattcttggaaagacattttatttttttttgagatggagtctcgctctgtcacccaggctggagtggaatggtgcaatcctggctcaccgc

SEQ ID NO: 56383 - DNA, 1105 bp, Homo sapiens
gtaatgatcattgctatgagcttaagtattctgaaactgaaatgaaatctttgaatcaaatatgcttctgtttgttgtaattgatgcaatgaagtaaaatatgataggccttttacagatttagaagcagttatattcggttttgaataatttattacttgttcagacatctttcttgacttccattgtctgcatcttggccattttcctaagggtagacagtaacagaaatgttacataattcagctatttttgctactttagagtcattagaatatcatggatggaagtacatgaatgtgggagttcagcctgccacacagtgcttgaattttcctttcttatattagtatattaaccttcataagaaaggagctgatatctttctataacagttcattcgatttttgtcatggcaattgctgtgtagacaggccttatacttttataaaggggctgggggaaggtggaaggggttgaaattaatggttaaaatgaatttgaaggattgtctgcagacataattgcacttctaatccactggataagttaagaaaatttaaattgtctgaaagaaagtttcattttgtttttcaataggcagttgatgcctccaccagcctttccagtgactggaataaaaacagagtccgatgaaaggaatgggtctgggaccttaacagggagccatggtgagtgtgatatagctgggggaacaggggagtggctaagactggtctaaagctattagttttctcagccgggcgcagtggctcacgcctgtaatcccagcactttgggaggccgaggtgggcagatcacctaaggtcaggagttcaagaccagcttggccaacatagtgaaatcccatctctactaaaaatacaaaaactagcgggcatggtggtgggcgcctgtaattccagctactcagggggttgaggcaggagaatcgcttcaacctgggaggcagaggttgcagtgagccaagatcagaccactgccctccagcctgggcaatagagcaagactccatctcataaataaataaatacataaataaagctattaattttctaacctgatgttcattcaggtgtttaat

SEQ ID NO: 56384 - DNA, 1288 bp, Homo sapiens
caagcattagcagcatttataaataacagaaagcttattacagaaagctaatcacatcgactgtcagtggttggagttctgtttgttaatggtcatgtttactcctagtagcccaaatgcataacagagttttcttaaaagttcaaagcactgtatataggttgtcaatttcatgtttccctaggatgaaggtgagaaggcttaggtgataatgttaccaaattatacatgaaggaaactaaggacctgaagatgcaaaattcatatgatacttattgatccttaaagtatattgtaatcattgtttacttattccttgggcattctcacactttttttcttccttggtttgttttggtcccagagtccgatgggtggtccttttattcctgctgctcctgtcaaaactgccttgcctgctggcccccagccccagccccagccccagcccccactcccaagtcagccccaggcacagaagagacgattcacagaggagctaccagatgaacgggaatctggactgcttggataccaggttaaataaaataccctgttttcctatcttcaccttattcttctactatattctccctttaaaaaagataaattcacatcattctcccagtactaggatttctgctttctggaattcattttggttaggttttttatcctattcaacagactcttgaaagcctctgagagttcttactttcttatacatctcactcaaagctcttgatctaccagtatgtggtttgtatttaaaaccttggctttcagtggtgctctctcttttaccctccacctaaaaaagagagtgatatctccctccagtctccccacccctcaagactgctagaaaaggagtgattctgtacatgtaattgtaaagttagccactaaagttaaaaagattcttaatttgtagttttggtgcaattttatcagaagtacctttccattttgccagaatccttgaatcattctttaaaccaaagcatttttttatagtttctagctaggtttatagaaactagtggagctatgggcagtcagttaaaaacaggccatagatagcataatgaattataacacccctgtccaagtcctatagagaaaaaaaaaaatccctacttttgactacagttacacagcagatcccaaagagctttgtagtagtttaacgtactacaacttatcagaaagatgaggcacttgacagttacattaaggagctaaagtcaatacggcagttgtagatttgctaatgccactgtatttt

SEQ ID NO: 56385 - DNA, 1035 bp, Homo sapiens
ggaggtcatggatgcagtgaaccaagatggtgccagtgcactccagcctcagtgacagagtgagactgtctcaaaaaaaattttaaaaagcaacattatgtaagagatatataaacttttcaaatgtaaggattataaatgctggtatgtttcttttataacttaagaaatgtatacttaaaaaaattttttttttgagacagagtctcgctctgttgcccaggctggagtgcagtggcgcatctcagctcactgcaagctccgcctcccaggttcacgccattctcctgcctcagcctcccaagtagctgggactacaggcacccaccaccacgcctggctaatttttttgtatttttagtagagacggggtttcactgttagccaggatgatctcgatctcctgacctcatgatccaactgcctctgcctccccaagtcctgggattacaggtgtgagccaccgcacctggccacaatttcttaaatcatgaaagtagaattttaggaaaagagtagatgtctggataataatctggatggattatatatactggtcttggaggcaggggagagacttaatgagagcatggtaatggatttatggtgggtccttctctgtgggcctctcatagtgtacccatgccatagcaaatggcagcctcgaaccattgcccagtccccttacctgtgggctgtgagcactgaagggggttgcacagtgtgtaacaaaaaagctatgaactaaattttatttgtggtctctagtcaaatttattttattttatttatttattttatttttgtttattattattttttgagacagaatctcattctgtcacccaggctagagtgcagtggcaccatcttggctcactgcaagctccgcctcccaggttcacgcgattctcctgcctcagcctcccgagtagctgggactacaagcgcctgccaccatgcctggctaattgttttgtatttttagtggagatggggtttcaccttgttagccaggatggtcttgatctccta

SEQ ID NO: 56386 - DNA, 1443 bp, Homo sapiens
ttggaccagcctgaccaacgtggtgaaaccccgtcacgaacattacccgggcatggtggcaggcacctgtaaccccagctacttgggaggctgaggcaggagaattgcttgaagccgggaggtggaggttgcagggagctgagaccatgccactgcactccagcctgggccacagagcaagactccatctcaaaaaaaaaaaaaaaaaaaaaagtgccaagtaatacatacaaagaaaaaaaaatcgtgaaattccaaattccaatcccgaaagttacctgccataggtattctgtttgtgtgttatccagctctccacggtataatgaacacctgatcacacatttcttcatattgatatattctagaaaggagattgatagagcagaaggtatacatgttgtacattttgaagttagtggttttaatttgtatttgtaaacttgatgacaactggaggactaagaaggctgagtctgatgaagtaagactttgctgatacattcctcctagaaaaaagggttggagagagcagccttcactgaagagtatcacagggctgactgtactacccaacactctaccccagttttacaggagactgtctttgctataatttcttattgacttatttcaaagattgaggatttaattatatattctgtttaatctgaagtattctgttcttcctacagatgcattatgttcaagataaattatttgtgggtctagaacatgctgtacccacttttaatgtcaaggagaaggtggaaggtccaggctgctcctatttgcagcacattcagattgaaacaggtgccaaagtcttcctgcggggcaaaggttcaggctgcattgagccagcatctggccgagaagcttttgaacctatgtatatttacatcaggtatggatggatagggcaggggacatgtgaattcttgtcaacttgttggtacagtcaggagtgattcagaaggagcaagagaaaactgggtgtaattaatagtaatgagggatttagataaatgctaggagtaattactttataattagttaaagaaattgtagaattggggcacggtggctcatgcctgtaatcccaacacttctggaggccaaggcgtaggaccacttgagcccaggagtttgaggccagcctgggcaacatagcaaaaccccatctctccaaaaaaattttaaaaattaggcgggcacggtggctcacacctgtaatcccagcactttgggaggccgaggcgggtggatcacgaggtcaggagatcgagaccatcctggctaacaaggtgaaaccccgtctctactaaaaataaaacaaaaaaaattagccgggtgtggtggcaggcgcctgtagtcccagctactcaggaggctgaggcaggagaatggcgtgaacccgggaggtggagcttgcagtgagct

SEQ ID NO: 56387 - DNA, 1015 bp, Homo sapiens
aatttttgtaatttcagtagagatggggttttgccatgttggccaggctggtctcaaactcttggcctcatgtcatccacccacctcagcctcccaaagtgctgggattacagacatgagccacagcacccagcttgccccattgatttggatagacgagaccacatttgtttataacctattagacaaccagcaaaaaggaattctgttcttaaatattgggttatctcaatagactggaaaataatggtagtgaatccataagaacagatttgatctgaactctgtgggccagttgacttttaaaatcaagaagtttatttgttccccagctgttaaagcatgttctgagacattagctagcaaaaacccttctaatgtatatagtcccttttggttatttggaaacttgaaacattacaaattagatctggtgacccatttgactccttttttggttttgaccacattgagatcatccttttttgtttctctttatagggatcgtccattatatcttcatgttcagggccagacacgggaattagtggacagtaagtaatgtttttggctcacgtagcactttttgtgaagagcaaagtacagggctctgtatagcaagttggcaaagtgtccctgatggctgttctaacccttgttcatgaactatacacgaatttgtatgggagtttagagggatggagagccacatatttgggtaacgtataaagcagatttacggtgaataattgaacactggcctgcctgggcactagtcagttcattccattcagttttactgtctgtgtttttctaaggagctgtaaaccggatcaaagaaattatcaccaatggagtggtaaaagctgccacaggaacaagtccaacttttaatggtgcaacagtaactgtctatcaccagccagcacccatcgctcagttgtctccagctgttagccagaagcctcccttccagtcaggggtatgttttggggagggatcgttaatagcatta

SEQ ID NO: 56388 - DNA, 1115 bp, Homo sapiens
cattgagactctttggggagggcggtgagtggattcagataaagaagacctctaaatagacaggcgtcagatatttattagtgggtttgggtcatagtctctaaagtcaggattgggtttaatttaacttcagaggaagataatggaatggatataaatgaattctctgggttggtttgagtaagaaaccatggaatcaaaatttcagatacaggagagaattctttccttctttacttggttgaatgaatgaatgggaagaaaatctgtctgccattgaaatcaaccaattgccacatttttttaattgaacatttccttttttagatcagccgacttagtggggctgcagtatcaactcgagggaggttcatgacaactgaggaaaaagccaaagtgggaccagggtgcgtattctcttatcttgtttatggaagggttgggtgtatgactcacgttagcctcatgttttttatccttaggtaatacgtgtacacaatatttgattcaaggtttgaggggtatgtgtgtgcacactatagcagaattctggatatcaaacagatacaagatgttgggacctgtttttggacttttatttcacatttaatgtttttattggaggaaacaaattataggaaagtgtaaaagaagatactaaccactaacatttaatgtatatactcttttttcttctttctgttccatatgatctgcagaaataatgtatatactttttttttttttttttgagatggagtcttgctctgtcgcccaggctatagtgcagtggcgtgatctcggctcacttcaaactctgcctcctgggttcatgccattctcctacctcagcctcccgagtagctgggactacaggcacctgccaccacgcctggctaattttttgtatttttagtagagacagagcttcaccgtgttagccaggatggtcttgatctcctgaccttgtgatccacccccctcggcctcccaaagtgctgggattacaggcgtgagccaccacgcccggcattgtatatacttcttaacttttttctgtggaaatagttcccctcacaaatgggctctttttttttttttttttttttgtcttt

SEQ ID NO: 56389 - DNA, 1055 bp, Homo sapiens
cggatcaggttttaccatcttactgttttttcattcttctttgttctgctgtaatagagtgaggaattattagttagatacaatttaagggtttttgagagctttacaaggatggagttagttggattttatgttaggattataggagtggcacaaagacaacttcctattgtatgcatgaggtatatgtattgtaggcattgctcctctaccttctattgtgttttactccatgtacagccaactaactgagctatagagtatcataacttggccctttaattttctttttgaaggttgtagcttctagtccctagagcttctgtaattaggtggtcataaaaatgcacatagggccaaggtcacagagaaatcttgattgtggccttcaagcagattgactttattattgactttatttaatgtcattttagtgagatttttgtttgcttgttaattcgtttatgaagaatgaccaactgtgtttacaggcagatgaagggaagggtagggaggtgtgggacttgggaaaggatagttgtacattggatgactaaaaggctttatctcagctgggcacagtggctcacgcctgtaatcccagcactttgggaggccgaggtaggtggatcacctgaggtcaggagttcgagaccagcctggccaacacggtgaaaccccgtctctactaaaaatccgaaaattagctgggcatggtgctgcacacctgtaatcccagctactcaggaggctgaggcaggagaattgcttgaacccaggaggcggaagttgcagtgagctgagatcacgccactgcactccatcctgggcgacagactccatctcaaaaaaatgaaaaaataaataagtaaataaataaaataaaaaaatagactttatctcatcataaaaactttttaatctaatttctcttttttctagcttcaggctcctggcaaaggcctaactagcaataaaagcaaggatgacctggtggtagctgaagtagaaattaatgatgtgcctctcacatgtaggaacttgctgactcgagg

SEQ ID NO: 56390 - DNA, 1007 bp, Homo sapiens
gagtttgagaccagcctgaccaacatggtgaaaccccgtctctactgaaaatacaaaaattagtcgggcatggtggcacgcgcctgtaatcagctactcaggaggctgaggcagaactgcttgaacccgggaggcggaggttgcagtgagccgagattgtgccagtgcactctagcctgggcgacccaatgagactccgtctcaaaaaaaaaaaaaaaaagttgtttgtaatcctgtaatcgcataataatttgtgttagtaaaggataaatggatatagtagttgagagatcatttagttttggaatgttccagaacacattttgttacaaatacatatttacgaggcgtttttgattgggctgattacatttatggaccaaataccttgtcttgtccttgttcacttagttcagcttaagctgtatttccatagtcatttaaagcaacataacatgtttttaatatatgtgctttttccctgaagtcagaggagttcaggtaaatcaagtgagccccatagtgtcatctctaattagaacctgtagggttttatttatttatttatttattttgatagagtctcactctgtcaccagcctgaagtgcagtagtggggtgatctcggctcactacaacctctgtctcctgggttcaagtgattctgattctgctgcctcagcctcccgagtagctgggattacaggtgcatgccaccatgcccggctaatttttttttgtgtttttagtagacagggtttcaccatgttgaccaagctcatctctgcctcccaaagtgctgggattacaagtatgagccaccaggcgcagcctattgtttgcaaagattgtgtgagtcagtcatccatttataaggtttatgaggaaaaattaaaagcatcttgacaaagatgtagtgctccttgtatattaagatttttaatactgatgttaatcgtttaagctctttttttttcttaaaataataatctttaggtagttgacct

SEQ ID NO: 56391 - DNA, 1067 bp, Homo sapiens
ttagttatggggggagaggggagatttaaaggaccagggacatgggaaccaagccatagggatcagagggccttgtccttgaacactactggggtatattcaggctcatccacgcagctgctgggttcttgccctaacggccctcccctgcaacatccgtcttggaggagaggctgcagccacagcaccctactgccctttaaataaaggagggctgtgggcagggccatgtccctttctcctctcccctcaacctcttactgctgttctccctttctccgtccttcatggaagccctgggagataacctggcttcctggagttgatggaataaaggttggggtggccataatggtttgttgggggtgagggaaaaaacccacagggaccagaatgttttgttgttcttttgttttcttttttgtaccaaagtcaactgcacgtgttttatatttttaagagatcgtaggcaattagagatcgaagcctcctatctccacatctctgaagaagttgaggggtgggggagagaatgacttctgccttcatctgcagtaacggggggacctatactgacctcttccccagccatttagaaacaagttctagggtgggttggaaaatctccaagagccctgacctcatcttccacctcagcaaccatgacctgaaacctcagcgtgaatttgggggatttttcagtggaacccttgcccccaaatgtcgaccagcccccaaatgtcgaagaattttcttcttgccaattttgttgtttaaaaaaaaaattcagggaaaattaaaaacctggaactccataaggtactgtcttccataatgtctgccaattctgaggaggatggtagtagagagccgggcagtgacctaagttcctctgaaaggggccttttcctctcaccgcaaggacagcctctgcctcactgaagagagggggcactaacaaaagtaaccactgcaaatcttttttttgtttttttaattcacaaatacaaggataaaaacaaaggggcacacaggttccaatgttgggaattccggtatcaggaaaa

SEQ ID NO: 56392 - DNA, 1156 bp, Homo sapiens
caagaggtgagatgggaattgatggtataggagactgaagggaggatgttcttagtctgagtagttagagcccagtttggagtggggtggggaaagcgtctacattcaagtatgtctccggatcctactgtccccacacccacccttgttcaacttttgggcagttctcccatcctaaagctggggccctgttcccaccctgtctgtcctcaggaggcgttacagcgattggtcaatctctatggacttctacatggcctacaggtcagtaggacaagggcttgaatggggaaggggaggagccaggctagagatgcctgtttaggtggggcatggtcatcccaacaggcctttctaaataccctcccaatccaagctctccaggagcgatgatctgggccttggagggtgaaggcgaggggtagaagagcacaggggttctgataaacccttctgcctgcattctactcccaggcagctgtggcccagcaggacactctgatggaagcccggttccctgagggccctgagcggcgggagaagctgtgccgagccaactctcgggatggggaggctggcagggctggggctgcccctgtggcccctgaaaagcaggccacggaactggcattactgcagcggcaacatgcgctgctgcaggaggagctacggcgctgccggcggctaggtgaagaacgggcaaccgaagctggcagcctggaggcccggctccgggagagtgagcaggcccgggcactgctggagcgtgaggccgaagaggctcgaaggcagctggccgccctgggccagaccgagccactcccagctgaggccccctgggcccgcagacctgtggatcctcggcggcgcagcctccccgcaggcgatgccctgtacttgagtttcaaccccccacaggtaaggtggcctgcagtggtgaatggacctggggtggacataagggtccatggagcccgaaagaaattgggccattggggatttgagcccaaatgcaatcagtcaactgacttgaaggatattgagatactggttggagaactgaaaagaaatgtagatgggtgcaggggtggaggaaattaactcgggtcgtggtgctgaaagaggccagttggtggtggatctcctgaaggggact

SEQ ID NO: 56393 - DNA, 1140 bp, Homo sapiens
atcctgtttgcttgatgccaaagcctgtacttgaccctctgcactgtgctgcctttccaagcgacctttggagagatatatctcagtaaacgcagataatcagtgctaagaaatgggagaaggtcggccgggcgcggtggctcatgcctgtaatcccagcactttgggaggcggaggatcacctgaggtcaggagtttgagaccagcctggccaacgtgacgaaaccccatgtctactaaaaatacaaaaattagccaggcatggtggtgcgtgcctgtaatcctagctactcaggaggctgagacaagtgaatcacttgaacccaggaggaggttgtagtgagctgagatagcgcccttgcactccagcctgggtgacagagtaagactccgtctcaaaaaaaaaagaaagaaaagggagaaggtcaggactaaattaaagctagggtgtgaggctgaggagtcttatcagaagatggaagcataaggcatgtttgggaaggagggaaggctgattctggtctataacctagcttctgtctctcaatggcatgcgacctgttacccctccagatgcccatccagggaggacttccccctgattgagacagaggatgaggcttacctgcggcgaattaagagtaagtccacccacaaggagctccttagtaatttataatacattcacacaatggaatattatgcaactgttaaaaagatgagatggctctatgagggctggtgtagatccacaactgaaacatattaagtgaaaaaagcaaggtttaaaacaatgtaaagtgtatactaccatgtgtgtaaaaataatatggaagaccaaggttgggtgagtaacttactttttcactgtaaggccttatattagttagggtatgatttaactgctatactaaaagaccacaaaaatcttcttccttaaaaaaggaagtagattggccgggcgcggtggctcacgcctgtaatcccagcactttgggaggccgaggtgggcggatcacgaggtcaggagattgagaccatcctggctaacacggtgaaaccccgtctctactaaaaaatacaaaaaaaaaattagtcgggggtggtggcgggtgcctgtagtcccagctactcaggaga

SEQ ID NO: 56394 - DNA, 1050 bp, Homo sapiens
agacattcattcttcacctttctcagcacagacaagtgttttagtctcttcttgctttcctgcccaagcccacgagagctctggagtcccccagagtcaaacagctataattgttactattaccgtaataataaaaaataagagcagctcacaggtactgttactgtgcacaggcacttttacacctgtgggaaaagattattttcgtcctcattttatagatgatgaaagtaaagcttcaagtcagttaaataatttgtcaagggttgcacacatttctaagtcccttctggctggcaccagtgcctggctcttaactggtattgtaagatgactcttcagtcctttcagtcctcgtccagaaggattgaaggcctaaatatgccaagggacaggattcccaggcttaatccttcctttcccctgactggcaggacaagccttcagtggtatcgctgcagaatctaatcgtacgagacattgccaaccaggagaaagggatgtttctgatcagcgcagccccacctgagatgtacgaggtgcacacagcatcccgggatgaccggagcacctggatccgggtcattcagcagagcgtgcgcacgtgagtgtctgcctgccgcctgcatgtgcttatgacctcagggtacctgcagcattagatcccaaccatagaactccctgggaacagaatccagcattcagaggtgggggaagaggttgagggagagacaaaatggcccaagactggaaaggtcacctatgttcttatgtcctgtaaagccacattttatacattgccaacctcaactccctttcaaattcagcatgagctgacaagcaagggaatactttgagctgtcacatggtggcatacctgccagccaacagtacaatttcagctgcattcacatgttcatctgtaggcagagggctgttatttggattgtattgtattttacatttatttttctaaaaatgaatgaaaaagaggataatgaaagcatcgatactagagaggaacaagtctcataaacagactcaacacaa

SEQ ID NO: 56395 - DNA, 1943 bp, Homo sapiens
gtgatccttctgccttagactcctgagtaactgggactacagacctgcaccaccacacccagcacatttttaaattttttgtagagataagatcttgctatgttgcctaggctagtcttgctcagactcctggcctcaagtgattctcctgcctcagcctcccaaagtgctgggattgtaaatgtgagccactatgcctcgccctctgttttcttgattgtgacatccaagttttatggaattgatctttgtttcctccctcagtcttggagtgctgaccccataggatctgagagcttggagtgtgaagcagagaaagaaattgaagcaggggcctgctggggttgaaggagatgggtgggtgagggatggtctttcagtcctctgcgagaggaaggaaactttctccctccctaccaagctcaaaattagaagtgggaatatgccaggacagggagaatttaggtcagatagccgtaaaggtcttccttagttagatattagaaatggaatttaaaggctaaaaaatgtggtccaggctgggcacggtggctcatccctataatctcagcactttgggaggctgaatcaggcaggcagatcgcctgaggtccggaattcgagaccagcctggccaagatggtgaaaccccatctctactaaaaatacaaaaattagccaggcatggcagcattcacctgtagccacagctacttgggaggctgaggcatgagaatcgcttgaactcaggaggcagaggtcacagtgagcagagatcacaccactgccctccagccagggcgacagagcgatacttggtcccaaaaaataaaaaataggccaggcgcagtggctgatgcctgtaatcccagcacttcggcaggccaaggcaggcagattacttgaggtcaggagttagagaccagcctggccaacgtggtgaaaccccgtctctacaaaaatgcaaaaaattagccaggtgttgtggcgtgctccttaatcccagctgctcaggaggctgaggcaggagaatcgctttttcctgggagacagaagttgcagtgagccaagatggcaccactgcactccagcctaggcgacagagtgagactccgtctcaaaaaaataataatagaatcaaattaaattaaaaataaataaaaaataaaagtatggtccctcttgctctggggaaccttatgaatctcacaaaaatcttggaccctgtcacccaaaaaaatacacgagttatgttaatatgtaaaactatttacacaccttcagaaggtttacagagccactgaagcctgacatcccagggggtctgtaggccctaggttaagaaacctgaatcagtcaggtagaaagggttttctgtagacactgagtgatccctgtggttcctgctagcccacaacgctgttttgtctgatagcacatgaatctttctgcaccctgcccgccccccaccccccacccacactgtttttaagctgtaagaatgtgtgaccaggcgcggtggctcatatctgtaatcccagcactttgggaggccgaaactggtggataaacctgaggtcaggagtttgagaccagcctgaccaacatggtgaaaccccgtctctactaaaaatacaaaattagccgggcatggtggcacacgcctgtagtagtcccagctccttgggaggctgaggtaggagaatcgcttgaacccgggaggcggaggttgcagtgagccaagattgcaccattgcactccagcctgaacaacaagatgaaaactctgtatcaaaaaaaaaaaaaaaaaatagaatgggtgaggtgtgagaggtctgaaaaagtgcaagcagccagagggaagagaggccaggaagagggaaactgggagctctaacctgatgggataagcctggtccttgggaaagagggaagcagctgct

SEQ ID NO: 56396 - DNA, 1041 bp, Homo sapiens
tgtagaaagtgacccgccccgccgtgctcaagcggcacggggtacaggagtgcatcctgctggtgactcagcgcatcaccaagtacccgttactcatcagccgcatcctgcagcattcccacggtgagtaggcaggcccaggagagggccactgggagacggccacctggggtgaggaaaggctcggtatgaccacaggaagggtggggtcgggtgtgaaaccctgggcagcctctaaaggtggaatcaagacacgatgggaactggggtgtgagtgaaactggttgagccgttccccatgccaacccccggtgccagggatcgaggaggagcgccaggacctgaccacagcactggggctagtgaaggagctgctgtccaatgtggacgagggtatttatcagctggagaaaggggcccgtctgcaggagatctacaaccgcatggaccctcgggcccaaaccccagtgcctggcaagggcccctttggccgagaggaacttctgaggcgcaaactcatccacgatggctgcctgctctggaagacagcgacggggcgcttcaaaggtcagacctgctcggcagactaggcaggaattcaaagtcagatggagagtgggagatgcctgcaggtcttagaatcaacctctcttggccgggtgcagtggctcaacgcctgtaatcccagcacttagggaggccgaggcgggcggatcacgaggtcaggagattgagaccatcctggctaacacagtgaaaccctgtctctactgaaaatacaaaaaattcgccgggcgtggtggtgggcgcctatagtcccagctactcaggaggctgaggcaggagaatggcgtgaacccaggaggcggagcttgcagtgagcccagattgcaccactgcactctagcctgggtgacacagcaagactccatctcaaaaaaaaaaaaaaaaaagaatcaacctccctttatgcagcccatacaacagtgagactcagtgggagagaaaaataggatctctgtggcagaaaagcctgaattc

SEQ ID NO: 56397 - DNA, 1099 bp, Homo sapiens
tggtggctcatgcctgtaatcccagcactttgggaggccgaggtggggagatcacgaggtcaggatttcgagaccagcctgaccaatatgaagaaaccccatctctactaaaaatacaaaaattagccgggcctggtggtgcgtgcctgtaatcccagctactcaggaggctgaggcaggacaactgctcgaacctaggaggtggaggttgcagtgagctgagatcgcgccattgcactccagcctgggcaatacagtgagactctgtctcaaaaaaaaaaaaaaaaaaagataaaaatgattagaaaagtatctaagatcataataatgcagaatattaacctggaatggaccttgaaaacctcacgtgaactgtgaggtccttatcctagggccccacgagttttagccaagccagggtagaggccaaatgtcccaatgtcccccacagagctaatccagacagagctgcaccatgtgaggacactgaagatcatgacccgcctcttccgcacggggatgctggaagagctacacttggagccaggagtggtccagggcctgttcccctgcgtggacgagctcagtgacatccatacacgcttcctcagccagctattagaacgccgacgccaggccctgtgccctggcagcacccggaactttgtcatccatcgcttgggtgatctgctcatcagccaggtgggaaaaggcaggacccctgggtgacattcatggaaggaggtgtgactgggttgggcatttcttgggtccaaattctaggggttggaggggagccagggagagctggagaaacaggaagccagcctgtttggcaggaggccagaggtgtgtccagtgggtaaagtgtggctttgggggaatgctgacctaaccttactcgaccaacttctagttctcaggtcctagtgcggagcagatgtgtaagacctactcggagttctgcagccgccacagcaaggccttaaagctctataaggagctgtacgcccgagacaaacgcttccagcaattcatccgggtgagcggacctctccagatcccatgctcatggcccaaacccaccctccccaactca

SEQ ID NO: 56398 - DNA, 1005 bp, Homo sapiens
agggctcctgctgccccctctccctcaattcctcctgaagttatggcagagatgcctctgattagagcaggattgaaggtattgtgacctgctactgaatagcggacaaaagctctagcctgtaaatccctatgaaacttggggaaggaacccccagaaaggaccagtgatgggcaacccgctcgggtccccttctacgctgtgggagctttgtcattttgctcttcacaataaagcttgctaccgctcaaaaaaaaaaaaaaaaagaaagaaaagaaaaccagtgaagcctccctactttcctcactgttcaatttagagttgtgaggatgaggagggaaccccaatctagatccctatagagacctgacaaaattcccaatccggaagcttgttgccaggggaacaggggaggcgggcagcactattttgagagcaggtggaaagcggaggttcaatccagagacactgagtgttgggggtaggagaagggagctccaggggggtgggggcagctgcaacccccacttctgtctgccccctctgctccaccctgtttgccttgtatttgtggaagtgagcgtggtgctgggtattgtctgaaagagttagcagagtttccggtgttgttggatgggggaggggaagctggagagggccgggagctgagggcatgtctgggaagggcacggccagggtcccagtgcctaggctcagcgaatcctcctttcttcttctctcctaccccatggcaaggtggggtggaggatggcggagaagcagatggagtgtgggagctgtggatttgcctgagttgggggaacaggactccctgggcctggaagggagaaggccaggcttggtggggagttgcctgtcccttctttaccactggagccatcaatcagccttggagctgctgaggcccagccagagtccagggcatgtggtgcgagggaaggagcacggcctttggattcaggcccaccggagtgtaaacaccac

SEQ ID NO: 56399 - DNA, 1050 bp, Homo sapiens
agtggcaacaggaggcagcccagccgtaggggccaggtaggtcagggacccagaacccatccgggctggctgccccagagcctggcctggtcactcccggacagctgcctctgacacccagttgcaggctctgctttaggaactggtgtctttccagcatcctcaggctggcattttttccttgcctctgcccccagcctgtctctctggactccaggcaccctggcattttccagcctcacttcctctccctctcatcccttccacagacccgggaaaaggagaagatgaaggaagccaaggatgcccgctataccaatgggcacctcttcaccaccatttcagtttcaggcatgaccatgtgctatgcctgtaacaagagcatcacagccaaggaagccctcatctgcccaagtaagttgtttggaccctgagagtcacccagactcggtgcccactgaccctgatcttttcatctgttttttctgcctggatccatgagggtcactcttctctctgatccccagctgggcccaaatgccagggccagttgcttgatcccttgctccctgtcctcactctgaggggtggtggctgttggaatatggcataagccggactatctgggaatgtgggggaggggaggctgtgctggctcctcttgcagctgtcatccaccaggcaccccccttgctccccgaacagctgctaagggttaggggaactgattggagaaggagcaggaatgttgtatgtgtggagggggtggggtggggggtgacagaggaactgggtggaaagctgccagccttgcagctggctctgcctgtcttcctgcgcagagctgggcattcaggacttcacagtccccttgcccctttctttctattgactatgggtggagcctgaaatctctgctgtttcaagcagaagatgtgattaggacccttcatctcaaatttctagtgagaaagagggaatgtagcagggatgtgtgtgttgaggggcaggggttagaattcctgcccttcatccacatctgagtgtagt

SEQ ID NO: 56400 - DNA, 1009 bp, Homo sapiens
agtttaccctattctctaagccagaaccccgccaccaccccccactccccccgcccataggttaactcattacattttccttggagactacacagatggaaaataccatttcctccttcagaggctaacactccatagtcctggagtgcaaaatgatgcatatcagactagttccctttcccttccccacacctgttctcaaacccaagcctctgactcattggcctatcctccccattctcctgagcaagtcccaggtttccaccaggaacacaatgaacaaaagcaaatatatcctccttgcctgtaacctggccagtcttgggatgtccaagctgcagcccctgaaagagggatgtgagctggcagagggctactccatttggagcctctcgtctccatgttcttttcatcctcctgggcctggaggctctgattgctgggctaaagaaaggttaaaccagttgggcaggggagccgggggagcagaatctaaactgggaaactcggtagcagaaacaaagccggtgtttgttgggcttccctcttgcctgggaggctgttctcagaccacggcattcctgagttggacagagtcagctcagagtggcttctccccactgctgcagcagcaaaagtcactgcctttccacaggtcacgcttagagcccaactcaagggatccaggtacttcttccctgccagagctcaaagaacagaagcattacaagtaaattcaggccaggtgtggtggctcacacctgtaatcccagcactttaggaggctgaggcagacagatcacttgaggtcaggagttcgagaccagcctgaccaacatggtgaaaccctgtctctactaaaaacacaaaaatcagccgggtgtggtggtgtgcacctctaatcccagctacttgagaagctgaggcaggagaactgcttgaactcgggaggcagaggttgcagtgagctgggattacaccactgcactccatcctgggcaacagagca

SEQ ID NO: 56401 - DNA, 1531 bp, Homo sapiens
gcccaggagatcaaggctgcggtgagccgtgaccatgccactccactccagcctgggcaacagagcaagaccttgtatcggccgggcgcggtggctcatgcctgtaatcccagcactttgggaggccgaggtgggcagatcataaggtcaggagttcaagaccagcctgaccaacatggtgaaacccagtctctactaaagatacaaaaattagccaggtgtggtggcatgcgcctgtaatcccagctactggggaggctgaggcaggaaaatcatttgaaccctggaggcggaggttgcagtgagctgagaatgtgccactgcataccagcctaggtgacagggcgagactccgtctcaaaaaaaaaaactaagactttgtatcaaaaataaataaatttgggctagactgctccctttctcattggactcatattttccctggcttctcctgtgccctaatccagacttctaagcaaggtctttgttttcctttacagctggactgggcagcctttggggtcatgacccttccctccatcggcatccccctgctattgtggtactccagcaagaggaaatatgacactcccaaaacgaagaagaactgattggggcttccacagccctcctctcccaagaaatccaggctcctctcccaagaaatccaggtgctttccagactccaaagggtatcttaaatgcaatctcttctctcttagcccttggccactttctcctggatcctgccctgctctcagccatagtgaaggaccagccctaggagtctgcgagagcctccttggttccatcgtgaagccataaacaggaatgcctttggcaatagccttgagcctagagggccctctgatgccccactgaggtgctgttggtttattgctggcaacgtgaattctctcaggggtctaggaggggcattttggagactgcctgacaccacccctatcccctgcctccccctctcagaagagggtggaagatgaaatgaaagctatgggactcttggaggatacccagtgtctattctgggttagagaagtgcttactaaggggttttctaataaaaacaaatgccacattgacttgtctgttttcttagcccccgggtgaacacaggtgattattggaactcagtctttgcccagacccctgggcaagcgagctgggttctggccttgctgcaggggttgtgggcgggtcctgttcccatggagatatctgcccttttgaatcttttgcttccatcccttattttcctctgattgttgttctcatcagtcaccacctattgccgtacaccttccttgccaggcagctcctcttcacagctggagaatgtaggatggggaaagatggtctgcagaggaacagctattgtcatccccttagatctcatctgatttattgactcagtatttgttttttttgtgggttttttttttttttttgagatggaatctcgctctgtcacctagtggtgaacaccggtgcctggcacctgagtgttctt

SEQ ID NO: 56402 - DNA, 1050 bp, Homo sapiens
atatatttttgctatttcatttgagcctcacattaaccctgtgaagtagtggatttttgctggaggattaagtaaatgattaccaagggtaagtcattccacgcacaccttgccctgtagagggaccagtggtggtgagcaacttcactctttgcagagtctgaggctcagacagaagaatttggctttaatttcagttgcatgcctggcctaccttgtttaatatatgttctccatggggtatttctcaggtcttctggctcctaggtactcctctttataacacactaagagagaatcatccaactctctctagccaaaagctttccctcatcttcttgaagttcttctgagcctttgggaactaagactctaatgcatagagttgggttggttgggactgccctttctcagagtagatgaggtggaacttcatgaggtggacttcccttaatgtcgttcttttcttcttttcagattggctctaccagtgcacctggacagggaggaatcctggctcagcgggagtttgacaggcgattctcccctcattttgtaagctttctagtgttctctctcatcagttccttggtatgagaatgcccttttggttctggaccctcttggcttccacagatttgttttgttggttggttcttgccctgtgtgttttttggtgtctgatatagatactcatcaaatagattgatttagccatgtccagagatttttggcaatgagatcacaattgccaaaaccataaaactgacttaagtagagtcccatctttgagtagatacccatcttaaactcctgggtctattttgaggtttaaaaaaaaaaaatctgattagattcagagggtcatagatcattgggtaggttaagtgggaactttactgtggtctagtctaggaaagaattttttgaagatgagcctgaagtactgaatgctggaattcattcagtgaataagtatgatgttccagattatgtgctcattctgtgctctgctttggggacacagtgatgaataagacacagtccctt

SEQ ID NO: 56403 - DNA, 1020 bp, Homo sapiens
atatatatatatatttttttttttttttttttttttttttttttgaggcggagtctcactctgttacccaggctggagtacagtggcacaatctcggctcactcaacctccgcctcccgggttcaagcagttctcctgcctcagcctcccgagtagctgggactgcaggcgcatgctgccatgcccagctaattttttcgtattttattagagacggggtttcaccgtgttgcccaggctgttctcgaactcctgaactcagccaatccacccgcctcggcctcccaaagtgctaggattacaggcgtgagccaccatgcccggcaaagaagcctatattttttcattcctgcagaatattgccggcatgagatcagcatgtattggcaaatgttttgtaagtggtgcatttagtccacaggttgaaaggctgctacaactttagcttcatctctttccgttccttaactcttgagccagtgctagcaatgtctcccacactgtggtcctgcgccctctcaaggctggttatttcaacttcacctcggcaacaattacttacctggcccaggaggatgggcccgttgtggtgagttgcccaaacccttagctggatggaatttggatctgccttcccttaaaatctcttgtggtgggggtaagagggggatgaagagaggttgattaatagataccaaaatacagttaggactgggcgcagtggctcacacctgtaatctagcatttttggaggccgaggtgggcagatcacctaaggtcaggagttcaagaccagcctggccaacatgcagaagccccatctctactacaaatacaaaaattagctgggcgtggtggcaggcgcctgtaatcccagctacttgggaggctggagcaagagaatcacttgaacccaggaggcagaggttgcagtgagccgagatcacactactgcacttcagcctgggcgacagagtgagactccgtctcaaaaaatatatatatatagttagaaagaat

SEQ ID NO: 56404 - DNA, 1004 bp, Homo sapiens
gccaggctggtcttgaactcctgacctcaagagatcagccagcctcagcctcccaaagtgctaggattataggtgtgaaccactgcgcccggactattgctttaatttttttgtttgtttgagacagagtctcgctctgtcccaggctggagtatagtggtgcgatcttggctcactgcaacctccgcctcccagggttcaagcagttctcctgcctcagcctcccgagtagctgggattacaggcgctcaccaccgcgcccagctaatttttgtatttttagtagagacagggtttcaccatgttggccaggctggtctcgaactcctgacctcaggtgatctgcccacctcggcctcccaaaagtgctgggattacaggcgtgagccacggcgcccggcctgctttaattttatatccattacttactaaccctttttgtttcatccattttctagtgctgcattagacgtggaactatctgatgattccttccctccagaagactttggcattgtgtctggaatgctcaatgtcaaatgggaccggattgccccgtatcctcttggcacttggtgatgaagggtcggggggcagggagagccttgcctgcaaagcagcaggggtacttcaaataggctggatatgtgtggctgtcctcctgtcatctctctggataagatggagcaagagaggttggtgtaaattgtgtgagcatgatttagagtagacatgaagaaggaggatactgaagttcagattataagaccctgaaacaagctgggcacggtggctcatgcctgtaatcccagcatttttgggaggccgaggtgggtggatcataaggtcaagagattgagaccatcctggccaacatggtgaaaccctgtctctattaaaaatacaaaaattagctgggcatgatggcgcgcacctatagtctagctacttgggaggctgaggcaggagaatcacttgaacccaggaggcggaggttgcagtga

SEQ ID NO: 56405 - DNA, 1895 bp, Homo sapiens
gttatagtaggaatggagaaaaaaagatctacttttttggcacttcaaagggcttctaaataaagctcagggctcggtgacctgctggatgtagggaatgtctatgtgtcttgtctgagaatagaaaaaatactggttggaatagcttttctctaattctctgttcgacagtactagttgacattttagatagatgatccaaatttctaggtttgctagtttcccaaagcacctaatgaggtgcgggtcacatacagtagtgaaaaatcagcttgaaaagccccccaaagagggccgaataagaagcctggagaacgcacaaacctcttaggagcgctcacagcctctcaggcaggcgggcactacaaagggaaaggtggggcttctccaagaactacaactcccacaaggcattgggcggaacaccacggtttccggccagtgcttatttccggtctttcggatgctgacgctctcttcctgtctttgtggctccggaaaggcgtttgggatgccaacggtaagtccggaggcttagggcgtccgaacgggagaggcgagagcctcgtgtccgcgcatcaccccgtggctgggggttagctaggggagggcgggaagggcagaggacgcggtggctggaggacgtgtaaccttgcaagaggcgggaggcggggggcagaggtgattgacccccgcccccccgcccgtgggaccaagaaagggatgtgacaggcgaggacgaatgggatctcaggggctggactggagagtggggtacagggatgtgaggaggaccccgcgagtccgcggtgggatcccaatagagctgtggccaaggaggaggggagcagcgggaaggctgtgggcactcctgtgtgagggaaagctacaggctcctgcaggtccgagatcggccgaaatcaggcaccccaaggaagccctgctctggccacatggtgtcccctcagaagactccaccagccggtgggcatcccggggcttctgacaggaagagggcagtagatatattggtgcttgtaccggtttttcgagggctgcagggtgaagatggtaggagagtctggagaacgggtctgctctggtggcttatggactactctgtggaaggggctgctgttctggtagcatcgaaggagctttctacgggagcgctgtcaagaggattttggtgaatttgacgtacttggtttgataactcactttgcttttttctctaaagatgaggctgctgtcatttgtggtgttggctctatttgctgtcactcaagcagaggaaggagccaggcttttggcttccaaatcactgctgaacagatacgccgtggagggacgagacctgaccttgcagtacaacatctacaatgttggctcaaggtaactcgaggccctagagttacagattaagcctatttctggattcttagttttcagatgggaatagggagcatattggtgggtagtggtttctctttgggacacttccagcatcagatatattgagtgaatgaatacacttcgggatctacttttggaaaggaggacattcttacctaagctacaagaaaccatctttcacgtttcgggttggaagaattttagagtagggaagtggcaagaattgtggaaaaactaggagggaaagataaagacacagaaaatacacaatcccttgttacctcaggggtttaaagtgtcatcttccagcctggcatggtagctcacgcctgtaatctcagcactttgggaggctgaggcgggcggattgctggaggtcaggagatcgagaccagcctggccaacatggcaaaaccctgtcactactaaaaatacaaaaattagccaggcgtggtggcggacgcctgtagtcccagcta

SEQ ID NO: 56406 - DNA, 1696 bp, Homo sapiens
tgcaatctttaaactttcagtggctgtgcagagtcgagggaggaaccagctctctggtttactggaacatagtcttccatctataccactagggttttgtcttatgtttacttttggtaactctcttccttctttttctccctaccccccaacccctagcccaaccaatgctagaatttcttgctctgaaggaggagcaggtgaaacaggtggtaattttccttctcggcccctattctggttcattcagcactttttggtgggaactgttggaaattccagggtaaggaggaagatgcctgttctccctgtctgaagagggagatgagacagctctctggacaggaattaacaaacgctggagcagcccagaggaaattcgtgtgaaagaggagggaatgagattattcggaggaagggaatgggggagacagcctgagtaaaaggcttggaagttggaattaacagtggggagcagaagcactcatagctcttttaggcagaagaatccaggcccgagctggcagaagagacttagagatgctaatggaatttaaactgaaaaaaggagcccaatgaagctaagcgccacgccccacaaggggtcatattggctttagttcctcaagcatatgtgcttatatgcacacacacacacatttccatggacccaggtcttgcttgtgtccccaggcaccagtagtttgagcccccctcaaaagacatgaagggggttggggtctgtgtgagtagtggggaggtgcatgtgtatccacatgtgtgcatacactcttaagttgggtgggaagtggattccttgttggtttctggttcagagtgctctcccaccaccagagacaagtgggtaaaaaggtcagtccattgcaggaatatatatccgggagagctaggtcccttggggctctggatgctgggtaacccagaggtaatgtgggtaccctttctgaagctgtcagggctgtgactagcacccttatcacccctcactgccttgtgggaatagtagagggtttttttcctccagagcccctggcctttcagttcttaactatttccctccaggccagaaagttttctttgaggaaggagaggagagggtggcaatgatgcctttgatctggaattggacatttctctgtcagagcacagaggaggctcatatcacctcttccctctcctacttggcccagctgcttggaggaccgaccccatggctgagaatatgacggcaagaggaacagagtttgctccaagtgggaaagggtcccaagcagtccagagaagatgtctgtgtggctttccctccctgcctcccccagctcccacactggcctttgtaaataaatggcgtggtctttgttgtgagagtgtgttggcgtttgtttttttgaggaagaagctggctgaaaacaacttcttggttttccagggcaagagttgtgatctagaggaatttgaagtttggttcagttactacagatgttaagaaatattaaaagtggctgagatcatgccattgcactacagcctgggcaacaagagcgaaactgcatctcaaaaaaacaagaaatattaaaaggttttagcctggcaacatagggagaccttgtctctacgaaaaatttaaaaattagccaggcatggtggtgtgggcctgtagtcccagctacatggg

SEQ ID NO: 56407 - DNA, 1022 bp, Homo sapiens
cccagtcttcctgcagcaggtgagtgaggagcctagatgggtggaggttgagggcaaggggtagtccctgaagcccaatgggtggaaatgaagttggggcagagcttgactctggactcctagttgaggttgtctcctctttcctgccacctcttgatgcctttctctgcttatttcccaccagatgcagaacccagagtcactctccatccttaccaatccccgagccatgcaggcattgctgcagatccagcagggactacagaccttgcagaccgaggcccctgggctggtacccaggtgagggtaggggggcaggagggcagcaaggttctagcaacttctccccttcaactcttctctctgccactctctcagcatcctttgtgtctctgagggtctgttttcctgtttcttccaactgcttttccttctggatctcacattctcatccctttcttggatgccatctcctacctcttggtctctcttgcctacagccttggctcctttgggatatcccggaccccagcaccctcagcaggcagcaacgcagggtctacgcccgaggcccccacttcctcaccagccacgccagccacatcttctccaacaggggcttccagcgcccagcagcaactcatgcagcagatgatccagcttttggctggaagtggaaactcacaggtacatgaggcagtgggggcaggtgctgggagcaccactttgatcctgggaggtttcaagggaagcaatagaatagaggcagtagggcaagcttgggagtcaggtcctgttctgccacttgctagccttgggcaggttactgatgctccctgagttcagtttgtgcagatgtgaaatagagatgagaagagtaatggtacttacccgtgcactacatactgttctaaatgctttagattttggagctcatttacgactcatttaccacattcctcacaatagcctcatgagaaagctattattattatttctgtgttaaagatggggaaaactga

SEQ ID NO: 56408 - DNA, 1043 bp, Homo sapiens
gggatgtcttcagcagatgctctaatttctctgcactctgggggatatcttgattgggaaagttccttccctctgtgtgttttagtttccttatttgtaaagtaaggactggaacttgatccatgattttaaaattgtgctcctgcatcctggaaaggtcttcatctccaggatgaggaaggacccaatgggagaggctgcagccctcctgccccagctccagccagaccattaacacacttggtttctgagtgagatttagcatgaggaaagggtctctgctgctaagacaagtttgatctagatgatatttaatcatttctttccaaattggacataatttgagcttatggcaggaacagtccagagaggcataaatcagacccagttcctagctggcttgtccttatcaagtaaatggaaaaggggccaggccaaagcagggcaagatgaccttggacttgggagagacttggactcatgccacaatcctagggtgcccactggaccattgcttttctgagttttgtagtcattcggtgtctgaagtaaggtagattgaagtgaggccttcggtttccatctggaccctttctctcctgttttctttttttccgccttgtcctagggatgttcaatagcccagaaatgcaagccctcctccagcagatctctgagaacccccagctgatgcagaatgtgatctcagcaccctacatgcgcagcatgatgcagacgcttgcccagaaccccgactttgctgctcaggtatgaaaccagcatgaggagagtattgttggggagagagttcctcttggttgggggcagtttcttgtggtcaaaacactgtggagccagactgcctgggtttgcatcccaagctctgctgcttcccagctgtgtgagttaagcaagttatttagcctcccagtttctttatctgtaagatgataataacaatagttcctacctcctatagttgtgaggattaaatgagttaatacacgttaagtgcttagaacatggcgtgtgacagagtaagt

SEQ ID NO: 56409 - DNA, 1009 bp, Homo sapiens
gctgggaagcagcagagcttgggatgcaaacccaggcagtctggctccacagtgttttgaccacaagaaactgcccccaaccaagaggaactctctccccaacaatactctcctcatgctggtttcatacctgagcagcaaagtcggggttctgggcaagcgtctgcatcatgctgcgcatgtagggtgctgagatcacattctgcatcagctgggggttctcagagatctgctggaggagggcttgcatttctgggctattgaacatccctaggacaaggcggaaaaaaagaaaacaggagagaaagggtccagatggaaaccgaaggcctcacttcaatctaccttacttcagacaccgaatgactacaaaactcagaaaagcaatggtccagtgggcaccctaggattgtggcatgagtccaagtctctcccaagtccaaggtcatcttgccctgctttggcctggccccttttccatttacttgataaggacaagccagctaggaactgggtctgatttatgcctctctggactgttcctgccataagctcaaattatgtccaatttggaaagaaatgattaaatatcatctagatcaaacttgtcttagcagcagagaccctttcctcatgctaaatctcactcagaaaccaagtgtgttaatggtctggctggagctggggcaggagggctgcagcctctcccattgggtccttcctcatcctggagatgaagacctttccaggatgcaggagcacaattttaaaatcatggatcaagttccagtccttactttacaaataaggaaactaaaacacacagagggaaggaactttcccaatcaagatatcccccagagtgcagagaaattagagcatctgctgaagacatcccccaggccatgtgtacagtcatagtccagataaatggagcatcctctagggttgtgcagtgcataacctgttcttctgtacatggcaagccctgcacatccctttcccccag

SEQ ID NO: 56410 - DNA, 1214 bp, Homo sapiens
ggtttggagcaggaggggaaaacctagagagggcatattctgctggaggtgtgttctgctaggggccgccactgtggtgtgcctggatggacagagaatgccaggtaggggacctggggagtgagggaaaggttctggggagttaggattagtccaaggaggctggggaaagggaagatcggggttcaagtagagagccaggtttgacagcccactcccattaagccagtagttagttattgagcacctactagtgtcggggctgggggtgcacaggcaaatctgacattgcctctgccccttgaggtacaggaacacaaatatttggctacacaatgggaaaactgtgtgtaaagtgcggtgggttacataggagatgattagagaccaaatattgaaagccaccggggggatgggaagtttccaattatctgagaggttcagttatccagtcactagcatcagctagctcccaccctatggagcaaggaaggagctatccattgtggggcaaagaactgaactgaggacctctaaggtcttagatctctctcccttttctggggaaggggaggctattaagtgagaggagagaatgggcctagcccttgtccctgatttgtttcagtccttaacccaaaacctttccctcctcccagtttggcaacaatcccttctcttccctggccgggaactccgacagctcatcctcccagcctctgcggactgagaatcgagagcccctccctaacccctggagcccctcgccccccacctcccaggcccccgggtccggtggggagggcaccggaggatcggggaccagccaggtgcacccgacagtctcgaacccctttgggatcaatgcggctagcctggggtcaggtatgtcctaggatggaaggagcttagtggggtcaccagggcagcccctctgtcccaggactgaatggggttcatactgctccaggattttgaagacagaggtgagactatcgaggccacagagggggctctgccgtctgggatagtggccgggtgagggctggttctggccatgtcctgatatccctaggagtgacctaagtaatagctcatgagtaaaccaggccccacttcctaagctccatgagcacctctggtattatccagtgtaaaaggttcagactgctgtggggagagggggctggagaggaatcaaggcagacctgggg

SEQ ID NO: 56411 - DNA, 1065 bp, Homo sapiens
gtcccccttgccctaccatgctcctcactgtgctccccaggatatctcaggtccataccccatgggatggtgtgcttcccaaaggcaacaccggaacctcctcccctccagcacctagcacagagctctggctgagggagtcccagactcagttttccctactcagcctttcttgtggtctaagagctcagcagctctctttcctgagttcccaggtggtcctacctcagcccctccccaccgtagggtttcatattgagctgcttttcctgttcattgaaagtgggtcatggggaccggggctaaccaaggattctcctactctgagctgtttccttcacctcaccagatcctgttcagataacagagctcacaggccagggttcatgcaccatggtttcagcctctgtgcctgtttcagatttcttgttctgatacttgcctagcacctcaccccaccttgttctgggctcgctttattcttcctggtacactctaaggacgaaatctcttttcctgaactacccacagtgataacaaccatcatttattgagcacctactatgtgcctgacacatttattctaatgcttataatactcctctaatacaacagttctcaaagtgtggtcctgggacccctgcaagcattaaaactgttttcataattctaagacatgaatttgtctttttcactcttattctctcatgaggatacagtggagttttccaaagtctacatgacatgtgacattgcaaactgaatgcagatctgagaaccagctgtcttgtagtaagctagacatcaaagagaactacaaaaatgtaaaacaagtccatactttcctctacagttttgtttgttttggaaaataaagttatttttcaaaataatgttatttatgttaacttgtaataattttttttttttgagatggagtctcgttttgctgcccaggttggagtgcaaaggcacaatctcggctcactgcaacctccacctccagggttcaagcaattctcttgcctcagcctcctgagaagctgggatgacaggcacccacca

SEQ ID NO: 56412 - DNA, 1263 bp, Homo sapiens
aatttgaaaacggctctcattgagaggcagtgtgtttagttaagagcctggactttggtgtcaagacctgagttctggtctgcctggggcaagttaccttacctcgctgatcctcagttttctcatctttaaaatggagatacggctgggcgtggtggctcacacctgtaatcccagcactttgggagtctgagtctggtggatcacctgaggtcacgagttcaagaccagcctggccaacatggtgaaaccccgtctctactaaaaatacaattagccaggcatggtggtgtgtgcctgtagtcccagacactcgggaggctgaagcaggagaatcacttgaacccggaagatggaggttacagtgagccaagatcgcacctctgcactccagcctgggctacagagcgagactccatctcaagataaaaataataataaaatgaaaataacaatatactatatctttaactggtgaataggtagtgctcaataactggcatctatttgttgtagttgttaagagaatactgggaatagagaggagagaaaattgggtctcagaaggctgaaggtccaaagctgttgaaggagttgggatgggaggctgctctgccttacagagaactaggtggagggactgaagctgggaggcagatagcagcaggggctttctagggtgggagactctgggatggagctgagagaagagcctctcactggttcatctcctttgttaagaaaggagatgcttattgcagctggaggaatggcgtcgagactacagaaaggacttcccatgactagagatgagagcaagagagtgcagaaggtgttgaaaaagagtcagggtccctggtagggggagtccaggcagcctccacagtgacctctgcctcttgatcacagttcaaagaggaaatctcccggaggtttaaggctcagcaggatcagctggtcctgatcttcgcaggcaagatcctcaaggatggggacacactgaaccagcacggaatcaaggacgggctcactgtccatctggtcatcaagacccctcagaagtaagttcaggagcagagcagatccagcttctgattgggcctccccatctgatactttctcactcattgcttaactgtacccagagggcctaagctgaggcccaggcaggtagctcctggatgaatatgatctcatctctaggggaagggaacctgatttaccattcccagaatgccctgaagacagataatactagctcct

SEQ ID NO: 56413 - DNA, 1139 bp, Homo sapiens
caatctcagtaattgttctttaaagctgactcgttcttcacctacttgcaaagtgctttcttgtctcataaaagttagattccaagaaggacttcccacggagtggagtggaaacactgtccttgaaggcctgggagaaaggcatccccatgggcacagaggctggggaaaggcacagggactttgggtgaccctaaccctgaccctctgctccagttcacctccatctatatgtgttcaggtaggggtcatctactgtaccctggcctgggaacacattgccctccccacacaaaactggagggcttggcttctgcgtgtgagaaatcaacatttttaaagcacttgccttctaccaaccccagcttgcaatcactgggccttcccctcctatccaaggggttggaggggccccttggctctccttttggcaggaggagcctgcttcattacaccaatgactctgccatccccctccctggccctagaccccaaacacatctccctctacccaatttactcttctcgccccacctagggacagattccccctgctctttttgtcctagaaaccccgctagtttgggatggtagcgtctggggtggggagggcttccccttccccactcgagggtgcgggtggggaagggggggtgggtggagacagccctggggcagggaggatggtctctccactgtagaaagtagagtaggattgtggtcagacttaatttgaggcatctagtgaagacacgtacaaatccaccaaggaaaaagatttcaaaagcaaaataaaagcgggaaataaaacagacccaagaataatcaagtcaaagtgatgttgcacaaaatgcagagaaaccaagaagggggagggttaatgtattaaatgtgctattaagaacttaattttattaaaagtactattacttaaggctctgtcttcgttctctgcatgtaagtctgtgccatcttggggtgagtgggaggatctgggtggggattgcagcttggggtttcctctagtgtagctttgggctccctacacacctgtgagtagtggatgtctctggagttccttgccacccttaagctccccctttcagctctccatagctctgcttgagtctccaagctct

SEQ ID NO: 56414 - DNA, 1272 bp, Homo sapiens
ctcctgctcatttggggctgccaccagctctccaccctcctggttccgctggccgggccaagagaggatggagggatgggagtcccaggagatccttgtaaatagtggggtgggactgttctgagtgatcacccgagcacttaaagctccagagtcccattcttcctggatggagcaggtggaggtgcagaggggatttcctcctctccttcctcctgtcgagaattaacacctctccacagccttcccctccagaacaccagccagggaggggtggggaaggaggtcacagccaagaaaactgccctgtgacgacttccctccttcccgcctatgtgagccatcctgagatgtctgtacaatagaaaccaaaccaaatgggcaccctcggttgccggggggcaggtggggaggggggtgggaagaagggatgtctgtctgtcgtccccctccccctctccactctttacccacaaaggcagaagactgttacactagggggctcagcaaattcaatcccacccttaccaattgagccaaacctagaaacaaacacaaaacacgaatagtgagagacaaaatagaggagagaaagagagcatgagagggagcgagacaggcgaccaacacagaggagagaaaacaaaaatagcaaaaaaaaaaaaaaaaagcagttctttataatttaatattctattttaataaaggcgtttattaccatataaatgtagcaaagaacctgggctaatatgaaaaaaaaagactttttattaggtaatttattatatgaaaaggatattttattttatgataaagtgatccttaaaaaaataaaaaaactttagaaggtttagaatatatgtagggagagaagaagaaaaaaatacatttgtattcagagttaaatcttaaaaaaaaaaagtgtttttaatatatgtttgggtttacgttgcttttttcccccactttttttttggggaggaatgtcatttgcttttcttgggggagcatcccgggggtgaatggtggagagaggagctgggggaacccggtccctcctgggacccttccagtagattggatttcactccatggactcctcctcccctctccccctccccctcaggggagccggcagagccaaacaaagaaagggattaacaagaaaggaagaagctgtaggactaaggactgaggatcctggggtgtcccccaccactttcccctgccctgtcgcaggggcaagtgaggagggggaatccagaattaagg

SEQ ID NO: 56415 - DNA, 1385 bp, Homo sapiens
tggagtgtgcagtacgcatctgcgagaggacggacccagagtgtcccgtctgccacatcacagccacgcaagccatccgaatattctcctaagccccgtgccccatgcctccggggcccactccactgggcccaccctggacctgttttccactaaagccttttggaaagcggtgatttgaggggcaaggtgcttagagatactcgctcgctggggaaggggggagggaggcagtggtggctggagggtgcgccactttcagagcctctggtcaccctgtcctggaaagattgggagggggccagactgaaaattttactagagttacaactctgatacctcaacacacccttaaatctggaagcagctaagagaaacttttgttttgccagaggtggccactaaggcattctgacgccctctgcccacctcccccgctgtgtgtcactccaccccttcttccgaggagggggtgggtaaaagggagagggagaattaccacctgtatctagaggtgctctttgcaatccctaagccctctggtcctgacctccgacctcctaacatgaccctttacctcccaccccacccccatatcctgtttgggaaactgtcaccagtttccagcagtgtaagggagttggagtcctatcagaagttgcatagatcttctaggggttggggagagaagcatgtcaatcgtttctgtggctgaaaggctcagaagccatctgtccccacaaagctgggctagaggaatctggagaggagtcctcctctctgcccctgtcccctgcagtgtttcccttcactctctccgcctatcttcccttcctttgggatcttccctttcctcaactctttcctttccctccagctctttgctttgctttcttttggtggctgtcactcccagctctgtcttgttccttgtctttgtctttcttcccttccccctgcccctgcccctaccagcccagctttggggacaccatccttctggggagaagtagggggaggaatatttggatggtccctccattcctcttcaggcatctggaggccctctcccccactcctccaaagaaacatctcaaattattgatggaatgtatccccattctcagtgaaaatgtgaggaggggactaatactggggtaaagggtcaaacccccaccttcatcactatgggcattatatttagggagtagttcttgggctggattttctggttgtggaagtgggggcgccagagtagtgtgtctgctatttaaaggagcaggaaagggcgtgaggcaggaggagagactggtggagggaagagctgctcctcccatgcagtgcccgactccctgcacccctctcaacctgacctgaacctttat

SEQ ID NO: 56416 - DNA, 1027 bp, Homo sapiens
tgagtacctgggattacaggcgcgcacccccacgcccagctaatttttgtatttttagtagagacggggttttaccatgttggtcaggctggtctcgaactcctgacttcatgatctgcccgccttggcctccattgcactccagcctgggcagcaagagccaaactccgtctaaaaaaaaaaaagaaagaaagaaagaaagaaaggtctttgggactcggagggctacagaggttgggggagagaggtcactgtgagtccttctgttgttgtggatctgatctccaagggctttgcaggctcagcctaggtttggagatggacaaacgtctctgcttctcccctgggactacactggcacttcctctgccaggtcccctgcattgtctgatttccccagggagagtagctcagaggggctggggtggagtctgggccccttaggacagctggttgatgaggcccctctgggacttagggctggacccaggcgtccaggaggcgggtgatactggagctgtgacagttggtccccagattccacacccagtggcgccagctctggtttcgagctgcggtgagggagggggaggggcacctggtgccagccaggggctggatgctgtcttggggcagggagggggaggcagtaaacatgtccttcctaggttgttgaggattttctaattgccctctctgtgccaggcactgtgcaaggtactaacgagattctgcaatgcaagatgcagtctggcacagatgaattgacagcatacagtatagaattagaatgtcagagctggactagaagttgaatgaatgaatgagtaggggaatgagtgaatgaatagttcatcagttacctaatgcactcattttacagaggagactgaggcccagagaacccgagtcctgtgactcccttctgctttctgatctgtcatgcttcctttttcaggaaagggaagcaaaaggcagagagaggggtgggaagggacttgacgtttcctgagtgcatgtttggtgc

SEQ ID NO: 56417 - DNA, 1091 bp, Homo sapiens
cagtggtggaagaagggtgagtcacactgatgggcaccagcctcagccctccccccactttcctggctcccagccctgcctacctgaccctctcccttgctttgcgcccacttccctctctttctccccgacccttttgcccacccactctccctccttggctctgccctctagcccagaaggtctgaggcaatgggggcaagcttggagccgacagtgctgagcaggcaggagccaagagaggggaagcttgagcctcacgcagttaggggtgcgctggagagggtggggcccgactccgccacaccccaacggtccttccccctcctcaccactcccgcccccacccccaatggatctgggactgcccctttaagagtagtggcccctcctcccttcagaggaggacctattagagcctttgccccggcgtcggtgactcagtgttcgcgggagcgccgcacctacaccagccaacccagatcccgaggtccgacagcgcccggcccagatccccacgcctgccaggagcaagccgagagccagccggccggcgcactccgactccgagcagtctctgtccttcgacccgagccccgcgccctttccgggacccctgccccgcgggcagcgctgccaacctgccggccatggagaccccgtcccagcggcgcgccacccgcagcggggcgcaggccagctccactccgctgtcgcccacccgcatcacccggctgcaggagaaggaggacctgcaggagctcaatgatcgcttggcggtctacatcgaccgtgtgcgctcgctggaaacggagaacgcagggctgcgccttcgcatcaccgagtctgaagaggtggtcagccgcgaggtgtccggcatcaaggccgcctacgaggccgagctcggggatgcccgcaagacccttgactcagtagccaaggagcgcgcccgcctgcagctggagctgagcaaagtgcgtgaggagtttaaggagctgaaagcgcggtgagttcgcccaggtggctgcgtgcctggcggggagtggagagggcggcgggccggcgcccctggccggccgcaggaagggagt

SEQ ID NO: 56418 - DNA, 1082 bp, Homo sapiens
ctccacatctgccttaaaaccaaagagggcttcctctagaagccaagggaaaggggtgcttttatagaggctagcttctgcttttctgccctggctgctgcccccaccccggggaccctgtgacatggtgcctgagaggcaggcatagaggcttctccgccagcctcctctggacggcaggctcactgccaggccagcctccgagagggagagagagagagagaggacagcttgagccgggcccctgggcttggcctgctgtgattccactacacctggctgaggttcctctgcctgccccgcccccagtccccacccctgcccccagccccggggtgagtccattctcccaggtaccagctgcgcttgcttttctgtattttatttagacaagagatgggaatgaggtgggaggtggaagaagggagaagaaaggtgagtttgagctgccttccctagctttagaccctgggtgggctctgtgcagtcactggaggttgaagccaagtggggtgctgggaggagggagagggaggtcactggaaaggggagagcctgctggcacccaccgtggaggaggaaggcaagagggggtggaggggtgtggcagtggttttggcaaacgctaaagagcccttgcctccccatttcccatctgcaccccttctctcctccccaaatcaatacactagttgtttctacccctggctgctgtggtgtctttgttggtggacgtcgctgtgtgtactgaggtgcagactcgtgggcatgcgcgcgcgtacacacacacacacacacacacacacacacacacacacacacacagcgccgcacggtcactgcatcctcctgctcattgctgcccagccctgccctgctccaggggaaacaattagagatcagagcactttgggtgcacatctgggcactcggtggtggctgagggggaaggctttgatataaccatcaccacccactgtacggctctctcccaacggaagtccttcagagaagcagcacctgaaggagggcatttgctaactaacttccctcgtccaccagcacttactgagtgctttctc

SEQ ID NO: 56419 - DNA, 1043 bp, Homo sapiens
gtgatgcacagcagtctgcctcccctatgggactcccttctaccaagcacatgagctctctaacagggtgggggctacccccagacctgctcctacactgatattgaagaacctggagaggatccttcagttctggccattccagggaccctccagaaacacagtgtttcaagagaccctaaaaaacctgcctgtcccaggaccctatggtaatgaacaccaaacatctaaacaatcatatgctaacatgccactcctggaaactccactctgaagctgccgctttggacaccaacactcccttctcccagggtcatgcagggatctgctccctcctgcttcccttaccagtcgtgcaccgctgactcccaggaagtctttcctgaagtctgaccacctttcttcttgcttcagttggggcagactctgatcccttctgccctggcagaatggcaggggtaatctgagccttcttcactcctttaccctagctgaccccttcacctctccccctcccttttcctttgttttgggattcagaaaactgcttgtcagagactgtttattttttattaaaaatataaggcttatgtatgatgggtgctgtgtttgctggagcagagtgctccggcagagaattgctgggatgtcaagggagcaagcagtccaagcacatcagttgggaggaggactaggtttgtggggggattgttctctccaactccagactacctcctctgccctgccagctccccacccagaaccagcccacccagaaccagcccacagcactttcctccactctgagcattgctagagggtgctgcaaacttttgccttttgggccaaccacaggttggtgttgaccaggctcagcttgtatccttctgctagacaggcgatacctcatccatcactaactcccctgctgcggcccccacagttgctgtccacacctctcccacacttctcgtgactccaattcagccctgcttccccactgcagcagttggcttcaactgttggtagacaaatttatagaa

SEQ ID NO: 56420 - DNA, 1267 bp, Homo sapiens
ttacactactgagtaatggaagtgaaactcaacatggatctcctgattgctggtgttctttccgttgtatgaccttgccttctaggtgacactaccttctctcgagccagaatcttatcccagaacctagtgaatagtcagtcccatgtgaattttctggtacaaggagagtagaggtggagaggaggaggcatatgcccctgggcctatttgtccctttccattggtagggtcaatagtgagagctctgcctctaacatttcacttgattacttcaggacaaagtgctcactaattctgcgtcacctgttaggtcccttgaggaagcacgtcaacatttgtgcctgagcagtgttaaaaagtggaagaaaatccggaattggagccatgcacatgagggtctgagaaagagccctaaagaagttgggctgactaagttgggagaagggaaggctggaggaactttgcatacaggtatctgcaaagaggattttttcagagggtaaaacaagaagaatgggattgatatttccgcaggaagtttggaagttatgtaacagagcaggttgagatcctaccttttaggagcagcctgccccttttgaaggggtaaagggagtgggtgcagtgccctctcttctgttgtagtggcttatccctctaaggcatgacccttggataggggttacctgcctcggaaagtccccacttccttgtgggagtttaaaatagattggcatatgtgagagatggagacaaggtgggaaatcggatcctgtcttaggatttctcatcaggagatgctgatacttggtgtttcagcttgataaattgagaaggtgccatgaaaccaggtcctggaacagaatccctggttgctctgtcttttagctgctctgaccctctgccctgcagagcatgcattttgcatgtgcctggcaggaggccctcctgcttgagccctgctgtatttgtctgtgttgacaacgtgactgccagccattaagcttggtcagtccacagacacactaggaaagcagaggcagctcttggtttctctggaacagagctgcaagaagtctctgggcatctgcatggccaggagcttatgcttaactgttgagtgacctgcagccataagggcattaattctgccttccagaggtgggaatgacttggctttaaacagtgatttgtgtgagaattcttcaaatcccataaggtagaaggcatggtggagtagaggagaaatcttggctcatatctg

SEQ ID NO: 56421 - DNA, 1467 bp, Homo sapiens
cacagtggctcacgcctgtaatcccagcattttgggaggccgaagcgggcagatcacctgagcccaggagttcgagaccagcctggccaacatggtgaaaccctgtctctactaaaaataaaaaattagctgggtgtgttggcatgcgcctatagtcccagctactcgggaggctgaggcaggagaatcactcgagcccagaggtgtaggttgcattgagccgagatcacgccactgcactccagcctgggtgacagagtgagactttgtctcaaaaaaaaataaataaataaaagaagcccgcccagcacttaaagtacctggaatgcttctcactctgtctgctaccttgcatacctctcctccatcacatgcccatgcctccaggaaatcttactggtttcttccagcctttattggagtcctattccatagcctattagcatagcctatcaacgactctttcctttaccttgcaggtttgtggttataagaaatatcgatttcagttaattcataagtctgtctggtttttccagtaggccataagttctctgtggattatgagagtgacttaaataggtttcacagattttatggtgtggatgcagcaaaaccctgacaaagcccatagtaatggttgtcttcagtcagcttaaagacagttacacagcacctagaccagggaaatagaatctgaatgatgatatgtaatatgcaaatagtaggtgttgccatataaagttttatgtctgatttgaggtggagaatcaaagttgtacaagagaatgaagtcactgggttatggtgaggggaggagggaaggaagataaccttaacaggttggagataaaatcagcttccctagtaccaggatgttgggaagcagataagtaacaaatataggtatttttgttcctaggaaagaatgccccctcatttgaaaatgaatacactggcatctggttggtttgcaaataataaagtgcacagggtcagtcctcattctttcctgagccttgttctgggcgttctaggaggagatccaagggaaaggacaggtctctactttgaggagcttccaggctggaaagacccagaggcataggtgaaaaagtccttgacatggctgtggaaaaagtggaagggttagggaagcagagacggtcacatgagagagtattggagaggaagaagggagtgcggaggagggtgctgaaggaggtagggcggaagcgggggatgttcttagccatggctgggataccttgtgaaggtcatatcatataaagggaggtatgaacaaggagtgagtctgtcctgtattggccgaggggctgaggagtggtttctaaaggtgtagtttaggggttggggagggtgtgggactgttgagaaagaagagagaagtgatttctgcttggccaggctttcagtgtgagagggaagatgcctatatttgttcat

SEQ ID NO: 56422 - DNA, 1125 bp, Homo sapiens
acggatcattctgaatcttcctgcccctcctcactgcttaaccctgagaaccacaaatataatggaagcagttccccccaccctcaccccatctctttaagctcatcctagcaagacctctagagaccctagagactcgactttagtccttccccgccatggcacagtggggaaggtgtcaatggggagtgtcacggacaggaggtaggatcctgccgctcgcgtcttagtgtttctccctcaagactttccttctgttttgttgtcttgtgcagtattttacagcccctcttgtgtttttctttatttctcgtacacacacgcagttttaagggtgatgtgtgtataattaaaaggacccttggcccatactttcctaattctttagggactgggattgggtttgactgaaatatgttttggtggggatgggacggtggacttccattctccctaaactggagttttggtcggtaatcaaaactaaaagaaacctctgggagactggaaacctgattggagcactgaggaacaagggaatgaaaaggcagactctctgaacgtttgatgaaatggactcttgtgaaaattaacagtgaatattcactgttgcactgtacgaagtctctgaaatgtaattaaaagtttttattgagcccccgagctttggcttgcgcgtatttttccggtcgcggacatcccaccgcgcagagcctcgcctccccgctgccctcagcctccgatgacttccccgcccccgccctgctcggtgacagacgttctactgcttccaatcggaggcacccttcgcgggagcggccaatcgggagctccggcaggcggggaggccgggccagttagatttggaggttcaacttcaacatggccgaagcaagtagcgccaatctaggcagcggctgtgaggaaaaaaggcatgaggggtcgtcttcggaatctgtgccacccggcactaccatttcgagggtgaagctcctcgacaccatggtggacacttttcttcagaagctggtcgccgccggcaggtaaagtggacgcagccgcggtgggagtgtttgttggcaccgaagctcaaatcccgcgaggtcaggacggccgcaggctggc

SEQ ID NO: 56423 - DNA, 1131 bp, Homo sapiens
acctcaggtgatctgcccgcctcggcctcccaaagttctgggactacagacatgagccactgctcccagccgaatacagacttttaagtagagacggggtttcaccatgttggccaggctggtctcaaactcctaacctcaggtgatccgcccgcctcagcctcccaaagtgctgggattacaggcgtgagtgtatggcgacagttcttaagttcttagatgccatacttagagatgtccttgtggttcagtcttctggcctgggatatgccgcacagggtaagatgtgtaaagtgacttaaagcctacgtctggcagtgaccaagaaaagaaagcgaattgcatttgtaatgaactagtgccaaagactgttggtgttcataggaaatagttcatcacaggaaaaagagtggtttaatatataaactattctgactataaatgccctggaaatatctcaccctctttgaatatgcaggtgatgcctgctattggtggtgttttgtttctgaagggtgggcatgagtcatcaaactgtggtgtgtggctccaggcctggcatgctcatactttccctccgtatgtttccagaccatccacctctttctgtccccactgtttttgccttgctccaggctgctgttgtctcagctgtgcttcctgaagccaccctcacatagcagccaagtgcatgtcctaaggtgtagatctgttcatatcacatctctgcttcagtcccttttctagctcctccggtcatgatacatccacactccagactctgtgtctggccctgcatggaagccaacatggccagatggcctggattgagtcccagctggctccatcacatgctggttgtgtgaccttgggcaagcttctctctgcctcagcttcctcatctgaaaaatgggggtgatgataatagaaccccgcctcacagaatcatggtaaggattcagtgagttatgtagagtacatagaacagggcctggcactaatcagtcctcagtttcctattattactgcatcttcacacacatgcacatatgtgcacgtgcacacacacacacacacacacacacccgcccttcagctacactgcctgaacttagtccatgctgctcttct

SEQ ID NO: 56424 - DNA, 1025 bp, Homo sapiens
tgatacacattccatgtgagtacaccttggaagctaagcttaggtacctaaaaaacaatacagtaggccaggcgcggtggctcacgcctgtattcctagcactttgggaggccaaggcgggcggatcatgaggtcaggagatggagaccatcctggctaacatggtgaaaccccatctctactaaaaatacaaaaaattagctgggcgtggtggcacatgcctgtagtcccagctactcaggaggctgaggcaggagaatcacttgaacctgggaggcggaggttgcagtgagctgagatcacgccactgcactccagcctgggcgacacagcaagactccgtctcaaaaaacaaaacaaaaataaaaacaatactgtacacagaatagacgatgggcattccttcaaccctcagcagactcccagatatcttgttttgctgctggcctgactagccacgcagtctgtggctaccaggaggaacgtggaggaacacatgatgctgaccaagcagggctggaattgaaactgggtaattgtggcttaaaacaggtttggcttagacatgggagatcctgttcctccacccagcctactcagcaggcggagggtctgagctggacgcatctctcttcagctcaggcagctgacagcggatagggcccagggcaggggtgaagcaaattctgaccaccagcgctggctgtgacctgttctgaggtctcctttatggtatgataattcagtgaaagtgaaggaccacagaaacacacacactcatacacagacacaagatgaaatatatgctaacaggacaatgtggcttaaccaaggagaaaggcagccagactggtgccagtgtcagtgagtacaggaagaaggtgatgtctttcttgagagccaatgcagaattgggaatgttttgaatgcccttgtggattttctgaaaaatatactcagggagaagcaggaaagtgatacactaaaaaaaaaaaaaaaaaaaaaaaaaaaaaaaatcgccaggt

SEQ ID NO: 56425 - DNA, 1155 bp, Homo sapiens
cagggagggcccaggagccggctgggagggtggggtccctttgttgccaagacgttaggaaagcgaggaaagtgcttggattaggagagtcttgtgggcccctggccagccttcctgcctcagctcccctgctgtctccaggggcaggtggtaggcatgggtacctgcatttcactggaatgggttcttggatctctgaggggaaggaacagcaaaagaggcccttcttcctcacccaagatgcagggtggttggggccaggagtttggaccctctaggtcttgggggaagagctgggtaatacctggtgtctgagtgattctctgcagacccttcccctcctcaaggatcacccatcctcctttcagccccctttatggggaccaggcagctctggagccagccacaggggctgttagagaagcaaggcctggagtggcctgcaccgagtagcagggtcagggttcgtgtgctcctcctcctgctgcaggggctgcacatcccattgccccacttctgctttgtgtctccctctgtctagcttccagggcagggagcaggccccacctagggctgcaggcagtctggcctgtgccagcacggtctcctgtgcccaccagccccacaggtgctgtgctttgtgctcttggctgctgtgctgggacagaatgggatgccaggaagagaagaaagggggtgcagtctgaggccaccaccccccttcctatctaagggagggctgaagacaaggggccggcattcagtgggcagcagaaaggagaggctccttgaagctgctcagtcagaggcccccgtccctccttttgccttccgcaggactgaagacctgaaggggctggcttttggagtgttgaggtgaatatctgggagcagagatcatgaatagctcagggcagtgaatggcgcaccaagagcagggctgtgtgtgggaggctgcagccaggattgcctcagctcctccccctcaggctgggaggatagcacaggctaggggctcggggtggagggtctcagctctgctgcccccaccccagtactagcctagcttcccaagctgtggcttagaggatagttggcttcctgcctctctcctctaaaatagcaagtctgggaaatcctggggtgagtggagtc

SEQ ID NO: 56426 - DNA, 1963 bp, Homo sapiens
aggaaaccctcttggtcttcctgatcactggagaagggaaaatacaccccaactccttacagctcattttttccctcataggcacaggaggaagctcgtcggaacaggctcatgagagacatggctcagctacgacttcaggtaggaaatcaggacccaagtgcttcttctgcacttggtagagcttttgtgtcaaccctactggcaggtctcccccttccgctgtagtccccctgctctgttgcctctgtgtccctccgcctctcccagatgaccctccttactactcactcttcactcagccatttgcctcctttctgccttcatttctgtctctccctctttaactcttatttctgtttacttttcccccaaagccattggtagagagggtcctctgatccccttaacaacaggaggagccccatagagccaccttgagcaccactcttcccccggcccggctgcaggggtcccccacagctgtacccaccttgccctctctcaccagctcgaagtgtctcagctggagggcagcctgcagcagcccaaggcccagtcagccatgtctccctacctcgtccctgacacccaggccctctgccaccatctccctgtcatccgccaactggccaccagtggccgcttcattgtcatcatcccaaggacaggtaagtacattggagaggtaaggagacagagtatgactaaaagagattctgggcttgggattaagagaccttatttggggcccagtttatatgcagtaaccttggtcaagtcttactacctttgtgaacccgtcacttcatctgtgaaatggacataatccctattctgccttacaagacagttgggagaaacagaaaatgtaagtgaatataatgagaaagcacttggtaaattgccaagtatattgctggcagaaggtcatgttttcagagaactttgggagccctctagggagccagggtcccttctctgcctgaagagtgtactgaggtgagctcagatacttcctccagagccccttgtcacagcagtctgagcttatctgttttgtctttccctaccttgcccaccagtgatcgatggcctggatttgctgaagaaggaacacccaggggcccgggatgggattcggtacctggaggcagagtttaaaaaaggaaacaggtgagtgtggcctggctggacctgtgctgagccctgggtctgtcttttggataacacatgcttatgaaagccccttgctccctatgggtaagacacatacatacccgtctctactcacagttagctcacctcactgcctggggagtgataccagagataattagaagtcaaggttgtagctgctgaaatagagggtgaccaaagggatcaggagccctgtggggagcactgagctgctgtccttcctctggggcaagcctgtgatcagcacccactggggagaagggagcagacctccctcccccaactttagactgtgaactcctttataggaatttctcctgctttggggttgggacaggtgatcaggtttctcagagtgtgagggcctcatccaggctgcccaggggcttcccacctccctgctgagctgagggagtggtaagaccgaagccagccagggaggggcagctggcagcatgtgcagatgctcagccggtacaggcctgcccttctggcctttggggctggaggagaactaggcagagggtgtagggaataaggagaaagcttccctctccctgctagctggcccaccccctcctctgcatctgctctggctggccaggaagctgcacaaggtctgattgttcggaccttgtctccagaagccctgacttgaaaagcatctgctgcttctcccctcccagctcctcccctgagaggaaccaaataattgatgttatcaggaggaaaagtgagctgggcccagcagccaggaagccac

SEQ ID NO: 56427 - DNA, 1181 bp, Homo sapiens
accactttgatgatgccactttggtcatcaaagagtcttcagtgggctgggcgctgtggctcgcaccagtaatcccagcactttgggaggccaaggcgggcagattgcttgagcctcaggagtttgagaccagcctgggcaatatggtgaaacccagtctctacaaaaaataccaaaattagccaggcatggtggcatgtgcctgtagtcccagctagttggggggctgaggcaggaggatcatttgagcccgggaggcagaggtagcagtgaacaggaattgtggcactgcactccagcctgagtgacatagtgagaccctgtctcaaaagaaaagaaaaacataataaaaagagtcttcagtggctccccatatcttacaggataaagtccccatccttagcctcatcttatagaccatactaaggaatttgggctttacccataatacagaggaaaggcatcagaaaacttttaagcagggctataatgggcatcagatggtttttaaaagattgccttggttgtaggtggagaagagggattgaattagaggcagagaccagtacggtggttgttacagtagtcaaggagaggtgttggcttagactagggtttcacagtggaggtggaaggatttgcatgctgtttaggggggcacaattgacaggacagggaacctgataacttctggggctgagagaaagggaagattcaaagccaaccctgagctttctgacttgggcagactggtttatttactaggctagggaacactagaggaagagacgcaggttctgaggagcagatggggctgctgagtaggcagttgtatgtgtgggtctggagctcaggatggtcaggcctgggctgaatctgcagatttggaagattttggcaagtggatgggggtagaaggtgaggaagtgcatgggtaggatctcctgggaagggagaccagattgagaagagcagagattgaatcctgaggcacagccaggtgatgtcctgcatggtgacggcacatggctgtctgcttcccctcccctgcagggcctggaacatcatgacctgcatcgggttggtaatggaagttgttcagagtgcagtggaagaatattttttcttccatgcctctcctcccctcattcagcagcagtgctagagagtgactttgcatg

SEQ ID NO: 56428 - DNA, 2958 bp, Homo sapiens
gctcccattgggctcactgagaaaccagggcaagaggctcagaccctctggtggtctccacctgaaggacatagtaagatgcctagggagaggggaggggaggctgggagggaggcctgggaaggactaagggatgtgactgatagacagggactgagaggggttttttttttttttatgagatggagtcccactctgttgccaggctggagcaagtgacgtgatctcagctcactgcaacctccggctcccaggttcaagtgattctcctgcctcagcctcctgagtagctgggactacaggcgcacgccaccacgcccagctaatttttgtatttttagtagagacagggtttcaccatgtaggccaggatggtctcgatctcttgcccttgtgatccacctgccttggcctcccaaagtactgggattacaggcatgagccaccacgcctggcctgaaaggggctttgagcagaggctgcctagctcaagacctgtacccagactgacctggggttgaggccatctctgtcaccttttaatctatgaattgagcaagtcacttaacctcaccacgccagtttccttgtcagttatgtgggaacaaacagaatccactttatggagttttttgaagatggaatgatagtgggtgtgaggtgccttgcacattgtcttatggcacatgtgtgtgcctagcaaatgctccctctgttccctttcattcaagagggataaagactgaggaatagaagggagcggagggctcctgatataaggggccatgaaggaaccttcccatcccagacatggtcccatcccacaggggccccaaaggatggaaagtggcctgtggtacctcttttccatccagtaattcattccacgaatatttatcgagagtccattttgtgccagacatgacagtattctaggcactggggttatagcagtgaacaagacagtcctttctcttgtgggcaacaatctggttttcacagtggggcctgcacagccttgggcatgtttcccaacacaccaccctgagctaagtggcaccagaacattggggtgttagtgtctggcacaggaagtatgatgtgtctcagcaacccctcagggtttcttcttcatctcaagccaatcccctcctccacattcttcctttgcacctgtcccagggccagtagcttccacaccctgtctgagtgccatttcttgtgggcattctgcttggctggaaaggggcaaaagctccccagaaactcccttccttactgtctgaaaaacaagcacattttgttaaaaacaaacctttgttaaggcttttattgctagtccataggggaagacatggggagggggttacaaaaataattatggggaagttagcttcaaaaaatgttaggagtttttgcaggcatttcctctagcctaaagctcttgaagacactcttcctgtcggggggtagggagtacctgcaagcccttctcatgtggtgctagactccacatgccaagatagacacaggccacgttgcttgctggggctgcctcctctgcttgagtcacaggcttccaccccgaagggcttatccccagcccagaggagtgttgtcgttatcacatttatcaagagttttctctgtgcacagcctggtttgcatgtgacatctcaattaacccttgcagcagcccagtgaggtaggtgcttgcatcctccattttatagataagaaacagtaggctgggctctgtggctcacgcctataatctcagcactttgggaggccaaggcgggcggatcacttgaagtcaggagttcgagaccagcctggccaacatggtgaaacctcgtctctactaaaaatacaaaaaatagccgggcatggtggcaggtgcctgtagtcccagctacttgggaggctaaggcagaataatcacttgaacctgggaggcagatgttgcagtgagtcaagatcgtgccactgcactccagcctcagcgacagagcgagactctgtctggaaaaaaaaaaaaaaaaggaaaagaaaagaaaatgtagaaagacaaaggaacattcccaagatcagaaagtatagtcggtggtagagccagggctctggagttggacacactatggatttcttatcctggctcttttctgctgctttagagacttagcttctctgtaggccaagtgggcactaggagttgcggggggtgtagtacctgctgatgggacttctgaaggtaggctttccctctgaggaacgcgtaggcctacatctgtttgaaatgctgggttggtaatgtcagagcctcatattagcacagctccatcttcttgggtccaggcggatctcactcacctacactagttctctgggggagcttttacacaagtgcccccatccccctctcttgaatatggagtttcacaattaccattttagtctaaaagcaactcattggcttgatttctgcagtgggaagagggaaagtttgtctatggtgcctcccttgcttaccagtttgcccacagggcctgtgagaaaatggctgttaggttgaggctgcagtgagccaagatcttgccgctgccctccaacctgggtgacagtgaaaccctgcctcaaaaaaaaaaaaaaaaaaaaaaaagagagaagatggctctcacctaggctctggccttctgcttccattctttcatttgtttacattgtttctcaaggggacactcttggcaccttgggcaggacaattctttgttgtgcaggactctgcaggggggtgggagtggatcttgcaactatagatgttattcctctttccctagtcttcccactaatgtctgttttctctttgtaatccagtccaggacccacagtatgtttgactgtcatgtatccttagtctcatgcaatctctgacagttctcagtttttccttttctt

SEQ ID NO: 56429 - DNA, 1055 bp, Homo sapiens
atttttgtgttttttgtagagacaaggttttgccttgttgtccaggcttcttttgttaattttaaaatcaaacccccacaggcctctgaacataggccagatccctcagggtggtgctttccttgctcactgctgttctccaccactgtctctagctgaaggcctcctctcccttctctctccccagagctctcaaagtctgtggaaccgcctgtctgtgttgctgaatctgttgcctgctgctggtgaactccaggagtctggtgagtgggtccctggcactaccctcctttctttgctctctcattgtccccactaagcccatctcccctccccataacccagcccttggggtaaggaggttaatgggattcactgccagcctccctagcacacagcagtcattgtgtggtctaggcctctccggtttcccaccacaacactgctgtattgtgggcaggtggcctggtcagcaagggagtgtgctccctagggaatgcaagggcagagtgagagggccctgggagccagacctagctgctgctgttgcactgatgcctgtggtcattgagaattgactttgacctaccaagtttgtttgtctggctcatctcctaccaccttccagctggaaaactccacctgctcctacctgctaagacttgccaagggctattcattcatcctgagcgcctcctctcatttccatcccaatgtaattgtccctgctgtcaggaagccttcctgacctgagccatccttgttcttcctgagcccctctgctctgcctgactggctcttatgtgtccatctctctttacttcactccctccatctctccgcactgtcctagggtatgtcctgcctcatcatctcatcagcctgataattcccaaagggaagggttatgtctctctgactgggagttcccacaggacagatggtcttatgtgtccttcttctgcccaggcctggccttgtgtcctgaggtccaagatcttcttgaaggttgtgaactgcctgacctcccctctagccttctgctcccagaggac

SEQ ID NO: 56430 - DNA, 1647 bp, Homo sapiens
cctgcctcagcctcccgagtagctgagattacaggcatgcaccaccacacccagctaatttttgtatttttagtagagacagggtttcaccatgttggccaggctggtcttgaactcctaaccttgtgatccgcccacctcagcctcccaaagtgcagggattacaggcgtgagccaccacgcccggcctgaaagtaactcttttaaaaccataccccttgcttttctccctcccttatagctcccctctaactgtctgccctgccttccagcacagagtaggcatttcataaatcctagttgaatgaatagctgtagatcaacgtcacaaattacttgagtctataagaatcatatttaaaaggcaccatattttaaaaacaaccttggtaaaatgaatttgatgagattaaaaaacaacaacagttagtgggcctggaaaaattgaataagggcctgtaagtggttccccagatttttcatatccaaattccttggaagggcccaggccaggtggaagcatgctccctgcacagagctgaggcctgttcccaagtgtcagttgtttatcccagtttttttctcttccattcacccaccccccagcctctgaggagggctctgagtcggaggggagtgagtccagtggacgctcctgtcggaatgagcgcagcatccaggagaagcttcaggtcctgatggccgaaggtctgcttcctgctgtgaaagtcttcctggactggcttcggaccaaccccgacctcatcatcgtgtgtgcgcaggtgtgtcagtccactccattgcccctgtcaggtcccagggtcttggaggaggggatgagccaggatggggcctgaggatcccccctgatggccaaggcaagaattattgccaagcaattaatcacctatctgtgctgggcccttatgctctgacagggaaggattaggcatgatcttggccctcacaaagcctgtggccagggaacaattagcgagctgcttattttgctttgtatccccaatgctgggcataatgcctgccattatgagtaatgccggtagaagtatgtgttcaaggaccaaagttgataaataccaaagaatccagagaagggagagaacattgagtagaggatagtgacagaagagatgggaacttctgacaagagttgtgaagatgtactaggcagggggaacagcttaaggagagtcacacaggaccgagctcttgtcaagccggctgccatggaggctgggtggggccatggtagctttcccttccttctcaggttcagagtgtcagccttgaacttctaattcccagaggcatttattcaatgttttcttctaggggcatacctgccctgctgtggaagactttcttccctgtgggtcgccccagtccccagatgagacggtttgggtcagggccaggtgcaccgttgggtgtgtgcttatgtctgatgacagttagttactcagtcattagtcattgagggaggtgtggtaaagatggagatgctgggtcacatccctagagaggtgttccagtatgggcacatgggagggctggaaggataggttactgctagacgtagagaagccacatcctttaacaccctggcttttcccactgccaagatcc

SEQ ID NO: 56431 - DNA, 1034 bp, Homo sapiens
agaatcggggaggtcatcactatggaaaggttggtgtggggcatggggatgaaggaaaggaacacagactcgggggaagtggtgttggagagcacattccagcttccaggctccacctgttcctcgggctccacctgaccttcctctttccgcagatgaaccagagtccaaggaacctgtggagaaagaggaggagccagatcctgagcctcctcctgtaacaccccaagtgggtgagggcagaaagagccgtaagttctctcgcctctcctgtctccgccgtcgccgccacccacccaaagttggtgatgacagtgacctgagtgaaggctttgaatcggactcaagccatgactcagcccgggccagtgagggctcagacagtggctctgacaagagtcttgaaggtgggggaacggcctttgatgctgaaacagactcggaaatgaatagccaggagtcccgatcagacttggaagatatggaggaagaggaggggacacggtcaccaaccctggagccccctcggggcagatcagaggctcccgattccctcaatggcccactgggccccagtgaggctagcattgccagcaatctacaagccatgtccacccagatgttccagactaagcgctgcttccgactggcccccacctttagcaacctgctcctccagcccaccaccaaccctcatacctcggccagccacaggccttgcgtcaatggggatgtagacaagccttcagagccaggtatttggaccacttcatcatcctgttctggtccgcacctccatgccatagacactcaccagagaggccgctttcctatctgtgtgaatgacctctcgtctctacccttacctttggccctctgcctgtggtgtagcccatgagttttttcctgagggtccaccctcctgctcacttccttattcccatctcccaacccatttgttggttttatttcttttgcacttcaccctgtcctgtgggtttggggctttcctccctacacaacaattgcagctg

SEQ ID NO: 56432 - DNA, 1101 bp, Homo sapiens
gctcttctccttccccagcccccaccactgacctcccctgttactcctgcccctctgtagctccgtggactcagagctgacctcactttgccagtcagtcctggaggacttcaacctctgcctcttctacctgccctcctcacccaacctcagcctggccagtgaggatgaggaggagtatgagagtggatatgctttcctcccggaccttctcatctttcaaatggtcatcatctgccttatgtgtgtgcacagcttggagagagcaggtaaccttccctatgttcctcttttctcttccactggctttggggatcctcactccccttttctgcagctccttattcataaacttccttccacaagcagcctcttcactcctgtgtcactgcttggctgtgggcaagtaagggccaagggatcctaccctaaaggaggtcctggtaattgagtacaagcaacagcacatttccttcccccttctccttactgcctcccataaatatgcacacccttggccagggcctgtgcagacacaagggtcagggtacttagtgatcatccagacagaatttcagaccttctgttggaggcatttaggcaattctggaagcctttctggcagaagtgtatgtagagcaagattgggaggtaaggagggataggactggatgtgaaggctcttgaggcatggggaggaacctcagagccagggaggatgagatgggacaaaaggatatgcttatctgaaggagtacaaggtgagatggtaaattctagattatggaagggataataggacacgtacagtgcctcacgcctgtaatcccagcactttgggaggccgaggcgggcagattgagcccaggagttcaagacccagcctgggcaacatagtgagactcttgtctctaaaaagttaaaaaaaaaaaaaaaagaatctttgataagtagttggatccttggaagagttgagaacagatgagatgtggttggaattgatggtgcctactcctcatcagggccctaggcccctaatgcctggctttcctgacttcaggatccaagcagtacagtgcagccattgccttcaccctggcc

SEQ ID NO: 56433 - DNA, 1535 bp, Homo sapiens
gttggtaacacccattacatggttggagagcaggagggatagtttggcttctgataactttttccctcccatctgtttcagtgatcccttcttttcactgcccttccatgagtcagagaggatcagtgaatacaggaaaaagggaaatttctttgagctttgagcaaatgaagataataattctctttcagtagtgggttgggaagattttaatttgatatttttcttctttgagtgtttcttttatctttatggactgctagatgaatagaaacttcagcacagggattgaaattagacatcaaggaggacttaccttcctaacagatgtttctaaggatggaaaagtactcttttgctttatagcccctggggcctctcgtcctgatagacagtggtttctcattaggctgctggtgtgtggctgttgggtgcattatgtcttactgacctgggtctactatccttgcccccagcccactcctggacccctcatgagcagtgtgtgcagagagtcagctgtttgatatttgatgaaccagagtatcattagtagtgtcttctctgtgaaattgagcatttgcatttcagaactaaatatcagaggtctttgcaagcatttatgtgtgctgcagctccccttcattgggaagagattaccaagaagagcctattcaggctgggcgtggtggcacgcatctgtagtcccagctacttgggaggctgaggcaggaggatcatttgaacccaggagttggagaccagcctgggtgacagcaagaccccgtctctaaaaaaaaaaaaaaaaaaaaagaaaacaaaacaaaaaaagaagagcttatttacttcacaaacaatattctttacattttgaacctaccagcaaggaagagagttgaacaatttgcccatagtcatgcagatttaggactgtgccagagaccccagcaacctgcttcctagctcaggtaccttccttccaggctcttgttaccactctcagagtggactcccagatgtgggggagggttttctgaaacttaaaatcatcgagtttcccttcgttttctctcttgtgcagcccgatatcagaatgaattagctggcgtagataccgagctgctagccgagagattttactaccaagccctgtcagtagctcctcagattggtaagttgtccccaacttgggcctctgaatccagtagggttttcctagggaagacgatgttgttgagatggcaggcagttcatactcattttccccagctcctcttcattctcagctctctcgtacttcaccttgtttataccttttccctcttgtaacacactcagaaaatggtggaaggggaagataaatgggaaggtcttgaactaaggagtgaggcagagtagaaggaaaagagaagatggctttcctctccctgaggtctcttgtagaaagagaagcacaatgagataaagcataagactattatagagagagatggggatttgcatgtaggaacaagcattcagtgctgagatagagg

SEQ ID NO: 56434 - DNA, 2157 bp, Homo sapiens
atggtaccttaatggtctctgaaatctctggccttcctaagagaggagataggatccctcactccatctgcagattttacatctaatagactggtgccataaagtagcacagtctctacatctaaaaagtagagtaaaataaaataaaaagaatggcattcgaggcagggcacagtggctcacgtttgtaatcccagcaccttgggagaccaaggcaggaggaacacttgagcccaggagtttgagaccagacctggcaacataacaagacccagtctccacaaaaaaattaaaaaatcagttgagtatggtgctgcacacctgtaatcccgcacacctgtagttaggctgaggtgggaggatcatttgagcccagaggttcaagtttatggtgctatgatcccgccactgccacagagtgagtgagaccctgtctcaaaaaaaaaaaaaaacccaaaaatatatttgagtcaagggagtcggccatactgcataatgaagggaaaaatgggataaaaaagcagagaaaaagagagcgaagtgtacaaagggaaaaaatgaggaaaaacttagaatgtttagtgcttcgtgcttctgtcttttggggctcccactgccttcctaggctgctgttgtgctgggtcatattgaccctgcatgtctcttgggaagcaccgagatttgttggtgggggtgttggcacatgactccttgccctcagttcttatgtccctgctccaagggatgggctgtctctctcatgctcctctacaccctccaggctgcgtgagctctgcgtcaagcttatgttcctgcacccagtggactatgggagaaaggctgaggagctgctgtggagaaaggtatactatgaagttatccagcttatcaagactaacaaaaaggtaaggggaagtccttgtctaaagagggaaagccaaggaaggaagagacagctaggaaagtgggcgcagaacatggttggaggtaggggagccaagaaaacatggcagtaagaggctgggcacggtggctcatgcgtgtaatcccagcactttgggaggctgaggcaggcagatctcctgaggttgggagttcgagaccagcctgaccaacatggagaaaccccatctctactagaaatacaaaattagctggacgtggtggtgcatgcctgtaatcccagctactcgggaggctgaggcaggagaatcacttgaatccaggaggcagaggttgcgatgagctgagatcgcgccattgtactccagccagggcaacaagaatgaaactccatctcaaaaaaaaaaaaaaaaaagacagcagaaaggaaggaggaagagagtcagatgtaattaggattagggaaggaggaagagagtcagatgtaattaggattagagaaggaggggagcctggtcccagatggaaagatcagagagttagagctaagagtatgacagtaacttgtgagtgagagtagatgtagatgaagttccagagccaagtgagatgaacagggtaagggagggtgagtgcgactctgagtttattgcttaaccagccccttccctttcgcaatctgtagcacatccacagccggagcactttggaatgtgcctacaggacgcacctggttgctggtattggcttctaccagcatctccttctctatatccagtcccactaccagctggaactgcagtgctgcatcgactggacccatgtcactgaccccctcataggtcagtggaacctgaaaggtggacttgagcaggttctcatgcttctacctctggccttatccctcagggttcatgtagcttgcgacccagccaggcagagagagttctagcagaactacatacaaatggtttatgaagtttggatttatccagacaatcatatgagttagggtaaagatcttaaggaaagagagaggcctgggattgtggactaaggcagaggagggacagaaagacctagagtaggtctggcactggaaggtggtattaatacatttcttttcttctcccagttgaatttggccagcactgtttcttttgactttagagattatttcccaatgtttgatgaaagttttgaaatctttagatatgttgggaaaattgtggacagtctttcaacatagtacaa

SEQ ID NO: 56435 - DNA, 1882 bp, Homo sapiens
cacggctagattttgtagtttttgttctaagagagattatagtttagtggaggagcttatgatctgatggaaaatgagaaaaaagtggtgagccctctcatatttaagcgttttcaattagaacttcctagagtggtggttatttaccttcttttggattaaggatataaggagagctgtggagcttgtctataaaaatatacactcccattagctctttccatggcaccaaagataaaagccctgccctagggactgagctggtataaagtaaatcactggtgctgcccctggcatcgagggccaggttggccaaaagggcttggcatccatctctaggctgtccagtttgaagaaacatgattgcttgtgagaaggtatcgattaccatcccacctactctgctgggtgctggcagtcacttcaccctgtgtagggcagcttagtagtgtgcctcctgagccaccaccaccacagggtgccaactgttgtggcccacttttcctggcccgggagcacgtcttggtttgtttgggaatcttcactctgtttttgttgcttttgtgtccacagttgtgcctgattcacatgttcttatagctcctgcctgatgtcctctgggttttacccttccagatatgagacctacctctgggacttcttggccgtccattgtagagtttctgtggctttttctttgctgtgatgacagacttacctcttagtgcctggagtctccccctcagccttagaacaagaaggatggagactaacacttggagtgattactatataccagtcactgttatgggtgctttatgtattagctaatttaatcctcacaaagtaggtaataatattcccattttatggttgggtgaagtgagacgtaaggaagttaggtattttgcccaggaccacatagctggtaagaagtagagctaagatttgaatccaggcggtctggtttcatgcctacactcttaaccactatgttcaacaaataattccttcagcagaatctaggcttatcagaatcttgcttacggctaagcagcccaggagctccctctacttccccatcataccccacaattccatagtagaattttatactagaagtgtctttcctttatgtcagggataataaggccttatgtaataatttattcattccaccattattgaatgtttaccatataccagagctatatataaattattatttcatttaatcctcacaacagttctctgaagtagctattattatcttcgtttttattgatgtggtaactaaggctttaaaagggtgggtaatttgcccaaaggcacagagtaagacacagccagggttcaaaccctagattttctgcctggcatcacagcgtgtgctctttccattgggagagtcggccttaccatatcacagtttctctactttgacactgttgacattttgggtagggtaatgctttattgtggtggactgtcctgtgtattacaggagatttaacagcacccactaaatgccagtggcaaccctctttccacccagttgtgatgacaataaatgtttctaccattgccaaatgtcccctggtgggcggggggtggggaggggcaggggttactgtaacaagatggagactgtgttcatcttgttttgtacagagctcagcctgcagccttctcctttttccctcaccgctaattctgtagcttttcctctagaatcgtgtcccagcgtcatcctctgtggaccatgcatatggctgaggggatatttgcctgtatttccctacagggctgtggtggaggctgtgcatcgacttgacctcatcctttgcaacaaaactgcttatcaagaagtattcaaaccaga

SEQ ID NO: 56436 - DNA, 1133 bp, Homo sapiens
cccatgccctcagcatccttaagaaacacggctgtccacctttttccctgcaagaaaactaagtccatcccttatgactgtctcgggccccaaaggtgaagggcagctccggcaaggggagaactccgattgattggagtccctgttggggcagtagcagggttccacccaccgcggtcctaggcctgggggcgaagtccaggcctggccacaaggttcaaagatgtgtcagacccaagccgctaccccctactccgagggcgagggcggagaggctcagccccaggggcggggcctgtagtcggaggccgagcgggcgtggtccgggtagtccaggcggctctcggtggcagtgagcatgcgctccggctccaccacgaacatgtagtagaggttccacatcagcatcgacagcagtggcagaaacgtcaggccgtagccgaagcctcggaaggagcggcccacggcaaaggtcagccagtagatcagcctatgggggcaagaaaagggtcaggctactctcgagggaagcgcgtcagctgattggcaataggctgacggtggggggagtagataggggaggcagatgcagttggtgggtatggctggtacttccaaatacagccaaagtttatgcacttaacatgtattaggcacagcgctaattactataagtgattgatttgacttccccacatctttatgaagttgagtatgttattcctttccctcttttatttacttttcgatttatttttatttttttagagacatggtcttgctatgttgccagtctgggctcaaacttctggccttgagtgattctctcacctcagactcctgagtagctgggattacagatgcgggccaccacacctggctgtacaaactttaaaatgtttgagcaaattcaatgagtatagtaaaatatcttcctccctttaccgattcccaccctattctcccccacccccaccccaggcatcaatattatggtttcttgtgcactgagtgattttttaaattattattatttttttatttttgagacagagtctctctctgtcacccaggctggagtgcagtggtgcgatctcagctcactgcaacctccgcctcccgggttcaagcaa

SEQ ID NO: 56437 - DNA, 1053 bp, Homo sapiens
cccagaaggcatgcctctcccacaggaagaggggagcagacagggaaatctgcctaccaagaggggtgtgtgtgtctttgtgcccacacgtggtggctggggagtgcctggatggtgcggtggttgatgttaacctagtgtgtgtgtgtgtgtgtgtgtgtgtgtgtgtgtgtgtgtgtgtgtaacaataaattactaccagtctttgctggctcttttttcctgtttgtcccccagtctcgagtgtcccttccctgtttaattcagatgacgatagaaacctcccagctctacctggtggagcagggctggcaggttccttggttccacagcaaggaaatggagcctcaaacagaaacttgccttccaagcccatctcttagcccttccattccctggaaccagcccaagaccagcccaacaacactcacacatcaagagactggagccctgtgaaaaaaaataaatctattttcttgccttccagggcagccaaccagtcagaatgcctctcatttaggcctgcaagtcccatccaagggaaatgtgtggagatgcaagaaggcaacaccaaggggaccttatcaatagccctgtcccctgcccgcctccaaagtcccccaacaaagtatgaaggaagccccacctgggggtctccaggaagtcgaggctggcctctgaggttccacagaaaagcaagatgggggagtgaaggggccggctggaacttgatgctccaacctccagagtttcgaggcacagcaagacaggttcagtaatgtccttccctccagagagcgggccttaatttatggactggtactctgagtacttcttgtggtgcagcagcagaaccaagccgccccctagcagcatgagccctggggcacccagggccactgccatgatgcccaggactagtggggacaagccgtccactggagggaagcccacacccaggagcatcgacctagagcaagcagagagagagaggtaagcgggcttaggaggaaaggctgggaggctcagcctttgtccacttcaactccccaa

SEQ ID NO: 56438 - DNA, 1023 bp, Homo sapiens
agtgcagaggagagagttcatcccaattagagggtggaactaaagactgggggtgggtgaaatagactcagatatgaaagccttggtagggggtgagtgggaggtgtggtctcgggagaaaaactgaggcaagcccagttccaccctacccccaccctccagctgcttgagtttgacagcaccaacgtgtccgatacggcagcaaagcctttgggaagaccatatcctccatactccttggccgatttctcttggaacaacatcactgattcattggatcctgccaccctgagtgccacatttcaaggccaccccatgaacgaccctaccaggacttttgccaatggcagcctggccttcagggtaaggcgtgagaaatcggaaagagctcaaaaaggctgatttgtgagggtgggatttaatgatggaggtggcccttaagcacaggcatccagctatttcccacacctcccatgcttcttccttcctaggtccaggccttttccaggtccagccgaccagcccaaccccctcgcctcctgcacacagcagacacctgtcagctagaggtggccctgattggagcctctccccggggaaaccgttccctgtttgggctggaggtagccacattgggccagggccctgactgcccctcaatgcaggagcagcactccatcgacgatgaatatgcaccggccgtcttccaggtcaggcttcctggagagaggcagatgggtgaggaatgtaggtgggacaccattgggacctaaaactcattcaaccatttgccatttagcaacactttctttgggtcgtttaagagctaggcactgtgctaatgaatctgacccagtctctgccctcagtggagacagacagaaagtgcaatatgacttacactctggcagatggagatctgcaagggggctaggggccaagaggagggctgagtccagacttggaggtttggaaaacaactcagtcctcacccagtcgaactccccatttttacagaggagg

SEQ ID NO: 56439 - DNA, 1030 bp, Homo sapiens
tgaaatgttaggcagggaagaagaaccacattgttccacagggaagaagaaccacagagtttcatgtgctggagtagaaagaaggtgtatgagttccacaatgggacagggttgggaacttaaggcaatgtactggagtagttccctgttgggtttattttctttaacctgtctttgtgtcaaaatgagatttcacgttcctcttaaaacatgccgtttgaatactgtgtttttggcattgtccaaggaaaactgaaaacttgtagcatgaatgttttttttttcacttaaaatcttgtgaccatattaaattgtattacttgtaagagactgacgtttcctgttttaagatagaatacaaagctgttctttaatacattaaatggtgctgacgaaaggaaatttttttaaaaagcaaatagtttggcggctccgcccttgaaagggatcagctgaacgcgagtcatgtgaccctctggcacctcttccgtcggctgaattgcggccgtatgcgcggctctgtggagtgcacctggggttgggggcactgtgcccccagccccctgctcctttggactctacttctgtttgcagccccatttggcctgctgggggagaagacccgccaggtgagggccctggggctacagcgatagaagtttcaggaaacgctacccttgcagggtggctggaaccgggcatccaggggctaggggtggagggtggctgccaagaggagggttcttcaacctggagggtgtgggagatggtcatgggtcatgggacgggattgtggagtagggcaaatgtgagggtgatgtctggaccccgactcagccctgggtgacccaggtccaggcaagtgttgaatgttttcttcttcgcagccctgtgccctgacccgcccaccagggtcaggggagtcctggctgtaccctctaccctaccccttttcatcctgtccccactgccccttaccccagggttccctcagctcccgcacacattcctcttgtctagtccccaaaat

SEQ ID NO: 56440 - DNA, 1307 bp, Homo sapiens
ccaaccaaagtgctaggattacaggtgtgagccaccacacctggctgagaactgcattttacattcaggactgaaaaggccgggcatggtgggtcacgcctgtaatcccagcactttgggaggctaaggcaggtggatcacgtgaggtcaggagttcaagaccagcctgaccaacatgaggaaaccccatctctactaaaaatacaaaattagccaggcatggtggtgcaggcctgtaatcccagctgcttgggaggctgaggtagtagaatcgcttgaacccgggaggcggaggttgcagtgaaccgacatcatgctactgcactctagcctgggtgataagagggaaactgcgtctcaaaaaaaaataaaagactgaaaagatagatttcagacaaaatggcagttccatagtagcatctaggtgatagatctaaaggaaagaaaagtgtcctttccttctctgctgacctctttgcatctgtggtttttctcctagacggcagttctgctactgcgaattgatgacatcgtttcaggccacaaaaagaaaggcgatgaccagagccggcaaggcggggctcctgatgctggccaggagtgagtgctaggcaaggctacttcaatgcacagaaccagcagagtctccccttttcctgagccagagtgccaggaacactgtggacgtctttgttcagaagggatcaggttggggggcagcccccagtccctttctgtcccagctcagttttccaaaagacactgacatgtaattcttctctattgtaaggtttccatttagtttgcttccgatgattaaatctaagtcatttgagaaagttgttatgtgtttttcaaccttgggccatctctcttatctcctggcaaataggtggaggcagaaaaccttactggggagggaaaggagacctggaatgagggcatttagactcttttgccttcttgagggagtattcttcagacttctcagtaaattttggttggaaagacccttttggagttcaaaggataatactgtaaagcttacaaagcaccattttgcattcactgcccaaagaacaagaggaacctgtctaaagcatgggtgttccccatatgtggttgtatgtagaggaacacccagtacatcctagggctctggcatgtgtcctaaaggacatataactttttttttttttttggtgtagttttcagaattctccctttaccatgagttatttttctctgccctcttccaatgtttttacaattccagtcttcattttggcttgctgaccttttctcat

SEQ ID NO: 56441 - DNA, 2601 bp, Homo sapiens
gttgttttttggggtttttgtgtttgtttttttttagatagggtcccactctgttatctaggctggagtgcagtggcatggtcacagctcactgcatccttgatatcatggtttcaagggatccctcacctcaccctcctgagtagctggagctacaggtatgcatcactgtgcccagctagttttttattttttgtagagacagagtcttgttatgttgcccgggctggtctcaaacttctgggctcaagcaatccttttgcctggcctcccaaagtactgggattacaagtgtgagccactgtgcctggccccctgaaaatctttttcaccggacaggcaagacctcttaagtgatgtttccaacaatccacttttgcccttatccctagctacagaccctagagactagggaaatgggtacaagtatctgaaatcatctgattctccccacctcttccgtccattagagcctgtggggcccggatagtcagccgaccagaggaactgagagaagatgatgttggaacaggagcaggcctgttggaaatcaagaaaattggagatgaatactttactttcatcactgactgcaaagaccccaaggcctgcaccattctcctccggggggctagcaaagagattctctcggtgagtcagccttggatgtatgaccagatgaagtagatcactgaacttcttgagagtttcccaaagggcctaaaataattctgtggtccatttatagctatttaatttggacctatagccacaaattccttttctgcttcctttttttaattaaataatttaaaattttaaaaattgtagtaagcataaaatttaccatcttaatcattttaattgtacagttcagtaatgttaagtatattcatgttattgtgcaagagatcttcagaactttttcatcttgcagaactgagactctgtacccatcaaacaagatatctcatctcctactccctagcaacaactgttttcttattttttacgttgaagttataaatattacttttttttcctcattgaggctaagtaactttcccaaaggcacatagctagtaagtaggagagtgtacaacaccatgcaacctcctaaaagatacaactaggaaggggtggaataggttatggctcttatctatcaagatacatgctgtttatttccatataactggcaagggatgaaataggttattgctcttaatctagcataatggacaaagacctaactttatggttgggtgacacccccaaaccctttgcagataccactccccgccatcctatattatagtcgtgtgttatatattctcaggtaaataatctgccctgcccagtaggggttccaaggaccttttctagttgccctccttggtggtttactaactttggcagttaggaagtccttttggtgcctccgattttatgagtcatcaagctttggcttcatactgtctgtttgcttctccaaggaagtagaacgcaacctccaggatgccatgcaagtgtgtcgcaatgttctcctggaccctcagctggtgccagggggtggggcctccgagatggctgtggcccatgccttgacagaaaaatccaaggccatgactggtgtggaacaatggccatacagggctgttgcccaggccctagaggtcattcctcgtaccctgatccagaactgtggggccagcaccatccgtctacttacctcccttcgggtgagttcctctccaagcttttctcttgatggagcagggaaagctgtgtttgccctgaggggaagattcttatctggctatccaaattctctttatagtctattccttgaaatctttctctccttttagtctttgacttgtttgctgtcattgccatttttccctgtcccttccatactggtccattgttttttacttcatttcttacctgatgtttcctgttaacttattttcccctttacttcttgcttcaattgcaggccaagcacacccaggagaactgtgagacctggggtgtaaatggtgagacgggtactttggtggacatgaaggaactgggcatatgggagccattggctgtgaagctgcagacttataagacagcagtggaggtaaggcaccctaagatatgtacacgctgttttaattaatttatttatttatctatttatttatttttgagacgcagtctcagtcacccaggctggagtgcagtggtgtgatctcggctcactgcaatctccgcctcccgggttcaagcaattcttgtgcctcaacctcccaagtagctggggctacaggcatgcaccaccactcccagctaatttttgtattttttagtagagatagggtttcactatgttgttcaggctggtctcgaactcctgacctcagatgatctacccaccttggcctcccaaagtgctggagttacaggcatgagccaccatgcccagcctggtctagtcttgaagggaggggtaaagaaggcagaatattcctctaaggtattccaaggcattctatctctttaattatctttagctcgtactaaaagcaagataatatagcacaatct

SEQ ID NO: 56442 - DNA, 1022 bp, Homo sapiens
tgatataactggagctggccgggcgtggtggctcacgcctgtaatcccagcactttgggaggcagaggcgggcggatcacgaagtcagaagatcgagaccatcctggctaacgtggtgaaaccccgtctctactaaaaatacaaaaaaaaagttagctgggggtggtggcaggcacctgtagtcccagctactcgggaggctgaggcaggagaatcgcttgaacccaggaggcagagcttgcagtgagccaagatcgcgccattacactccagcctgggtgacagagcaagattccgtctcaaaaaaaaaaaaaagcaaaactaaagctaaattggcttacagaggtgttgaggtcatggctttaacataattctgactctgagatacgtgggagaggtgggtggaaggagtataatatgacccttagagcttcaccagtccagggattttaaaatcagtgtcttttctttaccacacagactgacattgagattacacgagaggaggacttcacccgaattctccagatggaggaagagtacatccagcagctctgtgaggacattatccaactgaagcccgatgtggtcatcactgaaaagggcatctcaggtgggactttgttactttttccagcctacctttgaggtagacgagggtgggtgatttgttttctcccctcatgtttggcaggggcgtaatagtgtcatggttaagagtactttgattataaaaccagttcagaacccagcttgacatctctactcttggatttgtagatttagctcagcactaccttatgcgggccaatatcacagccatccgcagagtccggaagacagacaataatcgcattgctaggtgagtaggccaggtaaaaacaagacttttcttcccgtgtgtttcctttttgtagttgcgtaacagtcatcattacctgaaaaggtttaataaaggatatagtaacaggtagaaataaccttggcttagctgcctgccctcttcagaagtcctctagtcc

SEQ ID NO: 56443 - DNA, 1079 bp, Homo sapiens
atggtctaaaattggtgtatttcctaatgggaaaaaaatgtgattccaataatatttttgagcttcatcaaagaaaggtactttagaaacctgaaacactgggccgggcgtggtggctcatgcctgtaatcccagcactttgggaggccgaggcgggcggatcacgaggtcaggagatcgagaccatcctggctaacatggtgaaaccccatctctagtaaaatacaaaaaaaaaaattagccgggtgtggtggcgggcgcctgtagtcccagctacttgggagtctgaggcaggagaatggcgtgaacccgggaggcggagcttgcagtgagccgagattgcaccactgcactccagcctgagcgacagagcgagactccatctcaaaaaaaaaaaaaaacctgaaacactagctgtttgggaaagatgaacatctgggaaggaaattaagaaattgtctcttgattgtggattaaagtgcagttgtcttttgttcagatacctggaggcatcattgaagactcctgtgtcttgcgtggagtcatgattaacaaggatgtgacccatccacgtatgcggcgctatatcaagaaccctcgcattgtgctgctggattcttctctggaatacaagaaaggagaaagccaggtaaggttcttggccttgttccttaaagtagatgcaagaatctgactgcaaatatgaacaacagaaataaaacgtatgtttattgcatgccttctgggtgcatagtgtacactgactcttagaacaatcctttagaatagttggtattgatttcattttacagatgagggatctgaagctcaaacaagttaggttaattgcttgaggaatacagctagtattggccaaaatcaagatttgaacctggttgtgtttggcttgttttatacgatcatgctgcctttcctaatgcaccaggggaacataaggtaggagttaattcagctttgaagtactaaaggagaatttcagcttaatgcagtggctcacacctataattctagcactttgggaggctaaggcaggtggatggctcgagcccaggagttca

SEQ ID NO: 56444 - DNA, 1151 bp, Homo sapiens
atacataaaatgtgtttacagtaacataaaaacacaaagatgaccagttggtggtcatctttgaccactgtgacacaccatgagctaaaaataaaatttgctgttcaaatgaatgatttgataaaactcttaaagttggctagttatgggataaagtttcataaaaaaaaatgtgtcttgacctgagttgtaaaagttgaaaagtttacttggttgaagcagaagataaggaacaaattattttactataatctttgtatgtaagtgtaaagggttgctcagggaattaaggcaccgtctacagatgagttgtaatcttgctgaaaggcagaggaatggacaaaggttacctcctaatgtccttttagtttcctccaaaggaacaaatccccttgttctgcctcttggtccattattatagtcactgaggtatagataaggcacatctctacatatctaacatgccttcttcacatatcgtctggttttcttttctctagtatcccagtcgacatcagtgacagtgatatgatgctgaacatcatcaacagctctattactaccaaagccatcagtcggtggtcatctttggcttgcaacattgccctggatgctgtcaagatggtacagtttgaggagaatggtcggaaagagattgacataaaaaaatatgcaagagtggaaaaggtaaactttcaaagtgtatacattgggtcaaattatatgttagcatgagtcatctcacttgtgaggaaatagtctgtttttcatgccgttgttttgttttgtttttgagacagagtctcaccttgttgcctaggctggagtatagtggcacagtcacagcccactgcagcctcaaactcctggcctcaagcaaatcctctgatttgctaggactacaggcacatgccactgtgcccagcaaattttttttctttttgtagagatgagggtctcatgttgcccaggctggtcttgaactcctggcctcaagtgatcttcccacctcaggctctcaaagtgctgggattataggcataagccatcataccctacttgaatgaaatagttttaaatcagagcaaggtatgttttttgtttgtttgtttttttgagatggagtcttgctctgtcgcgcagaggctaga

SEQ ID NO: 56445 - DNA, 1025 bp, Homo sapiens
ttggagtgcaatggtgcggtcatggctcattgcaccctcaacctcctgggctcaagtgatcctcttaacctcagcctcctgagtagctgggactgcaggctcataccaccacactaagctaaattttaaatttttttgtaaagacagggtctcactgtgttgcccaggctgatcttgaatttctgggattacaggtatgagccaccatgcctagcctgggcaacaaggatgttttctgtataaattgccgtcttatacaatgtgtagaatttggaatagtatgaatggccaaatgtcataccttttgggagagtctgatttaggagagtattttttggaagaataattaagttacttgccttgatatccagatgctttaaatattactatggtgcttgtatctttttcagcaggggaaatgctgtctgtagctgagcacttcctggagcagcagatgcacccaacagtggtgatcagtgcttaccgcaaggcattggatgatatgatcagcaccctaaagaaaataaggtatcttgggggcaagaaataggtagtatcaaatatgagaggcctggctagacgtggtggctcatggctgtcatcccagcactttgggaggcctaggcgggtggatcttgaggtcaggagatggaaaccatcctggccaacatggtgaaacctcgtctgtactaaaaatacaaaaaattagttgggcatggtggcgcatgcgtgtcgtcccagctacttgggaggctgaggcaggagaattgcctgaaccagggagtcagaggttgcagtgagctgagatggccccactgtgctccagcctggtgacagagcaagactccgtctcaaaaaaaatcagctgggtatggtggcgcacacctgtaatgccagctactcaggaggatgaggcagaaaaattgcttgaaaccagggggcggagattgcagtgagccaagatctctccactgcactccaacctgagcaacaagagcgaaactcccatctcagaagaaaaaaaa

SEQ ID NO: 56446 - DNA, 1990 bp, Homo sapiens
ttacgcaaagcaatgaatggtcatttcttagggtcaccagccctttgagaatctgataatagttgtggatcctctttccggaaaaaaaaaaaattgcagtatctctcattttctcacataatctcagggagttcgctatcccactaaggcccattcatagatctcaggttatgaatccctgctgtaaatataggaatatttggttagaagaaaagtattaaccaagattccaaagttatttcttaatataccaaggattgaaatacagaaggaagttaacagccataaggacatatgtttacagttttttgagatatggttgacatataataaactgcacttatttaaagtgtagagtttgataagctttgctctgtggatataccatgaaacctgcattcttatttttcaaagacggggaaataaatagcttgtgtacgatggggcagtcctgggctgttgacttgtgtttttgtctattttaggccagaacacaaagcgtgaatccggaagaaaagttcaatctggaaacatcaatgctgccaaggtcacaaatcttttaagtgtttatggtagtttgcctccagctatctttcctggtatttggtcatagccatgtgtcctgtgcatctagactttatagagtaggcaaataggcagaggaaaagttgacctctttcagaacattttcctgatgatgttaggggaaaggaagccctccccttctgagttaggactgataatcttctcgtattaacttgtgcattattctgttgctgtgtattgttttatagtattctatttgtgtttgtctcccatactaaactgagttacttgaacataagtactttattcccttttgtattcctagtgcccaccgtagatcttggatagatattcggtaaatgtcttttgaatgaaatagtgaaatagccttatatctgatttaggatggtgtagaggccaccgtcatggaaagaaatactaagacatggacttctagtaattaggactgctgggaaacaagctctgggagccatttcccccttattcttgtgaaaagtcatttctgtatccattctgaaagcattcccaaggggagaaaaacaacagagctagccacatcctatatctaaagtggcatgctatgtctaaagtgatggctaaccatgctttaggggtgtcattaaaaacactgactctggctgggcggaatggctcacgcctctaatcccaacactttgggaggctgaggcaggtggatcacttgggcccaggggtttgagaccagcccgagcaacatggtgagaccccatatctaaaaataaaataaaattaaaataaaataaaacactgactctgtgggttgttcatgccccttttccctattactccaacatttctcacactgtcctctgatttgtgcttgcgtattttatgttccctttccattagactattgcagatatcatccgaacatgtttgggacccaagtccatgatgaaggtaggcttatctcttcctaaaactcttaggctacaatttttttcttcctgttatctaggacactttaaatataacttttgctttcatcttagatgcttttggacccaatgggaggcattgtgatgaccaatgatggcaatgccattcttcgagaggtgtgttttgtttttggttttgtttttttgctttctgacagttctgtaaacataaaggacctgttaagatacaggctctgattagttttttagggctgctataacagattaccagaaactggttggcttcaacaacagaaatttattatcttatagaatgaagctagaagtctgaaataaaggcgtcagtagggccatgctccttctgaagtctctagggaagaactccgcttctcccttctgatggttgctggctttctttggcatgaacttggtctctgccttggtcttcatgttattccccttgtgtgtctcttacacaaggacac

SEQ ID NO: 56447 - DNA, 1590 bp, Homo sapiens
ctggctggagtcccgcctctctagtccacctgttgctaaggctagaccaaaagagtgggaactgtgaagcctttcttagccttcacggtccgataggagccgagtcgcaatacacagtttaacgacctcacctgcggtgttaaccgaaagccgcaaccccagcacccaaccctagagttgacacacatgcgtagtggtgtgctggccaactgccagagccttggcgcctgcgccgacgttcgcgctgcacgcggccgggagcggccaccctactgcgcaagcgcctgtgccctcccagtgccttcgtcgtgcgctctctgtctaacttgtctggccgttcttgcgtagggggcgggactaaggctgtcaattggtctgtttttgtgccgatcaatgagatgggtgcggtgattggcgactaccttgagagtagcgggttgaggtgtaagccctgaggaggcagcgttttctgggcttctgtctggttctctctctccagaaggttctgccggttcccccagctctgggtacccggctctgcatcgcgtcgccatgatgggccatcgtccagtgctcgtgctcagtgagttctggggatgccaggaaatggacccccttttcgccctcttctgtccatacttttcagtgttgccccagctccgtcccccactgaccgggccactgagccttccaatcatcgtcttcattttggaagcccagtgtcccgctttcctctcttctcttaacctgttcgcttctctgcacaaactcaaactggccttattctcgccgagcctctttccttgacgtgtgctcgtcttgggaagctctttcccactccgcgttctgtccctcagcccccacgcttcccccgcccctgcgccctttctagcctgattgtcgctatgtagctgcacgaataacgtttttttttgtttttttttcagttaggtctagctttatattcttggcccatcccttagtagcggtaatttaaatgtttcaatctgtattacggagttaacagtatttcctagtagaattgtgagaattaaatgaggtaagtcggtagactgcttaaagagggtctggtaaataggtaatatccttggtcactttacgttacatttattttcagtaacagtctcttgaacagcaatcccttttcccgaagtaaccgtacttgcctcactgatcttagatgtaatcgttccctccgtgtccccggcgttgtactctttcccactaaccagttgggttttcccagatttctcgactggtcaccttttccttttggaagatcccttattttttttctttttatattttgagacaaagtctcgctctgtcacccaggctgggttgcagtggcgcgatctctgttcactgcaacctctgcctcccaggttcaagcgatcctcctgccttagcctcccgagtagctgggagtacaggcgcgcgccaccacgcacggctaatttttgtatttttggtagagacggagtttcaccatgttgaccaggctggtctccaactgctgatgagctcaggtgatccgcccacctcggcctcccaaagtgctgagattac

SEQ ID NO: 56448 - DNA, 2640 bp, Homo sapiens
cattgtagtgggcacctgtagtcccagctacttgggaggctgaggcaggagaatggcatgaacctgggaggcggagcttgcagtgagccgagatggcaccactgcactccagcctgggcgacagagcaagactccgtctccaaaaaaaaaaaaaaaagaaagaaaaaaaaatgcattctcctatgtccaggaaggactcaaattatttaaaagtgcatttgcatggaaattaacacattttgcatggaaattaacacattattgagaagaatcttgagacctgagtttcaacttctgtctccttaccacattctgcacaagccatcaagtgactgatgactctggagcaggagggaaaagaagatggatgacctaccagtagagcctggaaaatccacaaacccagtaacccagtgcaaaagaaaaaaaccaaaaccaaaaaaacatatttccctcaccaagagtgactgacagaacagatttcagttttcataggctcagtgaccttccagacagaaagcatctcaccctggcacccacatataagcacttcttcctcttaccaggccattccttctgttgccctctgagtaaagaacaagaataagacattttccttcatacaacctacttttcacacttctgcccccaggcttgttttttatgaagaggcccttcttaatccttcagatcccagctgagatattatttcctcaggacatgttttccagctctacagactaggtcagttgctttcatagcacttactgaagtgtaatagcatgtgtgcttgatcacctaatgcctgtctgcacagcaagactgtcagttccaggagagtagtgaccacttctgtttagcaaactgtggtatccacagcgatgacacataggcacttagctatctcttatgtgtatgatgaaaatgaattgttttaccatcctttcttgatttcattataacagtgaattattgtctccctactgtcttgcctttttaattcttacctagttccagctgtctgactttccatccattgcccttgtctactttgccacttccttttcatcttctagactcctgaggaggagttccttgaaggttcagtttttctctctctgttttttgccttggagagctaatgtatttttgcagctccttcatcccctttttggggctgcctggcagtttgacctttcacttgagctccggtgccagctctctggctgtttttctgggcacttctatttggatttcctactctcacctcagattcaatatgtccagatgtgattatgttaatatgagagttgagttttactcaaacttctttaagtaaaaaaggcaattcagggacttgtgcagttgggagagatgctgaaatagctcacagaataatgggaagaagagcggcaaaaaccagggcctcggggactaaaactggggatttggtgcctgttggtgtctgtgtatccatctgtctctctcctatgcttttccttgtctctagtctcttgcttttccacttctcatgatatgctagccaaatagctttcactgggcccaaccatacattttctcagaataggagatcagaagaaagtaaatttcttagacacagaatccatatattgatcccagggaatgactctggcccaacttacctcatgcgcctaatcccttggctcagtcacagttgccaagggggatgggaataccatgattggcctgtattgggtcacaggccaatccttgttagggagaggggcttgattgtggtctcaccagtatagcctggcttctcaagttttttgttgttgttgtttcattttttttgagaaggaatctcacccttgttgcccaggctggagtgcagtgttgtgatctcggctcgctgcaatctctgcctcccgggttcaagtgattatcctgcctcagcctcccaagtagctgggactacaagcgtctgccaccacgcccggctagttttgtatttttagtagagacggagttttaccaggttggtcaggctagtcttgaactcctgatctcaggtaatctgcctgccttggcctcccaaagtgctgggattacaagcatgagccaccgtgcccagccgcttctcaagtttttaaggttcagtaaatatcctctacctgaaaggaggtagagttctctcgctactcatattgatctcttctcccttttaagaaacattcatttttacctttaatcacatagtataactaacagataaaaggcttttattttcaccccagactcagactcattgtttatgtcctcatgttgttagatcactgtttcacctgtgtctgatttgtcttcctaactagatactaagcatctaagaaaccatgtcttaacacatcttatgtataccctaggatttagtacagtcgcaagcatgtagtgtatatcagtaagaacttgtaaacaaattagattttggcttatcccactcctgcttggtttctcttaatcctattatgatttcttttttgtcttatgtatctttctgatatgtaacatattcacggcagggcctgggcacctgctttcatggaccaggtgcagggatctaattagaaaggctgtcccttgttggaatgagctctgatt

SEQ ID NO: 56449 - DNA, 1049 bp, Homo sapiens
atccttgccttcctggagcttacgttctagaagggggacttagacaaaaattaagtaattataaaatatgccatatgaccataaatattatgggaaaagtgaaacaagggagggggtaataagttccagtgattgatttcaaattaaaataggatagccaggtatgcctcactgggaggtgacagctgggcaaaggtatgtctgggttgggttgtgcctggaaagattggagaggtcattttattagggtccttccaacctcagtacaattaccaaatctctctcctttgttcccttgcacctccgttgcttttccttctggagttgatcacaagcccaaggaatgcctaggactcctggaatgtatgtatgcaaacctccagcttcagacccagctcgcccaacaacagatggctgttttggaacatttacaggcatctgtgacacaactggctcctgggaggggaagcaataactcttctctcccagccttatctcctaatccattgttaaatcacctgccccaattcagtaaatgaattgtggaacaaagttattgtgttgttttcctctctcttcccagtaaacccttgttggaatctgggtatatgtattctacatatggttagtttgttcacaggttcataataagtgctcactgagtgcaaagcgttgtacaaggcacttggggttacatattacaaaaggagtttgcagggattactgtctaacaaagcagacaattcattgcaaaatgtagtggtattctgaaagaggatggaggttaagaactaacactggaggttactaggatacaactggaccaattttagaatcttgctggagaaagtggcttcatgatgccacttgaagaagggaggggttggatggcatggacagatgaagtcaggtagttccatatcagttgggaagcttggacaaagacctagaggtagacgtattagtccattcttgcattgctataaagaaatacctaaagttgggtgatttgtagagaaaatatgtttattttggctcatggtttggtt

SEQ ID NO: 56450 - DNA, 1035 bp, Homo sapiens
catttctgcagttcagtatccgaaggtttctcttgggggtaggggctcctgggcggccagatgaatgggtccctgggaacccagacctcagatgaggacttaatgtcttcttcctctcaagccaaattcgcctccacccactccctctgaagaactgggcatttgccaaagtaaccactggagtcatctaatggccctccccctccccaggtttcccacagctttcagggacagtgggcaagaggacacccccccccaccacctcagtggaacacaccattctccccccctcaacagcacactcagtgcagcaagactgacccctgaccccctcccagccctccctaccttggacaggaaggaagtaatgcaccttctcttgctgattatttatttgtttggagagacagaaatgtaaaagtgtatctagaaatatctatatctctatatatttttaactgactctttggaatcccctggggtggggtgaggggtaagtttaggctttcgcggaggggaggagacatggagcctgggaactccttgttctcccctctgctgcctctccccaccccttaaagcagttggtagaaggaatggtatttgtatggggggagggaggctggaatggagaatctggattctctcctcttccccattctccagagggagggaggtggtgaggaagaggaagggaggggcaggatgggccatggaggtgccccacccccacacctgacaatcacccacactcctggggctcttcctgggtcctggggcagggcgagtccaagtgtgaggctgttgatttgttttcaatatttcttttcgtgctgtatggtgatgctttcttagtattctacacaataagaaaagacaaagtcctcgagattcttatgagttttgtttgaaaactctttcactatatttgttgtaaagaggtttactattaaaagaaaaagaatacacgtttctgatacttcggcgtgggttttggtttctttggtgccgcgaggatgggaaggaaggactggt

SEQ ID NO: 56451 - DNA, 2682 bp, Homo sapiens
gccctatggggagaggggagtggggggtgcatacccaaagcctgggccaccccctcacacccccttctccatctcctctcttcacagacattaaagtgacgattcccactcccctcctctcagcctccctgatgaagagttgacaatctcaccgcccgcccttccctgccccgggctcctcccgctcgacccccacttcctttcttgtgcttcgtgtcctgttgacggttacatttgtgtataattattatattattattattattattatattttttttaatttggattctcgctttggagagggggatgctctcatcccctctttctgtaccccccaccattttcactggctggggggctctctttttcgcgggaaggggggacactttgcacgttgtacacatatgctgcaggaagggggtggggggcccaataaggcctttgggaaaggacaggtgccgagccctgcatgtggagccctcccaccccacccccagatagagggaaataaccaaaaaactaccaaacaacagaaacccacactctagactgaaaccccaaagtgggcttgatgggtgggtttgtgtttcaaggggaaagtgaggcagaggttctgaaaagggtctctgtttttgtgttcatgtagccataggcacatggagcagaatacttaagcctggcccccaaatgcccctgcacacacacgtgccacacctgcgctgattcttgtgtgtgctgcacccccaaggtgtgtgggtgctggctgagctttgggccgggaaggcagcctgggaatctgaggctggagacaggggtttgaggtgggggcctctctggaagcacatttggagggaaagacaagagagccatgaggagagggctgaggagggcagaagggctaggcagggggcaaattgagcccctcccttccccagtttttctctaagatatacagtgcaatagctccccacccctcagttgacgccagccctgtaaagctggccacagtgtgcagggagaatggggagagggtcttcagtgaggtggctggggcgagagtcggcctggacttccctggggtgctccaggccagagctctttcattggggcgagtgtggtgaggggacgtccttggtcttgcacgcacactacctgggggagtcaacactgggatggtctgtggggtgggagggcctacggatgggtccgtagaggtcccacctccctcattcctccttggcccctctccctagcttctcctgttagctccttctgctcctgaccccacctccttgctcttggcgcccctattgtctctggctacctccttgtcccaccacctccaggctgcatcccaccttccctcttggctactgtaattgtaaatagcgacctttggaaaacgttagcggtgtaacagtccaggaaactgtttttttttgttgttgttgtattgatatgaaatgagattctatttttgtcaaagtatattgtaataataatgactcaaacggcccgtactgtacagacgagattcttctgctgttgttcttgctcccctcccctcctctgagtccgcccctccctgctgcctcctcagtggggcagtgggcaaggggcccaggggcagccgaagcacggggtcctgagacctcaggcaggattggagatcaaaccagagggggcaggcccccagcctgctctctaggatcaccccccgccctaaggggcctggcctggggtgacgtggccaggcagactgtctgccccactccttcacacaagcccagctcctctgcccaaggggtgcggcgcccccttggggtttcctcccagttggagagtagagttaagacaaggcccagttttgtgttagccgaccgtctttgcccacctctatgacccagcctcttgcagtattcccatacttgatgcagggaaggaaccagaagcagaggggcctctacgcaggtacacacgtgtacctgagtgtgttcatgagggcatctggtgtttatgtgtctgagtgtagctttgtatttatgtgtgtgtgtgtgtgtatgtctgattgcacgggtgtacttttgtatttatgtgtgtgtgtggttgcacgggtgtgcctctgtgtgtctctgaccctggctgggtgtgtgtgcaaatctgtgtgactggagctctaggggcatctctgtgtctgagtgtgcctggtgtgtgtttacaaagggagagttggctgctccagctccacagccctgggaccccaactcctgtcttccctgctcctttccctgtgttcaccctcagctctgacacattgaactgcagttggggggattggcagttagccctctgtgcttctccctgcagccctacctctgccaaggtctctccctccagggacctctgcttccacccacatatgtccacttagtcacccacacttgacacagttcctggagtaccctcttcccccaaccccagacctgctttcagagcaaaactcaagtccctcttcctccgtgaagcttctccctcagctgagcagtgatcacttactcactcttaaccccaatccgctgactgggtggggacagcacgtccagccttcccacctctcctgcaggcttctagacggagtttcaaaaactgatgagcctcgatccagggcttgaaagaagcc

SEQ ID NO: 56452 - DNA, 1110 bp, Homo sapiens
ccttaccagcctttagttcacctggggggctgtcgctaggcaatgtcactgcctggcaacagccacagcagccccagcagccgcagcagccacagcctccacagcagcagccaccgcagccacagcagccacagccacagcagcctcagcagccgcaacagccacctcagcaacagtcccacctggtccctgtatctctcagcaacctcatgtgagtcctggggagactgcatgtgagtgtgtgggaagggagaattgaacgggaagaggagggacctcttgggagctgggttccctgcagggttctagtggacatcctatgaggctgtgcactgcacagtctgttaggcaacagtggcacccctgggctctcttgtacagacccaagaggctcaccctgaaccccttctgagagccagccccagggtagggggtgggaggtggggggccctgtgttgcagaagatgacatgggatggaaagagaactaatatttcttatttcccttctcttcccttcattcgaccctcttctgatcactctccatccaattgcctctccccaacaccccatcccccatattctcatcctcttgttctctctcactttctgtctggtgtcctatcacttgttctgtcactcaccccctctgtttttatcccttgtaccccatttccattgcctgcctccagcccgggcagccccctgccccacgtgggtgctgccctcacagtcaccacccacccccacatcagcatcaagtcagaaccggtgtccccaagccgtgagcgcagccctgcgcctccccctccagctgtgttcccagctgcccgccctgagcctggcgatggtctcagcagcccagccgggggatcctatgagacgggagaccgggatgacggacggggggacttcgggcccacactgggcctgctgcgcccagccccagagcctgaggctgagggctcagctgtgaagaggatgcggcttgatacctgggtactgtagcatcacctctcctgtctgccagtgtctgctacacccagggactgccccgcgtgccccctaacctgttttatttcccacccaagaggccttgtggccggctacc

SEQ ID NO: 56453 - DNA, 1025 bp, Homo sapiens
tagtggcatgtgcctgtaatcccagctactcgggaggctgaggcaggagaatcacttgaacttgggaggcagaggttgcagtgagccaagatcacgccactgcactccagcctgggcaacagtgagactccatctcaaaaaaaaaaaaaattagccgggcgtggtggcacacgcctgtagtcccagctacttgggaggctgaggcaggagaattgcttgaacctgggaggtggaggttgcggtgagccgaggttgcaccactgcactccagcctgggcaacagagcgagacttttgtctcaaaaaaagggaaaaaaaagaaaaatccagaacccagccctctgtgtaggaaagcccctcgtggcaggttaagagagctggagggaccgcctcatgttgagggaccagactctggcttgtgtgtctgtgtgtagttaccacccaggtgtctttgagccccttctcccttgcatgtgcacccatgtgtgtgcccagccccaggctacgatgtcctggcaacttcacagatggctgcttcagaagacacacgctgtgggcccgtctccccatctgtaagaggagtgggtagacaggaggtctatgaggcttttccagccctgccactgggcctctggggcccaaccagaaaaaccagccctgagggtggggtggcctggggacagggacagttggcggagggcagctcagaccactttttagaccacttttctggagctgtttatcaggtactctgtgagggtggttttctgtttttctgccatcttgttgggcccacagtcttttgtgaagcaggaggaaagttagttggtgtcagccaacctgggacaggcactcaggaaggctagacttaaagattctcatctgtcactctggcatgaaagcagtttctgcccctgggccgcccttggagccctgctgggaagtgtgtgagatttctcatctcctctcagagaccacaggctccctttcctcttgttacaggagcagctaagcagatctcagttt

SEQ ID NO: 56454 - DNA, 1098 bp, Homo sapiens
taaagattcaggagtaaggggtacttgcctcccattattctcaagacatgaagtgttcagggaatatcagatagctcagcccccactcaaagcctaagcatggctttgagaggttccgggtaacaggagtattggtgtggggaagttaatagggctgaaggataggcccatgtttttccttttaccctcttgttgtcacttctccagggaatggctacgtcagtgctcgggcttcccctggcctcctccctgtggccaatggcaacagcctaaacaaggtcatccctgccaagtctccacccccacctacccacagcacccagcttggagcccccagccgcaagcccgacctgcgagtcatcacttcccaggcaggaaaggggttaatgcatcacttggtaagtgggtgtctgggccaagggtgggggctggggaatggaagagtagggacaggggaaagagcagacctctagcaggagagatgaaggctagccagcagttaggacttcccaagataaatcttggaaccatggctttttatgagatttttcttcccagagggccttttaagaggttgcagcacaagaagtaccagcctaaggcagtaaaaaggggcaggaggtgagagagaagtggtggggaggatcatagaaaggatttgccactatagcaggagggatggggattagatggtgagcatttcctcactggtggagattgggatggagcatctctggaaatgagtcaggacggtggagagctctgcctttgtaggctgggtagagccaccctactcttatgcagagaggtgactggaacagctgtggggacagaggtgtgggggagggcagcggccagagactgaacatccccttggttttatttctgctctcagactgaggaccatttagatctggtaagtgaggctgtgagctctttgctgtggctttgaattctgggtattgctctgcggtcccccagcatgaagtacgtgtgcgtccttggcctctcgcctgtgcgtgaactgttgctgtttctttgcttagttgccaggagctgtgcttaggtgccaagtgggattcaaaggtgaatggggtg

SEQ ID NO: 56455 - DNA, 1076 bp, Homo sapiens
gcagcaggccagatgggtggagactgcaagtgaaatgatgtccctacccgtggtgcaagcctttaacagccgtgtgtgaatttgagtctgttatcagggcctctaacctgctccccgtgtgtcctgcctggctgaggactaacccacctccactagggggtgtccctggtcctgtctgcagtgagcagagccttgttctcattctgtgggccagaaatggacccagagtatggacccagagtttctccccaaagttcttccttggtgggactggcaggcaggactccacaagggcacagggcagggagcttgaactgctggccctaggatgcgtagcccagaaatgagaagaacccttgcctgccctcccaggaaaagtggactccatggaaggggtcaacctggcctgatcctgcccctccatctttctgtctagtcaactgtcccggcccccaactttgccatgcctgtcacggtgcccgtgtccaatcagagctcactgcagttcagcaatcccagcggctccctggtcaccccttccctggtgacatcatccctcacggacccgcggctcctgtccccccagcagccagcactacagaggaacagtgtgtctcctggcctgccccagcggccagctagtgcgggtgagtgggctggcaggtgggtaggtgaggtggaaatgagatgtgatggggactttgggattccattttcaacagcaagtatttctcttcacccaccacagcattccgccatttgtatggctcctgagggaagggagtatgactcttcctcctggggtcccctcttcatgttcagtccccaagactcactcttgaagcgggagtgttgtcagctcatcctggttctgtttttcctccaggggccatgctggggggtgacctgaacagtgctaacggagcctgccccagccctgttggtgagtgcagtcatccttctacctggaggtggggaggggtgcccgctcagtggcctcagggggtccaaggatcaggaacgacctagatgagaggagaggaagatcccagggccaggactggatgaagagtcag

SEQ ID NO: 56456 - DNA, 2019 bp, Homo sapiens
ttgttcactgactgggcagatgtcctctcagcgttgtctcttctccaagcttcagaatgggaaccatagttctaggccagaggagcagctggagcacccaggtgtctatagtacaagcaggttctagagagaagaatgggccatgggatattctctgagacccagaccttggaagccaggaggtccatttactctgtcctggagcctgaggacagcagtgaccgaggggaaagagtctgggccttggtgtgagctccagcttgtgcctggctgtggcataccattgcctcaggcagacagcattgcctcatgttgagggtggagctcagatgctgccagcctctcacaggggcgctgtgagtctggcctgtgtgcccagggagcagggctgggggttttgggggctcagagacctctcatgaccctccctttccaggaggctgtgcagaaggtatcctgcagaccatgaactgagcactgttcccagaccgttcatgagcacagtgtaaggtgtgccgagacccaccacccagcgagcccctcccctccgtagcactgaggacccccggagaagatggggaggaaaaagattcagatccagcgaatcaccgacgagcggaaccgacaggtagggaagtcctagagccgtacgaagtgggtgagggcagggagcaggcctctgcctctactcccttcaggcattccaagagggctttgtggaagaggggaaactataagctattacagaaggggaagggagattgggagaagaggaaccccaacctcttcgcagctcttggagctctgcgtccctggactccaggactcttctgctgccacagctagatgagcccatgttcccatcccagagccatttgcaagccttaggtcatacccccaggcactcctcctttcccaacaggaatcctctccctcttcttctccactgacctcttcatagcctccagcacagaggtgtggagttctgtccacctgaatcctgccccttcagtgagtgggctctgggctgtatctaagctgtgtgttggcctacaggcactagcctggtccttccccaaaccagggactcctgagaccaggggctgtgtcacactgagaatgggggctcctgagggcaggggctatgtccagccatctgtaggctgggactcccaatcaggccttaactgagccagatctggccgcccacccatccttctctgcaggtgactttcaccaagcggaagtttggcctgatgaagaaggcgtatgagctgagcgtgctatgtgactgcgagatcgcactcatcatcttcaaccactccaacaagctgttccagtacgccagcaccgacatggacaaggtgctgctcaagtacacggagtacaatgagccacacgagagccgcaccaacgccgacatcatcgaggtgggcccatacacacaggcaccaggatatacccccgcctgcatccacatggacacgtgcccacgttgcatgtacacgcagacctgcctatgcacacacactggtatacatgccccttgtagcccctcacctgtgcgcacacacatgcaaaccctccttctgtcatacaaacccagggtctgaggaggaaggaagggcagttcaagtgaacaggccagtgccaggctgccagcccacacccaccctgccctctccaagagtctgctgtcgtccagtgtgatgtaacatctctatcctgccttcttgcatcctgtctttctctttgtctctctttccccgcttctccatcttctggtgtgctcctgcacctgcctcttccttttttaaatctccctctttgtttccatctctcctgctgtctctgtctgtttgtgggcccggtagttctattttctgtttcaaagagagccaacattgtgaactgttgaaggacatgagctttggaattcagttctgacctttaccggccacatggccttgggcaggtgcttaggctttcccgagccttggtgcccacctccacaaaatg

SEQ ID NO: 56457 - DNA, 1388 bp, Homo sapiens
actggtggcattatgctcattccaacggctctcaagctgacccgcccccaaggccccagctgccactttcacttctgtctcctgagaccccagagggaagttgtgttggggaggtggaaggtgacacactaaccgtcccaaccgcccccacctctcctcagccagggcttctgatagccaagggcccctgtccattgctcttgtttagatgaccaaattgggttaggtaacagtggaagattggctgcggtgggagggatggccgttagatagcaggaaggacttcctaggattggagaccactgctgggcttcattgtttcagaagatatgggagaggtgtagatactctggacaaatgtaggtcagacttaaaggtaggtaggagattggttgtctgcagctcccattggttggcatacaatgctggggcctccatgccctcccacgtgtcaccagcctcgcatgcttggttggagggcttctgacaaagcaagtttgagccccagagactactttgagtccaaggactcagccctgagaagttctttctgtagtcttatatctgtcctacctgctgtcctgggccatttactcccaccctgcactgtggatgcgttttggaaatggagctagaaatggaagtaaaggacagctcacctccctcctgctgctgccgccccaaccttagcactaaagaggggaatgggattcttctcctgtgacgccccaaggcagtgacagagccacacttcaccctgtgaatcttaccaaactcctgtagctgccatgcttgcttattcctcgtgatttcacaccccttccccatctctgcctagacaagagtaggggacccagttggactgagagctctatactgtatcactgggagttactataaatccaagaatgctttctggaggggaaagatgggaacaaaggcctgaggtgccaagaactccacttggtgtccgcaagtgcctacggatcctgggtgggggtgacccaggtcctggaatgggaagttgagcctgaaggaataaggtcagagacgctatgcaaatcctcatgcaaatgagtggtggtgagtcattgcagctcggcctgctgggatggagtatgaagacagccttaggcttgggttctagagctggtcccaccagggaccaaacagtgaccttgggctagttgctgctcagtaaccacaagcaggtgggtctgataggcattcccagtgtgtgaggggattgggatgactgagcctctgccacaagggccttgtgtgccccacttggtacttgttctggctgaccagagcctttgtgaacccttggccatctgttggggggttactgtttagaaggcacctgccccttcaccagccccatc

SEQ ID NO: 56458 - DNA, 1082 bp, Homo sapiens
ttttttgaggtaggatcttgctctgttgtccaggctcgagtgcagtggtgccatcatggctcactgcagcctcccattcaagcgatcctccggcctcagccttccaggtagctgggactccaggtgtgagccatcgtgccccgcccaaaaaccaaaacttttgagatcccaatgaagagaggtgatgggttctcaaaagggaggaaggaaacttccatttcttatgttcctgtgtgccaagctttgtactgagcatgggaatataagaagactgtttctctctaaaactgtttttttgaattgggaaactgagtctcagagatgtaagtgacttttaagctttcctagttatgaagtataaagggcttttgtctgagattaaaggagagatcctgccctgcaggacggggcaatggaaaggaggcccacggagacctgagaggaggaggagaaattgaagggaagagaaaaccaggattcctcagcagagggcagagaatcagcctttggtggcaaggtgaggagggtattgttttgacttgagtgtcatggagaaagcccccaaagcaagggtgtgagggcaggaacaaatgacactccgagacccctcctgctgtccctgtgagctgccgcatgggatgaatgagaagagacactagagtgggaaggcttggaccacaagaggctgggcttgtctcaaggcagacacaaggccaatgtgagcctcccaggcccagacctggggaatgggccctggaaggaatgtgctagaactccccggtggagggagactccctcccactcccatccaggttgtaagcagaagccctgtgcccaacagtcagtctgcctctgccccttatttctggtgaccttgaggaagtccctgcccatctctgtgtgagtttccatacctgtgaaagggaggtggtgctacctgcctcacatgggaagggaaggagtttccgccagaaaaagtgtgatggttgcatcttttctctcagaccttcagccccagcctggcccaggactggcctgctaaggcagctacccagaagcaggggtgggggcaaggaatgcct

SEQ ID NO: 56459 - DNA, 1621 bp, Homo sapiens
tctgggaagggagacatacagtccgtgttcatggaagccccagtccaagggaagaagcaggacccagagagcctcatgatccttgtgttgggggatgggcatggggaattggctagagcttctgtctgctgtactcaatgcctgaaagattggtggaggacttggaggggtggcaggtgctgtccgtgtccaccccactctgtgcttggtgcccctgggctggagggcctgggcatcctggctctgcccccttggctcctggttcttctcataggctgggagatatgatagtctttctggctgctgttatataatctctctgtagcagggttttttttttttttttttttttttttaatctttcctgggagatgtgatagggaagagaagccagagggagactcttcaggttggggggagctaaaggagcagtagtaaggaagcttggagtgggaggtgccttggcccccgaggaggccttggggataggccctcattgattatggcccagcccctcagacccttctcctctaccgtgccctcagagggtccctctgctgtggtcgtccctggctcttatacccccagagaggcctggacctctccccattttgtcaactttctcttcctgaccagctgggccccctgctctccctggttggcactggatccagaatctcaggacttacgctggcctggtgtgggcccttggttggacactttgccacacacctgagtacctttatggggacaagggaagtccaggagcaagtgggtgggcccaacatttccctagttctatttgagtcaggccccctgcttctttgcccctctagtcgagagagtggtggccttactggaaaagaggagttgagggccttgacttaatacaggccttgacctcttggacacaggtcatcgttggtgttcatcaggttctataagtgggtatgaggatccgatgtgagcctggaacccatcatcaagggtcaggttctgagtctcatggcactgtggtgctgggattctccccatcccacgggaccatggctgggactctcgaggctctctcaggccagctggtttgaggcaactatctcttttttatagagaaggaggaaatggtggcaggccggcacaacctcagcatcactgtaattgctggtggcttttatgagccagtcatggggccggagtccggccaactgtctgtccttctgtcccagtttggtgacttactcatggagggaggggcggttaggtactagaagctgtgttctagaagctggacgtctgactgtattgtggtcgatgtcactctgtctatccatgatcacagcaggtaggatggagcttagacttcaggaagaacttcccagtggggaagctgggggggagagagatggctctaattttgcataggaaaggaggggaactcaaagcactttcttttccagtggctctcccgaaaggaaaggccttgacctttggcttggtggggtcggtgctatttggatctcggaatatttatcttctttttcctctccctgcttatggctgaaagtattctgaggcgtttgtcctggagctgtgggagaaatagccattaggcccctttccc

SEQ ID NO: 56460 - DNA, 1889 bp, Homo sapiens
ggaggataggttgttggaaggactccccagtggagagaaaaggagactattaagagagattgtcttgaggggtcactgggacagaggtagggcaggacagagggcagaagctgagactggagagtccaaattggcctgagcaatcactggagaaggctggggaaatgatggggacagaagatgtgtggggtgctggccctccccgctctctcacatgcccgccctctggacaggaagttcatccatagagcctgccaggtgccagagccagaggagcgttttgcagtggacgagtactcagacatggtggctgtggccaaacccatggtgtacatcaccgtgggggagctggtcaacacgcacagggtgaggggctgagatctggagggtgttggctgggtgggcaagggtttggtagcctgtgatggggtagtgggctggccccagagggaagacctggctcagaccctgcatctccttttctttctccgtcctgcagctgttgctggagcaccaggactgcattgcccctgatcaccaagaccccctgcatgagctcctggaggatcttggggagctgcccaccatccctgaccttattggtacgtgccctccttagcagctgaggccagctaggggacctgcatggagggagggacaggcaggcaggcagggcatgtgagcgtgcccatgcagcctaggtcttgtgccaggcggctagttccatactctccctctggtcctgacatgggcacagggacacagattgatgtggagaaggtagacagacagtagagggacccacgatcatcatggaaaacggtcaatgaaatgatctgaaagaggcacagggatcagggcctcattaggtttctctgagaaggaggggtttccgggccatggaataggaggaagccaacttactgggaggaaggacagaatgaagatggtgattggagagaaccaggagctgcaggctcagggaggcacagctcctctaccctcagggcacccagggctgagggtgtgggggtggcacagccccagtaacacaagggtatgctctgtgggtaacagcccttccatcggtgctaagggttggggacacagggtagttctgcaggccagtgtgggaaaacttcctggaagaggggcatgtggagcagctgatttaatgtgaccccatcggtgcatgtgtgtgtgtgtatgtgtgtgtgcgcatgtgtgtgtgtatgcctgtctccctctcattcctcaccacacctcaggtgagagcatcgctgcagatgggcacacggacctgagcaagctagaagtgtccctgacgctgaccaacaagtttgaaggactagaggcagatgctgatgactccaacacccgtagcctgcttctgaggtgggtgatgccagcctctgcccctgcatacctgagctccccagccctgaggccagtaaaatggccttattctgaggcgcccattccaccttcttcctgggctcccttatccttcaggaagttctccctgaagcctacctttattcccctcgctgcagccttggctcttttccatctggtatcctcagctttttgctctgtgttgtactgaaagtaaaggaatggtgaagatattggcaacagcaggtgtttgcatatcgtgctgtttaccaaatgcttttttcttttttttcaagtagagacagagtctcgccatgttgcccaagctggcctcaaactcctggcctcaaagccatccacctggctcagcctcccaaagtgctaggattacaggattgacccactgcgcctggcccaaatgcttttttaataagttatcgtttattcttagaaacaagctatgaggtagatggtggcttcccctcttcatagtt

SEQ ID NO: 56461 - DNA, 3707 bp, Homo sapiens
gacaggtacctgtaatcccagctacttgggaggctgaggcaggacaatctcttgagcccaggaagcagaggttgcaagtcgctgagatcatgccactgaattccaacctggacaacagagcgagactctgtctaaaaataaaaataaaaaaagatttgttcccctactgtagccagattaatccattaaacctgtacatgtgatcatgtcactcacctccttaagacttatcatgatgccctgttgccttgaggataaagtccaacctcctaatcacagctttggggctttttgtgatccagcctttccctacacctctaacttcactgacctgcccctcaccacctacaccttctgcactgtgttccagatacagtggacttccagcactccccacattcaccctctctgcctccttttcaccgacatctggggtgtctcacctcctccttgcagtgtctcttcactccccaggtggggttgggcaacccacttttgttttcccaaagatccccatgcttgctcctctcaaagtgctaactacactgcagtgaattgtggtttatttgtctagttcccctactagactgcctttagggacagggactagttttattcatcttccaaatctgactccttcatttattactaactgtgtaacatagggcaagttgcttaccttctctgagtctcagagttattatcggtaagagaggatagttatagtgtactgacctcacaggtggtcttaagtacgtaaagtacttagaacaggttctgtctcatagtaaacattctatgtattagttgttttgttgttatttccaataaattagctcagaggcttctttcttttttgctcaaatgccaattccaaaggtgattcaaggagaatcaccagctagctctgacctcccctaaattataaagcccactgtccatcccgtctacctgtccttcccggtgtgtacagacattcctgacagaggagcactgtgggagcaagcagggctgagtggtggctggcaggtaggaggaggaggaggagcaggttggcccagcagaagtgagtggtagattggggtagactagggaggtctgggaggataatcagagggagctgtggctctggctttggtgtcagaggtccctgggatagacccaggctggggtgaatcagaggcatgggaagagcagctattatgtcatctccagttataagacaggaagctcagggacaggcctggctagaaggctacccactgccctccaagtgcaagcagaaccagttagaagaggactggggttggggacctgctgatcccaagcagaacggggactggggtgggctgactcgggcaggggctggtgaggaggcctctgatgaggcatggctaatcctgatgcctcctcccttcctcccagtgcatgcaccccaccctcctctcagtgtggtacgcagatttgcccatctcttgaatcaaagccagcaagacttcttggctgaggcagagctgctgaagctccaggaagaggtagttaggaagatccgatccaatcagcagctggagcaggacctcaacatcatggacatcaagattggcctgctggtgaagaaccggatcactctgcaggtatggggcccaccagtcctcccctccccgagatctgcctgcctctggagatgtgatgctgaccattctctgcttgctaatcaatttttttcaaaatgttgtggattttgtcacctgactcaggtccttgttccagtggccctctgccattctaataaatcattttgggggacccatgacagagtagaaagagcatgaaacctagaatcagaatgcctggctctgctgattcccagggatggggctgtgggtgctcatttcacttctaagtctgttttctcattagcaaactgagaataatgagaatgtccacctctccaggccaaatatagagacagatatgaaagctgtttaaatcataaattaccatataaatatgcagtgacagggtaatagtgatatagtgatagctccacctcaaatgtgtgtagcagtctaataagaagagatagcaaaagccaaatagacacaattcctcagcctggcaaaccagttctctttggggactcactcccatgacaggagaggaaacagatggagtctcagggcacttggaggggcccttcctcaccctagaactgcttctgtcccccagcttatgcctgttccttgaacagcagaaagccctggctcttcaaggcactgattctagaccgtatgttctgtgccctgggatggcctaggctagttgtatcacccgctcctccacccctgcaggaagtggtctcccactgcaagaagctgaccaagaggaataaggaacagctgtcagatatgatggttctggacaagcagaagggtttaaagtcgctgagcaaagagaaacggcagaaactagaagcataccaacacctcttctacctgctccaggttagcagaggactttccaaggagaagtctctcccgtctcctgagggtctgagacttcaaggccttcttgtctgtgcgtttggcaccatgcaaggtgtcctttcccataatcttaattccttatccccaggaaaggagactacctcttcccctgtttgtctggaatgttactagcacctggagaaagtgtggtagtgctttctccattccagatttccatcaggggaaagcctttccttatcctatcactggtccttgaagtgcatggtcagccattcctgtctcccctcttgcttgcagactcagcccatctacctggccaagctgatctttcagatgccacagaacaaaaccaccaagttcatggaggcagtgattttcagcctgtacaactatgcctccagccgccgagaggcctatctcctgctccagctgttcaagacagcactccaggaggaaatcaagtaggctctccagacacaaaggaatggggagagaatgggttaagagatccccctgttggctccttcacaaggtgacaacttgttgaggcctaagggtagaaatggaatcagaagacctcttttctctacctcctgtggagaaaccgtaaaacatctgggacagcacagtgggaggatatgggctgacatgctaacacaaaggatgagagagatatcaagacattccttaagagcggggacaccagggcaggctttgagagccaaaatctcaaaaaggaaaagcaacggtatgtcctacacagaggcagaagactggtttcaatgacctcttaaaccacaggtcaaaggtggagcagccccaggacgtggtgacaggcaacccaacagtggtgaggctggtggtgagattctaccgtaatgggcggggacagagtgccctgcaggagattctgggcaaggttatccaggatgtgctagaagacaaagtgctcagcgtccacacagaccctgtccacctctataagaactggatcaaccagactgaggcccagacagggcagcgcaggtgagcacatgggcagagggaggagctctctttgatcagctgtgtcttgatcagctgtgtcttggaccctactggggaagcttgggtgtactttgaaggtggcatataaatgggcatgctgatctatgcaaatatgacaccagctttgtaggcatgaataaggtagtcttttag

SEQ ID NO: 56462 - DNA, 1920 bp, Homo sapiens
gaccagcctaaccaatgtagagaaaccccatctctactaaaaatacaaaattagccgggcgtggtggcacatgcctctaatcctagctactctgggagctaaggcaggagaatgacttgaacctgggaggtggaggttgtgttgagccgagatcgcaccattgcactccagcctgggcaacaagagcgaaactccatctcaaaaaaaaaaaaaaaaaagaaagaaagaaaagaaaagaagaaaagacatagagaaaaataaaatagggcaaagtgggtaatgggtagagacatagtagggacagtttttctgttttacataatgtagatctctttgctgaggaggtcattttgaaagagacctaaagggcataaatgattgccatgaggctatctggggcagaggccttaagaaagcaatgtgcatggtgtgttcaaagaacatcaggaagccagtgtggtggagtgaagtaaggaagaaagaggagtgggagatgaagaccaagtagccgaggccagaccacgtaggactctggtttttactctgagtgaggaaggaagccacgggagggttttgagccgggagggagttgatctgacctacttcttttttttttatttttagagacagggtcttgctctgccacccaggctggagtgcagtggtgcaatcacagctcagggtctggttctgtcacccaggctggagtgcagtgatgcaatcacagctcagggccttgctctgtcacccaggctggagtgcagtggtgcaatcatggctcactgcatccctgaactcctgggctcaagtgatcctcccaactcagcctcccaagtagctaggactacaggcacatgccaccatgcctggctaattttttaattttttgtagagataggatctctgtacgttgcccaggctggtcttgaactcctgggctcaaactgtcctcccatcttggcctcccaaagtgttggaattacaggcatgagccaccgtgcccagcgatctgatctacttaatgggatctttctggctgctgtgctgagaactgactgcaggagtacaaggggaaagcagggagacctgttagacagctattggagtaatccaggcaagagatgatgggggcttggccttgggcggtagcggagatgggaaaaaggagtcagattttggatacattttgaaagcaaactgacaggatttggtcatataatagatatggggtagaagagagaacagaattaggtatgactccaagatttggggcaagatgggagagacggtgggacatgcaggttaagcaggggaaccagttcagatgtgagctgttgggtttgaggtgcttgttagacattcacttggaaatcacaaggagctggctgggataaatgaatgggctggaggtgtgctttcgggagcatatggtgttaaagtcatgagattgggtgagatcatctacaatgtaagtatggagagagaagaggtctgaagactgaagattgggatgctcccatgtttagatgtcagggaggaaccagcagaggtgtctcagaaagaatagcctgtgaggcaagaagagaactaaaagagtgtggtgtcctggaggtcaagtgaagaaaatcgttcaactgtttcccctgacttctggctgatgattcacatgctactcacctctctgcccttcaccccactgccagttacttcgatgccctgctgaaattgcgacaggagcgtgggatgggtgaggacttcctgagctggaatgacctgcaggccaccgtgagccaggtcaatgcacagacccaggaagagactgaccgtaagtatagtctggagctgggtggagatggcccaacttaggcagtcctgtcccttagccattaagtctaggggccccctgcccacctagatctc

SEQ ID NO: 56463 - DNA, 1284 bp, Homo sapiens
agattaaattgggtttcccaggttccctttcaatggagtttttgcaggatgacagagaaagccaggacatctatgaccactacctaactcaggctgaaatccagggcaatatcaaccatgtcaacggtaagagacctcgagcaggagtggtttgggggtgacctcagggtaagcccctgcactgggaggtttggggatagcttttctcaagccagaaagccctatggtctcatttgggccaactcttgcctcggagaaagatcagagtccaaggagtatgtgcactgctttctggccatcggtgtctagagaagtagtccatgtccgggaagcttctgtctgactggagaaccatagagaggagcagctcttgatgccgggggggcagttggactggggtccttcgagaggggcaatgtggagaatacatgaggatggggggatctgggtaggagccgtgtgaaggctcaggatgggtgggcatttgcctatttgggtgaggatatccttggggtctggggcggcgaagtgagaaggctgtgaagaccaagctgaagaatttgggctgaaccaaatgggcccaggaaccaagggggaaagggtgggggtaattccgggcaggcaagaagagggtagattcctagggctggactaggggattatgagaggtggctttctcacactgtccattatggagtcattttttttcagtccatggggctctagaagttgttgatgatgccctggaaagacagagccctgaagccttgctcaaggcccttcaagaccctgccctggccctgcgaggggtgaggagagactttgctgactggtacctggagcagctgaactcagacagagagcagaaggcacaggttagcctctgtctattacctgccaccccctgtatgtgactataggataggagagggcctcttactcaaagatcaccactgttggtcctttgtattctgtaagtgctgactacgtgtttaaatggttaaatcaccccaaggcctagtagaccagattgatcagcttctgtccctgagagtcccccaggctgaccaagaggaacccaaggacagtcccataggcagtaatgtgctcccccattgttgaactggtgcctccacttagcaatcttgtttttaaagtagttgacttttcccctgacacattcgtgttgtctatgttgttattttagatgcttgctgagcaagaaagattaaagatgagttaatagggctgggcactgtggctcacgcctgtaatcccagcact

SEQ ID NO: 56464 - DNA, 1172 bp, Homo sapiens
gggccctgcatgggagtaggccagctctccagcataccacatctctggcaagggtctaaggtgaggcatgcaggctcactatagacatctggaagacaactgggggcctggttttttgttgttgttgctgttattgtttttggaggatatggcttatatcctgtagccttgatggccttatctggtgtttggttaatccagggcaccctaggactatgtgtctgtggctgagccttggcttagtatgcatcctcagtgaatttcttttatactaggctgactagaaatggttgggggagactgacctagacaccccaggtaacaagggaacacacacctcaggttggagaggaagacccattcctcggcaccccctctccgcatttggtggtgcttaaaggttcccaatggcagtaactggctggtttctcctctagaccttcttcccagagaccacggacatctatgacaaaaagaacatgccccgggtagtctactgcatccatgctctcaggtgagagacctcaaattttatcatccaggttcctctaggtggatgcgaccaacaatcaacaacaacaaactcagcaagaaagaaggatgaagggtagaccacagggagcactgctcaggagagtgaggtttcagatttacagagttgtgtttagatttttgtgcatgtctgtgggcacatttatgtatggcctgtgtgggtgaaggggaagggcaggcagggtaccagagataggaaagtagcagggtagggccttcagtttgtaactgggtataaaggaatcagaacaggacctattgagagcaacacaggcaagacacttagtatggatggtgtaggctctttggtcctacttacagccagccatcagcaaccagttggctaaatcacagcaagtgaccgaccggttccttgtgtttaccatgccatctctttctgaccacttcccatgtccctttgtgcccctgtgccttagctcagcaggtatctgcttgctgcgcccttcctgtcctctctctccattgagtgacctgctactgcaatgtggccttctctgtgaagccttcctaatcccctcagacccccaacaccatcttatttaccttctgcagcactttccttgggctgatttatggtcatatttctttatgtgggttgg

SEQ ID NO: 56465 - DNA, 1012 bp, Homo sapiens
ttggaccccaccttctaccttcgtcccctcaaactatgctttctcctcaaagctgtgagggtagagtgaccatataacttattgtccaaatctggataaaagggagtgttattaatctatgtttctctgtcctggtagggatggaaaatccacaggatgtggtcctctggttcccctctgcccatctctcctgaatctttaagctgtagtctgggctttacccatagggagtgctgagaactgtggaaatagattttctttttccttccctttcaggcaactggcttacatttccgtcacacagacaacatcaacttttggctatctgcaatagcccacatcggtctgccttcggtaatactgggcctgaagattggtattcatctttactccttaccagccacctcccacaatcccatgctttatctccctggaccctttagccctatttccatgtgtcttctaaactaacttaatctaagagaacagttccttgcagctgtgtgtctttgaaccaggttatttttttctctgcctcctcttccctgtggatgaaaggaggtgaagtttccctggcctgagtggcacggttcccattatgcagggggtgggaggctgctatgtcatgctcgtattggccagccttgtctccaccaaatttcacagtgtgaagcaagggtatacacatccctaggtggcagactttgagttagaagcctaggtccaaaaccccaactggacacatgatttcactctttgaacctcaatttgttactcatctgtaaaatggggatagtgagccctgccctgtctaccttacagtgttgtcaggaagatcacatggtctgtgtgaactccctttgtgaactgtgaagagctatacaaatgaaggcatgataggattctacaatgtatggtttctttctgctttgtttttcttccctgtagaaaggcactataagacaggaaacagcagtaaagacacttcgatgggaggcagaagcaatagagg

SEQ ID NO: 56466 - DNA, 1050 bp, Homo sapiens
taaatgagttaagcccacacatagtggctcacgcctgtaatcccagcattttggaaagcagaggtaggcagatcgcttgagcccaggagttagagaccagcctgggcaacatggcaaaaccctgtctgtacaaaaaaaaatacaaaaattagccaggcgtggtggcatgtgcctgtggtcctagctacttgggaggctgaggtgggaggattgcttgagcctggaagtttgaggctgcaatgagccatgatcgtgccactgcactccactccatccagcctgggcgacagagcaaccctgtctcaaaaaaaaaaaaaaaaaaaagattgactgagttaatatgacagtgtggcaatatgtgtaatccacctgttatgcattaagtgctcaataggagtgcccttcctaagttggacactttcaaaaggggaactccagccagactgaaatactgcagtggtgtgggagaagtgtgtagcccccacaccaagaggacagtgtaaatgctgaagcataagtacaggatctggtctctaccgagtaccattatcttatgactcaggttaataagcacctcattagctttgtgtttacaaggtaatatattttgggagatactatgtagtggtacagtacagattctgcagacaagctgcctgggcttgaattctacatgttacctgtgtgaccttgaagtcacttaacctttttaggccttactttactcatttgtaaaataggctaatatttccctgaatgggctgggaagattaaatgaaataatctttgtaaagtcttagcacatcctggcatgtggtgagcacaccataaacttaggtatcagaattgacaccattcctccttgacttctctatatgctctttctgtagccagatagggagctccccaaagaccaggccacctccttcctctgtctctggctcaggaaagagaattcttttttctttctttttaattttttattttttctagaggcagggtttcactacgttgcccacactggtctggaactcctgggctcaagtgatt

SEQ ID NO: 56467 - DNA, 1079 bp, Homo sapiens
aacctattgagatgtctagtctctaggctttcataaataactgttcctgtgaaggctgagtattcatgagtattcaaccctgaaaaatcaggacacagctatcacctactctgcctccacgaatttctcaggctactctcaatgcttccctggagttttccttcctcgtatttgcgcccgggactagctcagtgtaggacgcggagccgttcttggcatcctgagagggccagttagtactgaagtcccttggctgctcaaggattgcagggatgaggcaagtggaacagcctcggaacctccgaaaatgggcacgctccaggtcccagtttctatggcaaccataccggcaaattgggctccgcaatggtttctcctggaaaaaccgtgattttggttcccgcggacgtctctatggtttcgacagcctagaaggaacaaaacggcatttccgggaagatggcggcgcacaagtcaggtccggcacatgtttccgcggagcggacccagcaatgacggtaaggggctcccttcccccgaacggtggtagtcggagcccgggcttattagcaaacgtgagaggagcagagtatttttacccaagtggcactggggtaggagggctggaatttagccctcaagagcaaggaagcctagggaaagggcagccggctctttaggactgctgtaagacgagtgaacctggggccacttctgaaaacacagattgactgtagaggggacagtgcccgaagtgtgatcacaggtttcagaaagactggggcgcacagcttctacccagttatccactgaaaatccggtaaagccattcctaactatgccattcagttcaacaaataacgactgaatgtattcttgagttctggcgccgcgttacgtgctctggagtggcggaataaagccggtctcttaacttccagggcatgtagttttcaattattgcgacaagggttaggctgtgtgtggtcttacaggagaaagcacaaagagctgtaagagactgaagagtgtagtgatgaagaacatcagtttttggccgggtgccttggctcacgcct

SEQ ID NO: 56468 - DNA, 1225 bp, Homo sapiens
ggacagtgctgagccttctggctcagaggaagagtctgaccctgtttccttggagagggaggacaaagtccctggccctctagagatccccagtgggatggaggatgcaggcccaggggcagacatcattggtgttaatggccagggtcccaacttggaggggaagtcacagcatgtgaatgggggagtgatgaacgggctggagcagtctgaggaagtggggcaaggaatgccgctagtctctgagggagaccgagggagcccctttcaggaggaggaggggagtgctctgaagacctcttgggcaggggctcctgttcacctgggccagggtcagttcctgaagttcactcagagggaaggagatagagagtcctggtcctcaggggaggactaggaaaagaccatctgcccggcactggggacttaggggtgcggggaggggaaggacgcctccaagcccgctccctgctcaggagcagcactcttaacttacgatctcttgacatatggtttctggctgagaggcctggcccgctaaggtgaaaaggggtgtggcaaaggagcctactccaagaatggaggctgtaggaatataacctcccaccctgcaaagggaatctcttgcctgctccatctcataggctaagtcagctgaatcccgatagtactaggtccccttccctccgcatcccgtcagctggaaaaggcctgtggcccagaggcttctccaaagggagggtgacatgctggcttttgtgcccaagctcaccagccctgcgccacctcactgcagtagtgcaccatctcactgcagtagcacgccctcctgggccgtctggcctgtggctaatggaggtgacggcactcccatgtgctgactccccccatccctgccacgctgtggccctgcctggctagtccctgcctgaataaagtaatgcctccgcttcaaagtctggactcttctttcccccactcagaggggaccctcagggttagtacaggagagagatggcgggggcgggcggggggtggcgggggagaggaggaagctggtgctggggaggggctgcctcctgaggagaggaggacctggggggatgagggcagacagacccaagctgcagggagcagtgctggggcctggggagggccaggggctgttgcttggctgggggaggccagtccaggtgacctcagcgcctgcagaagccaggcccat

SEQ ID NO: 56469 - DNA, 2653 bp, Homo sapiens
gtcctgcctggaccagaggagcctgggggccagcggcaagaggccagtacaggccagtccccagaggaccatgcctccttggcaccacccctcagccctgaccactccagtttagaggctaaggatggagaatccggtgggtctagagtgttcagcatatgccgaggggaaggtgaagggcaaatctgggggttggtagagaaagaaacagccatagagggcaaagtggtaagcagcttgcagcaggaaatatgggaagaagaggatctaaacaggaaggaaatccaggactcccaggttcctttggaaaaagaaaccctgaagtctctgggagaggagattcaagagtcactgaagactctggaaaaccagagccatgagacactagaaagggagaatcaagaatgtccgaggtctttagaagaagacttagaaacactaaaaagtctagaaaaggaaaataaagagctattaaaggatgtggaggtagtgagacctctagaaaaagaggctgtaggccaacttaagcctacaggaaaagaggacacacagacattgcaatccctgcaaaaggagaatcaagaactaatgaaatctcttgaaggtaatctagagacatttttatttccaggaacggaaaatcaagaattagtaagttctctgcaagagaacttagagtcattgacagctctggaaaaggagaatcaagagccactgagatctccagaagtaggggatgaggaggcactgagacctctgacaaaggagaatcaggaacccctgaggtctcttgaagatgagaacaaagaggcctttagatctctagaaaaagagaaccaggagccactgaagactctagaagaagaggaccagagtattgtgagacctctagaaacagagaatcacaaatcactgaggtctttagaagaacaggaccaagagacattgagaactcttgaaaaagagactcaacagcgacggaggtctctaggggaacaggatcagatgacattaagacccccagaaaaagtggatctagaaccactgaagtctcttgaccaggagatagctagacctcttgaaaatgagaatcaagagttcttaaagtcactcaaagaagagagcgtagaggcagtaaaatctttagaaacagagatcctagaatcactgaagtctgcgggacaagagaacctggaaacactgaaatctccagaaactcaagcaccactgtggactccagaagaaataaatcagggggcaatgaatcctctagaaaaggaaattcaagaaccactggagtctgtggaagtgaaccaagagacattcagactcctggaagaggagaatcaggaatcattgagatctctgggagcatggaacctggagaatttgagatctccagaggaggtagacaaggaaagtcaaaggaatctggaagaggaagagaacctgggaaagggagagtaccaagagtcactgaggtctctggaggaggagggacaggagctgccgcagtctgcagatgtgcagaggtgggaagatacggtggagaaggaccaagaactggctcaggaaagccctcctgggatggctggagtggaaaatgaggatgaggcagagctgaatctgagggagcaggatggcttcactgggaaggaggaggtggtagagcagggagagctgaatgccacagaggaggtctggatcccaggcgaggggcacccagagagccctgagcccaaagagcagagaggcctggttgagggagccagtgtgaagggaggggctgagggcctccaggaccctgaagggcaatcacaacaggtgggggccccaggcctccaggctccccaggggctgccagaggcgatagagcccctggtggaagatgatgtggccccagggggtgaccaagcctccccagaggtcatgttggggtcagagcctgccatgggtgagtctgctgcgggagctgagccaggcccggggcagggggtgggagggctgggggacccaggccatctgaccagggaagaggtgatggaaccacccctggaagaggagagtttggaggcaaagagggttcagggcttggaagggcctagaaaggacctagaggaggcaggtggtctggggacagagttctccgagctgcctgggaagagcagagacccttgggagcctcccagggagggtagggaggagtcagaggctgaggcccccaggggagcagaggaggcgttccctgctgagaccctgggccacactggaagtgatgccccttcaccttggcctctggggtcagaggaagctgaggaggatgtaccaccagtgctggtctcccccagcccaacgtacaccccgatcctggaagatgcccctgggcctcagcctcaggctgaagggagtcaggaggctagctggggggtgcaggggagggctgaagccctggggaaagtagagagcgagcaggaggagttgggttctggggagatccccgagggcccccaggaggaaggggaggagagcagagaagagagcgaggaggatgagctcggggagacccttccagactccactcccctgggcttctacctcaggtcccccacctcccccaggtgggaccccactggagagcagaggccaccccctc

SEQ ID NO: 56470 - DNA, 1036 bp, Homo sapiens
gtcaggagatcgagaccatcctggctaacacggtgaaaccccgtctctactaaaaatacaaaaaattagccaggcgtggtggcgggcacctgtagttccagctacttgggaggctgaggcaggagaatggcgtgaacccaggaggcggagcttgcagtgagccgagattgtgccactgcactccagcctgggccacggccacagagcgagactctgtctcaaaaaaaaaaaaaaattaaaattgtgtggtccctttccatgtcacagagtctgcttttggctcagagtctgtatctagcctgtgtcaggatattgcctgttcttcccaccttgacttccagagcagccatcgctggtgagctttagttctccttagggttccaaggcattagaagtaagagtgtagcttggaaaccaacttctgtgatttaggaaagctgtctctttcctaaggtaatagggggtttatttcatttaggccccagttggtaggttttaaaataatttataaagtgttttaataatttggttgtcttttttaccttgctaaaccaagcctctaaaaactcaaattattcccttgataaatttttataatggaaaagcaattatgtacagtttcttctttatgttaaatagctctatcacaaagtattgtggagctgtagttttcttaggggatttccaggttcactggatgacactaactggggcccttcctggaagtcatagaactgaccaagcctttgtgcgtaacccacgtgacacatatggttccttgtcctcatccctaccacacatcagagctgagcatggcagctcacgcctgtaatcccagctacccgggaggctaaggcatgatgattccttgagcccaggaatttaaatccagcccaggcaaaatagaccccatctcaattttaaaaaaaaggaatgagcacacctaaaatgacaccccaagccatgcaactccccctgacacacacagggtatgtgaccaggagagtgagatagagagagtgggcatgaaggaggg

SEQ ID NO: 56471 - DNA, 1102 bp, Homo sapiens
ctcttagactcagagggttcgagctctataagcccctccactcccttcattttacaaatgagactcaaacctagagcgcggtaatgaccttactaagaccaaatggctggtgaattgggcttcactagaatccaggcttgctggctaacaccaatgctccctccatcatttcatgttatgttttcatttcccctctgtctgagagattgctctgatgtctttccttccataagtcctacggagatcgagcttacctcatttttctcccaggcctaggagctcaattaccaggatcactttcttccccagggtgtactacagacctccacatgttggacagtaggattcagcagagaatgagtcccacatcctcttttcatccataagccactcttcccaactactcttccgccttccattgtccctatgtctactttactgctcaatctggattttggggaacctcctcccaaaaaggcattagaaggaaatgccaagcaccgaaattttgtcaagaagcggaggctcttagaacggagaggctttctgagtaaaaagaaccaaccccctagcaaggcgcctaagttgcactctgaaccttcaaagaaaggggaaactcctacggtcgatggcacttggaagaccccttccttcccaaaaaagaagacagctgcttccagcaatgggtcaggacagcccctggacaagaaagctgcagtgtcttggttgacccctgccccttcaaaaaaggctgattctgttgctgctaaagtagatttgctgggggagttccagagtgcccttccaaagatcaatagccacccaacccgctctcagaagaagagctcccagaagaaatcctctaaaaagaaccatcctcagaagaatgccccacagaactccacccaagctcattcagagaataaatgctccggagcatcccagaagttgccacggaagatggtggcaattgactgtgagatggtgggcacaggaccaaaggggcatgttagttccttggctcgatgtagcattgtcaactacaacggagatgtgctttatgacgagtacattcttcccccctgccacattgtggactacc

SEQ ID NO: 56472 - DNA, 1131 bp, Homo sapiens
aggccagggtgggtagatcacttgaggtcaggagttcaagaccagcgatggtgaaaccccatctctagtaaaaatacaaaaagtagccgggtatggtggcgcacacctgtagtctcagctatttgggtggttgaggcaaaagaattgcttgaacccaggaggcggaggttgcagtgagccgagactgcaccactgcactccagcctgggcaacagagactccatctcaaaaaaaatattaagattcctaccaaatcagcctctggtgaacctctctaaggtgcatgttaagcaagcttcccaggcatcgagaacctacaatgcaagaggactgcctcccaagtcagtgccttgggaacccgtgttccttatggagaacggggtctccttagccccgctggatcctcccccatggggaaaagggactatgcctacaggcctgggcagaagaggctgagtgagtttggttcattcttccccttatgattaagccctttctcccaggtttccatgctgagctcctgcccatcttcagtcctgaactctctcccagaaacctggttctggtggccaccaagatgcccctgggtcaggctctttctgttctggagactgaagacagctgatgcagcctgaggaaacatctcagaccccatcatctgaaagtgcccagagagcacagtggcagagtacatctcatccagagaaacagcatcctgcatcctccagagtcctggttccttcagtttcatcccctttctctccttccatggattatgtaatacattgtaaagttttaattaattaaaaattggatatctgtttccttcccatttctgtaggtagataaaaggagatgcgcacccttcctgtggcactgctgcaagggtgctacagttaggactcagacgccactccccactggcctccctagcaggtggggtaggtgatggcttctgttactcacagatttccatgaaggggacttctctccccctctttggcctccaactcagaatctgcaggccctgccccttgggagggccgccttaaggccagctaacttccatccaggttctgtcataaactcaggaaagaagcttcttcccttcagtccctgagagtgtgctgg

SEQ ID NO: 56473 - DNA, 1051 bp, Homo sapiens
agcaacggggctctgggcagagggtttctcaccctctgggtccaaaaagtgctgtccaatgggaatggtgggttggatgctctggaaattaagagggaccatctcatggacatgattccctgcgggtaaccccaacacagaggtggagaaacgcggtggtaacccttgtgttttgaaccactgactcttttgggttggagggtggcaggaagcctggctcgtaggccaggctcacctcttctatccaccaggaaacccactgagatcgagtggagatttactgaagcaggagagcgggtacgagtctccacacgatcagggagaattatccctaaacccgaatttcccagagctgatggcatcgtccctgaaacgtggattggtgagagtgaggggcaggaaggtcaggggtgggtgctaggagtgagagtaggggacattaatgaaagttggcaagccctcccacccatctaagtttcctctggcttaacagatggccccaaagacacatcagtggaagatgctttagaaagaacctatgtgccctgtctaaagacactgcaggaggaggtgatggaggccatggggatcaaggagacccggaaatacaagaaggtctattggtattgagcctggggcagagcagctcctccccaacttctgtcccagccttgaaggctgaggcacttctttttcagatgccaataaagagcactttatgagtcctcctgtgtacagctgctgtgtggtagaatggcacccctaatcccagcacactctcagggactgaagggaagaagcttctttcctgagtttatgacagaacctggatggaagttagctggccttaaggcggccctcccaaggggcagggcctgcagattctgagttggaggccaaagagggggagagaagtccccttcatggaaatctgtgagtaacagaagccatcacctaccccacctgctagggaggccagtggggagtggcgtctgagtcctaactgtagcacccttgcagcagtgccacaggaagggtgcgcatctccttt

SEQ ID NO: 56474 - DNA, 1455 bp, Homo sapiens
gtctgacttccttgtccagggctctttatgccattgtagtatctttatttgtctttgaagttagggttcatttttatctataaaatgaggttaatcatgacttcttcatttggttgtccttaggcataaatgagatacaggaaagcacttagcatggcacgtggtaagttgcaagtattcagttaactgaagcacttaccatttatgccttcagttcattcaccacctcattaattgagaatcgagtggtttagagaacatacttagttgggaaatttaggactcagtaattctagagtctggccctgggtccttttcctttagaaaaggagctatcttagggaggagtggttatttcctatctgaggataggaattctaagtgggatagggacattttaaccccagtttttatttctgctacctatttgttcatttcactgatttacaactgcctaccttttggccgtatgccagcgttccatcctctgttttcttcctatcctgctgttcatacattgatttaataagtatttgttaagcacctactaggggccaagctctggattcaagagtgagatagataacatggcccttgtccttaatgaattttttggactttgaagtcagatatatgtgggtttgaatactgattctccaatgtagtagctttgtaatcataagcaagttacttgacctttctattttctcatctataaagatgataacctcttgtgaggattcaatgtgatgaggtccattgagcaatagagtaagtgctttaaaaaatgttccttcccttgcctctttgttcccgtttctatccatctgcccagagctgacaaggaaggtttcgagcgttttgctggcaaagggatttcttacaacctccaggcatgcgtctttctgccctgctggccttggcatccaaggtcactctgcccccccattaccgctatgggatgagccccccaggctctgttgcagacaagaggaagaaccccccatggatcaggcggcgcccagtggttgtggaacccatctctgatgaagactggtatctgttctgtggggacacggtgagagcctcatacagggggtagagtgatggggaacctcctgggcaaggatccccctccctaaccttcgtatcttcccacaggtggagatcctagaaggcaaggatgccgggaagcagggcaaagtggttcaagttatccggcagcgaaactgggtggtcgtgggagggctgaacacagtaagttgagagaggggatggggatgctcaggaagcctgtctcatctgtccctctccattcagagcagcacagggtggcaggagactggctgaggggatggcggcattactgaaccttctacttttcaacttgggctgaatgcgccgagtagcaagggcaaacccctttcacaccccgtgctttctgacactcccctc

SEQ ID NO: 56475 - DNA, 4062 bp, Homo sapiens
cggggaaagggtcctagctccctttgggagaagttgacccgaggttttgcctcctgctccagccctcccccctcctgcacagagccctgcctgcccggccagtgggtttaccccggggctaatccgacagaggtgggtctcaaatcactcgtgagactgggcacctgggtgggggtgggggagaggcgggaaaaggaaggagtgagtggctgagggagggtctggggagggggcccagcatggcagcgactggtgccactcagcctgtgctgtctctgctgcagtcctcccagaaaaagagctgtgtggaagagcctgaaccagagcccgaagctgcagagggtgacggtgataagaaggggaatgcagagggcagcagcgacgaggaagggaagctggtcattgatgagccagccaaggagaagaacgagaaaggagcgttgaagaggagagcaggggacttgctggaggtaactgctgcctgcccagggcctgggcccccctcaacattccccatggggtatcccacaggagcagggctttgcctcaggggtgcccagtctgagaggtcgatccagcccctagtcttggggagtccccagctgaccagatgggacacagaaggcatttcagctagtagggttggggaaggactgtgggtgtcagcctgggaaggagccccggaggagaggagtgggtggctggtggcctccctctccagcctcagcccacttcctctgttgatcctgcctaggactctcctaaacgtcccaaggaggcagaaaaccctgaaggagaggagaaggaggcagccaccttggaggttgagaggccccttcctatggaggtggaaaagaatagcaccccctctgagcccggctctggccgggggcctccccaagaggaagaagaggaggaggatgaagaggaagaggctaccaaggaagatgctgaggccccaggcatcagagatcatgagaggtgagtgagccccctgaccccttggcagctggactaggggggaccggccactctcggagaagaggatgaaaagggcctgcagtggtcagcctctcgggaggcagggtgggctctcctaggagaccggcactggctggggcaaggccaggccaaggccacaccattaacccttctcccctccaaccctccctcacagcctgtagccaccaatgtttcaagaggagcccccaccctgttcctgctgctgtctgggtgctactggggaaactggccatggcctgcaaactgggaacccctttcccaccccaacctgctctcctcttctactcacttttcccactccaagcccagcccatggagattgacctggatggggcaggccacctggctctcacctctaggtccccatactcctatgatctgagtcagagccatgtcttctccctggaatgagttgaggccactgtgttccttccgcttggagctattttccaggcttctgctggggcctgggacaactgctcccacctcctgacacccttctcccactctcctaggcattctggacctctgggttgggatcaggggtaggaatggaaaggatggagcatcaacagcagggtgggcttgtggggcctgggaggggcaatcctcaaatgcggggtgggggcagcacaggagggcggcctccttctgagctcctgtcccctgctacacctattatcccagctgcctagattcagggaaagtgggacagcttgtaggggaggggctcctttccataaatccttgatgattgacaacacccatttttccttttgccgaccccaagagttttgggagttgtagttaatcatcaagagaatttggggcttccaagttgttcgggccaaggacctgagacctgaagggttgactttacccatttgggtgggagtgttgagcatctgtccccctttagatctctgaagccacaaataggatgcttgggaagactcctagctgtcctttttcctctccacacagtgctcaaggccagcttatagtcatatatatcacccagacataaaggaaaagacacattttttaggaaatgtttttaataaaagaaaattacaaaaaaaaattttaaagacccctaaccctttgtgtgctctccattctgctccttccccatcgttgcccccatttctgaggtgcactgggaggctccccttctatttggggcttgatgactttctttttgtagctggggctttgatgttccttccagtgtcatttctcatccacataccctgacctggccccctcagtgttgtcaccagatctgatttgtaacccactgagaggacagagagaaataagtgccctctcccaccctcttcctactggtctctctatgcctctctacagtctcgtctcttttaccctggcccctctcccttgggctctgatgaaaaattgctgactgtagctttggaagtttagctctgagaaccgtagatgatttcagttctaggaaaataaaacccgttgattactatattggattctgactgattctttgggggtgtattggttaactgaagacagaaagtggggtaatggaatgcaaatgatttccaggtcatctcagatttaggtagagggtgtcaacctcctccatttttaggcatttggaaatccaaacttcttgtgggcagagtcgtagaataaaccacaccattcattctactcctgcccagccactgtttaacgcacctgggaaagttttttttaaaaaagggtttgcacaagaagtggggtgtgggaggatgcgagtatcggccacagcccaagatggccatgaagtgggagtttggaggctggttgtataaacaatttgaccccaaagtgcaagtcaaataataggataaccctttctccttgctaatgctaggggtacctgccacccttagctggtgatggggtggtagggggagggggttggtagggtgaaattccgccagtactccctgagttaagtggaatgactggtttagatcatttctgtttccttccagatctgacattttgtaactagatcggctactagcattggaagggcccacgtttcatcccttcctctagaaagcctaccggcagtttttgaatctgccctgcccccactccagcagagaaggacagggagagcattggcggtagccctgtctggaaagggcggccctttgccttgaacaggaagccacaaccacctagaaaatggagccttcttctctagaaactacaattcccagcggcctccacgcagagcatgcgcgggaatgtgccaggcgggccagccgaaccagcttgcctttcgattcccgacatgcttcatggtgtgttccggtttccttgatttcctacccccgccaaacttcctgtttccagctttctagcggcggactacaactcccagcatgctgagaggtaagattcgtggttgagcttccgttttacacttggactacaactcccagaaagtcgacgggcgtggcgggggaggggacgctgagggcccatgtgctgaaaatccgaagtgccgcggaaagtggaggtgagggccgcccgccctagaggtgcccgtccgagaggcaggtgcgggaagagcctatccttttccctggccatggctcagtcgcctccccagggtttatttgcaccggaagtttggagcgggtgggtgctgaagacagctaggccttggcgatgtctgggatgaggctggtgggggaagcctttggagccgtgacctgagagggcagaccttcgaccccactacattgcactgcgccttcagaacatgcagggaaaaccccactgcgggacgctcaccagcagcatctccagattgtgaagggaaagaagggaaggatctcgggggcatgcaagctgctctgggctggggtggttcagacctggattgactgaggtgaaggggctccttgcagcaatcacacagaaggctcgggtcttaagattggccctgctcctagtcaagctgtatgaaccagggtagtcactccggctttcagggcc

SEQ ID NO: 56476 - DNA, 1105 bp, Homo sapiens
gaaccttgttcttgattttgggtagcattccaaaggaaggagagggttcttgtgttaagaggtcccttcaggacacggagagaggttgagtgatgagctggagagacctgggcttttggggaggaaggacgatgtgaggttaagagcatcgtatttgttgaagacacagagttgaggaaggctcgctctgtggaagagggcagtggagctgggttgggatggaagagaagaggaatgatacctcaccttgggagaagcagcccgcagaaaggcctgaagtagcaggagtcaagcccagattaggtggtctgagtggacggaggtaaggaagaaacaagggctggtaagattttaggctagagaacttatctgtaactgttgtttttggtgttgctagtacataaaatctcacttgtcatctttctttcctcctatcccacacctgggctcaccagggatccagtgaggggactggtttgtctgccttgcttccccaacctaaaaacctgactgtgaaagagactaacaggttgctcctgccccatgccttctcccgcaaaccctcggatggctcccctgatactaagccctccagactggcttctaagaccaagacttcctctcttgcccctgttgtgggcaccacaaccaccactccgtcgccctctgctatcaaggctgctgccaagagtgctgccctgcaggtgacaaagcagatcacgcaggaagaagacgacagtgatgaggaagtagcccccgaaaactttttctccctccctgaaaaggctgagccacctggagttgagccatacccttaccccatccccactgtccctgaagagctgcctccaggcacggaaccagagccggctttccaggacgatgcagccaatgccccccttgaattcaagatggcagcaggttcaagtggggccccttggatgcctaagcctggggacgactacagctacaatcagttttccacatatggcgatgccaatgccgctggtgcttattatcaggtgggtaggaggcacagagggcaggcgagggaatgttggaacatggtggtcaaggagagctttgagctagtgatacagcctct

SEQ ID NO: 56477 - DNA, 1007 bp, Homo sapiens
tggcccaggctagtctcgaactcctggcctcaagtgatcagcccgtctcagcctcccaaagtgctgggattacaggcgtgagccactgcatctagccggccatatctagttgtaagggggtctaggaaatgtaatgttttattagttgtgtggtaatatgcctagcaaaaattttggattctttcacactaaagaagaggagaatggatttagggaggcaccaagcagctatgttaaataccgttgtgtttcacataatggtctctcactgctgctgagctttcctaagcttcagcaaaaggaaaggtgaaagcacaatgtcctgtgactttcaggcccttattcaggatataaagtactgttctatctgcagggaagtcacagcctattaggagggatctgcagaaatagggggtgctacctcaccatggaggttcttataaaaaataattcttctctgcttaccttttcccagaaaggtgtccatccctttgcatacttctgcctgtgcttgatactgtgttcatccactcccctatggatatccttcttggcaggtttgatagttggtttctttgggaaccaactaagcctaggagacagctgagaacccagttagtggcaaaagtcagtttcttctaggtagagtgagtatagaaggcctcactaatgttgagatcaggactgggtctcactgaagcttctaagttttaaaattctattccttcttcaccccacatttgctttgaggcacacctctggatgacttgtgtgatttgcattttgcttttttaggaagaggaaggcgtagcagtgtcctagaaagtttactgggcttttttttttttttctttaccttaaaagcttttgaagtaaagctaagactctgtgtgtgtgagagactccttttctacgcagccccacattctttgtctctaatgtccactctggtgtggggtctgttgattcggtgataccgaacaattagaaggaacagagatggacaa

SEQ ID NO: 56478 - DNA, 1065 bp, Homo sapiens
cacaacagcacctcagaaatcctggagtccctagattctgagcatgcaactcttctgtgttctcttcattattgatggtagccagctgtagtctttccagtgcttttattcatcacatttcccacaccacactcctgccttctctgtcctagttttcttcagtcagtatgatgaacatttcttcacctagtagctgagaacagcaaatgtggacatttatgagcctgccaccggaggggaaatgtgggaaaaccctggacttgagcccagcaccagcgagaccaaggtcgaggattttgttcccttttcctccccccatttgctttgctttgttctatggccacagatggccacacaagccccagccgtttgttttaactgaatgctggcggtcatacaggacagagcaaaggactgtggttagatcagcatagatccatcactgtttactggaaaaaccacttaggagagcatgctctaccaactgtgggtcgagaagcatagtcacatagtaatagctactgttgttaatgctcaccgtgggccaggaatggagctggatgttttatgtgtgtcatctttaactgtcacattaaatgacattaaatagcagcaagcaattagtatttgctattttcctatctccaagttttcttgccaccgtctcattatattgaactagattttgttaaaaggagaaaaagatatggtccttgtccttgaggagttgacagcatagttgggaagaagagatttaaggacacttgagtgtaaatgattacagtacagattgatgacataagtgctgaggagactctagagaggagttttgggagttgggtggagatgattaggaagcttctagtctgagacaactctggcagaggacagaaaaaccgcagaatgaaagcccagaccaatatagactttgacagtaaatcatttgcatcgaagtttggttacgggttcagtgcagttacgggcggaggctggaagactggggagaggtagagtgattgtgaaatttctaattccagggaagctgctggcacttactagaatggg

SEQ ID NO: 56479 - DNA, 1051 bp, Homo sapiens
aactgatccctgagagaccagctggggccagggttggggggttactggaggctacagtgtgtgtcaaggctcacccctcctgccctgtgtccctacagacactaacagcacatctggagacccggtggagaagaaggacgaaacaccttttggggtgagataggaagtagaagcttgtgcagactttgggaccgggaggctgggtagaggctcatctgcatgtcatttctggtcagagcagggagatcactaccatctggcctgagctctgacggccacccgcacagccactgcaggggtccccaggggaggatgaggcaggtctggagacctggctccgggctcccatgcaggatgaaaaaatggcttactacaggaggctctgagagtacaggaggagcccctggatctaactacccctgtcccccaccaggtctcggtggctgtgggcctggccgtctttgcctgcctcttcctttctacgctgctccttgtgctcaacaaatgtggacggagaaacaagtttgggatcaaccgtgagtcggggctgcagagggctgtctgtctgtctgttctcctggctttgtttcctactggctcttcctgactctgtctctggggggctgtgcacatgggagttccagggcgtgtgagtgtgtttggggtataaatgaaggcctggctgtgaggcttgtgagtgtgagtgtgtgtgggagcgtgtgtcgggctggtgctggggtagtttcagaggcggcagctgctaattggtggctggattgtagtcaagcattaagtgggtctgggaggtctgggctctgtgggggtggagggggagttctttggtgcccatggggccaggggtgggacaggagccagcacagggagaggcggtggtgcccccttccccctgcctgctgtctcgctccctagcttctcagtctctcccctgcaagttacaaggtgggggtgaccaggcatcctgcaggcaagggtgggcagggccaaggtgtgggcaaacccctccatgcggctgtgtctcctctctaggccc

SEQ ID NO: 56480 - DNA, 1034 bp, Homo sapiens
ccactgccggagcagtcctatcacaagctcatggccttggacagcacgtgagactccctgccctcaccccctttctctgggcctgtctcgaaattccaagccatttttagtccccgcccttccttgtccccctaccatctcggcaagggccctcgatttctgcccctacatcctcagaccagaccgccccctcaagcgctcaagtctcccatattccggcggacgccctgtaccttttccagcgacccacattctccctccggctgccccaggattgcgcacttgtctctgcggaacaataacatcgacgaccgcggggcgcaactcctgggccaggcgctgtccacgctgcacagctgcaaccggaccctcgtctcgctcaacctgggtttcaaccacatcggtgacgagggcgcaggctacatcgcggacgtgagtgcacggcggggagggacctgctgggagcaggggcggcttgggcggctcacgcgtccctgcccgcctcttagggcctccggctgaaccgttccctgctctggctgtccctggcccacaaccgcatccaggacaagggcgccctgaagctggctgaggtgggtgtgccgatcaggtggggcaggggcgtgggcgggccgagggagccgaccctgactacccaggcgtccgaccgctgagcgcccgcctccttcaggtcctgcgcgccttcgagctgacacacaccgaagtggtggagcgccgacgcctcctgctggaaaaagggacacaggagcgctcgcgatcggtgaggagctaccaggccccaggaccagccgagagcccctctgaccctcgagcccactccccaagtccgctgcttttcagcaaactggccatccagtttaatctccaccctctgtcctgactgtctttccctccgatttctgcacagacttttgccaagcccctgctgggggggctctaattgcagaaccacactatgggcagtagagtgtactggttcagagataggacactagattgagaccacctggacc

SEQ ID NO: 56481 - DNA, 1051 bp, Homo sapiens
ctcccaccccactgaacatcctaagcaggttgacatattttgtgggtctgttctttcaacctctccccctcttccacttcttgcctgattctcctgcccctgaaagatggggagtcctgcactcctgctgcattggtcaggctgagggctgcaggtgttcaagggtgtggcagagcctggagctcctgatagtcatttggtggttatgacagaccacgggccccaggaatgtggtaagctttctgctttcccctgctggccctcctcctgacctctctcccttcctgcctctaagatcttatctgtcacagagagtgaggccagtgatgtgtgtgcccagtggataaagttccttcaggaggcagctagaactggcttaggggaaattgaaccatcttttactaatccacatcagaaaactgaactagtgcaatatactaaggtgcttctggcacagccgcttttgttatgtttttctagcgccattttcgaaagtgtcataggcacctgtgatgcaagccccagtatcacagactttatggggacacttcaggcttagaagcaattttttgccctactactgcttctcactaagtagttatgtgaccttggttaagccattccatacaagtcagatccataggcacagccaggcactttaaggacagggtaaaaatagcaaagaagatgaaacctatgcagtctctgctaaggctgatatttcaactcggcaaatatttatggagttcctgctatgtaccaaatacttgtgcatcagacgtacttctctccttttcccccactaaccctcctttcatctaggaaaaacttaccctcctcctagcctctaaccaggtgaccagcctctgtctttgcagtctgagtcatctgttctttcttccattccaggtccaagtatgaggaagacaggaggtaagcaagtctatgatgtggatttgcagctttcaaggtggaaggagtggggttgagctactatgctttccatttctgacaatcacaggggagtccctcatgttgtacaaccatgaag

SEQ ID NO: 56482 - DNA, 1128 bp, Homo sapiens
atctaaaacagtgacttgaccaaaaacatatttccacctgtccaggaataacatcgtcttagattaatacagtgaacccaacctattcagaagtggtagtctttttttgctgtggatctttttcttcccaaatagcttgtcttttctggaatgactaaaagaatttcaggttttgacctcaaaggttatctcttccaggtgttctcagtttgcacatgtaaactatgaacggcaatacaaaagtaagaatgaatggaagaagtagtaatgaagttagcaaaatatttgcttagccagagtaattaaatatgtgaatatgtggttgaaaagatgttaaaaacctaattttagatcacaattggaattttattttcttactgccctgtccatgggaaaatggtgaaatatatgtgaaaggatcggtatgtgggaaagtcaccaagaaagtggagtgggacagggatcctaaagaatctacagttgacattatctggaaggccacagagttggtgatgaagagtgtgtgctgtgagttgaggctgcctgggttaagtccaggatacacctcatgactagctctctgacttagcaagtctcataacctcttggagtctcagtttctttgtgtgaaaatgggacgaataatagtatctacctcaaagggctactgtgtgaatcgaatgagataatgtgtaatgaagggcttagtataataccaggcacagagcaagtactgcacttctcttagctgatgttataagtatggttatcaccaccaacaccaaatgagctgagccttgagggtcttccggacaaggttccttctcacagaattctttgtttctctagtcattgatgaatcggaactcggtactgtcagaccctgggctagacagtcctcgaacctcccctgtgatcatggccagggtggcccagcaccacaggcggcagggctcggatgcagcagtcccctcaaccggtgaccaggtgagtgatctggagccaccctgcagttttccttttctcagaagtgagatttggaggcatgggtgttaccagtacatcgtcttggatcatcagactaaacccctgcttcagcaacccaaactttgagacagtcacttacat

SEQ ID NO: 56483 - DNA, 1037 bp, Homo sapiens
agaataacatttgacaaagccaataggaattaattaaagatgatctacttttgcttttaggatatccagatcaaaaaagtttgggaaacataggcaaatacatttaaactgcttcattttctgaaggacttctcatattacatggctgataggtaggagctcaggttgtggacttagaccatctggattcaaatccagcatcacttctcatcagcttaaagactcttgggcaagttaattaatccataggagccttaacttcctcatttataaaatggagatcacagtgttgtcagagttaaagcatgcctttgacagaggggctgtacatgtttgctgctgccactgcactgttgattgtgctatgaggtgatgagtctgagaaactaagcttggaatctgaaggtctgagcgccaaccctggccttagggttgacctgctgtgtatcttgggcaagttacttaagatctctgagcttctgtttcctcattgataacatgagagtaacatgcctaagccagagccattgaaagattaaatgtgacatagaaaagtgctttgtaaacagcaaagcactatcaacatcgcttccttcacatcccactagctcagtcagtctcaggccaatgcctgtccatcctcctcaaagatctccaaaggtaaaccttttatatcttccctcggtcacctgcttgagtctttttttatacttcttgatggttaagaagttctttcttgtatccaaataaggcaatagatgctttgaggtccagggtgattggataaagctagcttttagaatttcagtaatggtaaagctccctttccaccattaggggtcattgtcatcctcaaactgtacaaatgaagcaatatctcttctagctgggcatttttgaggcaatgaagcggaagaggccactaattgtaagcaaataaggcactgattggtgaaagaaaaccgtagggggagaggctcacagaatttgcccaccctgtgggcctttctgtttcaggacatacttccactatatgg

SEQ ID NO: 56484 - DNA, 1078 bp, Homo sapiens
agcaccaatatctaggtctcctggcttcctcttgatgtcttgagatgctattcttttcattgaacataagtttgatggaggactccgtgacaaaagcaaataaatataggctaaacataatattcggcagtagatcatctaggagatcttaggagatctgtaaaatggttgcatctatattagataactcaagacttgattttgtgtttcaaggcaggatgtgcttgctttggcagtagcttactaattgtgtctgacttagggcttcagcaaagaatagcacccatttttaaagtactgcagagtgccagccattgtactagatactgtacttacattacaccaattcttaaaacagcctgataggataggtggctagtattcccattttgtagatgagaaaactgaggttcgcagaaaatagtttgctctcagtcccatagatggccagaggcagagccaggcctgttctaactccacacttcaccacactgctcctcaatatcaatgtaaattcctgggcatagcttcggcattgagctttttctgagaaatatgtgacaaattggataagtccgatgtgagcttgtgccaatacctatgctgatagagcctgcaaggctgatggggtgttgggttctgagtggagaaaagggtgcacagcctagggcagtgctggattgttctactaaggggtgaagatggtgccctcagagccgggctctgcttcgtttctgggagacagttgtgcctctttactctaggactcacagtccagcgaacaaggagagaggtcgacaatgtggaaggtgcttttgcagaaatatataccaggtgctgtgggagacagaagttcctggagggttgactgggcaggcttctagttttctctgactgttctgaagggcaaggaggtctcaccactggagagaaggtggaagtgtggtgcagctgtggccaaaggaggccagaccagtgctgtccaatagaaagatagtgcaaaccacatgtaatttaacattttctagtagccatagtaaaaaaaaaaataatacaggtgaaattatttttaatgata

SEQ ID NO: 56485 - DNA, 1051 bp, Homo sapiens
atttcagaatagaagagcagcatatttagaaacgaaggcaaggcctggcattccttcctgttagccaagattagaaggagctgtgagaggggtagattttctgcaggacctctctatgatcttgggagtaagagttagagtcctagattcctttggccttctggatgtcatcatttccacatcctgtctccagccaaggctctccctttctggagagattgaagttgttgtttcctatttcacaggattccttttatttttacgtttggggggtctcacccagggaattccttcctgatgtcatctttgtgggatgtaaaggagggaatgaggggaggggccccaagaatgtttctctttctgtgaaagtttttttcagctcttactgccattcaacattacttgtatccatgagatggcttctttcctccctcaccccacccgtcttcagtttcctggaaatggaatgggggctggaagagagaaaggatggaaattcccattgcatctctctcggctatgcagtggttcagatggggttttggtgaggggggttgggagaagtagaaagatggagtcagccctggagggagaggccaggagactgctgagctgatggtatgggcctaattactccctgccttgagcttgcctgtaattgtggtttctgagagccagcacgtcctggaaatctgctggtacagcagagatttggggtttccgcctgggatggagttgaattttccacttggagcaacttgcccagcccccatttttggttggggagcagagtgaatccttaaagctcaaaaggagcgattaggatagtggtaggaatataaggccttcctttggaactgaacgagaggttgtatgctctgaaatgctagacatttttgaaaagttcagagaggcggcagatagcaggacctggtaaagagttgtatggttaaagttagaatgtcaactgtgtcccaaacctaggacaagtgatttaatctttttagacattagtttctccatcagtgatttgatttgaatatgtgtcttt

SEQ ID NO: 56486 - DNA, 1053 bp, Homo sapiens
ttgggagtctaaggcaggaggatcccttgaagggccaggaagttcaagaccaggctgggcagcatagcaagaccctatctctaccaaaaaaaaaaatagatttgtgatgtcctggctgccatcaattgtcaactgatttgccacacaagtggattgaagaatgctgtgtgtagaaacctatattttacagtgaatgttttatgtgtatgtacatatacgcacatgcccatgcaaaaacatgtttttcatccaactggccagcagaggagaatgcaaaatttcaaaaatgggagatatactcttttctttcaaggagtttgcagcttagttggggaaaccagagatgtagaagtatattgatctaagaatacctagaaaagggtgtcaaaacaagtgccctttaatatagaaatcaggtctctttagaatgaactccagggaaagttcatatttttggtcatactgaatgtgtgaaatataacttgaaataaatggtttgaatgggtttgtgttgactttttcactttgattttgttgtaagagactaagtagcagtacaagaataaatttgtgaggattgaagttaggagaggctaaatcaaggaaagcttcatgggattaatgcgttttaagtaaggttttgatagaattgggtgagtaccagaactgtttgggggcatttctcagtctgctctgtcaaccagaattctgggggttctgaatggccttgagaaactgccctgacaaccttcagttctgacctctgagctgtcgctgttcaaaagacctttaggatgttgaagtccacttcctatttgagatgcccctccatccatcttttgcactatccaacattagcttcacctcctgaaagtccctagaggtgattccagggaacccagaccctctgaaggcggtcaacattatgggggttggggggatgcagccagccctgagaccactgggagctataagggacagcattctctttttaatggtgggtataaggcagtcatcaaaccaagctgagcaaatccactgcccaagcaacgg

SEQ ID NO: 56487 - DNA, 1202 bp, Homo sapiens
tctgagatcgattcaaatatagtattatttgatctttggtaatttggtcactcttttagggctctactcgccatcatgttgcagtccagtctggtaattaggggtatgacttttatgttgaatcaacctaggtttcctgttacttaacctttctacgcctgtttttccctttggaacatgagaaaaaaagtatttctttcatgaggttcctctgaagattaaataaaaataatgcatgtgaagtgcttagcaaaatacctgatgtagttaagaattcaataaatgtcagctattattattatatcattacttcatgtcttatagtctccaattaacaagccagctccccatcccctggatgtgacttgcttgtcctgatcttggagcctttgcacagatcagtattgttcagtttatccattgctcccaaacaggggcttaacgtaattctaatcatttattttgctcagaattctggcggttgattgggctgagccaagcagttgttttcacatgaggtctctcatgcagctgtagtcatatagggatagggctgggcttccagagacttcttcactctggcacctttgttggaagggctcaaacagctggggcttgaaacagctagagctcttcagggatctctctttctctttcccaccaccctttctctggaatctctagattatctttctacatggcgacctcagagtagctgacttcttaaaaggaagatgaaggctctcagagcaagcatcgcaagacatttgcagaggtgatgtcttgatgagctagccttgggggtctgttagttgaggcagtcacaaaggccaacccaggatcaggggagaagacatagactctacctcctgatgggcagtggcaaggctgtgaaagagcatcagggatgggaactactgttgcagttacttttggaaaattcatttgccacaattatttaactcctttattgttaatttttgtccctcctctccttcaaataccagttcaaaactaacttactagtgaggtcttaccttattaactctccttgatgtgggtttcttctttctcctatagctctcaccatgtaggtcccttttgatttttatatgacatccaattatcttttcttgtgcctctgtatctgtcaatactcccacagtacccacaaccagacagcactcttttttttgtgtgtg

SEQ ID NO: 56488 - DNA, 1060 bp, Homo sapiens
gccccacccaaaacgttctgactcagtgtgtttgagctgagtttggggcctgaggatctgcattgttacaacttcccagatgatgccaatactggcattctgtgcttccagagccactgccttatgacatctgtgctcttaacgaactctttttatgttctcagaacagaacttttgttcactgtctatttcaaaacttgtcagtggctctactctgctgggaattgcttcggtggctggtgaataccttggagcagactggtcactttgtaagcttaacgtaagctccccatctgggaaaccttgcttaccccatttctgtctacctctgacataggtgcaaataaatcctgtctactagagatctttaaggatggtgggcttacaggattttttgtaatttcaaaattaaagcccagaagagtcatacataagagaaatgtcaaagcttatagtaaatgtcaaaatcaaatatatataatttcaataattcagttttggattaagtgagagaataaatttcctaaaatggtttctcaaactgatcccaggttctgaattttccagtggtaaggatccttggaatgtcattgttgcctcttagaatgttgttagagctcttaacacgtggttactgcactcaaagagcttagggctccagaacatgcttccacagagtgatcggttgttctacccttgcaggagtccacaccaccactatggcttctctgctcaaggggtgggagtagggatcccatgcagttctggggttctgttctagggcctttgccactccccttgaaattgggttcagggaccacactactgtggtttctgagagccccctgaccttcgagcctcttcctcctctcctgcttttctttttgccctgtgcattagtgggccgtttctcatcatctccaggttctccagaccaatggctctgagtctgagatgcagatgtgggtccgaggatagtggtaggtacatgacatggcctggcaattcttgtgccatagggtttcctaaataacacttcaggccttaggatcatttaatt

SEQ ID NO: 56489 - DNA, 1005 bp, Homo sapiens
gagacaggcgatcggattttccaggagtctggtgtggaagaaaaacccacctcgaactcaaatccacaataataatccgaacgaataataagggagccgtctttctggccgggcgagagagagggagagagaagggggaacgggaggaagcgaaatctccgtttcatggaggctgaggcaagagaaaatttcggagcctggatgtggaggagcccaacagcagaactaactcaggaaattgtctttcagaaaaaggccgaacgtaggctgggtctgagaatcaggctggggtaggtggaggaacctgcaagtttaaaggaaaaagaaaaggagagaatattttcagagattatctctggtttgttatcattactaccatcttaaaggtaaaaagcattgcatttcaggtgttctttgatttttattttatttttttttttggtgcaattggctcatttaagaatttcaaaacatttaatgtaaaagcttttttttttttaaggaagtccataaattttggttcccagggttgcactggacttggaaggagtgctgttgtgtacatactattgtatggttttatttattattttactgtacaaatcagccgaaagaatttttccaagtgccatttcggatttattaatccttttttttttcctttcctcaaagatatttgctgttgtcatattaagcattggagactagaaaattactttccccctttgagctagagggtctcttgccaacagaaggacagctgagaaagctggatttaaaggatggttttatctgtactttgcagttaacagtgatattttgaaggcacatttttctgtgattcatttttttttggccatagtgctaaccttgaagagattcgtggctgggtttttggtttctgagaaggtcgtagtttttcctcttttcctttttttttcttttttcttttcttttctttttttttaaagcgggggaggggaagaggggctgagaaaggaaatc

SEQ ID NO: 56490 - DNA, 1030 bp, Homo sapiens
atgggtaggagtgaaatatttaatgtaaacatttcaccaagtccctttaccctaattttgaagctgcattaaacccaactcactaacacagggaatgattgcaccctagtcctctgtgggccaagaaactttcagaagcattaaaaaaatagttgaagtatatcacttctcaccaagtgggtagagtcagttggctgtttgtcccttgttttttatttattccataattatgtttgtgctttttgttttgtaaacagtaatggaacgtacatttttattttgtttagaagacaactttgattcaatctttcaagaactgttccattcttggtttcttcttagggggataaaaagttaccagttaatttgttttgagatatttaagcattctttgagttatagaattgtgatgcagggatttgtgaatgagacatttacatgtgaaaggtgacttcactagttacctgcttgagcagagtaaagtgtgtatatgtacataaaatgtaagtaatcttaactccattgtgcagtgccttttagatgttccgctttctataaagtcttcaaatttttgcatatatattatatatatatgatgtaatgttatagaaatatatgtataatatacatattttttccaggggtatctgatagctctgtattttgttatggaagttgaaagaaaaaagtattttacctcagaaattaaataaaaaaatacttttaagtaatgtttgctgagagttggttttgttgttcatcatacactgtgctggggtggtcatgccagagaatttgccaagtccgtcctcgctcccccaccctcatgcattgttattcctattgtacaggtaccaacatagtaaggaaataggtctcttaacagttctggagattttccattttcttgagtgaatggctgctaccagttaaaactaactgaagccagagacgcaagttaggtggaaatttctatctcaagattattgtgaagattctttaagagtacatgtcaaagccagacacaaaa

SEQ ID NO: 56491 - DNA, 1036 bp, Homo sapiens
gtgggggtgtggttgagagaacataatgttgagatccattgcagatatgtaattactacacaacaagttagggcagttttagcttgactctgctatcattacagtttcatctcaacttctgtaaccactccctcctgtccctggggcatgcatttaaaaaaaaaaaaaaaagtggtattggaatgcatctctctaattacaacctgttttctttccttgtgcctgagggagaggcgttaggaaatcagacctgtactcgccactcaaatcttgcttcctctgtttctcactcttgccccttccttgtatgcctagaggaattgggaatctagatgtatataccaacaattttaaagaatttgttggttttcataccccttcaccccactcccaaaaaaatgtttcattcgtcttgttcttctgtctttgacccatttttatctattgaaaatccagaacttcagccacttggacaacctagaatggggcattcataagccctgggaagtaatgtggttttccagggcaaggaaacctggatcctcactctgtgaagaatctgatctagaaacctaacaatagtggcccagcacacctgttctgcccgaaggcgattgaaccaacattgatctttaacccaagctcaagatcctaatcaaaaagccacaaggggccgggccaggtggctcatgcctataatcccaacactttgggaggccaaggccggcagatcacttgaggtcaggagttcaagaccagcctggccaacatggggaaacccccatgtctactaaaagtacaggtggcagtcacctgtagtcctagctactcaggaggccaaggcaggagaatcacttgaacctgggaggcagaggtcgcagtgagctgagatcatgccactacactccagcctgggcgacagcgagactcagtctcaataaagcacaaggaaagcaaaactgtgtacatttcttttagtacatctatctctactacctggttgctcacatcctaggtatagacaactgcaaagaac

SEQ ID NO: 56492 - DNA, 1341 bp, Homo sapiens
agtggcgtggccttggctcactgcaacctctgcctcccgggttcaagtgattctcctgcttcagcctccgaagtggctgggactacaggcgcctgccaccatgcctggctaatttttttttttttttgtatttttagtagagacgaggtttcaccatgttggccaggctggtctctcgaactcctggcctcaagtggtccgcccgccttagtctcccaaagtgctgagattacaggcatgagccaccatgcccagccatcatcttctgaactttttcatcttcccaaactgaaactctgtgcccattaaacaataactcctcattgccccctcctccagccccagcaaacaccattctactcctagactactttcagactcagtttcttctttcacttaataagagagggtccactgctgactaatgggattgtttctatatgtggagtccttcttgcaaacatgtgattgagtttattgtagagaacggtaataggaaatgggattgtagaaagaaaagagatggagacaaatttggatgagggtttcatactgggtgtcccatccacaggcctcagcagccctgccacggatctacccagttcttttgcatcaagaagttgatcttgcgagccatttccatgttatagatctgccagcaccttttatagcttttcctctgtcgctggcggcatggcttttcattataccatggacatttaatgtcctcaaggagcccatccacagtgaggattctgtttagggtcctgtatgcaccttccacgtttccttcctgtaccatctcagtcctggcggtgaatttcagatgttttgccatgaccttggatttaagtctccactctgcagagcctggcacgctcagtacctagtcaaccccggctatggaggatttaaagttgctttagaaatatgtgtgtttgccagttggcgggactgtaaaccagttcaaccattgtgaaagacagtgtggcgattctcaagaatctacaactagaaataccatctgacccagccatcccattactgggtatatacccaaaggattataaatcatgctgctataaagacacatgcacacgtgtgtttattgcagcactattcacaatagcaaagacttgaaaccaacccaaatgtccatcagtgttagactggattaagaaaatgtggcacatacacaccatggaatactatgcagccataaaaagatgagttcatgtcctttgtagggacatggatgaagctagaaaacatcattctgagcaaactatcgcaaggacagaaaaccaaacaccgcatgttctcactcacaggtgggaagtg

SEQ ID NO: 56493 - DNA, 1093 bp, Homo sapiens
aaacgttcagaattctccaaaaagcaaagaaccattgcacgttgttgaatacatattttggaggaatggctccgcttttcagagtagccaagtatccccagagcaggtgcctggcccagccatcctgtttcatcagaagaacaaggaatgtggccaccactgaacagggaaatgagggagggcaggcagggagaagtactagtgagttacaccgttataaatacactttagggctgtgtgagttggccataaatcgctgcactgtgctcaggtgatgtcacccgacgctcggctgtatttatagctttgttcactgttccctgggattttttttcttggcacattcgaggtaatatgtgtctcgcccccacacactcatcctgaacaacagaagataaacttttatgccacttctgctcatcttctcccagctccttggaaggatgatttcctggacttaccaagtgcctgcttagttgggaatatcctcttgcagttcaattgctagccccctggctttgtactctgaaatggagctcagcctcctctctactccagtaaatcctttgtggaactcagaatcagaaatatctccctttttgccaggcactctggtaacaacagtgaacaacaccagtacaggctctacctgcacagggcttatgatcaagcatggaaaacagacattgaatacttaattagaagggagatgaatgttactagtggaaatagaaggtgcttgaaggcaataacaaggtgatctagcttgtctggaggaattagagaggcttccatggagaagtgacatttagtgtgaggtctgagggatgagtaggacttagcttaaggggcgaggttgggatagaccctgggcggaaagaacattgcaggcaagagaaccccatgtgccgagaccccaaacaatgagagaaatatggccagtccctagaacttagagaagccaggtggagttggagtgtaaaggataagaaggggagtggagagcagtggggttgggagggaaggccaacgtaccccaggcaggctctaggaaccaacgggaaggtgctgtatctgatcctaagggcaatga

SEQ ID NO: 56494 - DNA, 1001 bp, Homo sapiens
tagaacaatgattctcaaactttaacatgcttacaaaacatctggggatcttgttaaaatgcagattctgactcacaaagtctggggtcagatggaagttctgtatttgcaccaagctctcgggtgatgctgatgctgcttgtcctaggaccacaccttgaggtgttaggggatgctttccttggggaaatagatcttcaacgttctaatgagaatcaaaagaaaatagaattcatttaactgaattcagttttcagccagcttagttgtataacagccctgatggatcattgatttgggagcattgatatgtttgttttcaggaagcagctggtgggacaagagagtgcacagagcttgccagcacgcccatccttagccccaagattgtcttatctaagcccctccctgccacctcactagctccatgccacccaccccaccctgccaagtcttcactcaggctgccagctgtggagttgaaaagcaacctgctggtgtgctggtggaaactcatccatatcggagccagtcatttccactttttttttttttaatgaaaaaagtcctcataattcatctctcaatgggagatgtgggggaaagaattttgacagagcttctggtctgggccttgaccctgttggctttggcttaaaaactgggtcatgagcaagttgcatgatttgggaaggaaggtaggtcatagacttaattgggtgcatgatttgggggagcagtggggaactgtcttccgggcaggtcagcatctcacactcacatagacctcataattgttcaacccacatgatgagcgaactcactctctccctcccttctctgcgcgcagaaccccaggctgtagagggagatccacaggccagaggagagagactgcctgccttcagggttccctggttctgtgagagaagcctggtccttatacttagggaatcctgtccactgggggaaacaggatctcccattaattttccttcacc

SEQ ID NO: 56495 - DNA, 1081 bp, Homo sapiens
ttgatttcaaatactccctggcaagcaggaagttcttctttgtgtctagcctgaaccttccctgctcctgcatggaaattgtctgattgggtattgtaactgaacacgtctccagtcttctctgtgtctggataaataacattttccacaacaggtttattttctcatacttcaaggcaaagctccttgtaatagagaagcaagcccagagaggtcataggcgagactgcctcctgggccccgcgtgagcccaagaagtttatcttgttaggggtcagatttgctttccagcaaaccaccaaggctgtcctcctacagtatccccagccaggaccaggagaatgatgttcacaagaacctggctgagtcactgtgcccttacctgtctagtgtccccttctcagccgctcagagcagctgggggctggaggactctggtgtccttcccatcatttctagccgatggcctgagggaccctcctcctctctccacgggagccaggctgagagcagtgctgacatctgctgctgaagccagcatgtaggaaagtgggcatgggggtgatggcagaggtgggcctgcctcacagccagggccagttttagcttaggagcaggaatgttttcctcttggaatcactcagaagtgtccttgtcccgccttgccagggtggatcccaagagatagcagtgtaagcagagagaggaggggatggggtctgtgggatggggtgcctgcctttggggatctcctagtctgatgaaggagtgtgggcattttcctgggatactgaaccgtataagtgcaaactcaactgtaaacttgaacttgaggcaggagacttggtttctgttaccagctagctaactataatggggggacatgggttcccatcttccccagtgtataaacacctataaagatcatttaaataagggaagattttggaccctgttgtgcatctgcacagaagaagatagaaagagacactggagctgggtcatcagcgagggacgtttcctcagaaggggtggagggaagggaacctgggcccaggtggaaggaggacaccaggtggag

SEQ ID NO: 56496 - DNA, 1027 bp, Homo sapiens
ctgatcttgcctctgccgcctgccagacctcagattgcccacctcaagcctgtgtgccaaagggttaaacatagcgagttaaacataaaagggttaaacatatcacatggcttgcaacttctgactcagcttctggtttcctgggcattacaataggaacatctatattcaggaggcagtatggaaagagcactggattgcaggtctagatgtggattttagccccatttgtgcctctactggagagaccttactcagtgacctgggcctattttcttatcataaaatgagaaggttaatttccaagattctttctggctgcacagttttccaactccttcctatccggtaagagttcatgaaaaggactggctcttcccaaatgaggccctggatctctctgatttggtttataagccaaggccagaggtactgatttcagagggccagagcaggggtatcccaggagcagcgtttgctcaggaaccagggtggaagcaaacatttcatgcatcttcagatctggtctgaacttggggtaaggagagcaggagtccccaccataaacacacacacacacacacacacacacacacacacaccccacacagtcctgagaatgtcacacacatgcatacacacacacacacacacacacacacacacacacacacacacacacacacacacacacacacactgtcctgagaatgtcccagcctgccctggaaggtggggacctggaccaacggtgtgggtgcttgtgtatgcatgttgataagagtttctccccgaagaaacatgctctggctttgccctgaactttagctttggtctatgaaaaggttttgctgaatcttgtgggaacataaacattcggcagatttctttccctgaaagctatttcttctctttttctgggaacttttgccagcaagatcaagggccctccacccttccctcctccctcccctttgcctgagacacccaaccccctttctcctcctctcctaaatgaaaacaaagt

SEQ ID NO: 56497 - DNA, 1048 bp, Homo sapiens
cattaccctcatcttagtttcattcctgattctgctactaataagctgtgtgactttgaacaggttgcttaacctctctgggctttggtaatcataatccctaacatgtggaagttgggctaggtaaaagcagaggctctttttagctataactctatgtgtaagtctgtaattgaggttaagaagaaatgtgcatatacatgacttttgactgaatactatttactttctataacaggttacaggatatatataaaattatgttttcagtctccctccctttcctgggaaagactgaataggccctagaggttctgggggtgtggcagctgtggtgggctttacaaaaggggtttttttggttccttctgttcacttgtaaggtttcaaagaaaattgtgcctatacttatcaggatatatgtaagcaactgcagagaaatgccatgtaacctgaggtgttaagtactgaagggacaggaaataatactgggtgtggttatggatagtgctagtttggccaggcttccttaaagaggtaaatctggagcagggctcagcaggaggagacatggcatggattgtaaggggagaaagaaatccactccaggtgtgtgggtgggtgcggttggggtggggctcggtgggtagttattaaagctttatgcacctggattcctagtaggcagctattttgggttctggagaagtgggtcaacataatgaagtttgggaggctgcattctgatttctgggcacataaacctggggaaggcatgaagcaaggaggatgctgaagggccattatcatccaaatgagaccagtgggatgtaaaggataagagcattataagtatcccaaaaaagagaatctcagaattatttctatttgagcatttaacttgtgctaaacacctactatgttctgggatgtccgttctggaaaggaccttagaggtaatctgttctatgaattatgaaactgaagatcagagaagggatgcaaactgcccagtgccacccagcggattctgacagaagcagaacta

SEQ ID NO: 56498 - DNA, 1138 bp, Homo sapiens
gtataagtaaagcactctataacctgatggcttaatgtatttttgttaaatttttaattttatatttttagtaggtaatgtacgtagtacaaaatataaaaactacaagaaaaatagtgaaaataactctctcccatcattatcttctagctaccatttctcttaaccttaagtattttggtccttacaaaatccctgtgtataaggcaggtcagggtttttgatttttatttctcaggtatggaaattgaagcccagagagattaaatggttacctgaagttacccacatgaaagtggtgggactagaacccacatcttcctgttagtaccccagcttgttgtatttcatgtttcacactagaagatgtggtcagagatggaccccaggctgctgaattttgtgactttgggaccataaactcttttgagaatcttatggaagttatggatcctttctttctcaccctcacatacacatgccattcagacttgcatatattttagatggtttctcaaacactagaatttcaaaagtctaaaccatcccaatacctttatatcatcaccagggttttagctctataggacttctctggagagcagtggagtgtgctcagtgacctgcaaaccgaacctgctccccagggagcccaaagttctggagtcagaagatctgggttctactccaggccgtcgcatatcttagctttgtgaccttgagtgagtccttcaatttctctgaccttaattttctttgtctgttaaatggggttggtattctctgtccccaggagctgtgaactaacatttataaagtcattttgcaaattgtgaaattacaaacaaatctaatatattatttctccctgctaggcctggagcaggtgagaaaaccagaaagaagtagtctcatacctggaatttcatccagtagctggagtacctgtcctatgtggtagaggctgtccagccatgcaccccctctctggatttggtacccagagtcaagatccccaggagtaggtgtgagtgctgactcatgttgcactgaacatcccatcatcaaatcccagctccatctgctcatcctggtccaaagtggacgataatcccattgttaagacatgtctcattaa

SEQ ID NO: 56499 - DNA, 1132 bp, Homo sapiens
ggagggatcatctgtaacaagtgtgctgatccattaagcaagatgaggacgaagatgagggccagtgttggatttagcaacttgtaggtcattggtaactcagcactaaaagttctggtgtgagttcatgagtgaatgggaggagaaggattgtgtgtactactatgcttcagtgcttttgctataaaggagagcagagcatggagggggttgctgggcacagggtcaacagagaggttttaagagaggagagaatgcagcccctttgtatgcagatgcctgtggaaacaacaggttaagaaactagggatgtttggtcatgagaagaggagactccagggatatgtcataactctcctcacgtgcttaaaggagtgtcatatggaagagaattagattcattttatgtgactccatagagaagaactaggaccaatggctacaagctacaaagaggaggattgtagcacagcctaaataagaattttgtgcatccatgtatttgctcattcaggaagtcagtattgaatgcctgctgcatgtctgacactggcctaggcaccaggggtcgtcatgatgaagattcagccctttctggctaatggaagagagcaacacagacaaacaatgattgtgccatgtggaaagtgctgacaaggcccctgtgtctgactggggtggggaatgggggttcaggggaaggtcaggctgggtggagaagtcatcattgttggctgaggatattccaccttctgataaccgagagcctatttggcctaaataaatgagacttaaaaaggcacttgaacctcagttatcaggtccattttctggatggctaggccatgtagatgcagccttcataaaaatgatacctgatatatgggcggtgctttatcatttacagagaacttctaatcctccccacagcctgccaggatcattctgttgtccctgttttctagttgggttaaccaaggctcagagcagtgagccttgcctaaggtcacttcattattataaagatggagctggggccagaacccggttcatgagtccctggtccaatgaacacaccctcccagagctgtgaaatgctgactataatttgccgtctcccttctctgaccca

SEQ ID NO: 56500 - DNA, 1050 bp, Homo sapiens
gtaaagtgcacgttgaccagggtctaaccgaatttgaacttcatctgaagtcaatggagagccattgaaaggtttttcatagggcaatgttatcattagatttgtgtttcagaaagatcattctggcaactttgttgggaatggacttaagagaagcaggctggtgacaggggaagcaattaggaagttattgcagtagtccaggggagtgaggataaagaccttaagcaaagcgacagggtggagaggaagggatagaatccagacctatttaggagggatatttagtggtgcctgctatgaggtaggagaagaaagtctgggatgagccccaggtttaaatgagggtagggaggtagtggggtcggtgagcagaaagactacagaaatgcagctgaaaagacccgtattacagcaaccatggaccctcagtgaattggggagggtcatcagagccagaatccacaagttttgtggactgagctggtcttcaagtgatggtgagcaattcctggaaatccctggatgaggaccaaggacttggcagtttttcaggtttaaagtaaaaaatcagtgtctggaagtggagactggaggagagaggtgtgtgtgtgtgcacatgcctgtgagatgtggttagagattatctacaacatttggcgaggaatttctgggttccagggactacagcacttctgaagtcccaggtggcagtactgcctcaccccgacagcctcctagcgtgaacatagactcaatccaattctccccatcccagagttctgcagggggttaaggaaatttccttgactccttgatttaatccaatcctcttatttcacagatgaaatacctgaggcccagagaggtgaagtgaattccccaaggtcacacagctggtcaacagtaaagccagaattgtaactctggtctctgtggacttataatgaggtgctattttcactcccccctttcctcccattcactataaacatccctcgaacattaaacattggaaatttccttgaccccttgcagaactgtgggatg

SEQ ID NO: 56501 - DNA, 1042 bp, Homo sapiens
actttcgctgtcatgattaacagctgtttgcatcttgccagctccactttctttggtccctctggccccctccactcccttctggtagaaacacgggttaagtcctttacttttgcagctctcaccaagcaggggatttgagagagatcagctggcaggtgtgggggactcgaatatgggatatctttgttaagaaacaggtgaattatgtatcagtagcctcagtttccccaacctcatgggcaagagtggcggccccacttcctgtgccctggccgatgtccaagtgccatgtcaggaatgccaacatgtcatgaatttgtgtgccttgcaaatgctttattggcatctcgtggtgttgaaagtcatgtaattatgagcagaatttatatgtcgccagggctgcctaggcgccctccctgcgtctccttccgggcactgcaaatattgaaggctggcttagaaaagaatcaaacctacccaccttgatatctatgcaccctgtagataaggttttaattgaaaatcggttcatctgttccccatgcctaattacaaggtgcctgcactgccaatggagcataaggacaggagtccagcaccctccaggaaggcctggggttgtggtcccacatggggacagcagtaactttggcagctttacctcttccgcatctaccacctgaggacttctggtttcttacccatgagcaggcactggtgtttgcagggaggacactccctcagccccatccccctccctctctggctggtgcttctgcagtgaggacaggatgcagctcactgcctgcttcctcccttctgccctgccagggatacactcctcgccccccctcatcctgccctctcctttcctttcagcccaaatgggcaaaaccagtctctgtttgtcaacaccattccctttcacctctgggcttgcctggaggccactcgccctcttccagggcgctctttccccatcctgctttgtaccctcctctcccgagaagcccctgcagtggtgatgacagatcttctg

SEQ ID NO: 56502 - DNA, 1034 bp, Homo sapiens
gagctgggggtccaaacccagctcatccatcacccatcctgataatcagatttggctgcggcaagaacagaacataatactgagctcctctcccagacgccgcagccgacatgtcctgagagatgtggagggccttgctctttggagatgcagagagggagtggcaggacccggagggagagatccctgctcctgagttgtggggcagataggaagtgtctacagagcagttccacaccctacacagcacccttcccactgcatgtttcccatgggcacccaatagagcactcctgcaccctgtgtctgggcaagggatcccagggtcagcgctgtgggtgggaagatgttttggttctgccttccaaactggagtcctttcacttactccctgtcagatttctctctgcaggaacgtgcctcttcagatctaactcattctattgttgtctaaagcatcaagtccctttttccggagcctcacagccttggcccagccctcaaacccacgttcagccccagtttctagcacccagcctctgggacaagaataggactgtaggggagaacgctctgggtgtctgggttagagacaagggtaagcatccacaattagcttgagaattcaggggccaacatgtccaccctggcttggcctccaggttgagttgacacttttgtttgtctctacctttgtttgcctagatgaattctaactgagggccctcatctctccagaggtgggggcagaaaaaaactgggattagagttaggcgaaatgagattggggttaggaaagtggcctttaggattagggtagggaatactcacctggggtgtgggatttactagtgctcagtatgagcatcagggtaggcaggggtgggggctcaggcttgaagcagcgattactgttaaggatagaggtaaagtttggcttattatgttcttatttattcaataagcacctattgatcacttatgctgtacctggctctgaggggacttgagatgctgtgcctcttcaagagctc

SEQ ID NO: 56503 - DNA, 1070 bp, Homo sapiens
ctaatccacaggcccagaacagtaagccttcttgccctgtcactgtaagcaccagccagcccctccagccagccgctgcagctggcctctgtggtctgctcagatgcaaggaaaccaggccagaccatggtcacttgtaaaatcccatctggtccctggaaagattcccctacggctgtccctaccatacccccagccttagagacggacagaagggaggcggtggccaagctgcttggatgagggaggagagattgattcttctgtccatggctttggcttcctgggatgagaaaggaccagcagtgggaaggcggtaaaggtggattcagtctgggcatttgaggctcctactgttcagtgtctttttcactgcaaactgtgaaatgaagccagagagctttggtcggcagagacaggaggtgataatagtccttaaatgtttagaaacttgtctttggggaatgccgtttgtcatttctctctcttcgtctgatgtccatatcacctgacatctacgtgtagtcattcctctgagattatccactgagagcaaggcaatggagttttctgacctctgatgcctcatctgtcaaaggagggggttaagggtctctaaagtcagtcacatcaaaatttgacattttaggattctaggctgggctgtgtataaggcaaaatcaacagacccagacccctcatccgcagtagctgggcaggcacagagctttactctggggagcctctgcctgcctccatggcccttgccaggtttctttctctggatctgtcctcaccctgcccagccccagctcagcactcccctcccttcctccctccttcttgccttctcttctcctctatcagaagtgccaatctctccctttcttctctccttcgcccttcgatggcccagcctagagaattgaaatcctctttctctgagagaacccaatgtgaggggacctctctggctgttgtatttttcatagagcaagaagggaatgactggggttggggggaaaagagtcctgcgggggtggggagagccaagatgtgagagcagagag

SEQ ID NO: 56504 - DNA, 1024 bp, Homo sapiens
tctgtgctgcgatgccctatatttcctggcgcccacacactcgctctccctctctccccctctcctttgctccctgctgtgtgcctttttctctcctctttctcccctattattatgagaggcatttgtctgcaaacagccttggagatttcatctgctcctgctagcctccctgcttcagctgccctcctgtctgctcctccagctgtatggctcccagcctcgccgtgaggtgtcgtggcatcaggtgtctgtgtctggggcctcaccttctcacctgtcagtggtgtcccaggagagggcagagggaggagtactggtgtgggatggctgaggatgtgtccttgtttcaaggttgggcctcattctttctgtttctgcagcctggccacggtaccgggttgtgggctccgcagacgctgggcagtacaacctggagatcacagatgctgagctctctgacgacgcctcttacgagtgccaggccacggaggccgccctgcgctctcggcgggccaaactcaccgtgctcagtaaggaccccaatacccttcagtacttcgaggccctgtctctctgtatcctggcagtctctcccactctccagttccctctttaatttcccagcttctccctctctgttactggccttatccctgccctaatgctcaagtccaggtagaagaaagtaaaccaggcatgtgggagacgtggggtgctggcgggacgtgagctgtgtgaggcccagcatcctctctgccgcagccagtgcctcggccactcagggacagggccttctgccttttagaaacaaggctgtggagacaagaagcagggacgtatggagtgatggagacccgggccctcctttcccagctgtcctggctggcaggcttgttggtgagggggcgtctcccttccactttcctctcagctgcctcggagaccccaaacggcccccgtgcccctccttccacctcaccctagcctcacacaacccttcttccctcagctgcctcctttc

SEQ ID NO: 56505 - DNA, 1048 bp, Homo sapiens
cccgcctcggcctcccaaagtgctgggattacaggcgtgagccaccgcgcccggccttactgcgtgttctgaatgctgggaggaaggggtgcggccacagatgggagtagatggggggctgcagcattatctttgaacctgggctatttctagggtcttgggatttggaggagaaagtgcttacggttatccccacatcttctcacaggaaagcccagttcagaagcactggggggacaaactcacctgtgcacgggaagcagggtggggtgggaggaagggagagggcctggggcgggcctactgcagtggtaaaggtctggtaaataatgctgcacagggaggtggggaagctgaggcgattcactaaagaaggctggagtctacagctctgcagagacccccattagaccatttgggccagaactacaggaagaagaatttcagagtaaaacgtcctatgtcatttggcaatgaaaacactagaacagatcatcagaagaggctgcgtcctcctaaaatgattgcagccttcacctgccctctctggcctccaccccatccctgcccacacctgcagagatggtgtgtttacgtgccaacctgtgtagagtcagagcatggaccaaaatggactcgggaaccccatttcccttctgggaattcacttgtggcccttcctgctttctttccgatgcctccgatgtggggccctcatggacctaggggcccaggcctcctggctccccacccgaggctgctctctctgcccaggtcctgagtaacagcaaccagctgctgctgaagtcggtgactcaggcagacgctggcacctacacctgccgggccatcgtgcctcgaatcggagtggctgagcgggaggtgccgctctatgtgaacggtgagtgagtggcctgagaggcagccgggcctgggcgggctggtactgcagtttttaactggttctgacttgtgtcttcttgcttgcagggccccccatcatctccagtgaggcagtgcagtatgctgtgaggggtgacggtggcaa

SEQ ID NO: 56506 - DNA, 1339 bp, Homo sapiens
ccaaggaaaactgttggagccctgagtagataggtgaacattcggcagtcacagtggtattatggatggcacagtggtgaaagatgtcggaacacgggtggcagattggagagtttggagacagctgacctcaaagaagagcgaggggccaagcatcatagtcaggtgggctgaaggacagggatcgacagacaaccaagaccaggggcaaactcctgccccagctgcagggatgagacatgaccatgatctccattctgatggagctggagcacagaccaaaatccaaccacaatgcagaccttcctctctaatccaaccttgacttaaacctaacactgtccccaggctcagtcaaaacttagccctgtacacaagccaaggttgcctctgtggctgtggcctagcctttagccagcactgagcttagctcccagtataactccagcctcacccctccacctttccttccccatcgaaagaggtgttacctgtgggcatcatagctggggccaccatcggcgcgagcatcctgctcatcttcttcttcatcgccttggtattcttcctctaccggcgccgcaaaggcagtgagtatgggccctgtgcagcccacagccttcccctggctcttccagggccatgacaggcagtgcttggggtggatgggaggttggcccttgagctccagcccagagggagccagaagcagccgctgcagagaccagcaggaagcacttgttccaggctgcctctcccgtcccaggtcgcaaagacgtgaccctgaggaagctggatatcaaggtggagacagtgaaccgagagccacttacgatgcattctgaccgggaggatgacaccgccagcgtctccacagcaacccgggtcatgaaggccatctactcggtgagggtcctgctcctctctggcctcctgccttctccaccctctgaggaccagctccatcccagatctctaataaccgcggtcattctctccttcctcagtcggtcttccctggtcctgccacacacactctcccacactcacacacattctctcacacacgccccaggctagtttcctccagcagaggataggcagctgggattgtccaaagacttcctttgccccacagtgtgtgaaagttggaagcccccagaggctttctggtccatctgcctcattgctgagatgaggaaacagccctggagaggggcagtgacatatacaaggtcacattacatgttagcaaccaaactagtgctcgaaccaaggtctctggcctcttcccaccacatcccagagcctctgctgagaggaccagaactcaagtctg

SEQ ID NO: 56507 - DNA, 1067 bp, Homo sapiens
cggaccccatatgaggcgtatgaccccattggcaagtacgccacagccactcgattctcctacacctcccagcactcggactacggccagcgattccagcagcgcatgcagactcacgtgtaggggccagagcctggctggggcatctctgcggggcagaggagaaggctttcacagctgttccctgatattcaggggcattgctcattgctcccttctcggaccagccttcttcctcccaccatggcaggtggggagcaggtctcccagaaacaccccgtcccgaggatggtgctctgtgcatgccccagcctcctgggcctgcccttccctcttcttcgggaggatgtgtctcttctgacctgcactcttgcctgaccctagaatggggacagggaaagtgaaggttagggaaagcagaggggggcactttttagcattccctttctatcccacccctctgatctcccataagtggaaatgggggtacccagggatgggcaggctttggcctagggacatgaagtatgggagtgggtggctgtggcacagacaggtggaaaacgggatagcctggccagtccctctgttgtctgcattcgtgccctgggtgcctctctccttcctcagggtactgcagaagggagcgaacagggtactgttcgctcttgtctacagaacagccctggcactgcattcaaatccagtcttcattcagctgggatcaaaatgccagtcaccttggctacccactgtggacagctgtctgtcagcatgcagagggatccaggaatccccccggcagcacggcccgctttccttctcctccatgctgggccagccagataagtcagggtcctggtggagaaagaaaggctaggaccatgtcctcattgacccagatactgctgtgtgctgcacagcagtgaaccaacactagagggagccacacaagcctcctctccccagtctgccccacttcctggctttaactcttgagctggtttggggagtggtgaggtaggggtgggggtgctgtaggctctttttcaaagaaaacaaaaaac

SEQ ID NO: 56508 - DNA, 1578 bp, Homo sapiens
ctccattactctttcagtctccaagcactttgaatccatttttaaacattcaggttgccagacctgtcacacagtggactctgatagggttacggagggggcctggctctcagtctctactctcctatgtcccatcagttggttggaggccaccttccagggggtatgggagacaggttttggtttttaagtgtcttttttttttttcttggaccaatcagattccttcttccactttcagtgccttgagtgtcaagctttggatgaccgaccctatgtgggcggttgtgtggggagtgggtacttgtgagcctcggacacactgttaagtgttacagtgttaggagagagatgggtgaggggacctggagaggtaaggggcctggaaatggccctgacagagaacttgtgctgaccgggagaaggtggtgcggaagggcaccgcaggcattacacaggccatttctcctcctccatgtgcacgcacatccaacacacaccttccatgtgactgcttctcagccaccactttctgaccaaagagaacaggcgctccaaggagaacctgtacccctgccccagcctcgccttcctaaaaagcagtgtctggagttggctgtttcccgcctccccagctgcatgtccagcccagtgggagacagggcctctggtgcagttcccaaaatgttcctcgccctttctccgtggtcaccattcataattcatgttcgctttaatgagttacatgcttatcagccacaggccattaccacccttatggatgggtctggggggcgacattcctggccaaccccttgtaggaaggaccagataatacccaggaagcaagtagctctaattttaacttcacaggaagtctgtgcatcctccttcatttcagcagggaaaactcctgtggagtgggccctatctggggcatttacaggcttccagctgtattccatccctggaagctgatacctttctatagagtccttttatgagagctcagtgggaaggtctgtcaagaaattcaggttcttgtacagacaaattcatgcaaatttctattattttcacaaaaaccagaaaccatgggggaatccaaagacttgaagtctaaagatggtggcttttaaaacatgcatattccaaaaagaattcatttttgttttgggtttggctagattctcttatttatccccttttagcttaagtattagtttcattctactgaaatgatggagagagggcctaaggttactaggtaattgagctgatggtgcagggagaattgttgagaaaggaagcctagtttccagaagcctgacacagagctacttcactgtcctctactccttaacaaggtaactggagcctcttgggtgtcaaacaagcaccctggaaggcacagggaagcatcagcaaccaaggtagtctctgccctctgtaacttacgtgttggtgcatcagaatctgaattggaacctacctgatgggcccagtggaatagcttttctggggagtggaaggcgtccttgatcacagagctttgctgtcgaatcctggagtcctgca

SEQ ID NO: 56509 - DNA, 1951 bp, Homo sapiens
tgggggggttctctcctgttcaaagaagctttcaccatgggcttcattatcttgtcagaagtgaattagtttccaccagggacccctttatcccaaacagcaacacaaaatacaccctaaacctcagagtaaaattgatgtggggctatcctttggctatcgggtcatctgtgctgctccccactcatttctgatgggtttgcaaaggtgccttttgccagggcaggacatagtatgcacatagggatattgttatgtgcctaggtttcaggcactccttctgtaggggaaaatgggaggagccttcctccaccctgatccttaggaacattcctctggcccagggacagcttgttcttctcaccaaacaggtgaagcctgcagtccaaggtgcctggagccagaggtcggggagtaagcacagctgcccctgcctgagaaggagcagcttgcaaggggagccggtggagggaaaggggtacaacagctttggaatacattctggatcttgaggaggatcttgtgattttggctgagccacggtcacttccctcgtgaaggacccgccctatatcctaaattctggatccctcaaagtccagccacagagtttgcatgaagcaaaaagcctagtaagtgagaaaggaaaggggccagggatgggagcagtgctgtgctgttatcactgtcttgcttggaatgaaaacatctgagcaccctgtcttcaagcggtacgctctccccttattccagcagggctactttcctcttcactctgatgaggggagctttatctgctttcaaaatggagcacgtcgcactggagtttcgtgccctctcgttaacctgtcaggagccacagggctccataaaacggaatcagtgtctcaatatacatgacctatgttcatagcaatgttcagccatttgggtttgaagaaaaccacattaaagccaagacccgtttggagcgaactgccttgttctttgctgtgtggaaggttctgtccctactgctgaactccagttcctccccaagcaccctggcctcagaaatcctggcttccccaagttagtgctgtctgacctgagccaggccactgcttggtgcctctacaggccactgtgcatgttgagaattgcccaaaaggattagtgaagctcctgaccctggcgaggccataatgaacactgaagtgcacaggccaagggatgtaattgaaaggcatttatttttgtgaagatgctgtaaaattagcatttaaatatcccattcccttctcttggcctcctcctatccccctatggtatttctcctcctctcctcaaggccaggctttttgtgaaaggcattggctcatctttgtcagcgtggtcctgacgttcacctctgggctgctggagaggactgagagatgtgtggtttggtaggaagggggtgtgtgtgggggttagtggggaatcccatttttttgcatcactgtgaggtagcttcaggccctgtccctggagaaataattgctgcgcagaagtcacaggccatactgggcagttctggtacaaacctgcccttattaataataacaataataataataactccatttgcatagaactgtcactcattcctgccagtctgctgtccctaccctggttttttgctggccccaaccactggccttgttgagtatcgatgggccctgagctcttctgtttgcttttggagctcttcagatgctgtcccccctgagaataccctaactctggggaaagagcagccaaaatcccaatacagtaaaactccacacaatcttgttagcaacagtgacccagaaaattttgagaagtccaatttcaccagaagaggcccagggctccctgtggtcacattttctacccagccattcttggcattgcaacctccatttctagctcctgttgaattttctcc

SEQ ID NO: 56510 - DNA, 1018 bp, Homo sapiens
gtatatgcttgtacattcttttctttcaaagcttcttgttttgatttcttatatgggaactattaatcagtctaactatataagcaaaagatattttgcattcttaataatttttaaaattgtaaagggatcccaaaagcacaaatttgaaagccactattccaggaattaaaatatagatttttttaatctatcatagtctaatttcaaataatattatgcatttcatgtttaatataagattcttaaattgatacttccatttgttttcacccttgtgctattggtgtcacatattttaaatttttacatgttatataccctataattcaacatcattatctttgctttggtagtcaactggttttgaatgagattattaaatgagaaaaaaattcaccctcatagttcccatttccagtattcttcattcctttctttaggttaatattttcatttgtattatttttcttctgcttgaagaacttcatctaacattccttatattgcaggtcttctatccataaattctctagacttttgttcatctaaaggtcttcattctaccttcctttttgaaatatattttcactacatataaaattcttggttgacaacttctttcttccagtattttaaagatgtgctgtcttgtcttctgactttgcaagcttctgataagaagtctgctgtcatcatgatctttgctcctctgtatgtaatatgtctttttttccccctctacctgttttaaagcttttctctttatcactggtattaaacaacttgattatgctataacttgatggagttttccttgtttattcagctcggtgattgttgagctccttggatctgttttgttatggtactcctggggcagggtttattaggggactgatttagagatgaaagtaatattgagatatgttactcttctgaggaccctatctcatgtattacaatatttttccactttgatgggtggaatgttaactattttcattcttaattgagg

SEQ ID NO: 56511 - DNA, 1034 bp, Homo sapiens
taaaatacaccgtggccagactctaccctttcatctaaccacattttgttctgttgcagctgaatcctgattctttttgtactcagtagatcagaaaaacattgtcttctccttttaaaataaacttcaagacacttaatgctaaacctacctttaggtttccttttaaaacctggaaaacctcaggcacactagaacttagaacaagcctattttcttaaatgatttccatcctttacttcttcccctcacaaatgtagccagaacgtaaaccaattactactgagagtgcacaggggagtcagcccacagaaagatccacatttgctgtaatttaattttaggcctgtccctgtgtccagtttctgcaaacttccaccattctactttttctttcattcttcctttttgttgttgttgttgtttttggtctttttccctaataatgaataataaaacccataagttgacaaataatggtatggaaattccaatccctagacatcatctgattatagttgagtatgatgaaagggctaataacatgtgaaaacccacccatatccacattttgccctagtaaccctgctcctcagaggttgtgctgaaaattatccagcattactgaaattttcttggccttgtggacagaaatgtctttctgcctcccacagtaatatttagggaaatgttatagaggggtggggaaggaaaaacttagtttggaaccttgctcctgacattttctagctgaatgatcttaagcaaataaaatacttaatctctcagttttcgcataaaagaaaaataagagtaattcctacctcatggtattattaaatgaataatataaaatgagaacgttcatgtaaagtacttagcataatgagagactgaaaagtacttagtgaattgtaattatcaatgtagtacattagtatattaatagaaatctattcatatgtcgatttctaaattattattattcatatgattttttatacctctcccacaaagctttgccagggggagtc

SEQ ID NO: 56512 - DNA, 1014 bp, Homo sapiens
gacagctctttctctaatcctttgtgtctcagtgcctataaagatggagggttttatttttctaaatactaaaggaataatttaatagttaggactaaagatttagataagcaaatgcctaacaaaatactttcgtagatactgatatgttgaattgagtagaaacaggatgaatttatccctcatgtttcaaaacacaaaagggtactttcagggtctcttgccagtaatgccacaaacttgctaaagaactgcccgaaagagcactttcccttgtgccaaggtgctaccttaacaaatatacttctgctgctggccttttccaggagagcttctcccagtctcccccagtatctccatttgagttatcctgggaatgcaagcaggagttttgagtttttgacctacagaaactcctaaatgtttgctggcaactcaatcaacttctgtgtctacaggaggctatagcgacatcagtggagctaggtgaagactgggagcgcaccgaagttctgcataagaaatttgaagacttccaagtggagctggtagctaaagaagggagagttgttgaagtgaaccaatatgccaatgagtgtgccgaggtgaggtgggagcaaaatattcactccgtgcaaagggttcttatccttaagaataacttctggccattagtagatggatatgaaggagatggggcattgtgagaaaacagaggttggcatgttcctggagtaacatattctgaacagtttcctctcccctctggacccaccccttacaagtctattgaaatggagggttgagagagaaagagagagtgtgtttttgtgtgtttggagaaattaaatacacaatgggcagtgaagctattgccatttatatagtagcttctgtaccatgcagtacactgattactcatgttaatggggcactctttcttcatgaaaaaacacaaaaataaagtagcagagcatataaaataatgttgagctatcattatttatacatata

SEQ ID NO: 56513 - DNA, 1048 bp, Homo sapiens
agcctccctgtcctgcaggagccggcatgtccacagccatgggcattccccacctccccagacctcatcatcagctccacccaacacttcctcaactgaggtacactctccctggtccccttttgctttgttttcttcaaccccaaatataaaaattttatctcctacttaaaaataacatggataattagccaaataatccaatgtatatactgagaattagctagagtttaatcttttgcttccataggatactcgataaatttgatattatctctgacatcaggaggttttctgtcctgtgttgtttgggagaaatatagagaggtatggagttcagaatagtacaggtagatacagcagtgtgttcacagtttactgcttcagtctcttttacgcctcttccctctgctcaataacctgttaaagtttctttgatccacaatatgttcttttcttcctcagcgttttcacacaccatagtccctctccctgtaaaactcttaaatggctaaatagaggtactctgtggatcccaatattgatattccgtcctcagggaatcatccctggaaccacgttcagactaggtaaaatatttacggtgttcactttagtagaatctcattttttcctaccaattatgttaactacaactaataaatgtttgtccattcaatttattctgtgttgtaagattacaagctgcttgttgatctggtgaatccctgtaacccagagatttctttgagtgacagaaagtactgaaatgtgaatctgcacagctaatgaaggacaaatgagagttatctaatccagccatgaaaaccatgaaggttatatttttgtgaggcctaaaacagtacaaaaacaaacaaagtggtggaataggatggagagttgaaattgtggaaatccaggcagaaggaagactatacaccacgtcttggaaaataaaggaagtgggttgcaatttataattacgtgttcattcttattaggttgtactacttttaaagtggcttctcatattttgctatatctcaca

SEQ ID NO: 56514 - DNA, 1034 bp, Homo sapiens
tcaactctcttcgtatcccctctgtatctcttcccttgattccacctatcttctgctggctttctgaggtttagcactgtaggtgaagtaaggtcctttcaatagtacctttttgactcacagctgatatctttcttctcttgtcttcagcctgaacagaaacagatggtggcccagcaggaatctatcagagaagggtttcagaagcgctgtttgccagttatggtactgaaagcaaagaagcccttcacgtttgagacccaagaaggcaagcaggagatgtttcatgctacagtggctacagaaaaggaattcttctttgtaaaagtttttaatacactgctgaaagataaattcattccaaagagaataattataatagcaagatattatcggcacagtggtttcttagaggtaaatagcgcctcacgtgtgttagatgctgaatctgaccaaaaggttaatgtcccgctgaacattatcagaaaagctggtgaaaccccgaagatcaacacgcttcaaactcagccccttggaacaattgtgaatggtttgtttgtagtccagaaggtaagttttcatatctaatttcatattgattagtaagaataacgtatttcccatctgatcttaaagaaactttggaaatggttttaatgtctttctatatagacaaaataaaaaaatacaaagttctaaagagctgcagagtaaacatgccaaaattcatacaaaaactcaaaaattgtttttattgtcaaaaatgtcacgatcctatttcaacttaccccagtagcctctgaaaaaggaattagttcattcacataatttttatttctgcattatttttgtactttgtacatattatctttattttaagtgactatagttgtgattatctttattttaagtgactattgttgtgaatgcaaagtaagtgtagttgagtaataaaccagattaatgacctgaaaaaccaatacgcaaggcaggattaaagaactgtgattaaatgaagaaaacagaagaaagag

SEQ ID NO: 56515 - DNA, 1221 bp, Homo sapiens
tatgcctcgataaatctattttaaaaataacaggaaaatgtatcctgtttcctttttgttgttgttgttgttgttgttttgagatgaagtttcgctcctgttgcccaggctggagtgcaatggcgcgatcttggctcactgcaacctccacctcccaggttcaaataattctcctgcctcagcctcctgagtagttgggattacaggcgcccaccaccatgctcggctaatttttgtacttttagtagagatggggttttgccatattggccagtctggtctcaaactcctgaccgcaggtgatccgcccaccttggccttccaaagtgctgggattattacaggcgtgagctaccgcgcccagctaatgtatcttgttttctgagaattccagaggtgttgtatactttctgaagatgtctttcccaggagtagtgatcaccttgcttaagaagttcttacctatgtcctactcaaatctcttttactactgcaaatattttatttttctttaaaaaatattaatagctcaccttgctttattttgaatgtagaatcacttttggtggtgtaatcttacatgttttggattccttataggctgatcccaaagttgtcagatggagagtaaatacaaggagatactcttgctaacaggcctggataacatcactgatgaggaactggataggtttaagttctttctttcagacgagtttaatattgccacaggcaaactacatactgcaaacagaatacaagtagctaccttgatgattcaaaatgctggggcggtgtctgcagtgatgaagaccattcgtatttttcagaagttgaattatatgcttttggcaaaacgtcttcaggaggagaaggagaaaggtaatgtgggagttccacacctgccccgtccctttttctgccaagcctgggcctttcctttcatggcatccctgggatatgacccccagtgcacattgttggaatttgtttgctaacttagtgcacctgtctctttgcccccttttactgagaatcgcttctaggaagtgtttgttacaaattccacaaatccattccagcctttgtttgcatctcttcttccagccttagggttaccacttccatttaacatcttttctccttgcccatctttgtctccagttcagttgcagtgaatatggacgtagaatttcaaagttaacttctcccaactccatt

SEQ ID NO: 56516 - DNA, 1062 bp, Homo sapiens
agaagacccttactgggaatgtaacactgtctcagaatggcgttttcactttatttctcctttgtggttgagtggtttcagtgcctgcaattcttgagttagaaaattgatttgccgatttggtaatgtgaattaatacttatagtttgtgtcatataataagcattcgtctaagtgtttcatgtacattaacttatgtgatcctcacaacaacttcattaaataggtactactattatctccatttgacagataaggaaatttaaacatagaaggggaagggacttgaccaagattactcagataactcagttaagtggagaaatgaggatgtgagcccaggcattctggttccaaaatccattctcacttggattgcctactgtataattacttgtactatcttgtactatctctctgttcttagcataattctgctcttcattatggctgtgaaattgtgtgtgtccacatttggtgaaagtttcctaaagataatattttgggttgcaggctgggaggtgaggggactggaaggaataaagagtgggaggatgtagctatggcccaggggacaataattcaccttggagttagaagcctctgcttctaattccttctaatttattctgttatgaaatttggggagatatttcctaattttattgttaaaatgacataaaatatgtatgtgaaagggcttcatcctgagcaggggctgagaatctgatgtattggcacagtggctagtaaggaatgtcaggtctcagagactacacagttacaagacttagcggtttgcctgagactggggcagaattcagacttttctgtctcctgcagctcaagaattcatgcccttgtaggggtgaaagagaggtagggatctgcctacttcccgactttattttcttttttacaatcccagattttctgtgccttggagctgcctaaatctcagagcaacctaatgagtaggaaatcacctagatcacaagcaggtgacaatatcgaaggatgaagggaatactttttgtttgtttttgtcgctaaaggccagtt

SEQ ID NO: 56517 - DNA, 1048 bp, Homo sapiens
gatggaaaaaaaaaaaaaatcacacaaccatgaagcttgtgccactatgtttttaagactctcagactcaaccgagtcctaccttttcagtggattgaagtagtctctttttgttatcctgtttttttctccatagcactcatcataaccagaaactatctcaggagtgtgtttgtctattatcttcctccgctaaagctccatgagaaagagcctttgtttattctttcctgtatctccagcacatggtacatatggagtatggcacatgctcagaagatgtttgttaaacaaacaatctcagcttagatgtcactaactctaggaatttttctctaatccctatctcttaccaagtctgactttatggatttttccttcagcatcccgtgtttttctgtcatagcattttcacactgtattctcattgcctgtgtacttatttttatctttctctaggtcagcaatacacaatagaactttttataacgctggaaatattctatatctctgttgtccactacagtagccgctaagcacatatgactatgaaacacttggaatgtggctagcatgactgaagaaatacatttttacttttattaatatttaattttaattaattttgagctgaaatagtcatatacggttagtggcaactgttggagagcacacacgactctcaattttcagctctatgaggtaagggactgtctgtatagctctctgttgtatttctcagggccagcacagtgcctggcttgtgccgacaatatgaagaaagttgggcacataatctgtagattgtgtgtctcttagtggttattcttttccatggtgagatgaaagttcaatgtgaaaaaattctgtctcaaaaggatttggatatctacactgatggatttaagatatttaaatgatcattattgggtatgtgaaaggtcttcacatagctagcattagctggtaggcttaagatatctgaattcactgtagaaattgcttattctgactcaactctgaactataccatagagatttttaaaaa

SEQ ID NO: 56518 - DNA, 1006 bp, Homo sapiens
aactgaaaaccctcctctttcccagagttgccatattgcacaactccagggggcattgttcaaattggagttgtgcaaagcagcagcactgcctcccacggcttaccagaaagcagataaagtcaaggtaaatatctaccaaattaaatcaccctatatatacatatgacttaggcatgagaatttctagacaagttaaatttattattagcaataactattaagggtcaaattatatactaagttctttacatttattatccgtcttaatattcacaagcatgctggtcagtattcattaccctattttacagatgatgacagtgaggcttgaagaggcaaaatgactggtacaagagcacaaagatggtaaatgacagactcaggtttcaaatacaggttgtcttactgcaaactctaaattttcagtcattacacttagccaagaaggcttctcagagaagaggtcatataagtttggttctgaaggaaagatgggagttgcatgatactagaaaagagaatggcctatgagactgtagatgaactcagatcaatatggaaggagatactccaaggggaaagggagctagaaactagattgcagagggaaatgagtaaaagttgagagagtaatgggggagtaaaacaaatatgagcagagaccagggacatttttttgtgataaattcaggcaaaaataaaatcatgtaataaataaatgtgtcactgttcctccagctacaggctgattgatgtactatggaaagacagtagacacacataatcatctgcaaaccaaaatacacattttcagttacatggctatcagtcgcttctccaacgaaatatctctgtattctttcccttagattctgtgctccagcaatatcaaatggcttgtaatttcccaaacacactatgttgtttcatgcctcagtgtctttgcacatactattttctatacctggattgcccatctcattaagcctgatgaaacttgtgc

SEQ ID NO: 56519 - DNA, 1054 bp, Homo sapiens
tataattaccaaaactttataataactttgaatttttcactcagtagtcagtaagtagctggtccaatccacagcttgctttcaacaagaatctggaacctagatcaccatccttaggtaaaattccattactgagaattagatgacaaaaaagggattgttgagccagtatgcagttccactggagtaggaaacaacaaagaataagactagtcacagccccaggggttttctttctctggtgatattttttcctaccaagtgatttaaggaaaataaacttttgatcctgttttacatattatttggactgcaagaaagtagtaacatcaagaagtaccaaaatcaaatctaagaatttacagagcaatggcacaacctctcagtttgttatttcaaagtaaccagaacgccaaagcgatgctgtctctggaattttatggctgcagaactatgagtcactctctccaagtgaatagtgaatatctccaacaaggcactcttgcaattagatttggaccttctttcttcttcagttggaagaggaaagagaaagagcctaagggtagtaagctggctcattctatcagtctaggacagaggattttgaactgtgtggtagaaccccaggtagttccttaaggattataagaatgtgtaaaagccagtaagacagggaaaagggatataggtcttacttcaccatttcaacaacagcattctcctttgatatgttttcctcatttgttaaaaatgtctcacatctttgttttaaaaacaaatgagaaaactgctgccctagaggaaactattaaaactaacagtgctatccagatctatggagaagcttagaatagaatggcataactgctgggtaggcagttgacgttacatacattaggacctacatgaaacacactgattcttcatggaattaactaaactctgctatgcaagtgtctctgtgatggtcttaacttttctgtgccagaaaatgcacatgtctaaaaggagagcatatccttcccaagagttacagctgcaactaggagga

SEQ ID NO: 56520 - DNA, 1050 bp, Homo sapiens
ggactgtgagatctgtggacttgggagaatgtatctatttcacagaagagtgaaattctcacaaagtgaggctaatgcgaacaatgtaccgcaattttaaaaatacagatttttttttttttaagtgagaagagtgcagggagactaaatagcagttaggattgggggaatcagtgaaactagagtagtgtgggtgtgtagagcagaacacatttttcttcatgtaatgctcctaaccattgccctgaacctgtcatccacacccagactctgatcatccagtgaagggaaacagtaaaaacaagtcaggaaaatcagaaccagcagagatgagtgctttcttgcttgacttctaacaaattaaacttttccacagcattgttatcccaccacaccaagccatcagcctgtaatatctaaagtgcaacataaggagcataggagaataagacagagcccactgagaaagggaattcatccatgccctcagacaggtattggggcactgggatgggtagtgcagagtatgagcaagttgttggaacctgggctgagatttttcatctccagagaatatattctttacttctgattttctgggatttctggcccattcccagtctctattttcccatacccttccaatgagctaaattgaattctgcgtttgactctgttatgtttcctttctcaagtactttcctaagatgaggaactttttccccccagttttattacatatgtgtgaaaacagcaagataaattgggggaaagggtataaaatccctctacttagtttaagaggacaactaagagttcaaagtctggcctcctgactgtattgcattagaatgcagatttcaagtcatacctgtccgtatgtctaaagtgtttgatcatagtgagaagggaatgaggagatgggataaacagacactcctaaaatggctcagggctgttatcatcctgtcttcaggggcctactccaaaacaactgaagacagtcagtacctgcacagaatctgtgctctagaggtcctcactgagccc

SEQ ID NO: 56521 - DNA, 1034 bp, Homo sapiens
ctcttttgagatatacagtacattattattaactatagtggcctttctgtgcaatagagcaccagaacttattcctcctatctaactgtaactgcgcactcactgaccaacctctccccatgcccctccccttcctctcttcagcctctggtaaccaccattctactctgtacttctatgagatcaactgttttacacaaatgctgctttatgcagagctcttttttttgcagagacccttccctgctctgtggggatgccctccatctgttgctccttgtcccctatggttcagagtttacacagccgctttccctaactgtttctttttcacatgcccacccactcccccagcatgggctggtgaattgttgacttcccagggtctggatgccactcagtactgatgacccaaactttctgcctcttcctgcagccactaagcacagctggcatcctgagctcctcttctgccgcttccaacaggtcaaggaataaggctcgctatcggaccaaagccgtgagctctgaggtggatgagagcctctttggagatatcaaggtaatcctcaacaagtcctttcaagttgatgccacctgcaggcagaggcccaaaaatgtagctcagggcaaagcttctgctgagtaaccttgctctcgtaggtaactctcagactgaagacaaaggggaattctgagacctgagctgcagagctttgggatctagtggggcctatgtaaacagggacacctagcttcttccaccctagaatctctcatgtcttcacagtgtttaaaatctgttataatgtcaaaagggaggctcagctgcagagagtgcaatagttgctcagttgagctccatgatggaaacattgcagggctgatgggctaagcttgcagacaatagcaacatcttccccgctccatccaaggataatagcatcagagtacaacacaaaaccatcctcctttcccagttgctcaactaaaacaattacttagctttgggaaacgagcaggtctttatttgc

SEQ ID NO: 56522 - DNA, 3276 bp, Homo sapiens
accaaggacttctactatctctttcacaatccctagcacagatagtaggtgctcaattaaaatccagtggtttgcaccaacctagatggttaaaaaaaaagcaaagaaaacccagaggttgagggagggtagatccaaccagtttcctaagctgttccacattcctcctcctctccccaaatcattctctttcccagggctataaagagcagggttgcatttggtaacagttctggtcctcatccttggggctcaccgtgggggaaatggtgtatatccctgcaggcagaattcctgaattccccactccccaggctgcaaggtgttgaccaaaagcccgggtgtgtcctctccctagctccccgcagccaccgccacccattggaatggccaacaggggacctgcatatggcctgagccgggaggtgcagcagaagattgagaaacaatatgatgcagatctggagcagatcctgatccagtggatcaccacccagtgccgaaaggatgtgggccggccccagcctggacgcgagaacttccagaactggctcaaggatggcacggtgagagccgggccccactggcttggaagtgcagggagagcaggactgggtccagtggactggggattgtttaacctgaagaggagaagactgaaggcacacatgtcccagcctcttcctcagcttgaaggcctttgtcaaggatgtgagagggcccatgctttcctcccttcccgtggagtggagggtaagggtgaatgtgcctcccaggcagtggaagactgaggtgacactgaggaagaatgtctctaaggaaagaactgtgggagggtatattagcaaggaaagactaaacactggcttttcactctgggctcggaggaaggaggctggcaagaaggactgtgaggcttactctagtgaaagagtccaagctgtcttcaggcaagacaggagcctctctggttcattgtctctggttctgagggtggtgcacgctgagctgcgataggtaggcatattctcacctttccacccctgctgtcctcatccaggtgctatgtgagctcattaatgcactgtaccccgaggggcaggccccagtaaagaagatccaggcctccaccatggccttcaagcagatggagcagatctctcagttcctgcaagcagctgagcgctatggcattaacaccactgacatcttccaaactgtggacctctgggaaggtgggacagggcgaggggctgggtcctgtcatccaggaggccagagattgggctgggccctcttgaccaggcagaaggggctgttttctggctccctgcagagaaagaggggtgtgtttgtgttccatggagcacttggtcatattggaggctggaatggagaagggtatggaaatgaacagtagaaataattaggaagccaggcctgctgacttagcgatagaggcggaaccctggtatctaggacactgcggaggctgacacattcccattctccttcccaggaaagaacatggcctgtgtgcagcggacgctgatgaatctgggtgggctggcagtagcccgagatgatgggctcttctctggggatcccaactggttccctaagtaagtattgctgggacagccgcagggtccagcaggtgcattgtttctgcccaatcctgtccctaggaaataacttatctcagtagcagctggccctttacaaagcactttcagaaaattcctcatctcacttaatcctcacaacaccctctgggatggcaaatgactgtccctttggacagatgaggaggtggcttcagagagcttatggctctcgagggcagagctggcaccagcccttgagccaacagcaaagcctgtgctctgtccaaggaagggatttactagggcagcctgtgatctcctctaaccaccactcccttgtcacccaggaaatccaaggagaatcctcggaacttctcggataaccagctgcaagagggcaagaacgtgatcgggttacagatgggcaccaaccgcggggcgtctcaggcaggcatgactggctacgggatgccacgccagatcctctgatcccaccccaggccttgcccctgccctcccacgaatggttaatatatatgtagatatatattttagcagtgacattcccagagagccccagagctctcaagctcctttctgtcagggtggggggttcagcctgtcctgtcacctctgaggtgcctgctggcatcctctcccccatgcttactaatacattcccttccccatagccatcaaaactggaccaactggcctcttcctttcccctgggaccaaaatttaggggcctcagtccctcaccgccatgccctggcctattctgtctctccttcttccccctggcctgttctgtctctgagctctgtgtcctccgttcattccatggctgggagtcactgatgctgcctctgccttctgatgctggactggccttgcttctacaagtatgcttctcccacagctgtggctgcaggaacttaatttatagggaggagcctgtggcagctgctgccccagccacagctgcactgactgtgctcaccacacatctggggcagccttccctggcaggggccctcgtggcttctcattttccattcccttcactgtggctaaggggtggggtgaggggatggagagggagggctgcctaccatggtctggggcttgaggaagatgagtttgttgatttaaataaagaatttgtcatttttgaatggactctggctgtgtctggggccactgtgccactgtggggaagggaggaatactgggcaaagtgcagtgagtgatacaggaaggagggcagagatgagaggttgcagtgctaacccctgtcttgagtttcctccccatcctcattctcacttgctttggggggtggtgtaggttggaattgagaggggacaggacctcacagctgaatgcagactatgtaggcagtgtccacagggaagtaaggccctttctagtcaatggaattggctaatcctgcctgctgcctttggctgggtctgcctctacagttggaacagcttctcagtcactgagagggtggggctggctgctggcacagccatcagtcctggcaagtgaagctgtctccaggtgagaggtccctcaggcgggcttggggtgaggtggtctgtgttggagtggtgagggtgggggttgcagtggtgaggaaacgtggagagctggggaatga

SEQ ID NO: 56523 - DNA, 1273 bp, Homo sapiens
tgccccgccccgggtccgccccgtctgaggcgggaccctcctgaaaatccccggctgggcagggcgcaccacttgcagctgcagcccttgccttgagtcagtgcgccgctctccagcccgcttgaacggtgagcaggtcgggggtacgggggtcggggacatgtgcgtgctgtgtagaaagcaagaagccagcgctttgaacttgctccagcgagctcggggatcaagggctggtaccaggcaagggtccggtgactactttaccccgccccgtgctgtcaggtcctgtccccaagccctgacccgacattgttggacgatgaggtcaggcgaggttagcccatgcatagacagggcgtccgtctggagcagggactcagggactgagccccacccgcgggctccatcgctgagtcctcactggggcgaggggaaaaaagggcgtcggactttagctggctggccccgagtgaccccgggtcgtggcgccggccctgggccagctcgtgctcctgggctttcccgcgcgacccttcacttcctggttccaggagcacgtgtgagcactgcgtgccctctgagtccccgaggccgcccttttcattcctgttcctgctagcttgctattctggggacttgaggtcacgggctggggctagggggctctgcatgggtcgcacggtgaccttctgtgaagctccagtcatctctatgacggtcccctgacctcgggggtctgggtgctgcagccctgactgcgccccggggtgccctgtgtgaggttgtgggggtggtggtggctgcttttaccctgcccgagcgccgctgcccccaccgggtgccccctgctgctgggaaagccggtggtggccgcgggcggacgggcgggctgcccagaccactgcgtcaccccagcggcgggagggcggtgggtgactcatctgttgtaacggcccagggtgtggtcgtgggggtggggggcggcggctgggaggccggacctgcaggaccggaggtggactgccgcctccccccgcgccctgtgcctcctggggctacctgaagccggtgtcctgggagatctgtgagcagttggtatctgtggggcagagagaaacggggtgagagtggggatggagtgtgggattcgatgtagaagacctgcggctgggacggggctcccccagtgttctcattgacttcaaagcaccagacagcaatggctctctatctctagccccctcccagtttctcctccccactacaaggggca

SEQ ID NO: 56524 - DNA, 1243 bp, Homo sapiens
gggactcagaattccctggggacatggaattgctggagactttgcacctgggcttggccagctcccggctcagacctgaagctgagccagagctaggtgtgtgagccccccggaaaggcaggcatctcggccatactgtcccacatccccccgccaccttaggacccatctattcccagtcaggccctgcctcccaggctcctctgctctagactgtgccttgcccccttgggccatctgtactggaagggcctagcgagcttcacatctgagctcttcactcagtgaacctcagggcttcttctcattgtcctgcccgcctcttgcaggtgtgaagactccagaggagggctgcctcctgaacactgcccatgttactggccctgaggcccgctgtgctgcccttcgggaggaattcctggccttccgccgccgccgagatgctactagggctcggctaccagcctatcgacagccagtcccccaccccgaacaggccactctgctgtgaacatccctgatgtgaggctgtgaaaaggcatatggacctgcaaaggaggcccccaaccagacagacctagtttcaaacgagggcactgcccctgcctgcccctttggtgcccaggcacagaccctgatagtgggtttgggtcaccttggtatggaatgtatgtgctgaccccctaggtgagtctggggattggaacagggatcttaggtctgcctctctctctctctctctctctctctctctctctgtgtgtgtgtgtgtgtgtgtgaagttttttacaggtgaataaacaaagtttgaaagatgtttctgtgtgttatctgtctttgagagagtgccaggaaaatccctggacccttaaagaagaggagaatcttcttgaataaatggaggtgcattcagcattcattcaagaacatttattgagtgcttacggaggccagctactaaaggccagccactgaagtagatactgagaaaatacaaagctctggaagcacgcctttgcccttgaggagttctttctagtcagtgaggcggacaaagaaatagttaccgtatgataagttccgtgataaagctatgtgttggttattgtagcacaaaggaagatgttgcattcaaggccacctttagtgaacgctaatatcgtgtgctgggacaaatgccacatattgggggggagtcctcaggaccctcacagatagatggtggtaataatagtattcacta

SEQ ID NO: 56525 - DNA, 1012 bp, Homo sapiens
tttgcatctttaccagggggatgttgggtgttggggaggaacaaaagtgggagagggtaagaaggggtgtgcagtggccccagcctgaggccgttccagtatggcctgtgccttccctccacccctccaccttgttggtcctttcctcgcttgttcttcctagctctgctctgttgttcaccaaacctctcaaggcctgacgctggctcctgggagggggacctgcccctaccacagaccctgatctcctgtccttccccagctctgctctgggctcaggcagtcctgacagcgtggcgaagctgaagctccagggatccccagtccccagcctgcgccagagtctgctctggggggatcctgccggaactcccagcccccacccggatcctccatctagccggggacccttacctctggagcccatttgccggggcccagacgggcgctttgtgatggggcccactgtggcggccccccaggaaaggtcaggccgggagcaggcagaacctcggactccagcccagcgtctggcccggtcctttgactgtagcagcagcagccccagtggggcaccccagcccctctgcattgaagacatcagccctgtggcaccccctccagcagccccacccagtcccttgccaggtcctggacccctgctccagtacctgagcctgcccttcttccgagagatgaatgtggatggggactggcccccgcttgaggagcccagccctgctgcacccccagattacatggatacccggcgctgtcccacctcatctttccttcgttctccagaaacccctcctgtatcccccagggaatcacttcctggggctgtggtaggggctggggccactgcagagcccccttacacagccctggctgactggacactgagggagcggctgctgccaggccttctccctgctgcccctcgaggcagcctcaccagccagagcagtgggcgaggcagcgcttcgttcctgcggcccccctccacagc

SEQ ID NO: 56526 - DNA, 1022 bp, Homo sapiens
caccagggggagtgagggaacgtgaggaggcagacttcagcaagaaggatggcgggccctttaatagagaaataggagctggttttgggtggaagactctgaacttagttgtggagtgctgggaagagagccaggtgaagtcccagcaggcaggaagccccacgcggcccaactacaggggtggccattcacagtgtattttctgtgagtggcaccccctggagttgtgcagtcacagcctcacactattgggaggggtccctctgcaggaaggaaaggaagcactggaaatcagagaggggtcaggcctagacatggagctgctggagtcttctgcacagctgtgggtttctcatcctgccccctctcttgtactgccatcccgggcttgtctctgctgagctcctctctctagctgtcatcttctcttccttccagttccctggctggtcccagggcacagaaggctcactgatcatcgccctggggaacgaggatgccctgggagaatactcctgcaccccctacaacagtcttggtaccgccgggccctctcctgtgacccgcgtgctgctcaaggttaggccgggggtgggcgggggcctgtggtgacagtgggtcagatggctggagatggtgctaaggccaggctgatgggggtggggtggggcagacacatggggaggggtttccaagtttgtttcccatggtggccacggcagcagctgcctgatgccatcccagaggtttctgcagaggtggtgctcgggaggtgggacatcagtcacacacatccagaagtaagatatcctgtttgccccaactctcactaaccttgaccgtgctgcctccctctctggggctctgggaggaagaatgttctgcagaggtttgtacatctctgagagtcctgcctaagcctgccagcccttactacaccaccattttcctccagcccctacccactggggaacagaaacagagccagagaggaattgagagatggagagagaatgaggtag

SEQ ID NO: 56527 - DNA, 1094 bp, Homo sapiens
ggcccttgggaggggcattccagaccgggggtgcagggagcaaaggcatggagatgggggacagccagctgcccatactgacctgaaagagttcatgagggctgacatatggaaagatggctggccacgtagggagggtttggatcgcaggggtccacagggctgggtttgagcttagtgtagtaggagccaggtgctgttgcaggttcctgagcagaagtgttctgtggctcaaggggctgtttctgtatgaatggccattagagtggcagctgcaggggagcctggagtcaggggctgctgcagcatcttgaggtgaggtattgggcacctgggttagggccagagacagagaagtaattcaagaggtgacaagcagggatacaaatggtaaatgagcagagttaaactgactcccccaaacacacacaccattcctaggcagtggaactgcatgaatggagttgctcttgatggaacagagagaatttggaaagaagaatgggtctcagggagaggatgaattcttgttacatacagggggaagcttctgcttccactccccaaagccctgtaacaacgagccctaagattccagagagcagagctgggaagagttgtagaggtgacctcagggttctgggaagactgtgggctgaggccaccttcctccccttgtgcatcccacaggacccccagtcatcgtggtgccccccaagaacagcacagtcaatgcctcccaggatgtttcattggcctgccatgctgaggcataccctgctaacctcacctacagctggttccaggacaacatcaatgtcttccacattaggtggggtcaccctcattaggaaggtggaggtggggaattcacaaacagtctctgaagagccgcttggctgggcaaggcctggacccctcctcacacatgccacattgcagccgcctgcagccccgggtgcggatcctggtggacgggagcctgcggctgctggccacccagcctgatgatgccggctgctacacctgtgtgcccagcaatggcctcctgcatccaccctcagcctctgcctacctcactgtgctctgtaagc

SEQ ID NO: 56528 - DNA, 1286 bp, Homo sapiens
ccactgattagtggcagagcagagtctaggacccaggcctcctcactcccagaacagtgctcctcctgagggggcttggctctcccccaggctctggacatccaacctgggttcagccccaggccagtgtgtgggggtgggttgacagaatcctcatttggcctgggtgcagtagacagggtggccctgggctgaggactcctatgaggcagggctggtgggtgggcagcaggctggagccctgagtggtctccctggcccttggacactgctttttgggctgacagccccactggggcccctgatgcctgtctcccttgcagcaccccctcaattccaggagacacctcctgctgtgttggaagtgcaggaactggagcctgtgaccctgcgttgtgtggcccgtggcagccccctgcctcatgtgacgtggaagctccgaggaaaggaccttggccagggccagggccaggtgcaagtgagtcctgggggtggacagagtgagccatatagagtgtgaagggaaggtgggggcctggcagtggggccagaggacagaggaggcaaaggccaggctggaggatgggccagaagaagggcttggcattgtttgccccgagcctggggtgctgcctccctctgctggccaaactcggaagtgcaggatctgaggctggcaggggaaaggactcttcctcacccactccttccctaggtgcagaacgggacgctgcggatccgccgggtagagcgaggcagctctggggtctacacctgccaagcctccagcactgagggcagcgccacccacgccacccagctgctagtgctaggtgctctctggcgggagggctggggtccagggttacctatgcaagggggctgtgacctgtggctgaattggttcacagcaagataggagggagatttgtgcctgagggcagggcccgtggaagctaagggggttcccaatgcaggctgttgctctgaaaccagcaccttaattttaaaaggctcagtaagcagacaaagcgatcttagtgcccagtagtgtgttatagtggaaaggacatgggtgcttgtgttaggctgtgagccagttaactccttgagtcccagtttcttcatctttataaagagactcatctctacctctcaggtgtgttacaagaatttacttaggtgcagctgagcccagtcactggcacatggtaattcctggccaagatccttcctttagaagggaaactgagaagcagaaggcctggactgtgccttcatagagc

SEQ ID NO: 56529 - DNA, 1070 bp, Homo sapiens
caggccagagccggctgagggagttgggacctgagggaggcccctgagcccattaacccttttactgcctcacagtgtggaaggggcctctcagcctttgtgtaggggactcggaactgcagttgctaagcaacaggaggtagaggttgctaaggacaatgctcttctgtcataagccctctgggcagtgaaggggagatgggtcggggactgttgtggggctggtggcctagaatgtgtgcggaaccctgagagagactgttggattagggaccacacagaagggaaggcttcccatctttgaggactctagaagcatctagtagaggagactggatttatcaacgatgccatggagtgaaagcaatataaaacaagctaggactaaagaggaggattcagttagctgctgtgtgtaaagcgccccagcctgtgcctgcacagtgcctgtgtggtgtgaacccatgaccaggcctctggagggaaggaaggttaggcttagtggacaccagctttcctaaggtgggtcttagaccaactcattaaaatggcaggatgggcttttgtgctgtatttcttgggattttcaagatgccccacacagcagaagggatgtgcatttttttctctgccctgagttgtttgataaaaatcagtgacctcgttctccacttagaactcccctgcttgctctagtcacctcccctcaccaccttttattcttaatcctctgcccagtcacagcttcccagaagccttccttactcctcttgcttcatagtgcaatgtctgggcgcagttagcaccattttttgaacttctttgtggatgtgtggacgtgaacttgcccatttaggtgactgtgggttccctgccttccgagagcttaagagagcagagactgtgtctcctgttttcttcacacgccgctgcatatgggaagatctgaagtcaacaggctttagccctgcaggtggagggaggcctccaggaggtgggcccaggactcaggaggactcagggctgccctgctggcgatcttcctgttctgtaacactacaggtctagca

SEQ ID NO: 56530 - DNA, 1039 bp, Homo sapiens
ccagtattggccaactctgcatgttgccttgtacttttcatttagatctggtggttctccggagagcagcttcctcgggtgttacatgagccaagccctcactgtacagaagagtgagagctgaaacctgttccctgagctgatcagaaggacatcccttggcccctccatctgggctcctgtggataggaggggctgggtgagcaggccagctgggctatggtgtggtgcctcggcctggccgtcctcagcctggtcatcagccagggggctgacggtaagctgagctcttgggctcaagaatgccctgttagccttggggtgggtatgggggtgttcctcaagggttcctctttgagcatgtgagggcaggggaggaatagggctggttctggagaagctgaactgggggtttctccagtcacccaaagtcctaaggtgcctacagagatactgatggcactccccctcccagcactgaccctagccccccgttgtgccctcatgccacccatcatgcaggtcgagggaagcctgaggtggtatcggtggtgggccgggctggggagagtgtggtgctgggctgtgacctgctgcccccggccggccggccccccctgcatgtcatcgagtggctgcgctttggattcctgcttcccatcttcatccagttcggcctctactctccccgaattgaccctgattacgtgggtaagagttctcctcaggtgggaggtagggaggtatcagcaagaaaggtgggctgggtagagtcgcacaaggcctcctatgaacggctttgtccctgctctgatctcatctccagctctgctgccttaactctgcttaataagcatggctgtgctcccaagcagtgttaattcattgaaagattcattcatttacacacacacacacacacacacacactcacactcttatagctgtgctatttaggactccacgtggtctgttccaaaggagatcctgcagccctattccaaatatccattctaattctgtaactgctttttctaca

SEQ ID NO: 56531 - DNA, 1252 bp, Homo sapiens
agctcattctcttaggacattcttagaagttagaaacatttctgctgggatcgttggagggaacttcaaactttggaatctttcctgcaagaaattctttaccaaagaaaggcaggtgtttcttaaagggatgcaaaagatattttgcactttgtatgttccaaaacatttagtaagttaactaaaaaaatgagttaatttggtttcttgggggattttaattttttaatttgttttctggttatgtaaaaaaaatgttttttttttgcttcttatcacaatccttttgtttcctttttaatcctttaataacaccttcaaattttataagactttggcttatttcctatataattctttttttcttataccacctcttaagattgatatgttcatttgcaggtaagcattaattattagataaagagggatgattctcaagattgtgtgtgttctgaacagagggaactacatgacattttcttctgtaattgcctttgtaacgtctttagaatgtggttcctaaatattcctggataaattctcttgataggcccattggaaaggctaatactcccacccagtgctttgttccttcctggcaaaagaattcctaaaaccactgattttagttactgacttctcaccatctggactcttacaagatgtttcagaagttgtgtagaacttgtctttcagttgacttgtggctgaatttactgttacttctctaatatcagttgttttctgcattaccaccctctcccctaaccatctgtactatgaatggaaaaggaaaaagatggaaaaattatacctaggattgtccctaaatgcaacctcttggttccccccacccctcatgttttattataaacgattttaagagctgggcatggtggttcatgcctataatcccaatgctttgggaagctgaggcaggaggatcacttgaggacaggagtttgagaccagcctggacaacatagtgagacccccatctgtacaaaaaaaaaagtgctacttgggaagctgaagtgggaggaccacttgagcccaggaattcgaggaggttatagtgaactatgattgtgccactgcactccagcctgggtgacagagcaacaccttgcctctaaaacaaacagctccaactattttatttttttatttttctgagacaagatgttgctttgtcacccaggctggagtgcagtagtataaacatggctcactgcagccgaactcccag

SEQ ID NO: 56532 - DNA, 3037 bp, Homo sapiens
gtacgggggcggggcttcatgccggatgtgatagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctccagccggcgtctttggtgtggcctttctagccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctgcttccagatcgcgacaatgacaaaagcctccgtcaattccggtacactttccaggcttgtttgtacgagctcctgaaaaggctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttggtacctctgcttactgcctcttgtgatgccactagtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaatggaaaggctgatgaaactatcagatactaaaacattcttaaaatagaggaatatagttagagacatcaggtttaagccagtatttgttcctgttttacaatgcttctgtcttaagctgtgtcttaacttttaacacccatcttttctttctaaagctttcctgacagctgtgaaaatccaaaaaatattcttaaactgtgtatggtggcccttgcctgtagtctcagcactttgggaggctgaggtgggagggtcgcttgagttcaggagttctagacccacctggggcaagatggtgagacctagtctcaaaaaaaaaaaaaaaaattagccaggtgttgtggtgcacccctgtagtcatagctgcatgggaggctgaggtgggagaattgcttgagcccagagcaagaccctgtctcaaaaaaaaaaaaaaaaaaaaaaaggaaaggacaactttttagatagaaaagtattaaataatactaagatgcttagtagtattattttagagagttttaaacttctatattaaatgtggggtcttacaagataatccaaagactttgggaggccaaggcgggcagatcacgaggtcaggagattgagaccatcctggctaacacggtgaaacccctctctactaaaaatacaaaaaattagccgggcgtggtgggtgcctgtagtcccagctactcctcgggaggctgaggcaggagaatggcgtgaactccggaggtggagcctgtagtgagccgagatggcaccactgcgctccagcctgggcgacagagcaagactccatatcaaaaaaaaaaaaaaaaaaagataatccaaagaatttaaattgtaatcatgtttcatgtatttgttttattacttacttttatagcacttagtcccagtggtattagactgctatttggtttcatacaaaaaggattaaatttaaattcattcatgtttagacttgagttattacatttttaaaactatcatcttgcctttaatgtttgtggtcctacacaaactattagtacatttcagtatcctcttacccctttgtttttaagtttttgattgctaaagcaagacttttttcttctagaatttaagtcaaccaagtgttatctatgttgtaaaaatggataatagtagattttaggtgataaaacaacttgttagtaagacatttcctagcttaaaaaaaaaaatcaaaaattccatgatagaaatgcagacctgtgagggaaactcctgaaaagcataagaagcatcccagagagccatgggttttctagaccagagaatttagagggagattgtggaactgaggcttaggtggtcagatcg

SEQ ID NO: 56533 - DNA, 1048 bp, Homo sapiens
gagtttaactttgggcccagaaactcaaccatcaatggaaacagggcagtgacaagtggagggggtgtctggaagctgagcaggcccgacagagagatgaagccatcagaaggacttgagggggctcctggggaggtcggggggaggtggagcaggaagagttttaggggcaaaggacagaaccccttgtaggactggaggcaagattgaatgtgggagaaaatcggagagaagcgataggagttagaacatctggatgtgtctgcagcctgctgtcagcccaattgggccagggggtcccaaagacgcatattctcaccccacctccacctgcttcctgatcacatcccagtcaccagcggcagcttcctggatagtgagggagaacaactgcaagttgagagaggcagaggggtggaagggacctgaagctggcctggagaaaagcataggcccaggagagcctgccctgggacagcgcctgtctcccacacagcagcactggcccagcaaggacctcctcccttggccctggccacatcccactcctgccctttcataagccccctggggaaagcactccagtcttctctgttccaggctgggcagatagggtcctatggggcacagccagggtcctatgggcatagccagggccctatgggtcctctggaagcaagaaagggggccatggaagcagcccagacagctggggttcactcagagaggacccaagtcccagtcccttcctttcagtcaaaacacggatatctttgcctcaggtcacagggccactggggccctgtcatcaaagatgagattcctgaagcctggcattgactggtcccctaagaacagatgttgggatggagaatggggattcatttgggtttcagtaaaacaggggggtctggacaagagcgggtgggctacttggtatccacacacacgcactcacacaggagccaacccattgcagctgaacaagcagagaaactcagtctggaaaggcccctcctgcctgctgaagtcactgagaccctgccac

SEQ ID NO: 56534 - DNA, 1197 bp, Homo sapiens
caggctccccagctctaagccagggactggggcgtagagaggacccactaaggtgctgccccaggcactgctcggcctcccggggcaggccacacatctcagctagcatacccacgtactggggtcgctgcaccaaatgctgcgactcctttctgccccacactcagctccaggcctggccttgggtgcccgccctacgagggcagtgcctgcccagcttcataattgccccagagttggctggaggcccagaggccagttctgcccacgatctttgaagtaagtctctcccagttgcgctccacgcacttcatcaactgggggcagttccctctctcacccccatctccaccctgggttgggtccctctttgcccttcttcctgtctcccaaatggcacttggctctgcagccacccatcagttttcacaccgcttagttccagcttccttgcctcaggagaaaccaggttccatggagactgatcctgggatctccaagcaccttgtgcctgctgtggtgggtgttcatggtggggtgttctgggccaatcttgcatggatgcatggggataatgacagtggaattgtttttggcctgaactggagggctccctgtaggaggtggtctggggaagagtatggcatggagacagtgaaactgccagtacagatgttgatgaggctgaagcccttgaaatgagagtgaagcgtgggggtggggatggtgacttcagagctgctgtcgtcaaggcagaggctgaaggtagccccagctgcctgtttctagaccagagctccacagtggcaccaagcaaagccttcccctgctgcaggtccctgggccctgcagggttaggatgagtcctctccctggtccctgggcaggtggcaggaggatgtacagagaggaaggcgctgtggggcctgggttgcctagcacttggtgtgttttccccagtgggcagcatggagcagggaggagcccagggaggtggggaagtgctggcctgtgtttgaaaaaggagcacgcagaggtctgagcacccactgcctgtgggcacttacattcatttcacaaatgaggaaaatgaagtaacttgccccagagagcacatttagtgagtgttggggctaggatttgaacacagatctgattccaaagcaggcctctttgctgtccctttccttgctgcga

SEQ ID NO: 56535 - DNA, 1077 bp, Homo sapiens
ggaaggtcaggtccctgaaactctttctccttaccagctatatctgggtgtggtgctggcagctgtggtcattgtcactggctgcttctcctactaccaggaggccaagagctccaagatcatggattccttcaagaacatggtacctcaggtaagatggcagggctgggctctgggctaggctgtaaggttttggcaagagtccagctcatcttttgtcagctcccaggctctaagatagagatggacagaaaagatcctccagctttccatgccagcacctaattgtttatggggcttctccttctgcttgacggtgtgggagaccagcaggagaagaaggcaggggcagagacaagcatttcatgagctgcctgtggctccccacagcaagcccttgtgatccgggagggagagaagatgcagatcaacgcagaggaagtggtggtgggagacctggtggaggtgaagggtggagaccgcgtccctgctgacctccggatcatctcttctcatggctgtaaggtgaggaggtcataccagagcaagcagttgagtctaaggagaaggctgtgtgcagagctgagaggggcccagtgaggtttaaaggtggagagacccaggtccaaatgtcaacaccatgcctatgcccctgctaaaccttctctcagtgtggggtgcttgtgcagtgcctccttgcatctgtgtgttatgaatgctctatgccccaggtatttctttgttgtccactttttagcaatcatgtattgaataccaattatgtgtcagctgctttatatatgttcgatgtgctatctgatgtaattctgaaagagtggtgtaatcatgcagggctgctgaatgtggccacacacgttgcatcctgaatgaccccaggaggtgcattttcataactacagtgttagtgtctccccctgtggttgtgcaaggcagagattctgtttacattcaccattttacagttgagtacatggaggctctcttggttaagcaagtaacccgaggtcacataagaagtcaggaggagtcagaattccaaaccagggcaggggcaat

SEQ ID NO: 56536 - DNA, 1063 bp, Homo sapiens
ccagcacgtggctctgggggctgtcttctcgctcgtggatagacagctggagagacaacaggtagttacagagagggccatacttgtcttggtagcgcggcatagagcagcagctggtaaggaaaccaccttagaaaagtagccccaacccatcaaagattgtcaacaaagagaatctccttgtgcaggggggtgtttagacctcacagttccaacacttgtaacctgagagccacctccgtaggacagtctttcattcaacaaatatttattgaggtcaggttaagacaggcactgtgctaggggctgaacggctccctcctcagcatccccaccaccacctggcctcagggggctttacctctatggataataaggaatgctgagattgcattcttggcatttaacaggtgcctaaaggctaaggggcaccataaaggaattacagaattatggtttcactgactggggtagaagagttggaaggctaggccagaggatgcggagctatgggaagaagagttgagagagtgacagattgtagtaagggatggagtaaggtttgggagctggggctagttgcaatcagacatgcagtcatatgagctgtcctgggggacttagcagggggagggaacatgaccctcagacacccccactcctgctagtgatgattccccttggctttgtccaccctcacccatttatatccctctctcttcctctgtcctggcaacccaagcagacctggtacttgttggtagagttgaaaggaatctctgccaccttggggtttctgtctctcattttcctcactgagccacaggagagctcaatgcacttgagcagagctgactcagaggcatcaccagctgtgtcccgctgccagaagagacaagaattcagtgtcagcatgggagggaagggagtggaggatcaggtgaaggcggcactgaaacccccaaggcagccacatcatgtgagaaggaaagctggggccagcaagaggctttggagacacccccaaaacatacctggtgtgtgtcctgaccccctaccttag

SEQ ID NO: 56537 - DNA, 1181 bp, Homo sapiens
aatctgtcactctctcaactcttcttcccatagctccgcatcctctggcctagccttccaactcttctaccccagtcagtgaaaccataattctgtaattcctttatggtgccccttagcctttaggcacctgttaaatgccaagaatgcaatctcagcattccttattatccatagaggtaaagccccctgaggccaggtggtggtggggatgctgaggagggagccgttcagcccctagcacagtgcctgtcttaacctgacctcaataaatatttgttgaatgaaagactgtcctacggaggtggctctcaggttacaagtgttggaactgtgaggtctaaacacccccctgcacaaggagattctctttgttgacaatctttgatgggttggggctacttttctaaggtggtttccttaccagctgctgctctatgccgcgctaccaagacaagtatggccctctctgtaactacctgttgtctctccagctgtctatccacgagcgagaagacagcccccagagccacgtgctggtgatgaagggggccccagagcgcattctggaccggtgctccaccatcctggtgcagggcaaggagatcccgctcgacaaggagatgcaagatgcctttcaaaatgcctacatggagctggggggacttggggagcgtgtgctgggtgagaggccagaaacaggaggctcagaaggggattcccaagcctctgcggcatccctggggtgggggactgtgggggcgtccaggaagccactctgcggatctcactgatcccttctgcccccctttaggattctgtcaactgaatctgccatctggaaagtttcctcggggcttcaaattcgacacggatgagctgaactttcccacggagaagctttgctttgtggggctcatgtctatgattgaccctccccgggctgctgtgccagatgctgtgggcaagtgccgaagcgcaggcatcaaggtactggcctcccatcctcccctccattctagcctcccccatgccagagttcaaggagctgcagtggctgctgccctggaaaggcccaggccacggtggcctccttcccactgactcagagaagaagctgtccatctgcaaggaaaggcccacccctgccttggggcactcacccttatcccttttgctca

SEQ ID NO: 56538 - DNA, 1010 bp, Homo sapiens
agacggggtttcaccatgttggccaggctggtcttggactccttatctcaggtgatccaccagccttggacccccccaaagtgctgggattacaggcatgagccactgtgcccagccttgttttacttttaacagggataatgatgcctgcctcggagacagagtggttatggggttcagaaaccacatacacccacagaaacaagtctcctggtatgatagttaagaaatagcagactgccttggttcaagtacctgctctatgacttacactagctgtgtggccttggcatgttactttgtgcctcagtttccctctttgtaaaaaaggaaaaatactggtgcttattcacagggttgttgcgtagattaaatgaaatcatagaggtttagtgcttagaatagtgcctgatttatatgtgtcctccctggcacagctcattgtcccatctagatgtgtcatgtgacacaaattgtttactatgtatcaggcactgtgcaaggtgctagagtttgcaccttgcacagtgtctgaaacatagtaaacagtaaatatttgttgaatgaagaacaaacatagcacagaggagggagtggtcagtgagaagcaattgtagttgaacaagagaaccttgagtgggaggcattctgtggggttatgggctgagccactgggagcatacaagagcctgctaatcccatcctaagttgacagagagggtgggcagtagttgggaagggtaggacaactaggtcttcaagataggagtgccagattatgcttcaaatcagaatggaagggtacacatgcagatgggacaaagagctgtgccagggagggagaggaggggcatgggacactggcctctctgagcaaaagggataagggtgagtgccccaaggcaggggtgggcctttccttgcagatggacagcttcttctctgagtcagtgggaaggaggccaccgtggcctgggcctttccagggcagcagccactgcagctccttg

SEQ ID NO: 56539 - DNA, 1026 bp, Homo sapiens
cacacatcccacacacacacatagacacacacaatccccaccccccacacacacatctcacacacacgcacacatacacaaatccccaccccacatacacacacacacacataccccacacacacacacacatcccacacacacacattccctctcacacacacacacaatccccaccccctcacacacacacaatccccacccacacacacacacacacatcctacacacacatacacacaccccacacacacacacatacacacacacacatacaccccaccccagccactcccctgcccacagacgcacacacacatgcccttatttcggttgggatctgccatccccagacatctcgctatctagctttctcttactttgggagaggaacaggagggggataaacccttaatactactttcctgttgtctcctctccttcccactaggtgatcatggtaaccggggatcaccctatcacagccaaggccattgccaaaggcgtgggcatcatatcagagggtaacgagactgtggaggacattgcagcccggctcaacattcccatgagtcaagtcaaccccaggtgaggcctctgcaggaagcccctgtgccctaatcaacacgtcctcttgcacagaaggcttgggtgtcccctgggagtatttggatagcatttctgggacctttataggccttacctctgacactattgtgactggttcctcagccctgagcttgtatccaggctgtgccactgaatacccatgtaaccttggagatgtcacattcccttcctgagcctccattttctcaccacaaaattaggatgccatctccactgctgtaggagtgggatgtgagtaaagaaactagcccagggcctagcaaactgcacttacaactgcgatgatcccatggtgaggatttagactcacattctcaaagagaaatgggggaagtgagtactgaggagaggagaactgaagcaacaggggaagcaggctcagcagggagcctgcag

SEQ ID NO: 56540 - DNA, 1433 bp, Homo sapiens
cagcccactgcaccaccacgatgctggcaaagaatgccgtgtggcacgtgaactccaccaccttccgctgctcataggtctggagggagggtgggcagagacagatgagagtgtcggaggaaagggtaggaccagaaggtagcatggtttctcctgatccacccctagccccagtcccagttggccaccactggccactcctgccaggcattcagcttcccgtaccttcacacatgtgcgctgtgtttacacagcaccactcacccactcctgtccatagctgtcctccagatcattcatggtccggtcatcccagtcgaggcggattcccagtagccgtgatggcaggaaaccgttctctgccaggatcacaaagtaggtgaagaagccacccagtgcctggatcatccctgtgggtagagggccaaaggcaggggcagggtcagagcaggaagcagaaggggcacagcccctcagggccagagatggaggtccctgacccttgggtagctggcctctgtcctggaattttgcttggggctcattcctctgaaagctgggaaaagaaccctgttggggttccctcccgaggcccggggcttggcgcaccgatctgtccgtaggccatgctgatgagcctctcattcaccagcttgtccgtctgggagtttcgtggctgccgcttcatgatatcactctcagctgcctcataggccaaggagatggcagggacctgtgtggggtaggaaatggggcagggagggcatttgaagggacgtaggagatgacagaagcaattgatcttcgacagtgacgatcgttgacacagttaaaaaagcgtgtattcagaccccattgtcttccaggcctgtgcctgtctcctgtaacccccacagctggggccactgccccagtgcacctctcctccctgccactgtgccatcacgattgccttgcctgtcccctcctccacctcctgcgctcaccatatctgtgcccaggtcaatgcaaaggatggtcacagtgcccagaggtagggggatgttggcaatgatgaacagcaggaagggggtgatctcggggatgttgctggtcagggtgtaggcgatggatttcttcaagttgtcaaagatcaggcggcctgtggggagattctgagggcatcagggaggtcagagggactcttccccacccccagcccctgaagcatggctgcctgtcttcccaagagaggaagattttgtgttcaagggaagctaaagtgggctgggctgcctagagttgtggaatgattcttcaactggggtaaagggacagggaacagaggtgccggcttcagtatcctgcaaaccatcccaacccatgcagcctcctcaccctcctccacccccgtgacgatggaggcaaagttgtcatccagcaggatcatgtcg

SEQ ID NO: 56541 - DNA, 1004 bp, Homo sapiens
ggttcctacaggagatagctttctttcccttactccctatctaacacttttgctctgcaggcagccttgcccattctctaagcctggcttagaaggcactgggaatgtcctgtagagagagacctagataggtcatgcaagtgagaaagacatctgaggaaaatggaagacctaaggcagacaggaaggaagcacaaaagacaagcattgggtcagacccataaaccacctcccaaaggctgtcatttcattgcactggaattttgctttatcagaagcaaggaagtaagggagtcattgccttgggcctgggaatctaagtgggagacaatattaatttggatccgattaattggagattactaactgtggacaaaagtttatctttgcacaatcaataaaaatggcatttttttagtaaattaagagcataaacaatattgctagaggtggcatgtttagtctaccaaaaacaatacttttcaggcactttagaaatatccttttagaagcagcgagtgcatgggctaattatcatcaatctttatgtatttgttaaagaaacatctacaggatctttattggtgaccttttgtaagacattagtttgaggtactacctatgtacttgaaaataataaagtggcatttctttatgaaaaaaaaagaaatctcttccataattcagatttctacactttatacttgcctccctcctaaatcgtgatattgaaatatgtgctgtggcagaactcggcttgtagggaaagcaacaaagagatagcaagtgtcagggatgggagggaaatggtctgggagcagatgatgtccgtggagaaagcaagaggggaagaagttaggttgcaaaataacctacaagaaactatagcaggagcctccttcctcatgctgatcccaccctaagagccacaagagtttgtccaggacagggaggggcctgtgagtctattaagaacaagatcctcaggggcacttctgcttttt

SEQ ID NO: 56542 - DNA, 1029 bp, Homo sapiens
tagatactgaattttactgatagcctcctcaaccttttttgaaatgattatttcatcctttgtctagttaatgttagttgtttgtaacattttccttgtaatatgctatccttgcattccaccatttggggtagtcaatttattatctatattaaatataaaattttaacaaaatagtacttatctcataaaataggctgggcaacacaaaacacaaaataattttttatattccagcacattttaaataatataaggaaattctttgaggaatttgcaaaaaatccttcattgaattcactggagccaaggatatttttgaaagactcactttgtattaaatgtcttcctttgatattgatctaaccactttcttcctattttttgctgcgttcttagcattatgaatatttagtgactatctctgattatctctgatgcatgatcacatttcctattctgtagataaaaagaaaatgccatggaaagactttctgcctgggtcaaaagttggccttagcttctcagattacattcaatagtaagattcttctttttgctaaaatcctctagcagaccatcaaatctctttggatctttttctttctttcttttcttttctttctttcttttttttttttttttctgagatgaagtcttgctctgtcacccaggctggagtatagtggcacaatctcggctcactgcagcctctgcctcctgggttcaagccattcttctacttcagcctcctgagtagctgggattacaggtgtatacccggctaatttttgtatttttagtggaagacagggtttcaccatgttggccaggatggtctcgaactcctgacctcaagtgatctgcccaccttggcttctcaaagtgctgggattacaggcgttagccactgtgcctggcctggatctttttcttaaccccctaccgcatctttgagatcatatcttctccctttctcacggatctgccttgcccctgctgctcaaatgttaattgtccacaaattcc

SEQ ID NO: 56543 - DNA, 2001 bp, Homo sapiens
gggcaacacagtgagacctcatctctattaaaaaaaaaaaaaaaaaaattagcctggggtggtggcccacacctatggtcccagtcacttgggaggctgagggaggaggatcgcttgagtctgagaggttgaagctgcaatgagccatggttggaccactgcactccagcctgggtaacagagcaagactctgtttcaaaaaataaaaataaataaataaaaattctaaataaataaaactttgtttttagcgagcataactccctaaaaatccaagaaattcagccaaaacaaagcaacagcatcaataacaaaaaaaatcctagaagcaataaattcaaagttacagggtatatgggtatcagttttcaaagaagcaaatgtatccctaaatattagggagacagaaaatacagcataaagagcttctatttacaatagaatgaaaacaaattacgctcaaggtttactgtgtgcagcacatagtaactattaaagaaaatttaaaagtacaatgagaaaaataaaaaaacatgaattcatggaaagctaaacttgactgccatttgggaaggcagaacgtagtaaagataaaaataagttactatgaaagagtcaattcaatatcaattaaaatcctcgctgcatttttataaaacatgacatattggttgtgacattcagctgcaagagtaatcaggcaagaatctcagaggttttttctaagtaattatgaagcaaatgaatagatcactgatgctaacatatttaccccaacagattttaaaacacatcagaccactggccgggcgcggtggctcacgcctgtaatcccagcactttgggaggccaaggtcggcagatcaagaggtcgggagttcaagaccagcctggccaacatagtgaaaccctgtctttactaaaaatacaaaaattagccagacatggtggcgcatgtctgtagtcccagctactcaggaggctgaggcaggagaatcgcttgaacccggtaggtggaggttgcagtgagctgagattgcaccactgcactccagtttgggcaacagagtgagacttcgtctcaaaaaaaaaaaaaaaatcagaccaaagtggcaattatcaaaaccttgtagcattaagataaaacctgaaaactcattagtcattcaacatctattcagggactatttgtggaccagctgccctgtgccaagcactatcctaggagccaggtatatagctgtggaaaaaaacagggaaggtccctagggtcatggagaaccagacaagtcaacaagacaagtcaatcagacaagtcaacagttaacaggcaggataatttcagagggagagaagtgttgtgaagatcaaaagtgatagagagagggctggcgccggaggggctgttttggatttaactatgagagaaggcctctccgaagaggtggacttttgagctaagatctctagaacaaaatgaggtttctaaaaataatttcaattgattgtatctccataaagttgcttttgggcaatgcccatctgcaagactgagctaagtgttattgtcacatagatgatgcatagaaaaacatatgaattttaactttaattctaaccttcttcttaagaattttatgttcatctacattaaacacaaagactgggagaaaacatttgtgttatatatgacaagggtttcctacaaatcaatataaaaaagaaaacaatggaaaattgggcaaattgtaagaatgacaatttacaaaataaataaataaagtccaagaccaggcatggtggctcatgcctgtaatcccagcactttgggatgcccaggcaggcggatcacccaaggtcaggagttcaagatcagcctggccaacatggcaaaaccccatctctactaaaaaatacaaaaaaatcagctgggtatggtggcgtgtgcctgtagtctcagctacttagaaggctgaggcacgagaatcgcttgaacacagg

SEQ ID NO: 56544 - DNA, 1006 bp, Homo sapiens
cagatgagggacaacactcagcacatggccattcccaagtcatttaacctctctggacttcaggcttttcactgatgcaatctgatctcttctagcaccacagcgctgtggtctgcaagctggtctcaggaactgcaaggtggggtcagatgactccaccccacctaccccctgtgcggatgctgtggaccctcttcccacgtgtgacttagctgctcctctctcccccaccttccatttctctgatctcagctggaattttgaggcagtcatttgccctgtccttgctgtccagtggctcggagagtgactttaaagggcaaggatgcttgatactgatcctatcccagccttgactctggtccttaaaacacttccccagcctggtcatcatgaagacctgtggagggagcttcacagtaatccccactcccccaagatcagatttgacacatccagctggtgagggcttttccagacatttactgtctagactggctacgggattcagcaggaccatgcccctccctgcggggctccagctagatgcaggctgggcttcccttcagcccacctcatcctctgcccatgattccctcaagccagcccaggattgcccatctttctcatccaagataattcatcctagtgtctcagatgttgtgtcaaacttataatctctggccccatcccagctctcacaacacccctgtgtcacatgaagctcttcatctgctgagtttagtagtacgtctccctttccacccagcctgtggaagagaagaggccagcgtgaactgggagaaggaattagaggcatccaggggagacaggcagaagggaaagcagggacaaggttggaggtgggaggtctggaacacagggcactgagggtcagatggagcagaggggtgcagccaaggggtagagaggtctcggctccaggcgcagtcaaggctggcagcgaggaggggagaaagtcagtggtgggtctggagggactagg

SEQ ID NO: 56545 - DNA, 1220 bp, Homo sapiens
atcatcccccactatcgtccccaattctttgcaggcagggttcattttgagacccaccccttctagttcttcgagagtgaggggaaggtggaatactggaggtgcttgtctgggaacccccagagtacagggaggtcagagctgttgatggtgctgaccacggctggaggaagaggtgggaagtgcagaggtagaggctgagacactgggtgatgtggggaggtgggaggacaggtgagatggggatccagagaggggcacagtggagtctgagggttacccacgctctgagtctttgctcttgaagtagccaatgagtttgatctcatcctcaatattctcaaacgcctgcagctctcgttcaccttcaatcaattccacagggtcctctaggacctgaaagaggaggacattgcaggaagagagtttctatcctcaagtagaaccagaaagggacctagggaaaagaaggctggggaactggaggagggggctagatgttgacagtgtgtgggtgtgtgtgtgggggattgcatgtgcgtgtgtgtgtatagtgtgtgatgtgtgcagtgtgtggtgtgcatgtgtggtgtgtgtgtgcatgtgatatatatgtatggtgggtgtgtggtatgtatatgatgtgtgtgtgatgtgtgtggatggtatgagtgtggtgtgcatgtggtgcatatgtgtagtgttcggtatgtaggtgatgtgtggcctactgtgtacatgtgtggcatgtgtgtgatgtgtgtgaatgtgtggtgtgtgtacgtgtggagtgtgcatgtggtgtgtgcatgtgtgtagtgtgtgcatgtgtggtgtgcaggtatgtatgtgcatgtggtgtgtgtgtgcgcatgtacggtgtgtgtgcatgtgatatatctggtgggtgtgtggcatgtatatgttgtgtgtggtgtgtatggatgggtgtgtgtggtgtgtgttgtgtgtgtggtgtgcatgtggtgcatatgcatagtgtgtggtatctaggtgatgtgtggcctattgtgtgcatgtgtggcatatgtgtgatgtgtgtgcatgtgtgtagtgtgtgtgtacatgtgtggcgtgtgtggtgtgtgcatttgcgtggcatggatgtggtgtgtgtgcatgtgtggtgtgtgtttgttgtgtatgtgcatgtggtgtgtgatgtgtgtggagtgtgtggtgtgcatgtggtgtgtgtg

SEQ ID NO: 56546 - DNA, 1028 bp, Homo sapiens
aaatggattacctttgggcatggggacaaggattagccttcagcccttggtctagaaagagccagacccaagatggggcatcaggagatagctggcactggatcaggcagagcagaggagggccggctgatggcgaggaggggaatggggcctaggactctccccagcccatctctgtttccactcttctggtgtggcactccctgcttctatttctgtctctctccatctctctcactctttgtcatgcatttcctttctacttcatctttcagtctctcttttcctcctttctataggctttcaccccttctagcatttcctactcacctatccaacttagtggtagccatgaatacttaggactcctgagatctgtgcttcactgtccccatctgaatattcggagctgcaattaggaaggggtgagcatccctgctacaaaagacagagtaagtttggtcggagtggcttggagattcagtggttggctgcctaccagctggtgaagatatccatcatgacattgtgcgtgaggatctgtgtgagagagtgaggcgctctgtgattctgtgaccctcttcatgcatgataatacatccacacatgatgggcacggaattgaggaagtaggcaaccagggaagcctgcagcctagggcatcactggcaatttccccaatggagtatttaaccacaaagggaagagcaattaaagctaatcgctctgacagcctggggcccagacacacgtaccactttccctaactcccagtggtctcccccaaccttcatcctccctaatttgtttagtgcactctcaaacactgtttgcacttctctgaccatctctttctctcacttcctccctctccctggttccctgactatctctagacctctctggagatgtctgtctgcttctcacacacattcctctcattctctctctgacttgggttccattcttggctgactcatacccattctttttcctctccgtttcttccaccccctcctcctccatcc

SEQ ID NO: 56547 - DNA, 2359 bp, Homo sapiens
aactcatgtgttctagcttccccattctgcctcaaaggcaaaggggtccctcacttcaactccccaccaccccactaatgactcattttggatagatgcctagttgcttggtctgatggttccttggccccaccatgctagccttgtattcagtcattagggttcgaggtgggggaagcaatggaccacccccacctttgtggagcccattttctcctttgatggttaccaggcccccactcagctctctctcctaccctttgtgctgtgcctgcagcccccgtgcccaagaataccaagcaactggctctggccccctgcccagttcccaggctggctgggtggtggggggaggggactttagatgcggctttgggagaatggcaaaaggggactgcccccccttctcgtatcgtatcaacatcctactggcactaccttcagcatggtctgatgagatcagcaaggccagatctcacctaggctttcaccctatccctctttcatgatccttaggtgagaagtagagaacattcaaggccttccttccactaagataggaactgtggctaagacagaagaaagaaggtcagatgtttgaatggactttctggatttgataaaatgtgacactagtggtaagctcaaaaatggaacttatttccacaatgagtatctatttccttttagtcagaaaagtaaagcatgttttaaaaagtaaattgtatcataaacactctgtatgcgactagaccaaggggtgggcaagcagcaagatgaccttgtccctgacggaggctgcctgcaaatcaccccagcattaggctgggaatgtggcagatcaaaggggcttggttgacacattcacattttccttcttgctctactgcaggggaactgagattggcatggtggtcacaaaataagagatacagacccagaagtccccattcccagccccctacctggaccagaataaacaagcctcccttggtggcaggcaccatgacacaggcagacaatgagccagacaggagggctaccatgacccccgcaagaaacaggcagtcataggcatgctcagttgcacacccaggtgcaaccagacagaagggcccagcagtggccctgccaggccgggccaggaacaatgctctctgactgtcagcaccaggaactgtctctgccttgaaatctaggtcacagcagcaagctctggagcccaacccccctcacttcactgataatccaaggacagaaggaggggggtacgggtgagggggatgatggggaggggactagagatggagataagaatgagtaggggggcatgagtacaactggaagggaaagcgcagcaggagacaagaagaccctgccccagtggaggaaactctggggccaagccctcagctggaaaagggggcaggattgggggttatacttccctgctttcatatggaaggagagtttgtaaatattacagatcctgcgggaggaaagagtgcatctgtgtgtgtgtctgtgtgtgtgtgtgtgtgtgtgtgtcgggaggagttcagatttagggctttgaatctaaaacagatctacagaggaggtaggcgggaagagattaatgtgtgtaacacactcacccacaaagacttgggggcagtgggtaggagctttctaagagagtgaaagatacaaggaggcccctaagagagatgggggtaggaatgttaaagtggcagaggagaaatgtgtgtgtgctcggatcttatggatgctaatccccgggttgtgggcacagctctggaggaggcagtggctgggtatctgtgggtgtgtttggatgttctggtaatggaggtgtatgtgccagcactggatatatggctgtgggtgcactggctgtgagtatctgtcatgtgtgtgtttgtatgtgtctaaaccagccaagagcatgtgtaagaaggcatataaccacaggctcacatccagaggggtgaggggagcctacagaatggagaaagagagctggagttgggagacagaaagagactaaggctgcaaatgaggcatggggggcgagggggaggagagcatacagtccacaactatagaaggctgtagcctcatctcatctgttactatagcaacctcagttctgggtgccccccacccccagtcgttaggatgacaccactagatgggaggagtgtagggaatggtgagtaagaagggacagaaaggataggaataaggccccctgacggtacaaggaaaggcagcccagttgcctcccttcttggagagatccatttgcctaggccttagtatggcagaagaagcaaagggagtgttgtttagggga

SEQ ID NO: 56548 - DNA, 1093 bp, Homo sapiens
agtcattcaggctcagttcattcagcaaatagagatgagctcaaagcttttacatccacaatgtgtacccctctatagcaaggcagaagagaggtgctctaagagtatgggggccttagacatttttcactgtgcccctcatcggtaaaaaatgttattcagatactcctgtgctattatcacatatacaacagaacataaaaacaatctaaaaatagtaaaattttaagtggcaaaaattgggaagaattctagacaataaaaatggaagaatacctgaatgaggggagaactcgaagtgtaatctaactggtaaatagtaatactaatctttgttaagcattttttaaaaactggtaaaatttaaaactacaagttctatcattttcttatccactttgagagactactgcttggggagtgggatctatggattagagtaatccctcacagctggaggctttagggaagaattggtgtttaagatggccctgaaaggtgagtgggatttctaaggcaagatccaaaggagggcatgccaggcagaggaacactgtcacagagtatctagtgtgtttggaaatgcaatcagtcctgcttggcttgactaggatgtagggtgtttagaaatggctgggaaggtaaggtaagactgtgttgtagagagcctgggtattggataggtgaggtgagtgaactcagggcccttcagatatactattctgactgctgtgtggctggcagggagaacgtataaaggaggacgtgttacagttagactgtatggcaacagtcagaggggaggagccagggaagaaggtctaagggcatctataatctcctggaattggccaagccatggacatcgtccttctggtggtgtccataccttctctcatttagaataacctttctcaccaggcccagaatctctcctgggttgcctagagattccaccctgctggtcctacatgtgctgtcagcaaattctgatacttacttggatggaaagtggaaaaggatgggggtgggggtggggtatctggaagtcaagttgatttttcttttgtcccctccccacaacatatgggag

SEQ ID NO: 56549 - DNA, 1068 bp, Homo sapiens
acacgcgcacagtaagggggttaggaccaggttagtaagtgggtagatggtgggttgcccttgccccctctcctggaggatgggggaagggagtggtctgatgaaggtccaaccttcctcctcttcctcccccttgctcaggccttcttcggtgggggagccaatttgatgatctcttcctcagagggctgccggataatgtctgggggcaaaaaggtatgtgtccagggacagcagtgtgggagatgccaggcaggcccattgggcatctgcctccactctcccaaaactcaagtactccaaggatagtcaacgggacgaggcagaggtgcagctagttaaaggagtggccgcttacctttgtacttcttggcactggggatacgggttagcttggtgtccagctcatcctcctcagagatcttcagcacacgggttctgtagtcaaccaccatagtgagtaggtcaggacggcgggagatctcaaagatgtgctcaatgtaggagaggttgtctggaggaaggcaggagatagggtcagagctaggctgtagaggtcagcttcccctactccaccagactagtgacctggaaccaaagctgagttgctgacattggttatgggagggtacaacactggaggaagaggggctactaatccaggagaagaaagctaaggtacccaaacaacaatacagaggactgttcgcaggaagggcagatagttggtcagtgaagtttctagattgtggttagaatgaggggtttagcttagatactagctcccatatgttgtggggaggggacaaaagaaaaatcaacttgacttccagataccccacccccacccccatccttttccactttccatccaagtaagtatcagaatttgctgacagcacatgtaggaccagcagggtggaatctctaggcaacccaggagagattctgggcctggtgagaaaggttattctaaatgagagaaggtatggacaccaccagaaggacgatgtccatggcttggccaattccaggagattatagatgcccttagaccttcttccctgg

SEQ ID NO: 56550 - DNA, 2087 bp, Homo sapiens
cacacatacatacacactctctcactctgtctctcttacctttagctgcttgatcattaagccatccaacttcatgccagttcccttctttatagaagagtgaagggaaagacttcctgggtttgacttaaaccttgtccacctcttgatattttaggattgaggaataagtcattaatctaaggactgattacagtggctggagcttgggcacttgtcttatcactggtcactgagtctgaaagtcccagctgaattcttgcccttaagtgcttttgctgctatttttttgcccccagttccacaagatccaaccaagaattctgtatcctgggacagtcagattcttctaaatcaggccaggaaggaggggaaaagagtgagagaatggtattcccagatacttcttcctcctgccccttttcccagcagctctgagaccagatgttggctgctgtacttactccctgaggtagggaatgtgtggtgatcgagtggtctgtgttcctattgctggtggggtgatagggtgggctaaaaaccatgcactctggaatttgttgtattttctcccagtaaagcttttcttctcccgactgctgctctgtgtggtatgtggtccatttattcacaatggatggtttttgttcctactaatgtaggtacctagccttcccctctcattctgcacatgatacagtgttagaaagtccattttgggagacccgtatttccagtgcttgggctccaattggagactgttggaagtaggatacactccatttagctcagtgatacttaggagattgggtggggtgagggtatacacttggggtattttcccagcccttattctgggccataaatattgttccccctcccttcccagtgattcaaagcctgcaaaatcctggtcactcacagaaattttaaaatcagttagttgcaatacaatcaatcacctttattccgggttagaacaaggccgtgcacactgcagacagaagagcacaagataggggcaatctcacagcaatataaggagtgggtgggcaggttagtctttttagattattttgccttacagagaaactactagactctgctgaaaagaaccctgtctctcttctcccatttcttccataagaaaggctccttattctctctctcactctaatgtaacatatcccaaatggaaggacagttcatgctcattccccccacccaattctacaagtatctctctcttcttaagggagaagccagacagggaaagggagacttgggaaggtcctttaaggcaaaactgtggagtcctagaggtgtgtgtgttaaggcaggtgtctgcagcagtggccagaggggcagggcacgctaggctgggctaggagttaagagtactgtctaaccagtctggcttcttccttcttccagcagccagccctcccctcccattaaagttttactcccacatcctaaaagctcctaacttgaactttgtctaaatagtctctgagactgcatgtgaatttaatgttttttgaaaaagccttcttttttgtttggactatgtagcaatttgattctgccactcccttcactgtggcattcccctcccacccccgctctggcctagacaataagttaatgctagacaccacaaaaaagggcagacatggcagtgcagttttaatatacatatatgtagaatatatatgtacacacagttagcacggtcagggtggggaggggcatcttggggtaggcaggaggctggggtcactcactgtactgtagtgatgtggctaggaggtgttcacaagcccagggggccaggatatctagtaaagaagggtttcctaagtaagtcccttccgggattgaattggggtggggatcggtgcaaaggaaaacactgtagttaacttctttctggcttgggatgttcttcaccaaggagagagggaaggttgcctacaataaccaagttgggaccctatagatggtggtgtcaggattcgtgttaaaacctaagggtctcattcttcaacctccctaggtttagagtgcaacagtctgagtaggaa

SEQ ID NO: 56551 - DNA, 6210 bp, Homo sapiens
tcatggagggggacaagggaggcgtggtgagtatggtgtgctgagctggctggctccctaatctctccagtcattaaggtaggttttagcagggacactgaattctcactgtgactacatgataccatgttttagaggtccagccagccataaaagactagttagcctggaggtgctgagtttttgatggagtattttcttcctgttcctatcttctgtccctgtaaagcacagtttattgagacaagaaagggatcttagggaagaacctctgtcctgtcctgagtgatgtaacttatctctagacgtgcaccttttccaaatgaaaaagcgttagtgttcagggcgtaccctcctacacaaggctaaagatttctccatgtctcttccctttaaactaaactaagtagtgatcttggctggatcttagattagcagataaaagctataaagagcattttttggacagttgggaaaattagaatatggtttatacattagataacatggtattcaatattaaattgatttgattacttagaatattcttgtacttaagagatacatgttgaagtatttaggggtgaaatgtcatgcgtacattcaaatagataacaaacacatatacatgtgtacatataaggagaacgcaaatgtggcaattgttttttagtagctgagcagtctgcttgctgtataacccatgatcgtatcatagtctgcctggcctttgagttctgcagccctctgtggagttagggcaaaaaggaagagtgagaatcgagttagggaatgaagagcaatcagctcttaagatgtatctggttaaccttatctttttttttttttttttttttttgagacctagaattaggaaggagttcaatcgctttctgttacaaggtttttggaccacaggagatgggaaaaacacagtttggaagactaaattatactgattgcccagaatagtctggttatccaaggcctctaaggaatgactgagacagctaagtctctcttcctttttattccttcttagctgtggggaacttcaaagagcctagccatctcttgatgaggttttttcagagagtggttttagaatttagaatggttctttgcaatcaggatcccattccttatgtttttcttgccctggtgaaagggtatttcaaattttcttctggtttcctctaaatttcagggacctgggacctgcatagatctagggtttttatggtttgaatacaaatggagaggagtctagaagttcaaggtgtgtctcactcttccctgcttcatttccaactcttccataggtccccctgtgtcatctgcagtgaacaaacccaaaacacttgagtcttaatgggaattatgcaataggcatttagagaaaggaagtcagaaggggccagtgaattttttcttgacataagctattgccttgcattctgttccagagagatgcagggctgaatgccctctcccaggccagcatttgtccattctccaaaagcattctgcaggccagtttgcttttagctcagccaatgccagggtttgatgattaacccatttgcccaggtgaggaaggcatctacttgggatgggtgggccccaggcctaagttttagtggtcctaagagtaaatgagtagaataagagatatagaggctacccctgaagcaaatttccttacatattcttgtctctgtgtaagctgaatgatcgatgtggtcttttacttggctccctctgctctgttttttggtcctaattttccagcagtgggggttaccaggcactactttcaatgtagtagactcagcagttctatatcatgcaaattgtaaatgtagagtagaatgtaattgtaacgtagaatgttagaaccaaagatcttagaagttattttctgccttgcccagatctcctgactgatttgaggatcttttctttgttcccattcagcttcacagggacaagggttgggggtggtatcagaggacagccccttagtctcccaagagcactttgatgcttgatcccattctctacattcccccagcccagtcatctaaggccagagctcttttctctgctcaggcattattgacaggataagtcctggcattcagacaggtctggtgaagtgaccaggtactctggcccagaagttctctgtcggctccccccgcaggctccaattcaggtactgtatgttattctcttgttcctcttgccactggctttttccttagtcttaagttccaaggaattgttcccctgtgtttttttattttcctgacttattcaagcagagctagctcagagtacaggtctgtaacaagggcttattaggagatagatgaaaaagtgcaggtttgtatatgtaagttgtccattactatagatagatactattccaggcattggactttaactgcactgcctaaaagagcccaaagataaacttcacaataggctgatatgtggaatgggaggaggagataaagaacggggtttctgttttattcataagctcagtcttagcttcagtcttttctgagcatttgtttatttgtaagatggaagtcaaagtaagtgggaagtctgtaggtcagctctattttccatgcctgcccttgacttctcctcagctgttctctgcctgtgcaggtgaggcagcggaggtggttggtccagagagaactaaaagaagttgttttcttggactataggtccagctgcaaggcagggtgcctttcctatgtgttcctcttttcactaaaagactcaaaatgctttagcagctagatctggaactaactcttctggatggggtaggaacttccctgcccttcccttagggaagctcatgtttccaagtcagacagcagggggcattgggtgcctttcggacagaaggaagctgcctaagctagaaggcctgcctgctggagtttatttcttttgccttgttcagtgaatttacccagagggtggctgagattgaggctttgggagccccaagaagctgcttggttttaatgtgctgccttatagctgagcctgttgtgctcagggcaagtagtaggatgttccccctgggatgtgcaaggttctctcaagcagacatgagcctccatcactcccaccactccctgcaactcagcctcctcttctcagcctgtgccttcctccagttctagtaaacactgccaaatgaatatagttctccgactcttctctgggggttcattggcagctgctgctttcttcattttttaaaatttatttgccacttggtgaaagccactgagatggttttttccagccttgggcaagttggagctttggaatctggagtgaatgaggtcatctggatttcattgtcttcttacgaagccagcagtaagcttgggcagtccactcacccacccctagggccatatctggggatgaagccacccccgacctatacataggaaatgattgatgtgcctggtcttatacccagtctgtgtctggtttctctaccctcagtgccctttggcttaggctcaggatgggtgggcctcccttccccagcagctgcctcagccctgatcaagggcagttatttggctcaaggtgagtagtggtttttaaaccctactcccacacactgctgagtctgtgttttcctttcttcctgaccaggtaaactgtcttgagccccaccctcacctgcctgtgctggcaaccagtggcctagaccatgatgtgaagatctgggcacccacagctgaagcttccactgagctgacagggttaaaagatgtaagtggctgactgcagaagttattttctttctgcttatccacatactgttgattcttattgtcatagggaggaataacttgctgcccagttctttaaaggcactgctctaacaccctcccccacattcctgtaatttcctctgtaggaatagtcctgctccagggggcagctgtgaagtggcactaatttgtaataggatggggataaggagcatctttaagaattattctgtattaaagcctgctaccttttcagcagctgaacctagggcatcatttcctaatctaatgtagctccacttcaacttaagggaagcttttattgggataggagatcagccttcttgatcaggtcccgggttcctcttcattgctgccccctcttcccaacctttttgggttccaggtgattaagaagaacaagcgggagcgggatgaagatagcttgcaccaaactgacctgtttgatagtcacatgctgtggttccttatgcatcacctgagacagagacgccatcaccgggtaagctagggttggaaatgaattcccaagggagtgacccttttaagagggctaaaaagttccagagtagtgacttcaagcagtaatcaggtgatcttggtcggatttcctatccactgtcctctgtccccatcagatccctgatatagccttggaagagacatcagcagaaaagggtggtatctacttttgtccattgccgtccatgtgtaatgctatcttcataaaggcaaaagctggagggtggaggagggaattgagaagaaataacaagtctcagtgtgacccttctatttttcctcttatgccaaaagaggcctagttcaggggttggcaaactggcagttggcctgctgctggtttttgtaaataaagtttcattggcttgcagccatacccattctgtgtattgtctgtggcggccttcacgctacaatgagttgaatagttgcaataaagaccatatagaccacaagtctaaagtatttactctctggccctttaagaaaaattctgctgatctctggcctaaagcatctaaattctggctaagacctaacaggcttgtccttgttccatccagggaagttactaacaagcctttcccatccacagcgctggcgagaacctggggttggggccacagacgcggactctgatgagtctcccagctcctcagacacatcggacgaggaggagggccctgaccgggtgcagtgcatgccatcttgaggcctcatacctaggtggggcaggctggggctgccaacctgatcctgcctgggcaaccctttcctgtcccaggccctacattcagcagaaacgcactttggactttttgctttagataaaagaaagacatcccaggagaaggacaaaccagaggagtgaaccaacaaagagtacctaggaatgggagttgagccctggaatggggctctatggagaggtgcataggactcggcagaaatggcctctccccaaagcctctttttgagaggagagggaagcctattttgttaactggtttgggatagggaatggggtttctttttctttaatctcccttgtttcttgggctgggggaggggtggggggaacaactggctattcagtaccaaggggccagagtggagggtaggagtgccactctctctttggtttaggtttttgaccttttcttcctttgttttttaaaagtttatgacagttggctccccccccacccccagcaaccccatcccagaatcctattttcctgggaagtccttaaagcccctaaccatcccacactcttcactttcctttccaccttattcattctctgtacttaccacagtattttgcacttgattacatatccttcactctcttctcttcatcccatcaccccctaaataggtcaggtgagggaggctgggaagaggtgggaggaggggcagaagtgaaggaagaataggaaggatattacctcttctgttatttttttaagaaacattgtttggtggcagcaatctccctgtccctatcactgttagaggcctaattttatatctataaatatattaaaaagcaagtcaaacttggatgtatcaaggtaaaattattgtcaaagtttaaatacctatatattctctgaatgcaataaagggacttaagagtgaacaagagtaatggtgtggaagtgacacctggggtcagtttacctctgtgtatggtcactagagattgggacttaccctttaggttttaggaggcttgagaatggaaggatcctcatttctgcccttcctggttccctgctttggtgtaggggttgggaaaaacaggaaattcctctcagctctgcctcagatc

SEQ ID NO: 56552 - DNA, 1101 bp, Homo sapiens
gaccttatacctctaggaaggaggagtaaacaattcttttagatgaggcagaagaggaggaatggtggtagtaactagcccaagattggcctgttttgttccatgtctgtggttcccaaactttggggcacattgaaatcatctgatgtgttttgttttgtgtttatgagacaggatctcactctgttgtccaggctggagtgcaatggtgcaattatggctcactgcagccttgacctcccaggcactgcagcctcaacctcccgggctcaggtgatcttcccacttcagcctcgtgagtagctgggactacaggtgcatgcctctacacctggctaatttttgtattttttgtggagatggggtttcaccatgttgcccaagctggtctctaactcctgggctcaagtgatccgcctgcctcgacttcccaaagtgctgggcatgagccaccaatcccaatcctggtgttcttttaaaaataacagtttggccttaaccccatatattctgatttaatagggatggactgcaacttgagcactgagatttttaaaaactacccacatgattctaatgtccaggaaagttgaggaatcatttctctattgttaccactcctagcagatacctgtcatgattttgtcttggagatagcagttagaggttagttttattttttttcctgagctggtaagaagggagggaaaaatctgttcttggatctcagtacacaggcagataaaggaagggtgccagtctcatggccaatattgtactgaccatagtcattggaactcttggcttcttttactgattccggagagtggagccctgttaatggtagcaagcacagatcacttgcttctcgaggcagttgtggcatataccttcatcagtctcagatcagctgatgacccagaaatattgacaaggtaccaatgaagtccacatatcaaagataatcctaggccataagacagtgctgcctaagagtaggcagagctgggatgattcagggtgggacaggtaagagattagagaggcctgtggttacttgatagggtataaacttgagagactaaggctgctgctaaagga

SEQ ID NO: 56553 - DNA, 1630 bp, Homo sapiens
gccagagaagtctcagtggtgagttgagaaccaaaaccagattaggatggactgagaagtgaataggaagtaagaaagtggaaatattgaatgttgattgttcttttcagtagtgtaactgtaaggggaaggagaaaaaaagcaatagtaggaaaggacagtcagcagaaggatttttagaaagtggccagctggtgatgaggaagaggttgagaaattagataatcatcaaacaaggtccctggaaggatgaaatgaaaagcatttttcaagagattggctctgagattggaggagactgggtgagaacagatactggatctgtcttgttcctcactgtatttctagcacctagcataatatttgacacataatatgtgtgtcctcatgagtttaaagcttggattagagagaggaaggaaggtgaaggtgtagtgtgcttgataagaatgaggaaaggagagggagtcttgaggatatgggtggtagtttttaataattattgtggggtatgagagggagaacaggccaaatacagttttaaggagggattacagacccattgacttacattaagcatggtttctgcccgtgagtaacctttttcggtaggtaatgtacatgtaaaaagctccatactaatgttagttgtttcagtgaaaagtagcagtatgtgatataaaacttgaggagagagataaaccacttcaaactgacagaattgaggattgccacttaaaatgggaagtatgtggataaaggatttaagggtttgcctggccaacagatgaaactctgtctctactaaaaatacaaaaattggccgggcgtggtggtgtgtgcccatagtcccagctatttaggaggctgaggcaagagaattgcttgaacccatgaggcggaggttgcagtgagccggggtcatgccactgcactacagcctgggtgacagagcaggaccccatctcaaacaaacaaaagatttagggtttggaaatggattggaaaagggatgccctttaaggaagagcacaaaccaaaagcttggtttggaaaatgttgtttatctgcatccagctggcagtttcctgccactacatcaaattgcagctcttcaagggtttcgtttgtacatttttacattttcattgcttttccaactgtaggatttatgaccagaggaaaattgatgagaatgagaacaatggagtactcaagaagttctgtcctcatcacctggtaagattcatgaagggccagttgctgcaggcttccctgactcaaccccaaggctgcacctgaacttgttggtatggtgggaagagcttggactttcaagtcagtcatctggatttgaatcctggctttaccacttaccagctttgtgatcttggcagtcacttcacttctgatagcctcagttttttaatcgacaaaatagaaataaaaataactgccttgcaccttgatggtgaggcctaatgagacagtgtacataaaatggctagcacatggatgacaaccaaaagaaagccccaagatgctaccccctgaggtggtcatgtttcatcagttgtactcttgtctctgtctgtctttctcaaatctctgggagaagatataggggagt

SEQ ID NO: 56554 - DNA, 1937 bp, Homo sapiens
tagccatagatttttttttttagacagagttttactcttattacccatgctggagtgcagtgacacaatcttggctcactgcaacctccgcttcccgggttcaagcgattctcctgcctcagcctcccgagtagctgggattacaggtgcacgccaccacgcctggctaattttttgtattttcagtagaaccgaggtctcaccgtgttagccaggctagtctcgaactcctgacctcaggtgatctgcccgccttggcctcccaaagtgctgggattgcaggcatgagccactgtgcctggccaattttttttatttttaaataagaagctgttgatcaaaaagggttgtagtttgtatagattttcagttgctacctcctccaagttgagcattcactgaaattttgagttgagagttcctacttagagctccagattacttgaaaagtctgtgtctctaacaaattccaccactaggaccaagatgtttggaggggaatgtagtagtttgctgtattgagaactgtattcatatgtatgtatgtattcatatgtattcatatgatatgtatatcatattgccttaacccaaagctgatactttcccagggttagagtaaggcttagagttttagcatttcaacacaaggagaaatactcaaatcttctgtgtcttatcagcctcaatattcctctattggctatttactgggcagaagttatgtgaagatttttgttttttttttgagacagagtctcactttgttgcccaggctggagtgtagtggctcgatctcggctcactgcaacctctgcctcctgggttcaagtgattctcatgcctcagcctcccaagtagctgggattacaggcatgtgccactttgcctggctatttttgtatttttagtagagatacggttttgccatgttggccaggctggtctcgaactgtcttcaagtgatccacccacctcggcctctcaaagtgctgggattacagtcgtgagccaccgcgcctggctatgtgaagattttgaggcacgctgatcctacacaagcaggtagccctttcagcactccagctcttctctgacattaggttacactcaacttctctggcacctctcctgtgcagccaactgaatgttttgaggtttctcctttcttattcttcctttgaaagaacccaaacagctcatcttctggtataaatttgaaaacatttttgctgaatattatatatcataacatcattaactttcactcctagcctaaaggaattacttcaagggaatatagagaaatagcttactgatcctcaaggcttttgcatcattaatactgaattttagtttagggttattaaaaagtatttaagggaagctctggggagacatgctttttggcctgtggccaaaaaaaaaaaaaaggtaagtagaggaggtataggtgtgagtccctactacacctgctaagctaagctaattcctgcttagcttagttttaagaatttataggggtaaagaaaaagagaatatatcaggtgaatcctttagtggtaaatttggctgacatgaaaatttattgctaaaggattaagtataggccctgattgatgaagcacagtcagtaaatcatctcttcattccccagttcttaagccaacatcagcaacactgagagaacattagattaaaggcaggtatagaagagagacttagggtaacaagttagtgggtgcctgaaggcatgtgggaagagatgtggtaaaggtgtgcacactattccttacgtgacttaaaatgtcaaggggcttggtgtggtggctcatgactataaaactagagcactttggaaggccaaagctggaggatagcttgaggtcagaagttcaaggccaacttgggcaatatagcaagactgtgtctctacc

SEQ ID NO: 56555 - DNA, 1014 bp, Homo sapiens
attaggggatggaggtttcccctaatgacattcattttcagtgccctctgtattttttttgtttgtttttaattttaaaataaatagagatgggagctcactatgttgcctaggctggtcttgaactcctggattcaaacgatcctcccacctcagtctcccaaagtgctgggattataggcatgagccactacacctggtcctctgtattcatttaatgaaaagctgcagagatactaagtaaaatctcaacactttgcctagaacagttctaggctgaagtgactttggctatgcagaaaggatgctaaaatcatttctttacaaagaaacttgttgtcatggttatatttctttctgtttccatagcatcagaaataaataaaaccttagacttaaaaacaaaaactaaagccaagcctcttcctatagtttcttgaagtctttcctttgctgtaaatttaccaatcttcattatgtcatatttgactaattgaatgcttagatctgagaagaatattcctcatgccacccttaacctggaacaaattatggctgttttagacagattattctggatttcttcagtgaaaaatttatcagttttcagtgtgcatattttaagctgggttttttatttttttactttttgagacagggtctcactctgtcacctaagcagaagtacagtggcaagaccacggctcactgcagcctcaactttctggactcaaggaatcctcacacctcagcctcctgagcagctgggactataggtgcatgccaccacactggctaattttttataacaattttttttttttttttgagacagagtctccctctgccacccaggctggagtgcagtggcacgatcttggtccactggaacctctgccttctggattcaagcagttcttctgcctcagcctcccaagtagctgggattacaggtgcataccagcacgcccggctaatttttttatttttggtagagacggggtttcaccgtgt

SEQ ID NO: 56556 - DNA, 1056 bp, Homo sapiens
tgtggaaaacaaacaaaaaaaaagcgaaaaaattagccaggtatagtgccttgtgcctctagtcccagctacttgggcagctgaggtgggaggatcacttaagcccacaaggttgaggctttagtgagccatgatcatgccactgcacttcagcctgggtggtaaagtgagaccctgactggaaaaaaaagaaaatgaactctaatggctgatgtttttctttgctatctgttcatatctcttgaggacttagttgaaatagcaaatcaactgtcctttgactagttatagaataaacaaaactataaataattcgcatagaacaagagtaagtgggcttagattatgtcctttcctgggattttatgacaaaaaggtagacatttctctttttggaacattttaagtgcagcccttcccaaagttataggaatgaactagatgacctctaattctaatatttagaaacctcatgtttttcctttttcttcttcagttggcactggaaccagactctccctgtacgttcttatctgcaggtgaagatgcagttgttttcaccattgacctgagacaagaccgcccagcgtcgtaagtgtagcagtaatatcattacagaactgtatctcttagccttgaacatattccatatgtcttggtaatgcctaactctggttcatccgaatagtacctttgtgcctatggttaagaggtagtttaaggttaaggggaattccttacttcctctctttctcagtagtgaaatactattcagtctaccttcatttctcaaacagtttacttgttatatgtggcctttaataatttgatgatcttttgctctttattcacttggatatcattcatcttacccacagaaagcacattcttccacagactcatgtagaggtacagtcctgtaaattttaaatttaaatacatttttaatttagttatttatagaaacatacaaacataaaatttgaacaaaaatactggtagctgtagttgagttctgttttatcacagttcatttgtatgtgaatctgagactca

SEQ ID NO: 56557 - DNA, 1056 bp, Homo sapiens
agaaacatcagctctaccccgacctcgctggcaagccctccctgcccttcgggagcgggagctgggttcaagtgcccgctttgtctatgaggcctgtggggcaagagtctttgtgcagcgtttccgcctgcagcatgggcttgagggccatactggttgtgtcaataccctgcactttaaccagcgcggcacctggctggccagtggcagcgatgacctgaaggtggtggtgtgggattgggtacggcggcagccagtactggactttgagagtggccacaaaagtaatgtgttccaggtgaggcaagggagcataatagcaactgagagaatcaggcatgagttagagaaatctgaactgcagcatggattgggagctgatagtgagttattgtaggaattacatatcgggacatggccctactttggctcccctaatgacctaaatacactgaaagactcttggcaaccctagattccttgagcatgtggactgttggaagcctcataggtagggtgcatgcagcttattaaatgtgtgctggtaggaggcagtgtagtataagcacaggctcttgaaccaaactgcctgagttcaaatcctagcccttctgcttactagctcagtgatcttggccaagttattttacctttgtcttcagtttatctgtaaaatgggactaataacacatagggttatgaggattaagtaacaatagaagctaagcagttagaactgtgactggtacttaataaacatttgataaatgttagcttatactgttgttattctggaaagattttactccttggccccatctactgtactggtaccagccatttatcctaagggtgttctcttttcttccctgacattccccctattttcctttttctttgtagcaaatttatatttactttcttaatcaaagtagatttttcctcctctattccttttctcctctgctagatacagtcctagttcatctgagctcttatcatgtgccagttcaatcttccagagccaactgaaatgctctcttacatcaaaggaag

SEQ ID NO: 56558 - DNA, 1058 bp, Homo sapiens
gtggctcatgcctgtaatcccagcactttgggaggccgaggcgggcggatcactcgggagatcgagaccatcctggctaacacagtgaaaccccatctctactaaaaatacagaaaggtgggcatggtggcaggcgcctgtagtcccagctacttgggaggctgaggcaggagaatggtgtgaacccgggaggcagagcttgcagtgagcctagatagcgccactgcattccagcctgggcgacagaatgagactctgtctcaaaaaaaaaaaaagaaagaataataataataggtttgaagttagtcatctgagtgaacagaaagctcaatctcttcccccaagaggttgatttctgttgatttgtgtgtaaaatgatactcagaatctgacccacctctttatgttgtgaaaacaagtgttgtacagagtttgaggatacatatgtcacttatttacattggaagattcttgcctagggggcaatgctgaagttagctttatgtattgagttgagactcttggcttgcagtacctgtcatttgatatgtgcctcctgttccaggttttattttagttcccactttcgcatctgaaaaatcactgccagttactcagtgagtgaagtaaagagatggcacttgacctccccaaaaatatatcattatatggattttaaacatagggaagaaaacataaggaagaaaaaatttcacaagctgagaagacctgttaagcatgcatacacaaatcatttttataaaaatgataaaacctgtacattgttaaatctccttgtccctattgtcttctttcccaggtggtttcctaattgttttggtttcttcctctcccaaacccaggctggctacagcaaacatcattcaagatgtccagcaaagggagcagcacagatggcagaacagacttagctaatggtaaggggccaaaatgaaggtgaagctatttttactatcaactgaggttgtcctcctccctgcaagatagagtggaggcctggattttagtggagagagggaaactttcctgtgttgttc

SEQ ID NO: 56559 - DNA, 1007 bp, Homo sapiens
gctgcttttgaattctctgggagtggataatagtggggtgaaacgtatggtaaagagttttgattatggaggtgggaaaacatcagatctgttcttcatgttacactggtctgcttattaccttagtttataagttttttttaatttttttttttgagacggagtttgctcttgttgcccaggctggatggggtgcaatggcacgatctcggctcaccacaacctccgcctcccaggttcaagcaattcccctgcctcaccctccctagtagctgggattacaggcatgtgccaccatgcccagctaattttgtatttttagtagagacagggtttctccatgttgctcaggctggtctcgaactcctgacctcaggtgatctgccctcctcggcctcccaaagtgctgggattaatcttaacaaagtagtacattttccccacttgataggaattaatataattttaaactctagatggagaagataggctcctattctaaagaatataaacaaggactgttgagagggaaaaacaagtgctgtgtgaggaatgctatacaaaactgtctacctcaaaaatgaggaaaacaaaatgcattgcaaacagcttctcactatttttcttcatgttgcttcacatatctgttttttgttgccattgtctttcatcatcacccttccaggtgtcccttcctgaagttcagtcagcttcagccccagtcttgcagtatttctattcccaccttggcctattatgaacaatctttgggctactgtcttttgacagaggatacttttaatgaagcagcttagatttctatagagggtagcggaggaaaagataaggatgaggctgcttctggaataattgtcatgggaatgaaagggctgttgaaagattagaggccagtgtgcctgggtacaaggactggggtcataattatactttgtcttttactagtgccttttgtccaagtcactgaaagggcttaataaaattctggt

SEQ ID NO: 56560 - DNA, 1340 bp, Homo sapiens
ctttttaaaaaatgatagatacttttatctcttgtatcactcatttttcctaattgattaattggctacaaatgggattgtgactgccttgtttatatttgtagcttctaaattgcctggtaccaatgctgttgtgtaacagcatgtttgcttacacataggccactgggtggtgccagaggcttgtgatttgtataaaaatgagtagcctagactcccagctagagtctacctgctagagtctctctgcagttgggttgtttgtactgtcagatcttcagcacagtaggaatagagattaatttttctgttacagaaacattcagtttctttctgctcatctgtccagcctaccagaggagacagtgtcatatgttggacccctccaagtacttaatagaaaatagcccagaactaaagtcctacctaccataaacatgctttatataatgagtttcagcctctttggggtcatcctttgagtttcagtgcctgaggttctctgattaataaacactatacggccaggtgcagtggctcgtgcctgtaatctcaagcattttgggaggccaaggaaggtggatcacttgagtccaggagttcgagaccagcctgggcaacatgttccccaccaccatctctacaaaaaatttagctgagtgtggcagtatgcacctgtagtcccagctactggaggggctgaggtgggagcatcacttgagcctgggagatcgaggcttcagtgagctgagatcacattactgaattccagcctggacaacagcgagaccctgtcttaaaaaaaaaagaacatctgcaaaaccactatgctattagagtgtggaaggcaagtaggcttggagaagtaagtgtttcttgtgaaggagaaatattaagaaaagtaaaataaacttaaaatgagccatttcatcttggaaacaaaaattggaggtggagaaagtagaactagttgataccagatggactgtgggacctagaaaagcaaatttgtactttggatggagatcaaccctgaacagctgctcatttatgagtggtatgggacatctgtcctcccaagagaaacttgggactgtgtggctctctgtcttaataataattgaagtattttcttatcaccttcttctttcagaggaaattctaaaaccttgtctcatttaaatatgggtgtttatgtaggagagttgggcacttgagtagcagaatgaggcaggcactggtttgagagaatgctgggattatataaaccatgagatttgacagaccgaattcaggtcttagtaaagggatcaaggacaataataatatttacacgttga

SEQ ID NO: 56561 - DNA, 3800 bp, Homo sapiens
ctgtgtctcgttccggctcggcctgcgccccccctcgcttcccagccggtttcccctaaggatgggcctgacccgtatcccaagctcttagcgctcaggtcttttccttccgccgacccgaagtcatcgctgggagtactggttgccctttcctcaggtcagccctggtgttgcccccaagagccagccgcacagttcacagggacgccttgcttcgttgggtgacccatgtgtgcgctcctatttctccccttagattgagggacacggctcgccctgcgtctccccgtcacctcagggccaccgcgcaatgtgtccccctcccccatcccaagttcccaggcccagcaccttgtacggaaggcggaggtccaagaattccggagtcggttgttgtcttgtggtcttgtaccctttgtaatataattatcttagtttacctcctctaactcccaaatcttttaggatatcttagaacggtcccatttggtccctgttagttggaaagcatctggtggcttgaatttctgactcatgattgttactggagtctctgtaaacaaaccggcactagcgctatcacattctctccgggatttccccccctgctctgtggcttcttgttgagaggttgtttggttatggtttagcgttgaaaagattcaggttatccttttaaatgactttacgttttagtggagctgggagattacttgcctggcttctaatcttcatgttggttcattttatttccatatgtgtgtgggttatttgttcagtaattagaattagataaagtattctgcttttaagtagttttgagaaggcctaaaaatactaaagtgtattcataaatatttttattatgttcagtagaagacacacctttgccatgtaaattttaacttttctcagtccttcagtgaatctacagacctattttctcaggagctcagcctggccttacttcagtgataaaaggaggaaaggtgagtgggagttggaggcattaaaattcttgagttcaagacagactgcgctgatgctcaactgctgaccactaaagtcataaaattcctaccagtttcccaaagagcttgagtgttgttcttggctttgttccagctctggttgaattacttttacaagtttaattgtctgtgggcttcttgtctttctgtcctaaactattgctgtgtatctccaaatgacttaagcctagaagtgaatgtgtgccccctgccccatgtcttcttttcttctttattcattttccttgtattttgtctttgtgtcgatcatattttttacgttgttaaaaactggaacttagtttgcctgagttctgttcatcctgttgtcaaatcaggtctcttcccctctcacagcttcgggttgtcatcccttggtatttagaggagaatatttagctgcttgtgactaaaagctggggagtgatgagtgatgctgcctttagttggtgtctgagtccagtctatttcagaattccgactttttaggatatagtgggaaattttttgtaaaaaaaaaaaaaaaatagtggctgctctttcttttgtagctggtctgaagaattcttggttagcagaagaaacatcctgggcattcagcagcatgggttggtgccaaaaagggagtcagaacatacttataaatgcagttttcgtgaggctttcaggtttctggtagcagagactagaggctcatggcatgtgacagaaaagctaagtgactggaaggtaggcctggccaattcctaatatctttatgatttgtagtaggaaaatattgagtgacactggtgagttttattccatctgatgactgaattagaaaatgctcatcatggactggaataaaattattagtgatggtgtatatgtgtatcagtaagatataaagagaaaagtacagtctttagagattggacagacttttaatttaattttaaggtttaaatactagactaatatttcttagccatgtgaccttgagcaagttacttaaacttctctgactcttaatttccacaactctaaaagtgtgataataccacttacctcccagggtcattgttagtattatagggaatctatttaaagctcttagtaatctaagaacacgtggtacacactcaaaaaatgttgttttttggttttttttttttgcacatcattgatacagctttgaataagttatacgttaatttatgcttcttttacattttgccttagaacacatttttctggttaattttcccaactgatttttaattggtcagcttagacgtgtcctttgtaagtgcccacctagagttgtcttctgaacatgaaacccttggtgggggttcataaccagaggacagagaatattagatattggtgtatgtatatttcaaaatgtattcttaaacatcagtaaatttttttgttcattggttccttcatcttggactctctgttagcacacctgatcagagttggccgtgttgtaattctttccctctctgctgcaatgttgtttacttctactgcaactattctttatactttccttttttgccatgaagggaatacattttttccttcttgttgggctatacagtgatcctcatcaacaaattatcaaagaactgtatgaggaaaaggtctctttttttaaaagtgaatcagggctggggagttaggaatgaagaggttttttttgtttgtttgtttgttttttgacgagtcttgctctgtcaccaggctggggtgctgtggcgcgatctcagcccactgcaacctccgactccctggttcaagcgattctcctgcctcaacctcccgagtagctgggattacaggcatgcgccaccatgcccagctaatttttgtatttttagtagaggaggggtttcaccatgttggccagggtggtctcaatctcctgaccttgtgatctgcccgcctcagcctcccaaagtgctaggattacaggtgtgaaccaccatgcccggccaaagagttcttttttcagctccacagctggaccgtcttaataatatgacagcacagatgaagagttttaaaccttttgttggcttttctttcgtatctttttggcaagggcacatgaaaattaagtactgataatatcacaatgaaagcagctgtgtcattcagaccagtgaccattttaggtttgatgaacttttcattaccatcatccagggtctaaattctccattgtaaggtaaggattctccagggtggtggtgaggtgggttgagattgcatttgtatcatttgtgtttttatgaactctgaagatccatgtcgggtgaaggaaaggatgggaggagaaaaggaaatactttgaaagagggataacttggactgtttatttccttatgtgctgggtaagaatgtccaggtgacatctatatgtagtaaatcagtatttctagtctgtggaccacactgtaaactttttatctttctaaagttttttttatttttgtagagatagggtctcactttgttgcctaggctggtctcaaactcctgggctcaagtgatcttcccacctcagctgagtagctgggaccgcaggggcatatcaccatacctagctaatttttggttgttttttttttgtttgtttgtttttttaaagagatgaggtcttacttgcccggctcaagtgatgctcccatcttggcctcccaaagtgctgggattacaggcatagccgcagcacccagcttgaagatatttttatatttccagggttttagg

SEQ ID NO: 56562 - DNA, 1041 bp, Homo sapiens
tccatcaacacccaccttccacaactcagtctgcacctcagttggcaaaggagactggatggccatctttcctcatgttcccttgagtatttcaatgtagaaagcccttcaagtggtattatattttaaccttttacattattgttattaatgttagtaatatattgttatgttttctaaattatttttctttaagctgacgtggctttttttctgtggctcccagtgggtctacggaccttggctgacatatgttggtaggtactctggtcagctcagctggctgtcctggttcactcagaagataagtctctccaaagcaaattcacatgcattatgagtcgctttgagcttctgacatgtcacttgccccgaggttaaaacttttcaccccttgaagaccttacatgttttatggtattggtgaggaaggaaatgttctcaaggtctcaggctatttgggaaattccaactcctataccttaccagagcatggaagagcccagatctgaatgtaaaacgtctctgttctgccagagatggaaaaaatacaggtatacttgtgatatagtcatggggcttcagtgtcactattttctccttaaagctccagccaaaaactggacaaggatagagaggaggagggaagaacaaaagagcccttctctatgaaccttgtgccttctgtcctaccagttttcttttacagattctcacttctgctagcctagccagggcttactccaggaatctaaatagatgccctagtccactttatctttgttcccaaggcactcatttttattttgattttgattgaatgtgagcaggttgacctcaggtcacactttgttccaaaaacttttggaattattccaggacttgtggtggagttatggtactctagggcagtctttctcaaactatgtatggtaaaggaccaggttttttgttttccagtccttcacttatcaatatgcattcctattgcccatgacaggtatggagttcacactgtgtgctgccgacccggcaagtttg

SEQ ID NO: 56563 - DNA, 1654 bp, Homo sapiens
tgcagcaggtaaggcctcttgccttctgcccactggtgctgtccacttaggtgttcagtgaaggaagtatctgggaaggatgcaatactgctagacctaggtggaggagggatcctctcttgtgatctctctcagaagaaatagagagatcattcattagattcctcttctggatcctctgttgttttctgggcttttctctatttcatgttccattttccttattttctagctacaagatttaggccatcctccaaaagagctggctggagagatggtgagtatgtcttatttttccagattttaatttgagtccccaatttccagaattctttaacctctcaggattccacctaaggtgaaaattgtggctactggggatggatcttcacgtctgtcctaaaaaatgagcaactatctgagtcccttcatctcttccccagcctcctggcctcaactttgacctggatgccctcaatctttcgggcccaccaggtgccagtggtgaacagtgtctgatcatgtgaaacacaacacgttttcctctctgagtcccagctatggggaacatctggagtcagcagaaccattgggacctgaggcaggagtgtcacctgcgggagaagtctgcccgctgccctctgtcatcccattcaagattgtgccataccagctgaggtttttcctctgtctctctaggaatagggtctgtttcacaggccatttctgtgaaccctactccattgtggtttctgccactatcaaagttccagctacctgcaaggtgaaggaaggcatcccttttggggcatgcactttctttcctttctcaaaataatgttatatgtggccacactgatgttcacctttacgtccagggtctttgtgccttgtctctactccctctcttggatctggggaggaggggcagagacctgggactctgtatttctatagttctcctggcagagcctttgagaatggggagaaacagcctgggctggggctacaggtctgtcactatgctctcttgccttcagacagaccattctgaattctctaaagggaaagggcttttgcatctaatcacaatagagttgaaagagaggccttaggattctcctctctctaggtgctgagccctcacctccctgttccaggctgagaactcaaatggttaccctgcttcttcctacaatgctgtgtgatatgggtgaacccagcccctgaccttcctctatcccctgcccatcctcccttttacctcctctcttttttaaacacctgtttatcccaacctttttgagctcaagctgtgataaagaagggcccatcctatttcccctcatctagtccatttacgattctcactgactccccgtcttcctggcagacacaaataaacccagtgtcaggtctaggaaattaatggctattcttccccagatacattctggcttatttgagatacatgattctcttagaatcctgtcccttggttcaggaaagtagcttggaaaaggagtaggggtatagcttgggtcccttttcctgcaaggccccatggggcagaatataataaatattctgagtgaggagtgtggtctttttctgatcttcctcagcttccgtaagttgcagagtgaggtatatt

SEQ ID NO: 56564 - DNA, 1007 bp, Homo sapiens
ggccaacatggcaacaccccgtctctaataaaaatataaaaattagcctggcatggtagcatgcgcctatagtcccagctgctcaggaggctgaggcatgagaatcgcttgaacctaggaggtggaggttgcattcaactgagatcataccacttcattccagcctgggtgacagagcaagactctgtctcaaaaaaaaaaaaaaggaaaactctgtgatggacatttgtttagtaaatcccttcagtatttatccctcctttccccacagcagctttctttcctgtcaactagaaaggagcaggatgtaataaatacattttggtgtgactaggccacaccaactcttaatcatctcccattttccttagacatttaaatttcaaggcaggtaccctctgtgtactcagaaatttgaagaagttatttggttttccaaaatgcacactgcgggttattgatttgttctttacaactattgttctcatatttctcacactaaataaatctctatgagagcttcttgacttggccatttatttcttggacactctcatgttcttgttcacccatgcaggcaccccaccaaagtacatatcttccttccagtaataatttttaattacaaaataaacatccactattggaaaaaaaaaaaaaaagctagccgggcatggtggtgggtgcctgtaatcccagctactctggaggctgaggcagaggattgcttgaacccgggaggcggaggttgcagtaagctgagatcgcgccaccgcactccagcctgggcgacagagtgagactccatctcaaaaaaaaagaaagaaaaaaagaagcacatgtttttcatagggtatatatgaggacctaaactgctgtgaaaatgatagaaagcaagtagctcccttattctgtttttgattgcagccttttatcttttgctaattatagcaatatttattgagcacctgccatgtgactgtcactgttctagatattttacatgt

SEQ ID NO: 56565 - DNA, 1005 bp, Homo sapiens
ctgcccaaagagactctagaacagcagaagcgcatctgtgaggtaagatctataggaccctgagcacaacagagacgtccttcccttcacccttcactaggtttgaattctttaatttcaaacccagatctgagtggggatgaagagaaatttaggcccttcatttctatgaggggaggatacatttcttcatcctacttcctcatctcaccagtcctccatacctaggaggtagaagacctctcagctttatagcccatcatcctattttgtgttgtgttttttatgcatgtgtagcagcttagaaatgacttctaccaggtgtagcatcaacctggcatgtgttcctttttctgtccaccagatggcagcctatttcacccactcaaacctgcagcctgtgcacatgatcctggtgctgcgtacagccctcaatctgttcttcaagctcaagaacttcaagacagctgccacctttgctcggcgcctactagaactcgggcccaagcctgaggtggcccaacaggtagatggaactccttcagtgaccatagggaagccagatcagctcttacatggagggagcagaccaaggtccttgcctctgaaacaaagcaataaataacaacattcaacaaaaagccaacagaatgctaccctctgtttacttcctgacttggtgtttcctttgttcctggaaaattaatagtttattgagacatggcactcgtctaagagtgccgtgcaacctagaatagctccactgcagctgaaagtaaccccagtcctgtccttaagctccagatatcccatcacaaccaccacaaagcttcacatacacatctcattacttgtgtcctccaaatgcattctttttgggtgatggaagtctgttttaaccctttctaggacctgaccctgataatctctagagttggtggaggaatgtgggtctagattatggagccacttttgtattgagaaggggaaagtttgatacaatag

SEQ ID NO: 56566 - DNA, 1040 bp, Homo sapiens
agctaggtgcctccggcttaggatctctcatgaggctacagtcaaagtgttggccagaactgcagatatctgaagactcaccggggagagaatctacttctgcactcactcaatggccattggcagcccccatgtccttgctccctgttgtctaagaaacatcactttcttttcgtgttgacctctccataggagtttgtaacgtggtagctagtttcccttacagcaagtgagcaaaagagggcaccccaagatagaagccacaatctttgtaaccagatctaggaagtaacatcccatcacatctgccatgttccatccattagaagctatttaataaatccagcccacacttaagaggtgggtattttgcaacaacttgaataccaggagtcagggattactggggggccatttcagaggttgcttaccacagcagcatgcatttggaaatgtacctataccacaaagtctgttttctctacagagtccctggcctatctcacagctgctacccatggcttagatgaagaagctgagagcctaaaggagacatttgacccagagaaggagacagtgagtctttatttacataattgtctcttattacaggattaactctaggatcttagaacaatttaaaattatgaatgtcactctcccacctggttaccaggagaggcagagaaacaaatgagatcaaaggaggctccataactttccttacgtgacttccaagtgctatttgtttttagcctcttttcttctactattcagatcccagacattgaccctaatgccaagctgctccagccacctgcacctatcatgccattggataccaattggcctttattgactgtatccaaaggattttttgaaggcaccattgccagcaaaggtaagtacctatttctcccatagcacttttgttgtttgttttgtgaagaactgtcctagagaataccattagcatttagtttaacttgtcctttttttctgcatggagcctaatggaatattgaaatgccagtcattta

SEQ ID NO: 56567 - DNA, 1070 bp, Homo sapiens
ttcttttttttgaggcggagtctcgctcttgttgcccaggctggagtgcaatggcatgatctcggctcactgcaacctccgcctcctgggtccaagcgattctcctgcctcagcttcccgagtaggtgggactacaggcgtgcaccatgattcccagctaattttttttgtatttttagtagagacagggtttcaccatgttggccaggatggtctcgagctcttgacctcgggatccgcctgccttggcctcccaaagtgctgggattacagatgtgagccaccgcacccagccgattttcaatggaattagactaaaagctaggagtaattgaaagtataggaagttcttcaggaaatctatatagatgcagatgctttgcagagtccttggttttgagtcacattgtccttcaacctgttaacacgaccctggggattctttagattgctctggaagcagccaaagcactggatgacaagaactgctgggaaaagctgggagaagtggccctgctgcaggggaaccaccagattgtggaaatgtgctatcagcgtaccaaaaactttgacaaactttccttcctgtatcttatcactggcaacttagaaaaacttcgcaagatgatgaagattggtgaggccctcaaactaaggatgggaagaggggttcttgggggaaggaggaaggtgaattaaggagaaagagaacttaagagaaaagacctaacttggtgtctcttacttggtgcagctgagatcagaaaggacatgagtggccactatcagaatgccctatacctgggtgatgtgtcagagcgtgtgcggatcctgaagaactgtggacagagtaagtatccgagacttgccagctttttcagggtctgaggaagtatttttctgtttttgttgagttaatctgtgtatagtggtgagggatttctctttattgtgcatttttttaggagagacaacatgctcctactgtgcttagaagattttcttcaaagccaaagggaggtgcagccagaatattcagtccagccaaacacccttaggagaatagttat

SEQ ID NO: 56568 - DNA, 1030 bp, Homo sapiens
tgcatgtagaacccaataatttttaatatttcttctaatgcagtctgtaaattatctgttaaatgttgcattagctatattgacaaacttcaatttgcaatctatttattattattcagttcaaaatactttgttttttattatttctttatcagaactcttcacatctacctctcttctactttcagttatagattataaaggagttacctgtccataatcacctactgattatatatcagaacttaagatttaacttttaggtctgattcctatagccacatctgttactcatcttctaggataatagcatataaagatcgtgccatctaccccatcgtagaaagaatatgataaatttggcatttagttctgctcttttttgaatcacttcccatctatatcattgttcaaatggcacttgacaaaagaccgtttcctaggtttgttccgtttcttcacaggatggattttccctctcacttactgaaagctgtgccctctgttcttagggaccacgggatcattcgaactctggatttacccatctatgtcacacgggtgaagggcaacaatgtatactgcctagacagggagtgtcgtccccgggtactcaccattgatcccactgagttcaaattcaagctggccctgatcaacagaaaatatgatgaggtatgaagtgaggatgcaaactagagtattaagagaggcagcactctttttttttttcttttcctgtaagtgatgtctacttcttgcccgactccaccccaaatgtctaggtactgcacatggtgaggaatgccaaactagttggccagtctattattgcttatctccagaagaagggctatcctgaagtggcactgcattttgtcaaggatgagaaaactcgctttagtctggcactggagtgtggaaacattgaggtgagaggaatatggtcatcagccccatattgtcttagaggtgagagagttagagtgccattgggagggcattattctgggcttgcttctttagccag

SEQ ID NO: 56569 - DNA, 1030 bp, Homo sapiens
ctgcagtggtaattgacatggacaggacaaaaaatacttagttaattgaagctaaggaacaattgctgaggaacatcatcagttgtcatcatcatctatacacatttcttctcttaaccccatctttaatacttattgcagcttctgatcaagaatctgaagaatgagatcaccaaaaaggtacaggtgcccaactgtgatgagatcttctatgctggcacaggcaatctcctgcttcgagatgcggactctatcacactctttgacgtacagcagaagcggtaacatatcaggtgcccctaagcagacagccctgtagttggggagagtggacatctttagtgggaaccttttttccccaagtgagtttgtcttgtggcttggccacttcttgtgctccaagactctttatagtaacttttcccttctgtgatcactctccattcttcacgtccacactagcattacagtgagattcttggttatttatctgtttttacagtacttacctgaacaaagcgtgttctccgagcttagaatgagagagagacagagattaataacatagttcctacatttaagggagcttgcagtccagtggtgaaaacagacatacacagattccctaataatacaaggaaatgagggagagggggttgaggaaggggtaagtgcacaatgtgagccaaaatgtttaagtcactgagctactatgtaggaattacattaagtattttatgtaattagaattacattaagaaattggggtttacattaattagagggtgcaattgatgtagatcaaagcctgagacaagggaaatagatccattcatgtttgcacatctctatctatctcaggactctggcatctgtgaagatttctaaagtgaaatacgttatctggtcagcagacatgtcacatgtagcactactagccaaacacggtgagtcttcattatatccaccctgatttagagaccattcccttccaccccgatccctgccagtctacggcacttaccctatc

SEQ ID NO: 56570 - DNA, 1049 bp, Homo sapiens
aacccaagtaagactaccctaaggcatataaaagtcaaactctcaaaagtcaaggacaaagaaaggatcctaaaatacacaacagaaaagaagcaaagaacacacaaaggagctccaatttgtctggcaatagatgtttcaatgcaaaccatacaggccaagagagagaggaatgacattttccaagtgctcaaagaaaaaacctgacatctaagaatactgtacccagcaagattattttattttccaaatatgaaggatagtatttcccatacaaacaaaaggtgagaatttaccaccaccagatccatcttacagtaagtgttaaaagtagttcttcgatctgaaagaaaaaaacactaatgtggtagcggaagttactgcagctgcggtgttgtgctgtggggaagggagaaggatttgtaaaccccggagtgaggttctgcttacccgaggccgctgctgtgcggagacccccgggtgaagccactgtcatcatgtctgaccaggaggcaaaaccttcaactgaggacttgggggataagaaggaaggtgaatatattaaactcaaagtcattggacaggatagcagtgagattcacttcaaagtgaaaatgacaacacatctcaagaaactcaaagaatcatactgtcaaagacagggcgttccaatgaattcattcaggtttctctttgagggtcagagaattgctgataatcatactccaaaagaactgggaatggaggaagaagatgtgattgaagtttatcaggaacaaatggggggtcattcaacagtttagatattctttttattttttttcttttccctcaatcctttctcatttttaaaaatagttcttttgtaatgtggtgttaaaaacggaattgaaaactggcaccccatctctttgaaacatctggtaatctgaattctagtgctcattattcattattgtttattttcattgtgctgatttttggtgatcaagcctcagtccccttcatattaccctctcctttttaaaaattacgtgtgcacagagagc

SEQ ID NO: 56571 - DNA, 1038 bp, Homo sapiens
atggtggtgggtgcctgtaatcccagctacttgggaggctgaggcagagaattacttgaacccgggaggcagaggttgcagtgagctgagatcgtgccactgcactccagcctgggtgacagagcgagactccgtctaaaaacaataaaaaataaaaaataaaatttgtctggagatattaataattatttgtagaaataagataaaaataggcaagtaaaaaacaaagcagaatatcctaaatgcaaatgaggctgagtttaggggttagaaatatgtatttggaaattcacatgagaatttggggtaatattggaggacagacatggtaattctgatgctcaaaattttagagcagcgtagtctcttgaatctgttcacatgaagaataaatcagagacattttttacaacgagtagcttgattcattggtttgctttgagtaatgactataaagatgttttagaagaaccactcttttctacagggtcacgatcgtggagtaaactgggctgccttccaccccactatgccccttattgtatctggggcagatgatcgtcaagtgaagatctggcgcatgaatggtgagtgaaccggttacattatcgccatatctaagaaactgccagccagcaaggtaaagtagccaggtcttctggactctgacctatttttctaccttaggtgattaattaatgctaatcccaggagcatagaaattattttacaaataaaatatatcatctttacaatttttatgtgtacagttaagtggtaataaatatatttatattctgttttcctccatttcctccttcaccctccttcccattctactctcgatcttaataatatccactttttagcttccacatgtgagtgagaacatgccatatttgtctctttgttcttcccttaacataatggcctccagttccatccattttgctgcaaataacaggatttcattcttttttatagctgaataatattccattgtgtgtgtgtgtgtgtgtgtgtgtgtgcacgtgcgcg

SEQ ID NO: 56572 - DNA, 2090 bp, Homo sapiens
tacaggcgtgagccactgcgcccagcctttaggttttattttcaatgagagtttttattttccattacacataactgtctttttaaaaaatatttacaagtgctaggtaatttcatcttccactattcccccaaaatacttcaaaatataggattttagtctcaattctttttttctcatctacaaactgttataattttacctgcttgttcattccaaaggtttgttatcagagtccagttacataacatactctctgaaaaccacaaagtactttccgaatgtgagatagtagcagtgctatcataattttggttctgactatagcacaaatagcttttaaagatagatttacttgagccatatatgtgggtcctctacaaataagactattattattctggtgtctttttccatcgtttttaagttacaggataattcctcccagtaaaactagcctccaaaggttttaatggcaaaatccaagtattcaaatctataatcagccttttaagcaggaacttaaaatgacatgacagttttaattatcttgttcttcgtccaagagtcaagtagtaggcatgagtacactttttacatggcttatggttttacgttatcttctaccaaacagctgttttgtacttaataggcctagtttctgtaacccatttggaacttcccccatcagctgtcgaaaggcttcaagttgagaaacactgcactgtggcttcttcaaatggcttttcttttttgagatagggtctcaatgtcacccaggctggagtgcagtggcgccatcatggctcactgcagcctcgacttcctgggctcaagccatccccctatctctcagcctcccaagtagctgggactacaggctcgcgccactgcacctagctaatttttatattttttggagagacggggttttgccatgttgctcaggctgatctttaactcttgggctcaagcgatccacctgccttagcctcccaaagtgctaggattataggcgtgaaccaccacgccaacctcaaatggctttcctttaaaatttcttgagcctagtccgaagatagtgagttatctcagttgattgttcacagtcagttacagattgaactccttgttccactcttttccccattctcactactgcacttgactattctttaaaaaaaagaaaaaaatttctgaaatgatcggggaaaagctgctataaattttatgaagttgagagtagaaattgaatgtttaccatttggggccacatttcaagaacactgaagaatggaaagtgggcattaactgaagcagacacctcttgaggtaagatttgtggaagaagaggttaaagtgtgccagaaatttgggttaccctcctctagaaagaaattccagtaatggatctgtttaagtgttaagggagcagaagagaagacggtgaatgtacttcaatattttgaacatttttagaaataggaattcttgagtctcttttctttcttcagtcttttccatttctttttcttttctttttcactgtaatttctgtgtttctgatactgtgctgttttagataatattatgtttacatctttcatcccactccttatcccttcaaaggtctgaggaaaaaaaacctgtcccctggtgcggtggaatcggatgtgagaggaataactggggttgatctatttggaactacagatgcagtggtgaagcatgtactagaggtacttatctttatagccaggggctgaatatgggctgtcatcttgggaaagtcacagtatgttgttcatttattcattccttcaacaaatatttacagagtgcttattaagtgccaggcactgtttgaggtactagaaatcaaattgtgcgtgaaccaacagagaaatgaagcttatgtgccacctgagggagagtcttattaccttataaacccagtgggaaagggagaaagccaggcgtagacctcatcaccatcccaaagcagagcccattctcaagctttctgtaaggcagggcagcaggaaatttaatcggagttatcgagaaccagccatgtgtaacttttgtgc

SEQ ID NO: 56573 - DNA, 2084 bp, Homo sapiens
actattttggccaggctagtctcgaactcctgacctcaagtgatccagctgcctcagcctcccaaagtgctgggattacaagcacgagccactgcccctggccggcaattattcagaatatcctttgtcaacctggattctgtgagagaattaagtgctatagaaagtactttcagtggctgttttcgtagttcttctaagaatggtatatagctaatgctattctagttcatagagaatttgttacatacctaaactgatgcctttcgggcattaaaacttaattcttttccagaacgccgggttgagaagggctccactgtaaaagtaatgtttgtgccacctgatgccagccttgcatgttccctgcagtctagccaatgcagtttgggggcagtcaggtggttggattcttggtggtcatgaaatgctcaaggcatgaaatacttttctttaccttttgcagacagagaacatttttacatcaaaattaagggccctagatcagagaagagagggagtgtgaccccatggggtttatacttgctcttgaatgtgtgaagtgcatggattactatgtaataaccttgcaattgctatactttatttatgtgatagtaagaattttgtgctagcttgctgtactaatgttaatgctctttttaccatttctaagtgttgttctttacccacaactcttgacttccagtaaccccttaaccagagtggaaggagatgctttggtatttaacaaagtgcaagaagcttttgggttagacttttatactttccttctctagaaatcagcatattctttttcagcagggttcttttttgctattgggttcaaataagtctgaaaacaggaagaggaattagctttccgatctgttaaagaccagtgcttatatttctgaaagggagaagttagttctgaatgagagtatgaatactcccaaatttagaggactagttctaatttttttgactatttttttttgaaagggacactctctgagttagttaagcagtaagagaatatagagatctttaaaggaaaacctatctcttggtacctctcccatagggattgaaccccacagggcttagcttaacctgaatcttttgtgttaccctggcaaaaactatttgtttaaaagggaatgtatttacaaacctacatataaaaggttactttcttaacttgagcttctaagtaaactgacagttaaattattttaatatgcttatacctttgcatgtcaagcccatgtaattcaggctcagtctctgaaaaggctactaaaaaagtattaatttgctgccaaatcctgttatcatccctctctttttcctgctttccctggtccgtattgggaggtgtgcatcaaactggtccattctgagagtgtcctctcctccctctggatttgggtagctgctgtagaaattttccatctgtcgttcagtcctagcgagcggcttgttgaaggctcaaatatttcttctctgagtatcttttcactgcctgtcaccattcatctgtctgtttttgcccttccccttttcccggatcattacacgcaaatgcaacaaagccttccattctgtcatacggctttccttttaatgtgtttgttgaagcttattggaggtgaagtttctcacagctgtctatctttgtattttcctttgaatctgtttcatataccagactcgttagaaaaagttgacagatcttattaaagggacaagtgaaataagtgaaaggaggcatcccagcgataaagtatttatgagcctttgggagagtatattgtaaaacatcagctttatttctctctacctactggctaaatgctcatcttggacagaggacaagataattaaaattgttgtggccttctaagctcttgcttctccagtgttaacatgtaggtgccaccataacagaagagatatattataattttaaaacaataaatataaatgcagttattaaacttaagttcttatattttcctacagatggcaaagtttaggcttaaaatgacttaggttttctttcctttttttgagacgga

SEQ ID NO: 56574 - DNA, 1005 bp, Homo sapiens
gttcaagcgattctcctgcctcagcctcccgagtagctgggactacaggcacatgccaccacgcctggctaattttttgtatttttagtagagacagggtttcactatgttagccaggatggtctcgatctcctgaccttgtgatccacccgcctcgacctcccaaagtgctgggattacaggcatgagtgaccacgcccagcctgaaaaacttcaataattttatctttagcttttccctaatcctaccccaaccccatgttgtttatctgacctatattttcattcttgttcttttcccctcaaatcttaaacaaggctttctaccaaggttcctacctatttagaaatgccaaaatacaaataatgtatataaatctatatttatatacatatttctatctctgtaaagatatcaatttctctgagccttttagaggctcaataactatttctgtttcttagtttgatttgtctttgcaggtttggaattacaagcttcggcgctgtcttttcacattgcttgggcacttagattatattcgcaccacgttttttcatcatgtaagtagtcatggtggcgctagttttggagcattcttagtttccccatagtaatctttatttgatccttgagaacccatgttttaataatagagttgtttttggagtggctcttctacaatctgtgtggtattgtcctttctgctttttttctttctgcaaaaggaagcacttgggattatactgaatttaattttattggattcagtggattctatgggaagtcattgtttctctgtagggaaaagtagggatttgatttcagatttgctgaaccaaaaaacaaaagtttgccagctaatcccatgtagggtattattagtaagtagtaggtgtgtctggaagaaggtcagactaagatgccattttgatcagctaacaaacgtttcgaagtattaacaatcatacccctctatcctaggatttttgggtctggtggag

SEQ ID NO: 56575 - DNA, 1030 bp, Homo sapiens
tgaaaaatcctgaataggaatcaccttagagattagaaaggatagctctgtctaacatacattgcctgccttctccaccaggtccagtgcgaggcattgacttccataagcagcagccactgttcgtctctggaggagatgactataagattaaggtacagagggtctgtcataactgagaataaaggaaagaggatgtgggaaggtttgggaatcatgaaaggaactgaaagacaggaaatttcattcatacagagctcaggcctttgacaacattatccggagaacttactcagcaaacatttattgaatgcttactgtgtaccagacactgttttctttttagggaattcaaaaataaataagaaatggcttctgttttcaaggagcttttattctaatacagaagataaacatatatccaagtaatagcatgtacagtttggtaagcaatataatagagagatattcacagtgaaataggaaagagcagtataggtgcaaagacaaaaagcatgacacagctagatacagggcagctgttattggttttgtatggagaaaacctggagaaatggtgagagaaggggcagaagatgagaggggccagatcatggagtacctgtttgtggcgctcaggagtttagatgttatcatgcagataactaggagccatttgaggaacttaaatacaggagtgataccagatttatatgtttttaaaatgattacttggtggtaattaaagaaaagattggatgatttgggcaagacaggaggcaaaaataccagttaggaaacctgagcttaggtagtagcatttgaaatggagagaaggagatggatgtgagaatttaaggaaatgaatcagtgtgtctgttgggtgatggccaataaggagaaataaatgagatggccaataaggagaaataagggccaataaggagaaataaatgagctgactttcaggcttctagtttaggtcactgggtaaagggggtgtcattaactaggaaaggaaaatcaggag

SEQ ID NO: 56576 - DNA, 1401 bp, Homo sapiens
ggtgctgtgcggcgcttaaaaggtggatttcttatttcttcctctgttgattacatcctaagtctgtgtccccctgccttgcctcaggttttttttttttttttttttttaatcagtaaagcaagaataaggtaggatatgggtactcttaactgtgaagaccctgaagtaacaattcaaggaacttttggcatttataatgtacttaagtgtttgctgatacgcgttcatttactgatacatggctttttagttggtcaagccctaaaatgcaaatgcctgtatataactatgactgtgccttcccccaattcacattgtttttaaggatcctcaaaggagaaactacagctgccccacactgtgggcacacaaatgacctgctgatgttaaattaactgacccgtgtatgtcataaggtttctctcaattctgttcacactcttggaaaaatgcctcagaaagttttcttagcccagcacctgtgtattaaccaattagtaatatacatacaggatatacaagcagaagtgtgatcacctgtgcaaccagaatctggcaaatctaaggtcaaacacctttcctttgaccaagttttctctcttttagtgtcactgtcaatggcgctacatggactttgtaataaccctttgaggcacatagctgggtgccatgtagaacatgtatctgttacgataagtgtgtgcccaagaaatcagaagaatggactttaatctcattttagaaagtatgatattaaatgatttacccaagccatacttcaggttaatgacacgatagaagctagtacctgtgtctctcaaatttttctaacactttttatcttccgatcaggtttgtgcaggggaaactcagtggagaggaagatatatatccccttaaataaaacagctccctgtgttcgcctgctcaacgccactcatcagattggctgccagtgtgagttgagatggattcatgtttgtggacattgatatttgtctgtgccctagatactaagtaacatccatgtcctgcttaggagatttgacacttatattggactgtatgtaggcagttacagataaccgtctgtcaagctaggcaagataattaataagaactaacatttagtaaatgctgcataccaagctttttacatgtgcatctcatacaaccccaaccacaaccccacaaaataggtcttactgttattgtcactttataaatgatgaaactaaaacttaaagaagttgagtaactttcccaagatcatactggtaataagtgatgatgccaggatctggtggcccgagcactaagctgagagaccttttttttttgacacggagtttcactcttgtcccccaggctggagtgcaatggcacgatctcggctca

SEQ ID NO: 56577 - DNA, 2059 bp, Homo sapiens
agagatttagtggcatttcctagagaaaatataggtttgaaaactttggtgtctattgttgtagaatcttatgtatatggctaaataaggttgagggcagagggcaaaaaaatgaagttcacagaacctttctggcatataatgagtcctcttgtgctcttttatattccattccctcctgataaccttcagatggagctggggcaacagcttttcagttcaaatctagaggtgcctgtattcacccaaatatgttgtgacatctttaggggataaaagatacgcagaatcagtgaggcaaagtcagaattgttaactatgggagctttaatttgactcattctgtcctggcagcttcaattagtggagacacaggggttatccacgtagtagagaaagaggaggacctacagtgggtattgactgatggccccaaccccccttacatggttctgctggagagcaagcattttaccaggtaagaactagatgtatctgctgggaaaacatccatagagggaaagtttcagtgaacagtcctcacacttattagtgaaaacttcccttggctgccctggtctggtcaggggagagggcagggtggtcctcagaaggaaaggtgtaccatcaaaagaaatgatcttgagcttagggctaaatttcacctacctgtccctgagtaaccctgggcatccctcccctccctccctggggtccttactcactaaagctctactttttagagcagatcattgtccagactcagaatttagagactgaaagggaagaaataagtcaacagtttgattcccctagttccccatttgtttccatcctgcaggcagaatgtcaggctgtctgataccttcctgtgttccttcatggaattcctttcctattccagggatttaatggagaagctgaaagggagaaccagccgaattgctggtcttgcagtgtccttgaccaagcccagtcctgcctcaggcttctctcctagtgtacagtgcccaaatgatgggtttggtaagtgtcccaaaggatcaggagagcctactgtcacctaaggctcactgttgcttcggtcttacgtctttgtgagggatgtatatgtgtttgtgtctgtgtgtagtgtcagtaactgactcccaaacagggggtagtgtttatttgtctttgctgctcatcccttccctctcctgcttccccttcctttgccttacctggcattatctctttttgtcacgtgttcacatccctaatcttacagcctaagactccctgataccattgtctttctattttagtgtggatggtaatagacttcatgcctacttctttgagtcaccacctccttttgaactcttagtcccaactgaaagattcttctgccgtcacctggttcctaagtacttggtgtcccagtaaccagtccccctattccccatccttcccttcaggtgtttactccaattcctatgggccagagtttgctcactgcagagaaatacagtggaattcgctgggcaatggtttggcttatgaagactttagtttccccatctttcttcttgaagatgaaaatgaaaccaaagtcatcaagcaggtaatgacactgccagctcctagcaattccagttagaaagaagattatttttctagccaggtgtggtggtgtgtgcacgtagtcccagccacccgggaggctgagacaggaggatcacttgaggccgggaggcagaggtttcagtgagctgagatggcaccattgcactccagcctgggtgacagagcaaggccctgtgtcacaaaaaaaaaaaaaaaaaaaggattattttataggctctcctatttggagggtggctcattcttctggtacacctgctgaaagacggttgctccaaaaagaaccaagacgttagttcttctcacattctttccccacattttgctcctacctgatattacagcattaaagccttttagactagaagaaaatataaagaatatctgaaagagtaatatgaaacaaggtacacagcccaggttaagaaccact

SEQ ID NO: 56578 - DNA, 4057 bp, Homo sapiens
tagagattgagaaattcaatttggtaatttctgagcttctttttagctctaatatgccttaattctggtctagtatttccattttgactcatagagtagttaagagatttgtccaaagttgtatggtgagttgatctccaagctgtgtcatatctgatttcctatctctagtttggtgctctttgtatcagaccacactgaatcttttcagtggctgaagcttcaaattgggccaggccatctggaatgggatagtttcatctccagctaaaccactgagtctgcaaccctttgtaactcttgatgagtttttttctttgaccttatagatcctatggtggttctaggataactatagctcagggataaatgtctccgaaaagggtgtggctccatcccaaaaggatggaactgggccctcctccttctgggatgtaagggagggcctccacaaactagctgtctcagtggggtccatctcccctttcagtgctatcaagatcacaacctgagtcagaatggctcagcaccaaccttcccactatgtgccatgcagctcttttcacacatgcatgctgtcatcagcactgccacctgcatgcggcgcagctccatccaaagcaccttcagcatcaacccaggtagggcagatccgaaccatgagggtaatggaataaggggcagagggagagtggaaccaggccagggaatgttagagagactgtaatagggaaggagtagacaccatgaaggagctctgcatgggagaactagaaacaattctgaaaaatttaggcagcttgttcctaaagtggatagtggcagagaagccaacctcggactgttggaagtagagaaaacgacttagagtccgtggggcactggtcagagatttccaatgttgcctttatagctaccttctcctttagccttgttgatctctcattgtttgtgtcctgcttagaaatcgtctgtgaccccctgtctgattacaatgtgtggagcatgctaaagcctataaatacaactgggacattaaagcctgacgacagggttgtggttgctgccacccgggtgagtgttggcttctgatcaggatgggcagggctggcacaaaaagagctggtaggccccgctctagcatatcagatttcaaagttgctaaattgggaagcctcaaatggggaggaatctgggctgtgggactcctgggttgtctccattgccacaggacaggtatattctcttgactggagcaagaaaggaggtttggggccagttttaaagtatatatcccctgacttttcttctgttgtacctagctggatagtcgttcctttttctggaatgtggccccaggggctgaaagcgcagtggcttcctttgtcacccagctggctgctgctgaagctttgcaaaaggcacctgatgtgaccaccctgccccgcaatgtcatgtttgtcttctttcaaggggtaagggctctttggctggggtgcaatggcagggaagaaagaggatagtaaagatgagagtggctactggttggagaagacctcagcacttgacctaagttgttaaccagcacagagcttctggatgtgtctacatgtgtctcccctttagattcctccattttaggaagcttagattccttctttttaggaagcttttacaccctgaattggtatgtaaccagccccctctttcccccactgataagatatattggaggcggccttttacttttattctctggactcctttactgctatctccatccaggagccgttaggctcctgactctcatcactaggaccacagcagaataagggaacagcatctgtggctgagtcactggaggtgggggaccgttaagaatcagacacataatagctgatgttcatcttagacctttactaaggctactttccccatttctgggcttcagaagtcttgtaatacatatgagggatagtcacagctgggaggtggggccaagagaagccgaaagtcacatgactgtaagctgactagcagttgaggtgacctgagatagtcgtcttacctacagctttgatgatctggccgccttcgaggctctcctaaccctttggaatctctgttccccctcccacctacctccatctctcaggaaacttttgactacattggcagctcgaggatggtctacgatatggagaagggcaagtttcccgtgcagttagagaatgttgactcatttgtggagctgggacaggtatgtggcatgtcccccagccccttcctttttaattaaatcttcctcctttgttgttctgcggtcttaactgcaggaaccaccgcctcttcccttgacttctatcccctaggcatggcccagaacaggagactgattctaagtgttgtttcttcatcctccccccaggtggccttaagaacttcattagagctttggatgcacacagatcctgtttctcagaaaaatgagtctgtacggaaccaggtaacctgagcatctcccctcatttcctattcctacagctcagaatccagaccccaacccctgccctgtttccaccaacccccagggcctgtgagacagggtaagagacaggattggattgggtgttggccaaaggatgaacaccacagctgttgttgctgctgggaagaatcaggaactcagtgacattccattggttccctggactgggtagttctctgatcatttgttgcctagcagactaccactgcccattaaggataggtgagtgactagctcccttcttgccttgctgccccatggatccaattgtcaaggctgctctacccaagtcctggctgtgtcacactcgctgcccaacttgtcctccactttcctcattgcttgttcaaaaccttcccttccctctaggtccacctttaggcctgcttttttccaggtggtcctctttctgcaattccagccttcagcatcatccctgctctggactcctgtagcatttaaagaattggttatctgtttggcattcagcacgcagttttctattattatttgctcccttcaattctgcacaataaataataagtgaagcatccactgaggataaagcagagtcttgaagacagtagaatttacttataaatatgaaaaaaaaggtctcttctttatgccccaattttctaactctaaaaagaatggtggaagctacaggaaattcagagagccttggtcccaaaaggcttgagggataaaggtctactagagatagggtagctccccaagcagggaacttgaagtatagagcatttcaggcctaaaagagacctcctgcttcccatcccccagcctcccatcagttaatctccctcgtaccccccaggtggaggatctcctggccacattggagaagagtggtgctggtgtccctgctgtcatcctcaggaggccaaatcagtcccagcctctcccaccatcttccctgcagcgatttcttcgagctcgaaacatctctggcgttgttctggctgaccactctggtgccttccataacaagtaagaatcacttggccctgcaccctcttcattcttgaagagagtctattctgcagtctgggaggaaggtcactgccctccgctttcccacactaccccctccagaacttcaggtccatctgtattctttgctcagtggcgttttcacatctgaactgaaacccttatttgtttgactggatattcatcttagaaactcatcctcacccttagccctttactgtcaacaatccttggttatggttccactgctccctagctctccagggtcctgagttcctcagggttgccagcagagggcatcatctcaaacacaagcatgggaaggatggtgggggccctttggctagaagacagaaagcagtccttctctggaactcacccagaggtgccagaaacagtattcatactctgtgaaatgtaccatgttcttgccatgtggtagatggccatggttcagtgcgagggtaaaagtgcctcctatagctgatggggctc

SEQ ID NO: 56579 - DNA, 1957 bp, Homo sapiens
tcatcgccagcaaagagcttgaggtgagatggggcaggggcataggtggcagggatctgtttgacttctttctctgctttcttgtgtcatatagccctttccatctcccatttgccccacatttgtagcaaaagcctactgcaaatctgtccctggtcagccagcatgttcccttaggaggccttttttttgagatggagtttcattcttgttgctcaagctggagtgcaatggcacaatctcagcttactgcaacctccgtcccttgggtttaagcagttctcctgcctcagcctttcgagtagctgggattacaggcatgtgtcaccacacccagctaatttttttttatttttagtagagatgggtttcaccatgttggtcaggctagtcttaaactcctgacctcaggtgatccacctttcttggcctcccaaagtgctgggattataggcgtgagccactgcacccggccaggaggcctttcttcacagatagtttgagtaggtgttcattctggagagcccctgtggatcccagaactctttcacagcttcaactcccggctggcattccccatctggcacagctgggatgagtcagtctaatgtaccgagctcctgtcacaagtcagtaatgtaagtgccgcaagggaaccaaagccatgggccctcctttcaaaatgcctaaaatctaagtaatacaagatggaagcaagaacagagatgctttacttctcttttcaaatggggagacaaagtctgtaggctggagagatgttgcccatgattattccatagttggtgcttagagccagcatccgaattcccatggctccaaaccccaaacagttatccaaaaaactgcactgagttctgagaatgcctttgtcctttcctgccctccctccccctgcagttgatcaccctgacagtgggcttcggcatcctcatcttctccctcatcgtcacctactgcatcaatgccaaagctgatgtccttttcattgctccccgggagccaggagctgtgtcatactgaggaggaccccagcttttcttgccagctcagcagttcacttcctagagcatctgtcccactgggacacaaccactaatttgtcactggaacctccctgggcctgtctcagattgggattaacataaaagagtggaactatccaaaagagacagggagaaataaataaattgcctcccttcctccgctcccctttcccatcaccccttccccatttcctcttccttctctactcatgccagattttgggattacaaatagaagcttcttgctcctgtttaactccctagttacccaccctaatttgcccttcaggacccttctactttttccttcctgccctgtacctctctctgctcctcacccccacccctgtacccagccaccttcctgactgggaaggacataaaaggtttaatgtcagggtcaaactacattgagcccctgaggacaggggcatctctgggctgagcctactgtctccttcccactgtcctttctccaggccctcagatggcacattagggtgggcgtgctgcgggtgggtatcccacctccagcccacagtgctcagttgtactttttattaagctgtaatatctatttttgtttttgtctttttcctttattctttttgtaaatatatatataatgagtttcattaaaatagattatcccacacgacttgtactgctagttattcttcccaggccaccttgttcagcgagcctagactggaagtcatgaagttatcttttatgctatcatcttgggctccagaggacccaaggagtaaggctctgtcaaaaacagttgaagtcctttcaaattgcagagccctggttctcctcttgtaagaacaatgttaacatagtttcttctcactttgtaatgaacgggcattttttttttttttttt

SEQ ID NO: 56580 - DNA, 1846 bp, Homo sapiens
attggattttgtgtagtcgggtccgtggccctaaagagaatatggccagccccagggatctgggggctccttctccgacaggaggggtccaggaagacagccccaggagggactgcgggctgggccaagtccaagaatcgaggcattcccctgcccaccgttcgggacccgagtgtcagccccaccgcggattcccaggatcggggagggccgctgggcatctgaaggcgcagggctgggggagcggcgactccgggaagagcggggccgcagacaatggacgcggcggtaggaggggcggcggctgtgggaacagccgggaggcggcacccgggagctcgcgctcccccgccccctgcaccccccaccctcatcccctccccctccgccccctcccccctgcgccgccggctcccgatctgattcctgatccttgattccttgatccttggtcccgccatgggagcctgagcgccccctattcccccctggcccccagcccccggggccttgagggggaagaggcagcggtctgggacggagcagggggtgaccagactcaagaacccccccctcaacatcccccatcgcgcgcgctgcctgtccaggagcgccgagttcggagcgacccggagcgctgcggatacaaaggcgacgggccgagcggggcgcccgcggagcccacccggcagttcgcagcggcgggtgagtgccgggccgcgggggcgcgggcaaagtttgaaaaaaaaagaagaaagaaagagagagaaaaaaagaaatggaaaaggaggaaaatcatgcaaggggccagggggtgcccgaccccagagcgagcggggtggcttatgggggaaggggggctggactccgggcaacccccttccggtccgcttccccactgcacagcggagtaccccccccaactttggggaggggaaggggctcgtggggagggggcggagcccaggcctggagagccggggactttcctgggcccgggcgggggccttaatgatcccaggggagccggttgaagccggagacggggagcttgtgttggaggtggggggagaggcgtggaaggatcggagtctggaggtattggaagccaagggtgttttggggtgcatacacccctcaggagcgtggggagggacggaggcaggtatgcgttaagggtgtagagtggagtcaggggggcgggttgggcagagtagatagggtgtatgtacagaccgaggatggggctggaggcggtagactgtgtataggggccgaggggacaggcgctggcatccctctccccactcatatttacccatctgggggactgtgggctctgcgttagtgagttttgaagggttggtggaggatccgtgtgcatgattctttgttttggtgtgtgtgcacgccttgacgtgctgcatgttcctgcaggtgggcccctggtttggatgtgtaggtgtttttctgtgcttgagtgtgtgtgcacccagggagcggctgaccatgcatctgctgtgtgtttggatatgtgtttatatgtatacttaggggagggcgtgtatgtctatgtgtgtgtactgggagaggggttcacgggaaagaggtgtgtaggtactgaggaaggtgggtgtgtaagagcagaatggagtgtatgtggataggtgtgtgtgcacctgtgtactgggaaggggtgtgaatctgtgttctcttgtgtgtaacctgtgttgatgggtatcaatgtgtgtgcctgccttagctggtatgtatgtttctgagtgtgtgtcgggggtacctctagactctgcaggcagattttcctggcaaaaatcccgaaaagaag

SEQ ID NO: 56581 - DNA, 1048 bp, Homo sapiens
ataggagaactaggctttggttctgatcttcctttggccgaccacattaggcactctctcctatctgccaggcacagtgtgaagcacaggggatggaggggcaaataagatgttttcccaggggagacatgtgaaaacatgttgattcactgcagcccagtgagtgctgtgtggaggtgtgttcaggaggccactggagcatagaggaagagtgcttggccctggggtgaggtgccagggaaggttcctgcaggagatgccctgttagctggattttaaaaaaattaaggtgaaattcacataataggaaataaaccattttaaagtgaacagtggcatttagtacattcacagtgctgtgcaacaaccacctctgtctagtccccaaacatttgcaccatcccgaaacaaaacccatacccattacacaattgtcgccatttccccttaccccagcccctggcaaccaccaatttgcatcctgtctctatggatgtacctattctggatatttcatacaaatggaatgatagaatgcatgaccttttgaatctggcttccttcgcttaacataatgttttccaggttaatccacacggtagcatgtagcatgtattagtacttcattcccttttatagctgaatattattcccttgtgtggacagactttacctggttaaaggatgagttaggccaacaggaagggtcttaggatggcactcctggtggaggctgagcgtgagcaagaaggcacacagggtatttggtagtcctgtaccttgcagtatgaagtggggatttggcctcagtttctctgtctataaaacaaagttaatcatccctttcctgcttgtgctatgggcttggtagagttggaggtattaggggagaagagaggctagggtattattgcctcttctcagggtctgggctggggatgggacttttaaaacttgctctttcctcctctttcctgggcagctcactcctgtatgcatcaaccctcatccttgtggggagccatctccctgttcacttgacatcagc

SEQ ID NO: 56582 - DNA, 1009 bp, Homo sapiens
aggcactattattgccattttatagataaggaaactgaagtttggaaaaggggagcgactcacctgagattacatagctcgtaaaaggctgtgccaggtctgacttcagtgctcttccttttcccaaagtctcttcaccttcccctactgtcattccagttcggtctgattgctcattattgcctttaatcttgcacttgagtaattcccctgttttctgaaaagcaaacatgagtccagtgtcagcctgaggagtagagaagcctacccttgagggtgggagtcagagaacgatctcatctccaggaggagcaccttggtgtcataagcctggggcggggccagcatctgggcagaaacctctcctggggtgggtctctttctccttgctgggccatgattttggatgggggttggggtaaaggagtgactgtaggctccggccaccatggcccgtggggtcttgtttgtgaatgggaggagcctggtccttattgtctgtagggttttctcacagcccctaacaatgtccttcagactcctgttttcaccagagtgttcttggctccctcagcctggtcagagagagagggtgtgtttgtttgtgggtctagggagggggttctggtttttttttttttgaaaccgtttcgctcgttgactaggctggagtgcaatggcgcgatcttggctcactacaacctctgcctccctggttcgagtgattctcctgcctcagcctcccgaatagctgggattacaggcatgcaccaccatgcctggctaattttgcattttttggagaggcggggtttcaccatgttggtcaggctggtctggaactcctgacctcaggtgatctacctgcctcggcctccctaagtgctgggatcacaggcgtgagccaccacgcccggcccagggggtctggttttttagggtaagtagggtttagataggaacaggtgctgagcccgaagtgtgaatgcagtcacttaaaaaacaacag

SEQ ID NO: 56583 - DNA, 1031 bp, Homo sapiens
gcccttcccctgcggtgcaccctgcactggggtctgctggtgagaagctgctctggaagcctagatgcctggatgacacaagcatggccaggatcccacccctcctctgccactcagcccagtgaggagaaggatcctgcccccaccctggggctatgaggatggtgagctcatctctggggctgtcctgggagaatgcctggttaacagggcgggggtggggcacctggtgccagctcctgggctccctgctctgcccttcccacccctcagcccaccaagatacagctgttctctctggcctcctgggcagcactgtcacccaaggacagcctttttcagggtttaggaatgagggtcagggcaaaatcttcatcctatttttggtccagggctggagctggtccttgcccactctgtaccttagtcttttcggtgatagcaaaagcccagcctctctggatgggtggcttgcccatagcccaaggctggatggggatgaaggaacatcaaggttcttagttgtggtagatggatgggtgcaggaaccaccccttttggggatagaggctctttggttctggctgtcttagctgaggcctgtctagtctctgtctctttgtccctggtgagaagagggggcaggacggagtcagcaaatcctctcctgtcgtggccctcttgcagttgtggctactcaaggaaccagtgtccagagcagtctcatggagaaacctggtctcactccaagaggagcactcctcaaagtcagtgttactacgattttccaacaattagaggaggccagaaatgggctgccgtagaagtagtggccatgggctagtcaccttctctctctgggtcccacttttttatttgtaaaatttgaggttgtccctctaaggcccctttcagcttggtgctgggaactgctgagaagagggtggttcagccagctgtgtcctcctgaagggaaaagggaaagggaaagggaaaggggaaggggtgtcaggggaatgatatgggcatag

SEQ ID NO: 56584 - DNA, 1029 bp, Homo sapiens
gtgtctggcttcaaggtgtattccctcggagagggtgagcagccctgctcctctgcccttccctgtctcttcccaagcaggactccaagttcccgcctctcttttaccctttgtcccttgctttttcctttccttagcccatgttctagccgcttctattcagtcatttcccttgactccaggtggctgatcttagctgctcatcctacttgctgtccctttatgctatggcatgtcccctgatctggctcctctgtgtctctcatcagccctggtctaagccctttggctctcggagctgcagaaccccctgcactggggaggaacaactgcaggactcttgcgcttccagtgccttccttgttgctttcctatggcctctcccagaggtggccaggagggttgggattaggaggtattgctgggtggtgggaacagcttcttctggacatgtcaggctgctgtctccagagctcctggagtgggaagagaggccacactctgatgtgaccatctcctctatcctgttcctgtgcagaaaacagcaccaacaactccactggccagtctcgggctgtgattgcagcggcagctcggaggcgggacaacagtcacaatgagtactactatgaggaggctgagcatgagcgaagggtgcgcaagaggagggccaggtgggtccctgggggagaagaggagaggaggtgcttgttgggtgaatggggagaggaagaccaaggaacttctgtaactgctggaaatatagggcaatgatgacatgagttgggggtgtgtgcttgttttccgttgctgccctaacagattaccataaacttagcagctgtgaaacagcacacatttattatctcccagttccatgggtcaggtgcaggctggctggaggctgtgctcaggcctcacaggctgaaatcaagaggactctcatctgagcctatgctttctctttcaagctcattattatggggagaattcagtgccttgtcacatagccccataggcagtttacat

SEQ ID NO: 56585 - DNA, 4397 bp, Homo sapiens
agccattgcccaccttcaactctattgccagcttcctagaattgctttccctgagccacccttggtgagcaggtaactaaagatgttgcactttaaccttgacacctttggctccctcctggtgcagacctgcttggcacgaatcatacaagctgtgtgggaaggaaggaagaatgagggagggcttgcccaggtcacagcctggtgcagggagaagagcagcagatgggggtcaggggagccgagttcagtcctacctgatgagccacatccccctgtgcactccggcttcttcatttataaaatgagggtctgaagcagatgatctcaggccccttcctgctgtaacattctgaggttctagttcatatgcatagagtgagctcagggacgtccttcttgtctttggaaactatgacctaggggatgaaggaccgtgggtagatgacagagattcttatgcagccccttctttccacttcaggccttcttggagcgatacttggcggctggacctaccatccagtaccacaaggaacgctggctggccaaacagtggacattggtgagcgaggagccggtgaccaacggcctcaaggatggcatcgttttcctcttaaaacgccaggacttcagcctggtggtcagcaccaagaaggtcccattcttcaaactctccgaggaatttgtggatcccaagtcacacaagtttgtcatgaggctgcagtctgagacctcagtgtgactgtgcaacagcagggggagtgggaaactctggggggtcctgagggggtgggagggggcttggttctcaggcccagccacattcctgccacccttcttcttcttgctcttttttttttacttgaattaacgcacccccaccttctctcctcgcttcttccttattttaccccatgtgaacctggagagaccatcctgctgtcaacagtacctgggaaggactcccacctcaccaacaacttttgtattactctaggccctgcaggaatcagtgcctctctccctcttctttccctagtcttttcccagattacagtctctcctgaaagggcacagggccctgctgattgtactttcccctcctgagccccgactcacaaatccaagttcttaaaacatttctcttcagtggcccaacagggtttctctggggcacatggacatgactccagagagccacagtgccaaactcctccagggcagcaactggccctcctgtccctcaccccagccacaacaaaccctgggttctagggcagggatactcctgccacacagcccgagttagaaatctccttgctaggagcatttgcttccacatatatttagagcaaagaaggatcccatccttttcccagaaatctccacctaatgtttttggtttgtatggtcacgtgaccataggcaaccacgtggaaaccctctgtgaccacttttccagggacttaggggaaggtacctttcttccaatgtgtcttcctaggcagcccctgaggaggagggctgaatagatccctgaggttttggagagacccccatcactgactcctgctccctaaccctaccctcactttcgtccccgctcttcccagtgaaggatggtatgtagactcctgtacagacatagtggcttgcagaccctgacccagcccctgtggtcttagacaaatgtttttatttttgtcaccagccacccctgtcctgccgccttctctcgactccagagacctgttgcctcatctcttttggggaagagccggcagctcctcctcatcccctgccttaagtccagttctttgcctcaggggtctcgtttccttggccttccagggtccccaccccttttctccctgcctgattctctgagctctgggctccgtctgtattgggttgaggggcaaggattactgccttttgtaggtacttcacccctcaccccattttagcttccatagtctttgcaccaaatccaaattcttgataatttagatctcattttgagcaaaatttgctggccctctaataaatattttcaatataaatctgagcctttgactcagacatttttgccaaggagagtagaattaggaagtacccatatacatccagccaggatccacatggaggacctttctgatggctgcaatgactaggccattcctctgagtaactcacagtgtccttttgtaggcccttcttttccctgaaagactggttggtacttaccttgcagagcacatcctgggataagatccccagtgtctcccctgggaggctccccctctgtgtagcaccagccctgggaatgatggagcctagtgatcggggtttctcctgctgtcctttctgcaaaagttcacttgtttacccaccgcatgctagagaggagctcattggccaatgcttaccttgtccccaaaggggtgggttgtggagctcacttaggcagggcctctggctggggccagggttatgagataggcctgtatgaaatatgtcctgttctgggggtctgtctcttttcttctcttcaaaaactttgtgtcagagagtcccttctgagtcacataaatacctcactatcctggaaaacagggcctggatggtgactggggtcattgcctttgtggacaggatggagtgtggtgtggtctgaggagcaggttggggtgggggagagggaaaggatttgggatcttagttgctgccctaggttaggggctggggagtgtttattttaagatcctgccatgtttttaatcactgtgatttttttttcattcccctttcctaaaaaaaattttttgcctccaactctctaagcactaagggctgtgcctgagaatggtagcattttggtcttttgcttcagaactgtggtatctttgtcttttttcattattattattattattattattattattactattgttttttaaaatgtcaggatgaattgtcagacatatggccatgtgtttgtcctctgcttctcccctgtgggaagttgtctccatgctgtgaactgctgtggggtgtgcagctgactcagtccctctgagcagtttccccactgtgtctgtcccatcatgcgctggatctgctcattctcctgctgtgggggtatgcccacctcttacccccttgacaccatagggctgctgtggctgggcctcaccagcactgtcttttgtgtgactcatggcatcctcgttcatccccaccgtgcctagcaggccttccttttcaccacctcggaacgcttgcctttcctccctccacaacaggacgctgtgcctcagtccttcacctacctcgccactctgccactgtccccattggtcctttctcctaaactggtctttgtgctctctttgttttttcttatttccctcttgtctctcattttttcttcccattcccctcccatttcagcccttaacttttctctttcccatctccactcagtattccaatggcaaaccctgatgatgtaacacctgcgatgagacatcggactctccggaactttctcatctgacacgtctttttcccagggttcgtacttctcctccattggtcccaggctaactcccctgttcctctgtggtgtctgtcagtccgtctgtcttctctttcctctgcccttcccacagggcagtatctgctgatggattcagtcctggtgtgtgattgttgtgatttgttcttccgtgcgcaaaaggaagagggctttttgagtcccttccaagtgagattgtaaatgtagaattttccactgttggatctagattttttttccttttttttgggggggtggggttacagagctgagaccttgtgcatgcatgtagaaaattgtaaaatgtaaattttttttaatatataaaaagcttgtttctacagtttgcagtggatctaaacattacggcaattttaggatttttttcttaaacataggaactaaaactgtacaaattttttttatataaaataaagacatttgacttttgtgggggcattctgttgcttttctttctttacaggaatgggagcaaatgagggccagggaataatgaatatattccttgttagggagggaatgggcaggagggggcagtgtgagctcatcattgctctgcaggccttcagggtgtgttggagagaaatgggaaaatgaaaaaggaaattgcttattctgaatcctgattctaaagagagagaaacaacaatgtgagggcttaaccacttcctggtgtagttgtcaggatagagaaagaaagattacttcctgggtccaccctcctgagcaagcttgtgtctgtatggcctctagggcaggagtgggtttctaaaacgtatttctaaaacat

SEQ ID NO: 56586 - DNA, 1016 bp, Homo sapiens
ctgttaatgttagttctctttgacataagaatgtgtgattttagggtggggttggctgggatggtttttactgtaataaagaacacttgttgaaggacttcttgtcttctgtcagtttacttatatcttaacacagtacctctggcctcaaagatggaatccagttgaagtgaaagcagatccaaactgtatcatcagggaaagctgagcttgtagaattcattttcagtgactggtacgagattgtgtacttctggtttggagcatattgaagaattcgaccctgggcaacctttttcctggaattgaaatgttcatcgggtttttactctgtcttgaaataggtccccaaaatagagtttttcaaactttaatggtgcgtatagcaagtgtacaaatcacttggggattatgtgaaatacagaccctgattcaacaggtctgggtagggtctgagtttcttcatttcaaacaggtgcccaggtgtcttagtcagctcaggctgctgtaacaaaataccatagactgactgggggtcttaaaatccagaaatttattcctcatagttcttgaggctggaagtccgagattgggctggcaagcatggttaggatctgatgagggatctcttcttggcttataggatgctgctttcttgctgtgccctcacatggcagagagagagagagagagagagagagagagagagagtgagagagcgaggtttcttatgtctcttcttataagggcactaattccatcacgagggccctagtctcataacctcatctaaatctaattacctcccaaaggccgcatttccaaataacatcaaattgggggttaggcttcaacatatgcattctggggcaacacagtataaagcaccaggtgctgctgctgatgttctacagaccttattttgagcagcaaggccctaaaagaagcttaatatacccctgaaaatttgagggtcctaaacacgccttacttaactctaagataattgatgcaag

SEQ ID NO: 56587 - DNA, 1924 bp, Homo sapiens
aagacccatcagtgtgctgtattcaggagacccatctcacatgcagagacacacataggctcaaaataaagggatggaggaagatctaccaagcaaatggaaaacaaaaaaaggcaggggttgcaatcctagtctctgataaaacagactttaaaccaacaaagatcaaaagagacaaagaaggccattacataatggtaatgggatcaactcaacaagaagagctaactcctaaatacatatgcacctggcactcccagccggccacagcctgacacgccgcgcggccccccagtctcccgcggccgctcccccaggcatggcacagggcctcgcctcactatggcagcagcacggcacagcacgctcgacttcatgctcagtgccaaagctgatggtgagaccattctaaaaggcctccagtccattttccaggagcaggggatggcggagtcggtgcacacctggcaggaccatggctatttagcaacctacacaaacaagaatggcagctttgccaatatgagaatttacccacatggattggtgttgctggaccttcagagttatgatggtgatgcgcaaggcaaagaagagatcgacagtattttgaacaaagtagaagaaagaatgaaagaattgagtcaggacagtactgggcgggtgaaacgattaccacccatagtgcgaggagagccatcgacagatattggcccaccgccgatgggcgcctggttgaatatgacatagatgaagtggtatatgatgaagattcaccttatcaaaatataaaaattctacactcgaagcagtttggaaatattctcattcttagtggggatgttaatttggcagagagtgatttggcatatacccgggccatcatgggcagtggcaaagaagattacactggcaaagatgtactcattctgggaggtggagacagaggcatattgtgtgaaatagtcaaactaaaaccaaagatggtcactatggtagagactgaccaaatgatgattgatgggtgtaagaaatacatgcgaaaaacgtgtggcgatgtcttagacaatcttaaaggagactgctatcaggttctaatagaagactgtatcccggtactgaagagatacaccaaagaagggagagaatttgattatgtgattaatgatttgacagctgttccaatctccacgtctccagaagaagattccacatgggagtttctcagactgattcttgacctctcaatgaaagtgttgaaacaggatgggaaatattttacacaggggaactgtgtcaatctgaaagaagcactgtcgctctatgaagaacagctggggcgcctgtattgtcctgtggaattttcaaaggagatcatctgtgtcccttcatacctggaattgtgggtattttacactgtttggaagaaagctaaaccctgaagatcagtagcccctaatcacatgtgctgcaaatagccttcctgacctccatatgctgtacatgacatcaaaatgagtcaggcaattgattgtgaagtccttaaagttttcctttttttagtaattatttttaatttaaaaaagcaaatggaaaatgtatattttgatgagcttagggtgttttttttgaaagtcagctgaaggatggttagacagcacagcgaagactgctaaatgcactgacccccccattagaatgtgatttttgttcctttttatttatctgtgggcttttgtttttgtttttgttttggtagatcttcagtttggatatttggaggagtgaacatcgttgttttgctggagggaagatcttgatggtgtttctttccccaaaaattgacttagatattaaaaattggtgcttataagagagagttaaaaaaataggattgcttcaattaaaattacaaaagagaaaa

SEQ ID NO: 56588 - DNA, 3401 bp, Homo sapiens
accttcaagtccgtgacacgggaagacactgggacatacacttgtatggtctctgaggaaggcggcaacagctatggggaggtcaaggtcaagctcatcgtgcttggtacgtgccccatgtcttctgggtgggcctggagttagttacttctcatagcaggctctgctgcactttggagctctttgatggtgagaatacccacaggtgggctattcagagtcctggagctgccagagagggagatgagcccctggttaggtggcagccaggggcatggtgagagtaggaggcttgagctgagtagttgggggtaccattgtagttggttacttagactcaagcagcccccaccctgtactcagcaccttctgtctttctcttccacagtgcctccatccaagcctacagttaacatcccctcctctgccaccattgggaaccgggcagtgctgacatgctcagaacaagatggttccccaccttctgaatacacctggttcaaagatgggatagtgatgcctacgaatcccaaaagcacccgtgccttcagcaactcttcctatgtcctgaatcccacaacaggagagctggtatgtatggggtggtggtgaaagatgtgtgggggatgcagttatagaaccccaaaaggtgggaggaagaacaggcaacagggtgaacttggaactggggtcaagagacattaaaaaatgtctattttgcttcttcagcaggaagccaatttgttttccttcctcaggtctttgatcccctgtcagcctctgatactggagaatacagctgtgaggcacggaatgggtatgggacacccatgacttcaaatgctgtgcgcatggaagctggtgagagttagggcttgagcccagacctggggtggggattggggtctgcttttcatcctgccattggtgatactgtaggtgccgtgagtgagtatccccgtgcctgacttcttatttgtgtctcgcagtggagcggaatgtgggggtcatcgtggcagccgtccttgtaaccctgattctcctgggaatcttggtttttggcatctggtttgcctatagccgaggccactttgacagtaagtatctgcccccagaggctctcctttgtactgcccccatcccagggcctggcatgggtgtcatctgagtactgaccctgatactgtgctcatgtgtgtgggtgttgtcccctggggaacactgatcacccatctaacaccaagagctgggggcctgcccctccatcttcccaagccatgctgtcttctgtcctgctgacactcatgatcccatttcttctctttcaggaacaaagaaagggtgagtgaggtgctgtcctggggttctccaagtttgagagcatggatgcatgtggtttgaagctgaagtgggcctaggggaatgggttgaaggcagaagcaaccagtttggagggaaggcatttggatatccagccctttctctgtggccttggccctgggtctgtcctgttaccccacccatacctgtctgctgcgcactctgtgcttctgtagcattctcgcttctggcctttaaagttggcaaggggaggttaataagcacctaggtggctgagtgtctctgtcttctggcttgttcacaggacttcgagtaagaaggtgatttacagccagcctagtgcccgaagtgaagtgagtatgcctcccctgggcaggggtgggccacctggggctggagtgaggagatttctagcccatgtttatgtgttttggggattatcagctaaagaagactattgagagttgactggatgttttatttctgcagggagaattcaaacagacctcgtcattcctggtgtgagcctggtcggctcaccgcctatcatctgcatttgccttactcaggtgctaccggactctggcccctgatgtctgtagtttcacaggatgccttatttgtcttctacaccccacagggccccctacttcttcggatgtgtttttaataatgtcagctatgtgccccatcctccttcatgccctccctccctttcctaccactgctgagtggcctggaacttgtttaaagtgtttattccccatttctttgagggatcaggaaggaatcctgggtatgccattgacttcccttctaagtagacagcaaaaatggcgggggtcgcaggaatctgcactcaactgcccacctggctggcagggatctttgaataggtatcttgagcttggttctgggctctttccttgtgtactgacgaccagggccagctgttctagagcgggaattagaggctagagcggctgaaatggttgtttggtgatgacactggggtccttccatctctggggcccactctcttctgtcttcccatgggaagtgccactgggatccctctgccctgtcctcctgaatacaagctgactgacattgactgtgtctgtggaaaatgggagctcttgttgtggagagcatagtaaattttcagagaacttgaagccaaaaggatttaaaaccgctgctctaaagaaaagaaaactggaggctgggcgcagtggctcacgcctataatcccagaggctgaggcaggcggatcacctgaggtcaggagttcaagatcagcctgaccaacatggagaaaccctactaaaaatacaaagttagccaggcatagtggtgcatgcctgtaatcccagctgctcaggagcctggcaacaagagcaaaactccagctcaaaaaaaaaaagaaagaaaagaaagctggagctggtggcttaggccatcacccttcccttggctggaactactggacagacccttttgagatgtgcctgtggtgctgtggagatgtgtgtagtggtcttagctctttgttgagcttgtgtgtgtgttgtgtagtcttagctgtatgctgaaattgggcgtgtgttggagggcttcttagctctttggtgagattgtatttctatgtgtttgtatcagctgaatgttgctggaaataaaaccttggtttgtcaaggctcttttttgtgggaagtaagtaggggaaaaggtctttgagggttcctaggctcctttgtacaacaggaaaatgcctcaaagccttgcttcccagcaacctggggctggttcccagtgcctggtcctgccccttcctggttcttatctcaaggcagagcttctgaatttcaggccttcattccagagccctcttgtggccaggccttcctttgctggaggaaggtacacagggtgaagctgatgctgtacttgggggatctccttggcctgttccaccaagtgagagaaggtacttactcttgtacctcctgttcagccaggtgcattaacagacctccctacagctgtaggaactactg

SEQ ID NO: 56589 - DNA, 1067 bp, Homo sapiens
aacgtgtcataatgtacacgaaaacacttttaaaagcaccacatgctccacaaatgtcgagtattattattatcctcatcatggctctgcccttcccttccatcccttgcctccagccctgctggcttccttccaggattgtcctgacaagtggctgcaatcatttgttgagaagctttctctgaacagtgaaatgtcattctggaagctgcccttggactagtagaaatctaattagattattgggagtcacagagagaaaaattagaagcaaaagaaactgcattcccatggataaaagaagtattagctggcaattgtagcaaaaagcacttaaagaagacatttaggatcatggtgacaaagtgtgagagccagagggagcataagtctggaatcccttcctcttagggtctgtgaatggagaagccctgtccactgggtctgtgactccttcttcctggcatttctctgtccactcctgacagggcccacctctttctttctccttaggctccctggcattgggcagtgttacagtgcactcttctgaacctgaagtcagaattcctgagaataatcgtgagttgggaggggccatggagggtgtgagggtgagcagttgccggccgcctggggatctagagagcacccagcccagcctgcagtttggggctgttccccatctcgtgtatttgctgctgcttcttccttcggctcattttgaccctgtctgcagctgtgaagttgtcctgtgcctactcgggcttttcttctccccgtgtggagtggaagtttgaccaaggagacaccaccagactcgtttgctataataacaagatcacaggtgagttgcttctcctccttcctgattgcctaggttgtggagggattatcatgcctggattctacgatccagactttgtgcccttatcccagggcacaccctggggctgaagtcctcatggccttcctacccccctttctgggggaagaggagagcacttgcgtaccttggatgcccccttcatcagcctcccttagctctccagttcactctgtccttg

SEQ ID NO: 56590 - DNA, 1108 bp, Homo sapiens
gcctgcctcagcctcccaaagtgctgggattacaggcgtgagtcaccgtgcctggctggagaatggactttctatacatgggcccaaaacctaagcaggccaaaatctattgatgcctttaactttgtggcttttcttgttgtgaacttagagaaaattaaacttgacaatggaaaggatggaatttccttctattattcgtttaccacgtacatcagtaggacatttgcatgtgtgtgtacagtatggtatgtatgggcccaaggttaagtgcaaaaggggggctgtgaagaggcacgggaaaatatgaaatagatgaggaggatggacagggaaactgtgagtgtcctgatgtagattggattcagtgagagcaagttcctagctctgctggtacagctgtgaaggttctagagaaggggccgccttcccaaggcagctgcaatgacaggggagatatggtttggtaggctggagtaggcacttttcaggctttatttatatgtcttgttgaagaaaacattgaagtcagaaagaagtatgtgtacagaagggcctatgaacagatgatgataatcataaaatataatacttatttggggtttcctgttcagacactgctctaagcactttatttgtacagtattagcttgtttagccttcagaacagccctttgatgtagaaactgttattatccccattttacagatgcgtaaactcagatttgaggaggccaagtggcttgtccaggtcacatagcctagtaagtaacagagctgggatttttttttttttttcttttctgagacagagtttctcccttgttggccaggctggagtgcaatggcacgatcttggctcactgcaacctctgcctcccaggttcaagcaattctcctgcctcagcctcctgagtagctgggattacaggcatgcaccaccacgcctggttaattttgtatttttagtagagacgaggtttctccatgttggtcaagctggtctcgaactccccacctcaggtgatctgcccgccttggcctcccaaagtgctgggattacaggcatgagccactgcgcccagcattttttttttttttttgagac

SEQ ID NO: 56591 - DNA, 1073 bp, Homo sapiens
agcctgggcgacagagcaagactcagtttccaaaaaaaacgaacaatgaaacctaaataacgttaaattgttcttgtacatgaatttttttttttttttttttttttaagatggagtcccactctatcgcccagactggagtgcagtggcgtaatctcagctcactgcaacctccacctcccaggttcaagcctcagcctaccaagtagctgggattcaggtgcctgccaccacgcccagctaatttttatatttttggtacagatggggtttcaccattttggtcaggttggtctcaaactcctggcctcaagtgatccgtccgcctcagcctcccgaagtgctgggattacaggcgtgagccactgcacccagccaaaatatttaaacttatctttgattgctttcttaggctatattcctagaaattggggtgagattaattttgactgaggaaaggtataagagatcaatagacatttgaacaggatcttgaaagatacatgggatttccttgcttgtccaataaagctacatatagcataatagttttagagcctcaaaatcaggcagagttaagattcctaccttgctatttgtagccatatggtttggatcaactgttttttttttttttttgatggagtctcgctctgtcacccaggctggagtgcagtggcttaatctcagctcaatgcaacctccccctctcggcttcaagcaattctcctgccttagcctcctgagtcgctgggattacaggcgcctgccaccatgcccagctaatttttgtatttttagtagagacggggtttcaccacgttggccaggctagtctcgaactcctgaccttgtgatccgcttgcttcggactctcaaagttctgggattacacgtgtgagccactatgcctggcctgggtcaactgttctaagcctcagttttttcatctgtaaaatgaaatggtaacggtagtacttcaatcttcaatggtacttgtctcataggttttttttttttttaagagtttagtgagaaaatgcatataaggcctaacattaataatatgccac

SEQ ID NO: 56592 - DNA, 1065 bp, Homo sapiens
caccacacccaaaaatagatttaaatgccatgcacattttatgtgataataatgagacttgtttatcacatctgttaggtttgactagagaccctggagatctctaaactcaaaccagtttctgtttcagagattcaggaaagacctggatgaccttgcgtccaacataattgaggatgaggtttcactattgtgtgacggttgtggaaagcagtatgagtgaacacatactgtgagagtggatacacactagggttttcctggcattgagaacccagagttcatctgcctggactccctgataagcagggtttctgtctaaagtccggctgcgtcatttgtttcacaatgtaggggcggaacaggaggaagcagctggctggcaggaagtgggtgctgggcccctgaagtaagtcctgcgctggaaggctcgaccttcccttgcactgggaagatggggtggcgggggagctgagcaggtagaaccggaaattctgcagagagggcgggagggagccagggagtgaaagcgagcctgtcttaccctgccattaccactttctgccatcctcagaggacccgagccagctgatcgacatcactgaaagtgcagccaaggatggctatttagacatagcccagcctgttgttggcctcacagagccttcctcttgctcacacatttctaaactgttctaccccaaaccccggaaaggcccttccctgtggaacttccctggcccatggagcctcttgatctttacgaggaggccaacccttatgggagttacttcaatctctacagggtgagtggtggggaggaaggggaaaaccagagtggaagctctaggtccaggttctaattgtattgcagtgtgaaattcacttgttaatccaacaaacattggtgtttactatgttctgagcactgtgctagagattagggggaaaacatgaagttaaactgggtatgctgtagctggtggggtgaggaggccctgactcatccttcctattgcagggctccagctccctggcaactggggggtcttgtgagtctcatat

SEQ ID NO: 56593 - DNA, 1716 bp, Homo sapiens
ttacaggtgttgggctgggggacagtcaggtctttcccttcccacgaggccatatttcagactatcacatggggagaaaccttggacaatacctggctttcctaggcagaggtccctgcggccttccgcagtgtttttgtccctgggtacttgagattagggagtggtgatgactcttaaggagcatgctgccttcaagcatttgtttaacaaagcacatcttgcacaacccttaatccatttaaccctgagtttgacacagcacatgtttcagagagcaaggggttgggggtaaggccatagattaacagcatcccaaggcagaagaatttttcttagtacagaacaaaatggagtctcctatgtctacttctttctacacagacacagtaacaatctgatctctcttgcttttccccacactggtgagtcactcctcctttcctctccctctactcccaggagtgaattgttccctccaaactagaaactggtgactggcacttcctagttctacctggaactaggaaacgagtggcagtggaatttcagtgtcctttagtctttgccttctggctccagatcactttttttttttttgagacggagtctcattctgttacccaggctggaatgcagtagcatgatcttggctcactgcaacctccacctcccggcttcaagcgattctcctgccttagcctccccagcagctgggactacaggcacgcgccaccacgcccggctaattttttgtattatttatttatttatttgtttttgagacagagtctctctctgtcgccaggctggagtacagtggcacgatctcggctcactgcaaactccacctcccgggttcatgccattctcctgcctcagcctcctgagtagctgggactacaggcgcccgccaccatgcctggctaattttttctatttttagttgagacgaggtttcactgtgttagccaggatggtcttgatctcctgacctcatgatctgcccgccacggcctccaaaagtgctgggattacaggcgtgagccaccgcgcccggcccctaattttttgtatttttagtagagacgggttttcaccatgttggccaggctggtctcgaactcctgacttcaagtaatcctcttgcctaggctttccaaagtgctgggattacaggcgtgaacccctgcacctggccactccagaccacttttacctcaccatgttgctcttcagttcctttgtgatcatgtcttgtggagtctccagcccagttccgattcaagatagagctactgtgattttttttaaaaaaatttaattagaataggttaattgacatggttttataattaaaatgatatcaaaggggtggggtatctcattcccatgttgctcctgttcaccccaaaccccaatagtttctaatgtctcttcagtgtttcattttacagatacaagtatatataaataatacttgttttttctcccctttctgacacaaaaagaggcatactacatatattctacatcttgcttatatatatatatcatggagttttgttgttgttgttgttgtttttgaaacagggtctcactctgttgcccaggctggagtacaatggcatgatcatagctcactgcagcctttttttttttttttgagacaaagtcttgctgtgttgcccagggaggagtccagtggcgtgatct

SEQ ID NO: 56594 - DNA, 1056 bp, Homo sapiens
caccgcaacctccgccttccgggtttaagcgattctcctgcctcagcctcccgagtagctggaattacaggcatgcaccatcacgcccggctaattttttgtttttagtagagatggggtttcaccatgttggtcgggctggtcttgaattcctgctctcaggtgatccacccgcctcggcctcccaacgtgctgggattacaggtgtgagccaccgcggctggccatgtcttcctttttttctactctttgagttcccttttctttaatttcccttttttccctaccccttgcctattttacttctgcctgtattttagaactgctagtgacacccatagtcaatttttggttatgtggttctggtactaaaggtttttccaacctttgtactgtgccagtatttttcccctaagcccagaagtttcttctgtgtgagtgactgtatttgtaacagtgtttgtctgtgacagtatttgtcaggcttaaaagcttcctggagctgcttactccctatcctttgccactgcttcctttcttttttctccctctaatttcctatattatttatgataatcctaaaataatcatatactggcactggaaggtcatgataacaccattttgagcttggaggtgtcttcagggaaccaagccacagtagtgcagagggaacctgagatgatgtcgcattagcctgttaggacagtgggtcctgggaagtgacttgtccaggggatggaggaactgaccttgtaacttttaaatcaggctagatctggggttgggttgggggaggggagtgatttggttagtgcaaatgaggatggaaatgggagctgggccaccatacctgcattctagcttggctttctctctgccttgtttgtgatcttaggcagtagctcagtcttttcatctgtaaaatagcagtaatacttgtcccacctttgtcaggaggatcaaccagcataatagttacattacatatacatgaagggattatttttgggcagctgttatcccctgtggattttgtgaggatggaagaatgcc

SEQ ID NO: 56595 - DNA, 1522 bp, Homo sapiens
aggcgccgcgaacaggtgctgcgggggcggcgcgggaggcggtgcccttgcttccggatccggtctcagctctgggagggaacgggagatgttgcaggcgccgagagggcgggccagggccgcactccggagactcgcggttgctacgcgcaccatggctggaggtacctgcgggggattcctggggccgcggttctcttggtcctctgggttgaggcgtggcagggagtggggtggcggagcgaaggggcgtggctgaggggtcttcgtgcacaccctaccgggaggggcgctgccaggtgaggggatgccatggcggccgtgactcctaggccccctcttcctgaaggctgtcgcgccccttcctcagcgcccacggtctcgcttcctgaactccgttcactcctagcctccggacgggcccggctcttcgacgtgcgctctcgcgaggaggcggcagctgggaccatcccaggggcgctcaacatcccgggtatagggtggagaggggacgcccaggtggtggaatagagaccgttcaggaggttctttgccaatgggacctcatttaggatggaatggggaaggcactgattatgggggtcctgcattcccgggagccagccctcagcttccgtaggaaggactgatggggggcggatcttggcatcggaactggcccatccagtttgagaagacagcaggcggagaggagaggggcagaccagcttctcttgacctccccaaatctggacgcctgagggggcatcccgccccgcctcctcacagcttagggagtggcttgcattcaaaagttgtcggtttctgttccttgaaattggggtgggggtaggggatggttatcatatgttgtttgggggcccccaggacccagcccttccaggcccagcttccgaacctgagtgccaaattgctggctttcccttctaccctctccactcctccagtgtccgagttggagagtgctctgcagatggagccagctgccttccaggctttatattctgctgagaagccaaagctggaagatgagcatctcgttttcttctgtcagatgggcaagcggggcctccaggccacgcagctggcccggagtcttggatacactgggtacggggaggtgtggctgctagctgggaggtgatggggactgcctgtcattcctgtcagtctctcacgcttctttgtctccacagggctcgcaactacgctggagcctatagagaatggttggagaaagagagttaggcaggaggcagcttactgattgccaccccctggccccttaatggccaccttaactaagggtgtgaacgggctgacttggtgaattgggcaactccttatagtgttgtgcacacaaaagcatcaaataaagaacatttaatcaaagtattggaagcacttaatgtgtcaggtggactgaaaacagttctaatctttatctagacctcaattcagccctggatcatcatttcgcagcattcatctgcttccccct

SEQ ID NO: 56596 - DNA, 1189 bp, Homo sapiens
aatggtagagagaggggcacacatgacagtagtcttatctctccctgaggttcctgtatccctgggagatattataccaccttccttagatgaaaatgaggtccaaagtgtgaacctacttttggaaagcaagctgggtatctgaaatcctagttctcattttgttgaccttatcttgcagagtaaaggtgggattctatccaaagcttgtgattatatccaggagcttcggcagagtaaccaccgcttgtctgaagaactgcagggacttgaccaactgcagctggacaatgacgtgcttcgacaacaggtcagactcctacccccagtgcagcccttctcagttctgctagccactgacccagtttgacaccctctactttgttctccatggagaaggcttcatcttttccccctcaccagtggatgtctgaatacattcaggggcttggaagtgccagctttactacccattccctttactgcctccttcccatgtcaggtggaagatcttaaaaacaagaatctgctgcttcgagctcagttgcggcaccacggattagaggtcgtcatcaagaatgacagcaactaactatggggattcaggggctttgggcccaagaactgcagatagcccaggagcaacagcctaatcccgtgcccctttccttcactgccccacttctggcatgggacagggggaagttcagaaggtgtgtccttgaactgaggccctgtgatatggcggcctgcagtggtgtgaaacacacaatgtggacgtgcactgacagccttgcccacccccaccatgcagcccctgggcccttgtgctcctctcgcacaatgcatgtgctgtctccatgctggatactggacacactaaactctggggcttgtcctgtgcttgcttagagtgcccagcagaggtttgctgacaggtgatgctctggcttgccccaggactctggcacttccattggttcttcctttccctggagctgaggtttagatgtgcaacctgtggctcaggggagcaagcttacacaagaagtgagggaaggatgtttagcagtggctggtgcccatgaagaggagattggccagtgagaagctgaggcctatgcagacatctctggagccagagagaacaacaggcaggggcccacttggggccttcccccttgtgggg

SEQ ID NO: 56597 - DNA, 1081 bp, Homo sapiens
acagaaggtgtgagcctttagaacactagaagctttggggtctttggatgagtgactgctgacgcgaataacaaggaacatatccaattctatgcatgccccgataggtcgtaatctctagcaggtaacctttcaaaaagacgccctgcgccaagatggcctcccaaatagcccttgttaaagatggcgcctccgtcggacgtccctcccttgatctcagctggattctcttctttcctggaatgaaaaaatgccctgccaagcactaagatattagtacaagttagtcgtctctttcccgttcttgtcgaaagtggccaggccttcagctacattctccaggacacggcttctttccggcttcacaaataacccacaaacaccaactctcatcaagatggagtgagcggaagtggggcagttctgagtttgagtttatgggcggggcgagagcgacacttccgcccctcaccaacatggccgcgggctggaagtgcgcatgagcagctgtctatggagatacctaggccgggagagggagaacacagttggagaaaatcggcagctgagacggccttggccggtgagtgtaggaccgggcagaagtctggaaactgggtggactggcaaggcagggcagctttgattttgtttccgtttttcaagttagagaacactgctggggaggaagcctttgttttgggggagggggctgtgctggttctttatctcataccctgctttgtgggccaaactctctcccttccccagagcgcgagcgtcccagccctcctgcgctgtccagctgcgcgccgcagccgccggcaccgggcgcttgagctccctagtccccgaggccctttcctgcctcctccgcggagcagctggggcgcggggctaagactgcggggctgcggggtcacggcgcaggctcccgggctcgcgcctggcgggcgctcagctccgtaagcgccttctggttggtgagcctgcagggagacgcctcattctaaggcaaggtctaggtgcctgacttctttcgggagttgattttttttccctttgtgtccagacttagcaa

SEQ ID NO: 56598 - DNA, 1031 bp, Homo sapiens
ttcacctttcccagggttagcctgtgtttcaaatgcatatgacctgcgctgagaggacaacagggggtcaggaacctggggttctctggggggcagactaagacgactccgggatccagacccttctgcaccttcagatgggagctccaggcagctaaggggccgaggagaatgggcagagatcatgctacaaggggaggttctggggatgaggcagtaatccccaccctcagtacaggtctgggttcgccgaactccttgagcctcagtcctttggcggtcccgggctagggccacagcagcatcaaaggaaagactacccccattcctccaagaggatcgagaagctcgggacccccaagccctttctccaggagtcccatcaagccggccaggcctcgggcatggatttgcaggtgccacatgaatcttgctacacattgcactgggcatcttggcaaactgtggcttggggggcaccacaggcacagagcggacctgttggacctgaaccagagtggaagctagacgcatgcccacgccacccaggccaagagaacaggggcatagacagccgtctggactgggctgcccctcaggctccatctcctctggctgaggtggctgtggggctacctcttccatctcagaagagtgaggattgccctctttggcacagtcaacctccagggacgctacacctgaaccttcagagagggtgtcctcttctaaatagtaccctccagccctctggtctccctcagcctctccatccccactctcccgttccttgctgacctcccctgctcctccttcagttgctgcttctgggcttctgctgtcttcaccatctccttggtcttttcttgcttcatggtaccccttctccctctgtcctttgtcctcatcctctctgactccctcagcctcttgtttctgtacaacttcccatttctcctcagcaacttgatcttcctgggccccttgctctaggtcccttccagcttctacctgggcttcctctctttgtt

SEQ ID NO: 56599 - DNA, 1041 bp, Homo sapiens
gagttctctgtggagccacccctggatgacctgtctctggatgaggcacagtttgtcttggcccccagctgctgttccctggactccgctggccccaggcctgaagttgaggaggaaaatggggaggaagttttcctgagtgcctatgatgacctaagtccccttctgggacctaaacccccaatctggaagggttcagggagtctggagggagaggcagcaggatgtggaaggcaggctctgggacagggtggggaagagcaggcatgctgggaagttggggaggacaagcaggctgagcctggaggcaggctagacatcagggaagaggcagagggaagtccagagaccaaggtggaggctggaaaggccagtgaggatagaggggaggctgggggaagccaagagacaaaagtcagattgagagaagggagtagggaagagacagaggccaaggaagagaagtccaaaggtcagaagaaggctgacagtatggaggctaaaggtgtggaggaaccaggaggagatgagtatacagatgagaaggaaaaagaaattgagagagaagaggatgaacaaagagaggaagcccaggtagaagctggaagggacctagagcaaggggcccaggaagatcaagttgctgaggagaaatgggaagttgtacagaaacaagaggctgagggagtcagagaggatgaggacaaaggacagagggagaaggggtaccatgaagcaagaaaagaccaaggagatggtgaagacagcagaagcccagaagcagcaactgaaggaggagcaggggaggtcagcaaggaacgggagagtggggatggagaggctgagggagaccagagggctggagggtactatttagaagaggacaccctctctgaaggttcaggtgtagcgtccctggaggttgactgtgccaaagagggcaatcctcactcttctgagatggaagaggtagccccacagccacctcagccagaggagatggagcctgaggggcagcccagtccagacggctgtctatgc

SEQ ID NO: 56600 - DNA, 1188 bp, Homo sapiens
aacttgttatatgatagatattgtcctaagttcttgatgtaattacttaatccttacaacattctgtgaggcaggtattatctgtattttattggtgaagaaacatcagaaaagaagtaattaatacttatgcattctgtgagacaggtattaatctgtattttattggtgaagaaacattcagaaaagaagtaacttgtcatggtctgacgttaagccatttctgtcaggcacaaaaaagctccttcctctaacttgtaaatgtgggactagaatttctgaaaaggcctggttttgcaggcaagtagaataaaggcaattgctggaactatagaagtagctaagaatgccacttgaaatagtataggttaccctgatttgattatatgaatatatcaaattatcacaataccatgaaaatatgattatgaatcaataaaaaataatttcaaaaataatgtaggtaatgaagaagtgctatgaatagaatcttagatcctgtggccattgtgggagtgaaagaggaagaactttcagaaaggagaaagaaggaggcttgagataggaaggagaactgaagggacctggaaaccaaaggggagtcgaagatctacattgtatcgggcacttgacctattatctcagttagttctcattgttaccctgtagcagtgattctcaactggcattatcttttcctaggagacatctggcagtgtctggagacatttttggttgtcacaaatcaaaggggttgctactgacttttagtgggtatagtccagggatttgttaaacatcctataatgcctgagacagccctcctagcaaagaatgatttggcctaacatgtcagtagtgacaatgttgagaaaccctgccctgtggtatattatattaagtccattttataaatgaggaaacaaggaaagttaagtgactcagtcatatagcaagtaaatggcaaaactgggatttcaacccaggtcagaataagaagtttgggttctttccactttactatgttgctacttggatcccagtacttggggaggctgaggcaggaggatctcttgaagccacgagtttgaaaccagcctgggcaacatagtaagacccccatctcgggctgggcgcagtggctaacacctgtaatcccagcactttgggaggctgaggcgggcggat

SEQ ID NO: 56601 - DNA, 1024 bp, Homo sapiens
aatatggagaaaagggggtaaaagaggaatataagatgtctctcaggtttctgtctttggtggataatggtgccataaggaatgtaggaagacagacaattttgggggaaatgtaagtttattttaggattttgagtttaggtttcttgtgggacacccaggttaaacattcagtagacactttgatttttaaatcttgagatacagtaagaaatctgagttggagatacagatttgagaattgagtttatggatgataaagccgtggttatggataaaaatgatcactttccatagtttgtacagaaagtgaaaaaagaagtagaacaagagtggaaccactgttttaggggagctaaagagaacccctcaaacttccctcaggaaactgaggaagtgtgataagtgagttttgaggctgttccttgattaacattctcttgcctttgtttattctggagagaacactgggtaaaacattacaagatttatcactgctgcaaatttgagccacatatgtcccttacaaacaagatggaagcaaataacacattgtgttagacacttgttttaccttctgttactgactgagacagggtctcattctgttgcccaggctggagtgcagtggtgcgatcacggctcactgcagcctcaacctcccaaggctcaggtgatccttctacctcagcctcccaagttactgggactacatgcgtgtgccaccctgcccagctaatttttgtatttcttgtagagatggagttttgccatgttgcccaggctggtcttgaactcttgggctcaagcagtccacctgccttggcttcccaaagtgctaggattacaggcatgagctgagccaccgctcaggcctaccttctgttattcaattactgccatttgaagtaggttgtgttgtcctccatttataggtgaggacattttaatttcagaggctttagttaacttgcccaaggtcagtaactggaagagcaggatttttaaatgagggacttaagaa

SEQ ID NO: 56602 - DNA, 1018 bp, Homo sapiens
gtagctgggactacaggcgcgcgccgccacacctggctaatttttgtatttttagtagagacggggtttcaccatattggccaggctggtctccaactcctgacctaatgatccgcacgcctcggcctcccaaagtactgggattacaggcgtgagccaccgctcccggcctacagctgtcttaattataggttcagtttttgttgaacaattaatacaagcagatgtatcagcataaagatttttatttttattgttttttgagacagagtttcgctctgtcatccaggctggagtacagttgcgggatgtcggctcaccacagcctccacctcccgggttcaagcatttctgccttagcctcccgagtagctgggattacatgcccgcaccaccacgcccagttaatttttgtagaggcaggatttcaccatgttgcccatgctggtctcgaagagcatagtctagtggggtaaataagagaagcaaaatgctcatatgaggcagaagataagtgtcctaagagaagtataaagtgctatggaatatggtttctgacttggggtgggggaagggaaaaggaacctaatgctttttaatacttttttgttgttgagacggagtctctgttgccgaggctggagtgcagtggcgtgatctcggctgactgcaacctctgcctcccaggttcaagagattctggtgcctcagcctcccgagtagctgggattacaggtgcaccaccatacctggctaattgttgtctttttggtagagacggggtttcaccatgttggccaagctggtctcgaactcctgacctcaagtgatccgcctgccttggcctcccagagtggtgggattacaggcatgagccacagtacttttttttttagagacagagtttcacttcgttgctcaggctgagtgcaatggcgtgatgatagcccgctgcagccttgaaatccctgggtgatcaagccatcctcctgactcagcctcctgagtagctgggact

SEQ ID NO: 56603 - DNA, 1159 bp, Homo sapiens
tttccgcagtccaaaagtcatctccgggaactatccttggttttcccaagactctctccttgactgtgcacttgcgcagctttactgactcgaagcatatttcccctttcaccagaatctcgcaggggaaagttcaccctctctcgtctcccacccctccctggtgggcaaggggcaaaggaacccaggccccaagccgcgccccgccctccaccctcccgccgcccgctccagttggcccgtccctccccgcctctcccagaggcagcatctctgttacacaagttaaagcaccgcaggtgggattcaccgcggccgacgggatagggagtaggtcctacatgaagatatagccaaaaccattcgcagggtccgatccggagggcggtctggagccagaagcgccgcagcgagtgggcggtaactcgcaggccggacgtgacgcaaggcgggggctgagctgcgccggccggaaacccagcaggcggcgaagatggcggagaacagcggtcgcgccggcaagagcagcgggagcggcgcggggaagggggcggtgtccgcagagcaggtgaggagtggctaacgcgaagcagggtacccacctgggtctggaatactagcgagaagggggagcctgtggcttgtgcaggcctttactccagcaccacatgtgcgtggcacctagagagggaagggtccccggaaaagctagccgaaccccttcggagaggtagacgggtgggtaggtgagagccacgcctccgtgaggtggtgggtgagcctgagcaaggggaaagccctgacatgtagggtctgggaagatgcacaggtctgaggggagatggtttgctgctttctctatctctcctcagcctctccaaacaggttatggctgggcaagacagctcgaaactaaccctagagaattagttaacgggctggctgtgtagtctgttacgtgatcctgaacccacgttgacaatcgccgtcacgctgcagagccacgtgactctcatactcgaacagcctagtgttctatatactattttaattcgggagttcattactagatcgaatttctttagagaccagaaacccctttctaatccgagtttgcattttccccagtgcctagcatcgggaagcgtttgataagtta

SEQ ID NO: 56604 - DNA, 1085 bp, Homo sapiens
cttgcttactcctcccaaggaggagatagtttataggctaggaactgaagtaggaccacccctaaatccttgggtcaaggaaataagagttgagaaacaattctggagaatctaggtagaagagcatgggaagaggcaggctaaagggttataaagtctcacctttgctgttcagcagcacgtgacaattgtagattttctgagtctgctcccagtcttggccacgctcatggaaaccacccaaggacagccagagtccacattccctggggggaagggacactgacaactcttcactgacttctcaaggctctaccctcatatctggcaacccagggacactgtccaacaaagattctacctctccctcgctatttccctgatacctggcaagctgggtgtattcttccaaaagtttcccacccagtggttcagacaggtgtagcgtctctgcagggtcccgtgcaatgaagtcaaatgcctcaggcaggaaagccaggcaggcacccagtctggcagcctctcgaaccagctcagcacatgttttaaagttctgttgcttgtctggcgtcgatgttacctggcacacagccaccaggggcagttcgcaggaggaagaggagatagccatggctctgggcctgtgaacagcataggcaggattctcagatttcatagcacagggaagcaaatttaatgctaaggggtgcaagtggagaggcaggaaagctggacttccttttgatcatgctcttacagggcacgttgacccagggctagtagggctcaccaatcaaatgtgtggatagttgacactcctgtgtctcccactatccatttaacaaactgagcatctaagtgccaggcactgaggacacaacaaaacgtgttacctgggctgagcacaaagtactgagagttgaggtatccggagtccaggacacagaagggacaggaatctgtgaggaggcctggtgatgaagcccagcctgaggaaggtgagatatgaggacaccaaccccttcttcaagcaataaatttctaggattctctgacttctctctttatactgtgagcctgaatca

SEQ ID NO: 56605 - DNA, 2070 bp, Homo sapiens
tcgaaacccagtgctatgtagtggcagcagcacagtgtggacgccaccatgagaagagagcaagttatggccacagcatggtggtagacccctggggaacagtggtggcccgctgctctgaggggccaggcctctgccttgcccgaatagacctcaactatctgcgacagttgcgccgacacctgcctgtgttccagcaccgcaggcctgacctctatggcaatctgggtcacccactgtcttaagacttgacttctgtgagtttagacctgcccctcccacccccaccctgccactatgagctagtgctcatgtgacttggaggcaggatccaggcacagctcccctcacttggagaaccttgactctcttgatggaacacagatgggctgcttgggaaagaaactttcacctgagcttcacctgaggtcagactgcagtttcagaaaggtggaattttatatagtcattgtttatttcatggaaactgaagttctgctgagggctgagcagcactggcattgaaaaatataataatcataaagtctgtgtctggacatcgcctttgggaactagaaggggagttggtattgtaccagctggactaagctccagttctagacctcctggctcattcaacatgcctccctacctaaataaaagtgcaacactcagtgcatgtcccagccccattctcccaagcatgggagtgggcgtaggagtggaggagggggaaggaaaaaggaattacttcacttacacctatgatgccctttgcccaagccagaagaaagcaaaggggaaaagggctgcagggtacattatttattttcacttgaacatggaaagaaagtgtcacactcccccttcccctttatagggggagtgtattttaatcagcaacctcttctccatccaccctgtgtatgtgtgtacacatataccaccacagttgggaggcatgactaggctgacccagtcttatctgttcctcctttgaagagggtttgacaaatgggaaaaaggaaggagccacatcaggcagaggtttcaagccatggaatggaggaaaggcggcagagaggagcagcaccagaggccaggagagagtggaaagggccacagcttgtttttaaaaaattctataatttggaagagggtggcgattaattttcaaaatacacttcagagtcccactttccacatagctcccttactcacagccctttggttttttagacaaaatttaagagctctcataaagccagaagtattgataactccttagtgcatccaaaaaaaagtgttcacatcaatcccttacaaagactatgtgctgtagactttgcttcttcctatacatttgtcttacggctcagtggtaaggtagctgtagagacacattacggggtaaatggaaaagggaaataaaggggaagcccaggcacatgggtgcagggaggggtggggaataccacttccactttcttttgtctttttctttaaaaaaaaaaaaaaaaaggcaggggtgtgattggttggaagggtagagaacaaaccccagaacagtgtaagctccagaggtgggtgatgggaacagtccccaaagtgagaagagggaataggtcagggcaatgcttgcagcatcaagttcctcaggagtttctgtcggcccagctcatagtcctcctcgtctacatttaccagcagcttgatggcttcatggcccacagcttgcttgagggagtctgtgatgaagacacctttaagtgcctctaataaagagccattgatgtagtcacgccagaatgcatcgaggtaggtgagctcagagaacttgatgtcacagatgatggagcccaggtcccgggacttgaggatggtgttggcctggttaaagcgctcaaactggcgctcaagtgggtcctgcttgttagagaagacattgccctgcagagcagtctcatgctggcagtattcagcccgaacccgcagtctgatgtctgttggaaacagaagatacagagcagaagaggttacagtaagggatgagtttacaagccaagcttg

SEQ ID NO: 56606 - DNA, 1016 bp, Homo sapiens
ggcatgtcccgtttaagggaacctcctgcattcaggcaaggatttcagagatacatagaaatagtcctggggaagaggtagagaagctgtcaggtgatattccctacttttttattctgttgtgcttttcagttttcaagcttggcttgtaaactcatcccttactgtaacctcttctgctctgtatcttctgtttccaacagacatcagactgcgggttcgggctgaatactgccagcatgagactgctctgcagggcaatgtcttctctaacaagcaggacccacttgagcgccagtttgagcgctttaaccaggccaacaccatcctcaagtcccgggacctgggctccatcatctgtgacatcaagttctctgagctcacctacctcgatgcattctggcgtgactacatcaatggctctttattagaggcacttaaaggtgtcttcatcacagactccctcaagcaagctgtgggccatgaagccatcaagctgctggtaaatgtagacgaggaggactatgagctgggccgacagaaactcctgaggaacttgatgctgcaagcattgccctgacctattccctcttctcactttggggactgttcccatcacccacctctggagcttacactgttctggggtttgttctctacccttccaaccaatcacacccctgcctttttttttttttttttaaagaaaaagacaaaagaaagtggaagtggtattccccacccctccctgcacccatgtgcctgggcttcccctttatttcccttttccatttaccccgtaatgtgtctctacagctaccttaccactgagccgtaagacaaatgtataggaagaagcaaagtctacagcacatagtctttgtaagggattgatgtgaacacttttttttggatgcactaaggagttatcaatacttctggctttatgagagctcttaaattttgtctaaaaaaccaaagggctgtgagtaagggagctatgtggaaagtgggac

SEQ ID NO: 56607 - DNA, 1019 bp, Homo sapiens
tttcagtacggtggggattgcagctgctgagcagggattctggaaagcattgcgtacctgagcccccagcatggcgggcctaaagcggcgggcaagccaggtgtggccagaagagcatggtgagcaggaacatgggctgtacagcctgcaccgcatgtttgacatcgtgggcactcatctgacacacagagatgtgcgcgtgctttctttcctctttgttgatgtcattgatgaccacgagcgtggactcatccgaaatggacgtgacttcttattggcactggagcgccagggccgctgtgatgaaagtaactttcgccaggtgctgcagctgctgcgcatcatcactcgccacgacctgctgccctacgtcaccctcaagaggagacgggctggtgaggaagtattaggggctggaatcagggaagagttgtgggaggccaggaaggagcagcataggcgtccaaaggggaggacacattgatcctggggagtacttagagtaagttgtgaggcccactgggggtttggactgacagaagggaagggtgtatattttcctgaatgattacttctcctcctacagtgtgccctgatcttgtagacaagtatctggaggagacatcaattcgctatgtgacccccagagccctcagtgatccagaaccaaggcctccccagccctctaaaacaggtgagaagacattaactccccctgctttccatcatcaagtaaaaggacactgatcccatcacattctgggctttgccagcttaaatgaaaggatgctgtgcgcccacatcttgccccataaaaaaaaaaaatcaggcgaggtgacatttctcctaggtcctgtatttgctctcacatgtcttgtcttttttttttttttttttgagacagagtctccctctgtcgcccaggctggagtgcagtggcgcaatctcggttcactgcaagccccacttcccaggtgcacgccattctcctgcctcagcctcctgagtagctgggacta

SEQ ID NO: 56608 - DNA, 1043 bp, Homo sapiens
cctgtaatctcagcactttcggaggccgaggcaggcggatcacaaggtcaggagttcgagaccagtctggccaatatggtgaaaccccgtctctactaaaaatacaaaaagtagctgggcgtggtggtgggtgcctgtagtcccagctactcgggaagctgaggcaggagaatcgcttgaacctgggaggcggaggttgcagtgagccaagatcgcgccactgcactgcagcctgggcgacagagtgactctgtctcaaaaaaaaaaaaaaaaaaaagagtttggagtgttcttatagataacgatggggcaatcaatgggtctgaagcaggaaagtgacttggtcagttgtggacttcagacagctaactgaactagatgtggcagtggatggatttaggtaggttaagattggtgttgcagagaacttttaaagttacagtagtccaggtgagagattattgtaatctgaaccatggcagtggaggtggaaaggtaggatagatttaagaaatatctagaagtagcattaacaggaatttaggattgattgtgtgattggagagtgtgaccagagagtgcacagtataggatggtactgtctggtggagcagtaagtatgagtgacttgagtcaaagttgttgaatttgggaattgattaatggctgcgtcattggtattacctgtagcccataacgatggaggaactttgtgaatcaagagccaaactatataacgaatgtggagctgtgattggtcattgataggggattggtaaatgacatccatgaggaaagcttagaaggtggtattgccaaggccaggtacggtggctcacgcctgtaatcccagcactttgggaggccgaggtgggtggatcacctgaggtcaggagttcaagaccagcctgaccatcatggtaaaaacccatctctactaaaaatacaaaaattagcaagacgtggtggtgcgtgcctgtaatcccagctacttgggaggctgaggcacgagaattgcttgaacctgggaggcggaggttgca

SEQ ID NO: 56609 - DNA, 1646 bp, Homo sapiens
ctcaagtgttcctcccaccttggcctctcaaagtgcagggattacagacgggagccactgcacctgtcctataggatgtttctaaatatccctggcttctactcattacatgctgatggcagtccccttccccaccaggcataataatcagaaatgtctccagacattgccacatattccccaggggtcaaatttgcccctggttcagaaccactgacctaaaagctattataattcctagtacattgatgatctagcctgggatctaggacttaaaggtggctagtgtgtttgtttcctctcaaatgtagggagttaacttcaaaggattgaagcttatagaattacatccattgatacataattaggaccacagtgctttcctgtattttgccttattttccattgcgagggtatgtggggacagtgtttcttcatttcctggggtttaagcacactttaaattagggaactgtggagcaaccagctcttctggttggtttaatgtgaaacctacccaatctgctttatctgagagcctcacaatcaacagctggcccaagggaacaggtgggatagggaacaaagagaagttgcaggggctctgaggaggctcagttttctcatgttgcctgctatgagcaataacttattttcctttagcaccttcatttgtacccagtaacagcaacaggtgaatcgagaggaagaggcaaggaataccagtctatagttgaatagctatttcccatgctttgggtggggcatctgggctctcaaaactatatatggattacatttcctgtctacatatcagaacccatggtatagggttaagtgatcccagagtgtacctccccttttcttaagggaatgagtttctctgtgctttcattttagtttttcatctgaggaagaaaggaccagttcctacttactcttcagctttctctatcagctttgtttttccaaagaagcttattattttattgtttcctagtctagcctcagttcctttttgtataaaatggacagagcaacctgtttaattgttgagtagggtagagtggtgtggtatggtgtgggtagttctggacattgcagaggaggctatggctagttagaatatatgcatggtaactgaattacctgtatctgtttttaatggggtcctctcttggacttttgtgaatttgtttcttaattggaattgcttgaggtgatctcttggagattaagttcagttcaacagtgggttgctcccactatatttgaggctctgtccattactaggcactagggatataaagatgaatatatctctccatgagttgagtaggatctaatgggataataaatacacaaataattttagtacatggtgataaatggtgtaaaggagatatgcatagtgttccataagcgcacagaagaggactacttatctctgcatgggggtgtagaaaatgcattttgaagatggcatctgagctgactcttaaagaatgagtaggagttagccatctgaaaaagagtgatgatgggggtgtggaatagagaagggagaggggcattcaggcaaagagaagagcctgaagaaggtatagagaaattgcatgatgtatgtgaactataaacaaactgat

SEQ ID NO: 56610 - DNA, 1051 bp, Homo sapiens
aattaaatgagtgctgtagtttccagacccttttgctgttttaagtctggaagggagggggtaacatggatactgtatgtagaaaaacttttccctggtgaaacatagacgtatgagtggatgctgcgccattagatattttgttctcattgtgtgctagttaagggaaagggccaaatgtagaatttggaggatagtgctggtctgctgtaaccactttcctcccagttttttctaaaggtgaaagttaacgttaatattgtaacaaaataggaataaggaattgtggaggaagatgagaagctgccagagggtaattggttttcccagaagttcttaaatttgggagctgtcttgccgcaagccattgagactggaaattcttggagttggtattgtttttgtaaattgactaatagagagttagggaagcctggagacttgttgggggtgagttctctaaatggttttaggcttgtctgtgtacttttgcaacgagattgtctaattctatgggcctctgaggtttcaaagtaaaacttgaaaattaattattttcccctccttatttgtttttgttttgctgctggctgtgaaacttgtgctaggaagagacctgggaaattaagtttcttgcggaggtaagtctggaacttttttattgttttcaaacaatggaagggaatggaaatagcatgggagttattttgaggttgggtccattaatgaggaggagaatgccagggaaaatgagttatcattcatccatctgagtgcatgagatctgttgtaatcactgtctttagttaattggagataggaggtgaaagagaaggagatttagatgtcttgggacaatcccccagctttggtttgttattgtctagtcttcttggtcagctctgaaacattttttttttttaacatatggaaggctgtattctagtacattgtctactaaatgttgcccttggagggttgctgggacaccttccttccgtgggaaacttttcctctaactttctctttcagctgttggggggttcctggc

SEQ ID NO: 56611 - DNA, 1048 bp, Homo sapiens
acaggtaggactgaataggagatggcaaagagtcaaagaaagccttaaggaagaacttcgtggcgggagggagagcatcaggaagaatagctaatggatgcttggcttgatgtctgggtgatgggatgatctatgtgtaaatcaccatggcacgtttacctatgtaacaaacctatacatcctgcatgtgtacctctgaacttaaaagatgtaaggaaaaaaaaaaaaaggaagaactttggaggcagagattttcccagggtctgctggcctagtggggtgccaggccctcctttgctgagcctaagcaaagtacttagctgaacttgttctcaattctgatcactagtagtcttcctatgcccccaagaggctgctgtgctttatggtaaactttgcatgtcaacaccttcttcatgtccctctcataggggtggcaaaatatgcctgacggatcatttcaaacctttgtgggccaggaatgtgcccaaatttggactagctcatctcatggctctgggggtaagttttgtgtatttggcataaaaggagaaagagggacttaggccctgagcagtacaagaaaagcagctaagaataaaaggaataacagtgatgtcccttaagcatgttcccccagaatctgtctccaggaaggagcttctaatggaacaagaagcattgactggtagtaatctcacaggattttccttgtattgcagctgggtccatggctggcagtggaaatccctgatctgattcagaagggcgtcatccaacacaaagagaaatgcaaccaatgaagaatcaagccactgaggcagggcagagggacctttgataggctacgatactattttcctgtgcatcacacttaactcatctaactgcttccccggacaccctccacctctagttgttactaagtagctgcagtaggcattgctggggaagaaacaaacacacaccaaacagtactgctacttagtttctaaggctgcacagggaagggaaagactgggctttggacaatctagaggtaatttat

SEQ ID NO: 56612 - DNA, 1038 bp, Homo sapiens
tgggaaagagtcggaaataggggatgctctggtcaggagtgggaatgaaatgttgactgttccccctgctgctcagatctacctttgtcctttagtggtgagccatgctttgccctaccgtgttagcctgcaagaagtggttttgccggaccagcacttcccgccctccagggatcttcccagccctctgtgaagtgctagatgcttctccactggtctgcgggctggacccaggcctgcagtttgccatacttgcgcccctgctgtttgggaaggatctgtgctgtaagcctcgcggccatactacgactgtcagatctccatccctatgggctataggatggggcgacggcaccctatacctcagggacttgctttggagtcatggattaaagacctctctgggcagcgttgagaaccagcgaccctaaacttggctgcgtttccatggtgtcgatcgcggagccgtgggggcgggctcacgcaagcgccaagggaccggtgggaggagttcgggtgtggatgcgcaggcgctttgagagacggtgaagccggtggccggtggccgggcgggaccaacaaagatggcggcggcccctgcggcgggagcgatctgggcaacggctgcggctaaagctgcagccgggcccacgggggggctgcacgggggtagtagggggtggccctgaactggggcctggccctggctggcctctcccgccgcctcactgggggacaggtacgggccggggcgttatggcatggcggggtgtgggggggcgcagagggaagactgctccagacccgagaggacactctccacaaaggcgcgtggggcccggcggggcctgggagaactgggctggagggacagcatccctggaccgcggggaatacgccgccggattccgtagccaatcagcggtctcggcctttctgccctcgaggggggcggacccggctaaagccctgctgtggtgggagaagtgcagagattaagggtcaaggagttgttcgtcctccatccccgactactgc

SEQ ID NO: 56613 - DNA, 1732 bp, Homo sapiens
ttttctgtcccccatttccctgaagttcctttctcagcccttcattacagcagtttggacatgcctctcccttgcttaaatacccttgagcctcctagacccttttttgggttgttggtgactcttcagcatggtgtgccatttcggtccccaggggattaccccaactatttagaattcttctttgggtccccaggcccttcctttcccttgcttgcaccttctctactgggactctgcctaggcctaattaatctctggagctaaagagaggcaggcacagaacatcttagcaaacgtggttgcacattttctgagctaagtaagctaggctgattgcaattggagccagcaggagaagggcaagaaggggccacgggggcaggagggggttttgggggcagaaaggtgggagtggtgagcagctgggcaaccatgccggtgctgggggagttgccccaggagctgcaacgtcagctagctgagcagaggagtaagtgggcaacaggtgggacagccatggctgagtccgtggtacattcagctgtgatgggcttactgctcatgaccagtgaggtagggagactagaatacctagtgaggggaatagggtagagtttggggatgaaacatgcatgggatgggggaggcagtgggcagcatgctgttgaaaggttaaagtgccaggtaggatatataggaacttgccgattgtactctgaccttccaggctcatcacacactccttctgggctctggtcatgttggccttcgaaacctgggaaacacggtgagagctattctcctatctttcctctctaaaaggaatgtgaaatggtgctgggggtggggaaaacccacgagcttggggaaggcatgtggaaggagagctctgaagctcttctaaggcttcctgggcagtggtctggagagataacagcagtgtccctactgctccccagtgcttcctgaatgctgtgctgcagtgtctgagcagcactcgacctcttcgggacttctgtctgagaagggacttccggcaagaggtgcctggaggaggccgagcccaagagctcactgaaggtggggcaacaactcctgctccctctgttcaagtccctttttccccaaccacttgcaggtccatctgccactggtggtggcccccaacccttaaatctggcagttgtatctacttttcccagtgcctactttcctaaaggttattttctaccctctgagccaccttttgcttgcctcttccagacattaacctttgtttgccttccccactcccatcccaacagcctttgcagatgtgattggtgccctctggcaccctgactcctgcgaagctgtgaatcctactcgattccgagctgtcttccagaaatatgttccctccttctctggatacaggtgggagagctggaggctatgggatttctctctggccatgtctgggggtagggccaagcaagggccctggcagcattgttctgagccttgagatgttcttcatccaggaagtggggaccaatatctgggcagggaatagtgtctgtggactaggagaggagtcagttgcccatactctttgtctggctgtagccagcaggatgcccaagagttcctgaagctcctcatggagcggctacaccttgaaatcaaccgccgaggccgccgggctccaccgatacttgccaatggtccagttccctctccaccccgc

SEQ ID NO: 56614 - DNA, 2096 bp, Homo sapiens
ggggagtagggctctgtaggttgtttcagtgggtgttgggggtgcccagtgttcctgctgtctcatgggtgctccccacttcctttgatctgtggtagtgatgatgaccgagccaacctaatgtggaaacgttacctggagcgagaggacagcaagattgtgggtatggaatggggcaaagcaatgagggaaaattagtgtgtgaggggggtacaggcttggggggaaaaatcgatactatcaaggggtatgggaacaagactggatgatgcaaatgtgaagctgtgtgaagagttgattaggagtgttggtagtgggaaaggaagggtcaagcaaaggggcaggaagagatggaaatccaagaaatcatctcataacatccaacaatgaccttttctcctgtccctgtgcttctgtctagacctgtttgtgggccagttgaaaagttgtctcaagtgccaggcctgtgggtatcgctccacgaccttcgaggttttttgtgacctgtccctgcccatccccaaggtgggattccagaggattccggggtggacaggacaggggctctgtgacccaagcctacccacccccagagtgtgggcgggaaccctgtgggtttctggagcagaactgaagcctggattgattgagaagagttggaaaaggaaattcagaacatgttgacctttcttccccttttcccccagaaaggatttgctgggggcaaggtgtctctgcgggattgtttcaaccttttcactaaggaagaagagctagagtcggagaatgccccagtatgtggaggttcacaagggatacagtaagggtgggagacctggggggactccatgtggataaaagggattgcatgatgtcttcatatggggaataatatttatgtatctgggtttgtgttggagtctcagatctgttctagtactcctagagcaaaggggagaagccaagaggatccagctgtaatgaagagcatactaaatttgtatgtggatcggggtgtcagaaaagccaattgaggttaggagcatattaacctaacactgtttgccatttattcaggtgtgtgaccgatgtcggcagaaaactcgaagtaccaaaaagttgacagtacaaagattccctcgaatcctcgtgctccatatcctaatcttcagattcttacttctcttaggatacctcccatacattctctttcctccatgtttccagagaattgaattttccttaggaaaagtctgccacccacttttccacaagatgctcccagtgtgtcgggagtggggagaggacagctttcaggatagaagaagttcccctcagaggcccactgcctcccaaatgctccttaaccagggcttagatctgaatcgattttctgcctcccgaggctccatcaaaaaaagttcagtaggtgtagactttccactgcagcgactgagcctaggggactttgccagtgacaaagccggtgagtctggtggggaaagtcctaaggagccaaaggagtgggggcacagctctgattatagaacttgatcatctccaaccccgcaggaagtcctgtataccagctgtatgccctttgcaaccactcaggcagcgtccactatggccactacacagccctgtgccggtgccagactggttggcatgtctacaatgactctcggtgagaatagcctcctatttacatcctgccccattcccactcagccctgacaccctccccttctatgaagctccaggagagcagagtgccaggtgaaaggagaggtggaggtcttgcctgatcatttcctggatgctctgaggttcggtcttgtagggagaagggagtaaacaggaatgaccacaaccctttcccgatctccttttttcctagtgtctcccctgtcagtgaaaaccaggtggcatccagcgagggctacgtgctgttctaccaactgatgcaggagccaccccggtgcctgtgacacctctaagctctggcacctgtgaagccctttaaacacccttaagccccaggctccccgtttacctcagagacgtctatttttgtgtctttttaatcggggagg

SEQ ID NO: 56615 - DNA, 1042 bp, Homo sapiens
tccggggccttccaagtcccgccaatccagatgtaggagaggtagggttaggcgcgtgccgcgagaacagagtggacggagcgtaggagagaccgaaaaggctgggggtgggagtagcggatttgaagcacttgttggcctacagaggtgtggcaagcagagcacctcagaactcaggcgtactgcccgccgcccgagccctgcgagggccgatagcgagggtgtggcccttatctgcacccagcagagcgccggcggggtacggtcttaggacctcgatctccttctccctcattttctctcatccctacctattgtgggtgagtcctggcccctggacggggacctcgctgttccaccagcccatccgtgcacacttagtttcccctaaagcagtgagtggccgggatagaactcaaaaccggcggggcttctggagcgcaggttgtccccggtctgcctgtccatatcgccccctttcccccaggtttccgcatgggccggaccgtggtcgtgctgggcggaggcatcagcggcttggccgccagttaccacctgagccgggccccctgcccccctaaggtgagtgctccacttgtgccagagggagcttcatttaatgctcttcccatttccatcaaaagctagatggatcctggccctctgaatatgcctcttcccctcccctcctgacctctcgccggcggctacaggcggtgctgcagtgtctctccctcttgtcgccaggtggtcctagtggagagcagtgagcgtctgggaggctggattcgctccgttcgaggccctaatggtgctatctttgagcttggacctcggggaattaggccagcgggagccctaggggcccggaccttgctcctggtgagaggcttgtgggatgtctaggagaggttgtggagggggcttccattggggaatagagtttaggggaggaagtatgtttggtgggtcagatcttcccttagtttctcctcttctgagggcatgtggagagcaggtttctgagcttggcttggattca

SEQ ID NO: 56616 - DNA, 1010 bp, Homo sapiens
acaggtgtgagccactgcatccagcctcaatgattcttctttgcttcctctgcagggcggaccccacagccagactcagcactcattcgccaggccttggctgagcgctggagccagtggtcacttcgtggaggtctagagatgttgcctcaggcccttgaaacccacctgactagtaggggggtcagtgttctcagaggccagccggtctgtgggctcagcctccaggcagaagggcgctggaaggtaggggaacccctggagtgtaatgaacctgtcagtgtttccatctttatccaagtggcttaactaggccagggccgataggactggagttcctcattgtttttgtgccttagaagctacttagacatgggctaccccagaatcctaggccctatttgtgaaccttcctcaaagagcctatgcaagtctgtggatagaagtagtacttataagtggcttagagataggggaaagaacccagcttcactgaacatttcagaacagccacactggcctgtctggtccacttcctggagtacacagaggaatgattttttgtgaagtctacatagtcacccaatctcttcatcctgggtcagtacacagtctccccggccacatgggtgcctgggaaactgagagtgaggcaccagaagtctcttttcactcatcaaattctcattttctgggtctctcaaatgttttcatgctctcaggtatctctaagggacagcagtctggaggctgaccacgttattagtgccattccagcttcaggtaatggaatagccaccttccccttccccaacccctaccagtgagaagcaaaagctataccttcctgggtcagcaggaccacaccatgcccctgaactggtcatctctatgggagtctaatcccaaagaggactgacaactgtaatgggaatgccttctgagtcaggcctctgcctgatctctagtgctcagtgagctgctccctgctgaggctgcccctctggctc

SEQ ID NO: 56617 - DNA, 1478 bp, Homo sapiens
actgggccctgaggatttggatacatccagcttttatattctcttcagccatttccttctttctgtttgacttctgtcctgggctttttttttcttttgcctactaagtaatagttgtttttttgtgtgtacagaaacatttaatcccttccttgcttttctctactctggatcccccatgataccctcacttttcccatagggtgcgcctggctgggatgaagatctctcggccccccacatctgtaggacactataagatggtgaagcaccgaggagataagggcaatgaggaaaatccccacaggtaggaagaaggaaggactgcctgggaattgttactggatcctcagggttctgtacccctagccaggaaaatcctaaaggtccctagatttctggctgttcctttctgggtcttagtctccaacctctaaccctcagatttgacctcctggtccgtacccagaattcctggacgcaagatgggatgaactcactgacataccagttgctggctcgagagctggggcctctttataccaacatcacagcagacattgggactgaccctcggggtcctcgggctccttctgggccacgttacccacctggttcctcccaagccttccgtcaagagatgctgcaacgccggcccccagccaggcctgggcctctatctactgccaaccacacagccctccgaggttcacactgactcctccttcctgtctaccttaatcatgaaaccgaattcatggggttgtattctccccaccctcagctcctcactgttctcagagggatgtgagggaactgaactctggtgccgtgctagggggtaggggcctctccctcactgctggactggagctgggctcctgtagacctgaggggtccctctctctagggtctcctgtagggcttatgactgtgaatccttgatgtcatgattttatgtgacgattcctaggagtccctgcccctagagtaggagcagggctggaccccaagcccctccctcttccatggagagaagagtgatctggcttctcctcggacctctgtgaatatttattctatttatggttcccgggaagttgtttggtgaaggaagcccctccctgggcattttctgcctatgctggaatagctccctcttctggtcctggctcagggggctgggattttgatatattttctaataaaggactttgtctcgcatctgctcctgctttctgcatcccaggcacactttgcctctttgctgccccgcattcttatgcctataggtgatagaacagccagaccaagccaagctccagcaatttttattttcatgaatgagagttggggatcagctgttaggttctgtgcccaggacactgactgctgcctggcgcccactctctatacagtcattaacagcaactccctcataggaggctccagccagagtcaggggcaacctgtgagca

SEQ ID NO: 56618 - DNA, 1108 bp, Homo sapiens
ccgggaaccataaatagaataaatattcacagaggtccgaggagaagccagatcactcttctctccatggaagagggaggggcttggggtccagccctgctcctactctaggggcagggactcctaggaatcgtcacataaaatcatgacatcaaggattcacagtcataagccctacaggagaccctagagagagggacccctcaggtctacaggagcccagctccagtccagcagtgagggagaggcccctaccccctagcacggcaccagagttcagttccctcacatccctctgagaacagtgaggagctgagggtggggagaatacaaccccatgaattcggtttcatgattaaggtagacaggaaggaggagtcagtgtgaacctcggagggctgtgtggttggcagtagatagaggcccaggcctggctgggggccggcgttgcagcatctcttgacggaaggcttgggaggaaccaggtgggtaacgtggcccagaaggagcccgaggaccccgagggtcagtcccaatgtctgctgtgatgttggtataaagaggccccagctctcgagccagcaactggtatgtcagtgagttcatcccatcttgcgtccaggaattctgggtacggaccaggaggtcaaatctgagggttagaggttggagactaagacccagaaaggaacagccagaaatctagggacctttaggattttcctggctaggggtacagaaccctgaggatccagtaacaattcccaggcagtccttccttcttcctacctgtggggattttcctcattgcccttatctcctcggtgcttcaccatcttatagtgtcctacagatgtggggggccgagagatcttcatcccagccaggcgcaccctatgggaaaagtgagggtatcatgggggatccagagtagagaaaagcaaggaagggattaaatgtttctgtacacacaaaaaaacaactattacttagtaggcaaaagaaaaaaaaagcccaggacagaagtcaaacagaaagaaggaaatggctgaagagaatataaaagctggatgtatccaaatcctcagggcccagtgccagtcaccct

SEQ ID NO: 56619 - DNA, 2164 bp, Homo sapiens
ccacttcaactggttcttggtctgggggaaaacaatgtttccattagctgtcctgtccccactccccaatctgtcctgttggggtgggggtacgggggtggttaagtatgaacctgacacttatcattccagggtagcacgggagataggcgagggacctaccatctcctgctcctcctcttcctttccaaccactttccttcacttcgcctgctgggaaaccagcttcaccctgatcctgatctctggcggtgcaggtagctagttatcctttaccacttctgttccagctggtcccagattcgctgctggagtgctggatggagcctttctctgccctctgtgacatttccaattttagataatgcctcacatctctgtccccccgggaccccctggagcccccatgatccctaagaagacagcttgaacctaggtgagtctatctcttcccttctaaaattggaagagggggttctctagagactttctgaaatgaacatgagatttgaatgatgtaaacatttttgggggtgaggactgacagtagatggtgggagtggtttggggggaggtagaggagagcgaaacttgggctgaagtgacaggtggtagggttactggtggttacattctgtttccttgcgtgactgtgcacctgtgtgctcccttctgtgactttgttttctgctttttcctctttacccctggcatcaccttcaaccctacctactgacctctctgctggcttgctctcttcctgcctacccccagaattcccctctccctccctagatctcacccccaggatgttgcggaggctgctggagcggccttgcacgctggccctgcttgtgggctcccagctggctgtcatgatgtacctgtcactggggggcttccgaagtctcagtgccctatttggccgagatcagggaccgacatttgactattctcaccctcgtgatgtctacagtaacctcagtcacctgcctggggccccagggggtcctccagctcctcaaggtctgccctactgtccagaacgatctcctctcttaggtaagtgcaggaggaaggaggtggtgaaaggaaggacaaggtgcggagacagggaggcttggggatagggaggcatggagtggcagaagtggaacttagaagaggataggtaggctgaggctgcaggtaggctgaggttgagatagagggctgaggttgagatagagtagactctgaattgggagtttagattagactattgggtttccactttctactgcttgtccctttatgggctcttcctgccccaggctaggaattgttttccttgtagatgagccctggtttaattagttgcaagtctctccagccttcaactatagcttccaaccctgtaagacaggagaaagttaggcaaccctaaaataagaagagaaggctaggtaaggatcctgcaccttccagcctttgtagagctgtcccagtgataggtaatccaaggcatgcgagatttctgagtgagccctgagaactaagccccagaaccagactgccagtgtcagaggtattcccaaaccctagtttgattcttttctctttgcccctctgatccctctacttgccattccttcccaacagtgggtcctgtgtcggtgtcctttagcccagtgccatcactggcagagattgtggagcggaatccccgggtagaaccagggggccggtaccgccctgcaggttgtgagccccgctcccgaacagccatcattgtgcctcatcgtgcccgggagcaccacctgcgcctgctgctctaccacctgcaccccttcttgcagcgccagcagcttgcttatggcatctatgtcatccaccaggtacccccaatctccacctcattttgactgactttcttctaaggaagcctcaagcacatgccacttcactttcatctaaatgggtccctagaataattttaagaaggccagactgttagagtgtggagaagcacccggcactgctcttccaactttgttagtcccatacttttccttaatctgcttaggttattcccactgtcctacactctcctgtgattttttctttattgaatggcttgtgcagagttggaattggacacaatagggctaaaattctagttccg

SEQ ID NO: 56620 - DNA, 1095 bp, Homo sapiens
ctggagcagagaggagtaatagccctatacctaggcctgggggaagaataccttgggacccccattaacactgtggtgaacttgctaccccctcccccaccttctcctccctaatacctttctcatccacccctactttacccagttcatgagcagcagtgaaggctgactggagcccatcatcctccacaatggcacagctccgagccgggtcacagacggtgcccacatcagccatacccagcgtgtcgcaagtggagactccacacaggtcctgtggagagggatcatagaaggtgcatagacagccaagacacctgggtccattgggttgagatccagattcccggggacctgggcactgaggacccagcactgtcagggcctaggtagccacacatggcagtgtggctggggcaaggcaccatgtcacacaactccaggaacatcatttgcatcatagtctatgtagtggcgcttcttagaattgtgcagtgcatggcctgcggtgctgactggggcctcacctgacgggtaaacagaatggctgtgtcaaagtggtcagggtccgagtcctcaggggtgttgaggccccgctgccaggcacagaagctgcgcagggtctgggcagcactgggccccacttggggcccctcctcgcctgaccccaggatcactagccgagtcaccaccaagctgacaggattgcggatgcttgggtgcttgaaggccttggctgctgctgccatcactgttagcaggtagcgctttagccccgcaccgtggaatgcggccatcttgtcatctgccaccaccagtgtctccacaaatctactcagtgaagcaaagcgctgtagagaaaaagggagaggaagatcctgaaatagcctctcagacccatgggtcggtcgattctccaatccctcacttcctgggtctggaactcagcatagtcagctgggccccacacaccccacgggattcctgactcctggcgggtcttggttgggcccttcccccaacgccaaatctcagggcttttgtggtaactctgaggagtcagcagctggttctaagaaggggaggagaagggga

SEQ ID NO: 56621 - DNA, 1043 bp, Homo sapiens
aggagagaggccagcagtagcagaagcagccacaccagccaggagagcggcacaatggggagcaggaggcagggttgggctccccacagccagcgccctgccaagcccctcccgggatgcgagcctgtctgggacatggcactggtactgcagctgggagggactgaggccgtctagggcaccaagtcctccacaccctagctttggaaagctcctctctgtagcctgggggcttggactcctgccaaggtcagaggcaaagttttcagaagggctgaggaccgttaaaggaaatggagaaaacttagtccttgggcttgggagaggtgcccaggggtctggcttctccaaactctcctcctgagccctcctttcctggatctttgtctctccctgcctgtgtcttctgcagcttctctggcctctccctctgtaggactctgtctgggccgcttctgtgcctgccctgtctctgccttcttccgctgtgcctttgtctctgtctctttcctcctctgtctctctcgtgcatatgtgtctgtgggtctccctgtgggttctccccagcctctctccgcgccagctcttttaagcatggtgagcctctgcgattgattggctgatctctaagccactcagctgagctctgtcggtgggactcagatgggtgtatcatcgcttcccaaaaaaatgggacttgcccaggggaggggaatctctagcagccgaatggataataggcactgggccagctgatgacatagccttttcccaaaccccacaatcagccctcagctgtctctttccctttttggtgggacagagccccaggagaggcagagagtgagggaaagggcctggccggcatgcacagataggatcacggtcctgggagaattcctgctcttatagtctaacctaccatggcttctcttttctcaaggctccctcatgctgccctttggccctagtggctggtttccagggctgaggggactgagtgagctgcctgagaaaagagggtagggaacaggtaaggaggc

SEQ ID NO: 56622 - DNA, 1035 bp, Homo sapiens
tgttagggaaaggaagcaaattattcctttggctttggataggagggaactcggaaaagaggtcttgggtatgaactctcaaggcaaggaagggttcagaagtaggggcaatttctgctcaccccatcctctggctgcttgtttccccaggaaatccccaggaaggagagtgcagtcagcagtctctttcctttcccagaagtggaccacctcctcttgcctctattcccctattcactctgctttgtcacctcctgtcccccgcatatcatatccgtcagaatacttcctttccccctcccttcctgctcaggtcggtaatacctgccctggtgcctatcacttcctggatcacccacccccttgtgactgccagacccacctcttgacccaccacttgcctgaccctggttctaagccaacggggctgggactagaggagtcggacaaagggtgggagaccagaaggggcaggggcaagaggagctatcaccagagaactctactgcccctttccactcccctatttgagatgaggacaaagggggtgactaagcaatgaaagacaaagggctttagagtggctgcagcagtgtgtgtgggggtgttggcagcagggagaaggcacaaaagctgcagtgtcctaggcagcccctcaggagccccccaccccagtcccagctcaagctgcctccagggccaagcagcccaaagtctatcctgacttctcccaggctggatcaaggcaaataaatgcagtccttcccatcccccaccaccatggccacatttgctgtgtttcaacaatagaaagaaggcccagggaaagagcaaggaatgaggacaacagagggaccaaacctctgccctggctctgtggcagctgccttgtctagcccaggtcctggtcagttcccacagctaaggatctggccccaccctttggtacagttcccattaggtcaattcccaggccagaagtctggctttcccctctttctctgcagtgaagaattccaccatctctgcttcctg

SEQ ID NO: 56623 - DNA, 1050 bp, Homo sapiens
ttggatcctggagctaaacaggctgggttaaaatcctggttctgccacttactagttttatgatcctggaaaagtcatttaagctccatggcctcagtttatccaatgaaatggggataacgatagtacctattactcataacagttgttgtaagaattaaatcaattaaagtgcctaaggtagtgcctggcacataataaagctatataagtgttatgtattattaaaaagatattctatgcacactgactatgaaccatgaaaaaaaaaaaggtattctaggagacatagagtgagattcatgatgtctgtcatcagaaagtttagatcttccttttccccatctaagagtcctcttcctggttatagtggagattaggaaattaacaaagtatggaatggtgagttagaaaatctatagggagaggctaactccttgctatcttttgggggatcccaagggaataaccatgtggctctgaactatttcttacttctcagatgtggaccctccaaaggacacaattgtgaagaacattaccctgaactttgggccccaacacccagcagcgcatggtgtcctgcgactagtgatggaattgagtggggagatggtgcggaagtgtgatcctcacatcgggctcctgcaccgaggcactgagaagctcattgaatacaagacctatcttcaggtgtggggggtgaacaggagccttttggcgggatctggggttgctttagcctggggctttgccagtttgctgcccttaaaacgtgaggggaggaaggtgttgagaggagtaacccgttgagattactcttggttgggtggatggagggaagtggcaggggatgcttgagtcattaggatttggtttatttagcagcagtgctttgaagctggagctatactcagcttttctctggctgactttttggcaggcccctttgccattacttgagtgcctcagtttccctgctcttacgttagactagtgcgtcaaagccagtgtccctaggggcagggaaagagaaaagacattagctcg

SEQ ID NO: 56624 - DNA, 1003 bp, Homo sapiens
tactactggtttttgggatatttttacctgccttgttggggctcctgagactagaaaggcttatacagcaccaacttctggtgccgactgagagcaaggcttcaggcagccagactgtgggctcctgagcctgttagatgtgacccacattcctccctcttcccaggcccttccatactttgaccggctagactatgtgtccatgatgtgtaacgaacaggcctattctctagctgtggagaagttgctaaacatccggcctcctcctcgggcacagtggatccgaggtatgtccccccaactttttctgtggcccactgtgagcatagcatagtgccttttccaccacttccccgttgaacccaagcttagtgttcagaccccaggctctgcccagacctctctgtccgcctcagtgcttggctcctatatcctgtcttctccttgtcttcacagtgctgtttggagaaatcacacgtttgttgaaccacatcatggctgtgaccacacatgccctggaccttggggccatgacccctttcttctggctgtttgaagaaagggagaaggtaagagtgggaggaaaggataggaatagggaaggaagtgcaggaagtagagaaggtataaaggagacaggagattaaaagaagagagagaacatgggagaacatttagagggggaaggtatgtttaacttgggttatatttgtagaaactatatcatgaggggttggttgggcacaagaaggcagaaagtgggggagtaggccatcataggacctgggggcctgggactttgacactaattcccagcacgttctatgaagatgtttgagttctacgagcgagtgtctggagcccgaatgcatgctgcttatatccggccaggaggagtgcaccaggtgagcaggtccccggcttccccaaatgtccagcccaggcctattttccctgtggccactggagggcagtgctggatgatggaaactccaaacctgta

SEQ ID NO: 56625 - DNA, 1063 bp, Homo sapiens
tctaagaacttctctcttcggcttgatgagttggaggaggtaagctaggagtcaatgggaaaaatctctcccccacaagaagggctagagaaatacagagatatttgaagagtgtgaggaagagtattaacacaccagttttcttgatcaatagttgctgaccaacaataggatctggcgaaatcggacaattgacattggggttgtaacagcagaagaagcacttaactatggttttaggtgaggggaatacaacttctctccgtaggagtgggggtgggagtgggggagttccagcctaatatcttgtctttgaagacttgttggcatcctcctagtcataccctgaatgtgaaggatcaacaagggaggctaaggaagaaggagcctccttacttagtttgtggagagtggcccttattcccattatgctctccacagtggagtgatgcttcggggctcaggcatccagtgggacctgcggaagacccagccctatgatgtttacgaccaggttgagtttgatgttcctgttggttctcgaggggactgctatgataggtaaggccccaatcctttcttggctgatattccagctagtttcccctgcctcactcttctctttgccacttccttctttaccctacttctcagtgtctgtgggagctcttgtgtgtgttagacgaggttgctctcaaaacactttcacatatatggaatcttacttatttttttcttttttgagacggagttttgctcttgttgcccaggttggaatgcaatggtgcaatctcggctcactgcaacctccgcctcctgggttcaagtgattctcctgcctcagcctcctgagtagctgggattacaggcatgagccaccacgctcagctaatttatgtatttttagtagagacgggatttctccatgttggtcaggctggtctcaagctcctgacctcaggtgatctacccgcctcggcctccaaaattgttgggattataggcgtgagccaccacacccggcctatggcattctttttatctttacattatccttgtctta

SEQ ID NO: 56626 - DNA, 1042 bp, Homo sapiens
caacaaagcaagagtccgtctcaaaaaaaaaaaaaaaaaaaaaaatctgaaccaggtggagtggaaaatggcagatgtagacagcctttcctgagcgtgaaagtctcctcattctgtgggttaggagttggtcattgaagggctgacgcttaagagcccagatctcccaactcccttagttggcccttccgggagccgcccggtctcttgtgcaggaaggggaaggggccaaagcatgggggaaggcgtggcaggaagagggggactctgtggtcagggaactgctcgctgagcacagctgcacagtgctgtcagaacggccgatctccagcccaagatgattccagcagtggtcttgctcttactccttttggttgaacaagcaggtaagagggtttggtgagggatagcgtgagctggctccagggtggaagtccagagcttgggtctgagggccaagtcaaacacaggtgaaggaaggctgacagtgggtaggtgggcatagggagaccctgaggctagtcctctccagccccgacccagggcactagactcatagttccctcctttcttgttgccttcttacttcattccagacttttctccgtattattattattattttggagatggagtcttgctctgtcacccaggctggagtgcagtggcgcaatctctactcactgcaacctctgcctcctgggttcaagcgattctcctgcctcaggctcccgagtagctgggactacaggtgcccgccaccacgcccggctaagttaagtatttttggtagaaaccgggtttcgtcatgttgaccagggtagtcttgaactcctgactcaagtgatccacccacctcgacctcccaaagtgctgggattactggtgtgagccactgcacccagctattattattattaaaaaaagacagggtcttactatgttggccacatcggtcttgaactcctggcctcaagcaattctcccacctcggcctcccaaagtgctactgtgcctggctgacttttctcttttcagggtt

SEQ ID NO: 56627 - DNA, 1040 bp, Homo sapiens
aaggagcttcagtggcccaagctacaagatgctccctctagtgtcttgtacgctcacaagtttttttccgaccttggagaggcctagtgatctaaagccttccacttaagtctaaggggccaccaatcaagtcctgcccgcctctgcagctccagggttgaagctcttgggccgtcagacctgccactcattttcttcctcccttcccattggcccatggtaaatagcgaggcttttttttttttttttttttttcattgattgggcggggcccaatcagggttgggttgggtctttgacagctttctttgccagattcaaagatggcgcttacggccacgctaagaatgcagcgtgaagctgcagttctgccatcactcaagatggctgcccccatcaagatgaccggggtgtgccggggggaaaggggcagcatgatggtctgagatggtaagggatactgcaccattgcgggcctggtcttggggcctgggaatgaagaatagagaggctagggagctaggtgaagtctgtggtgggggctaggatcagagaaagggagagaggacaagggtgacaagtgggggtgagagatcaaagatggggcgggagtgtgcctagggttgtctctccatgagtgctctccttccctactcttcctgttccaggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcaccaatggggactttgccccgccggagcccccgccgagaggaacccctgcccaaccctgggagcttcgatgagctgcaccgtctatgcaaaggtgagaacttggcacttgggtgtctcaggatgaaggggcagaggagtggagggtcttgaatgccggatgtccggcgatgggagcaggaaaggggagatcatagctgggtcatgcagcctcag

SEQ ID NO: 56628 - DNA, 1045 bp, Homo sapiens
gggagtgaagctcgttgtcaacaaggttctgagcagccatttccaggtgctcccacttctctggcccctccttactattccccctttcctgtccctggatcatcttctcctttcctttgtactccagccctagccagtctatgtgggacaaatgagggaggatgtggggttctctttacctccgtgcctgtgggacttgttgcttttaatccgatgaccttctctgtatatgttggaatatttaggattcttgagaggccctctggatggggaaaagactaagggtgggatgagggattgaagtggagcaggaatgcgcttttctccactgaatcctcttttcctcaggtggcgcacactatacacatgagtgccctgggcttgccgggatatcacctccatgcggcctatgcaggggattggcagctcagtcccactgaggtgagggctccacacacctgggtcatctccctaaaaaccaatctgggacccaggtctggaggaagaggaattgtgtgtgttatggggaggaatgggccgtaacctgattctctgtgtcttttctgaatgagagagggtagagaaacattttctgtgaagagcccagagtgtgtctttgtgactccaccagggggcgctgtgcactcttaatgaagttctatatttgggtttaggctgagtggtgccatccggctcagccttactactgtgtacacccttccacaggtgttccccactgtggtaggggatatggacagcagtggcagcctgaacgcccaggtcttgctcctcttggcagagcggctccgagctaaggctgtcttccaggtgaccacagttcctgcctccatcccctgaggcacttcctctttctcctccacgggtttcctgctctgagggcttggaaggaggagcagagtctataatgatcataaagagggagggagattttacttcttgctcttgccacccagacgcagcaggccaagttcctgacatggcagtttgatggcgagtatcggggagatgactacacagccactct

SEQ ID NO: 56629 - DNA, 1009 bp, Homo sapiens
ctgagtcaaggtacttaggctgggaattagctatagttacttaggggagctctgctactcttggaccaaacaacaaatgtcttctttcatcacttattcataaatcctacagttcaagttccaatgcacactcactttcctcagctttctctcagtttctgatggagataatgctgggacttttgatgagtttcttcttatcttgtacctctctccccccaacactccagacccagtttctaaaatcaaggaggaaatactgatcgtttactttctaggaaaaatagaaggaagcctatagatatagtactgtagttccaaactggtactttgtttcacttatccacattcttattcctttcatgtctgactttaggaaattccagactcaccctacttgtctttatgtctctacagtcacctgctctacaaactgcctagcccaaccccactcacctttttcctcttggccagctgcctggttggttgctggggatgttttggtattaagctggaaaaaatattaggatatcagaatattagatattcatggaagtaatttgaaggcatcatcaccttagacctcttatatactctcaaaccctattaccaggtgcattcccttagtcttttgaagaagcaagtcttgagatcagagaccagaggaaaagttatcaaaattcatccagcaaagatttactgatgctagaaagtgtagaggacaaaacagacaaagaaattctgccctcatggagcttacattccagtgtatatagagacaaataaagcacataaaatgactactatgatgataagtgctatggagaaaaggtagcgaaaggaaatagtaagtactggggtggaaatggaggaatacagttttacatagagtagtcaggaacagcctctctgaaaagcagcatttgaccaaatagctgaaggagatgaggaagtaaggctcatagatatctggcaggagttttcaagggctctgggttggaagtgtgac

SEQ ID NO: 56630 - DNA, 1050 bp, Homo sapiens
catgagtttaaatcttctccttttcaaggccgggtgcagtggctcacacctgtaatctcagcactttgggaggcaaaggtgggcagatcacttgaggtcaggagttcgagaccagcctggccaacttggtgaaaccctgtctctactaaaaatacaaaaattagctgggcgttgtggtgggcacctgtcatccccactactcaggaggctgaagcaggagactcgcttgaacttgggaggtggaggttgcagtgagccaagattgcaccactatactccagcctgggtgacagaatgagactctgtctcaagaaaaaaagaaaacaaaaatcttctccatttcaaaatggtttagaattgtatgaggtgccaggggtcccagttttatgtatcatattagttgtaacttatgagcagctgtgacaagctacttggttttctcctcaggggtctctctttttggcatgtcggccctgttactccctgggaactttgagtcttatttggaacttgtgaagtccctgtgtctggggccagcactgatccacacagctaagtttgcacttgtcttccctctcatgtatcatacctggaatgggatccgacacttggtaagttaattcgggatttgcacattttctctgtgaagggagtggggagactgggaggattctttccttcattactgggtttagtgctgttcttttttttttttcccaagagtggagtctcgctctattgcccaggctggagtgcagtggtgcgatctcagctcactgcaacttctgcctcctgggttcaagagattcctgtgcctcagcctcttaagtagttggcgttatagacgcatgccaccactcctggtttttgtatttttagtagagatggggtttcaccatgttggccaggctggtctcaaactcctggccttaagtgatccgcctgcctaagcttcccaaagtgctaggattataggcgtgagccaccgcgcccagctagtgctgttcttaaggttagttgtgactcagagtcctcttggggaaagccaga

SEQ ID NO: 56631 - DNA, 1079 bp, Homo sapiens
gtctcaaaaaaaaaaaaaaaaaaaaaactgtttagaaagtcttgcagttaaatgtttatgaactttgtatgaccacagaacttttttttttttggcccatacaatggctttcaacattctgagagcaagtgtttggaagaatacaccttgagaaacattaatctagatgtgtggtcctgaggaaaagttgtatctattcattctggaagcttttgtataccgtatggggcctgtggcattctagagaacattcctcctaccatcaccacacaatagaacctgattttctgtcattggaataagtggataataggttccatactgtgggttttgagaagggtaaaggtggggcataagggtagaagcgcttttctctagaatcatgctgagaggagatatctattcctttaggtagaattactttctgagacaggaactgttaatgtcctatttactgaaattccttttttttttttttgctttgtccacagatgtgggacctaggaaaaggcctgaagattccccagctataccagtctggagtggttgtcctggttcttactgtgttgtcctctatggggctggcagccatgtgaagaaaggaggctcccagcatcatcttcctacacattattacattcacccatctttctgtttgtcattcttatctccagcctgggaaaagttctccttatttgtttagatccttttgtattttcagatctccttggagcagtagagtacctggtagaccataatagtggaaaagggtctagttttccccttgtttctaaagatgaggtggctgcaaaaactccccttttttgcccacagcttgcctactctcggcctagaagcagttattctctctccatattgggctttgatttgtgctgagggtcagcttttggctccttcttcctgagacagtggaaacaatgccagctctgtggcttctgccctggggatgggccgggttggggggtgggttggtgaggctttgggtgccactgcctgtgggttgctggcttaaaggacaattctcttcattggtgagagcccaggccattaacacctac

SEQ ID NO: 56632 - DNA, 1120 bp, Homo sapiens
gagccactgtgcctgggtgatcctgggtttaaatgtggaaagtaaaactataaaacttaaaaaaacaaaacaaaactggagaacatattctttgggacgtaggactagccaaagaattcttagacttgacacccaaagcatgatctattaaatgacatagattctcggctttccttctccctcaatccctcgcgctcttcctttccaacttggacccggcagaatggctcccgcaaagaagggtggcaagaataaaagggccgttctgccatcaacgaggtggtgacccgagaatacaccatcaacattcacaagcacatccatggagtgggcttcaagaagtgtgcccctcgggcactcaaagagcttcggaaatttggcatgaaggagatgggaactccagatgcgcgcattgatatcaggctcaacaaagctgtctgggccaaaggaataagaatgtcccataccgaatccgtgtgcggctgtcccgaaaacgtaatgaggatgaagattcaccaaataagctctatactttggttacctatgtacctgttgccacttttgaaaatctacagtcaatgtggatgagaactaatcgctgatcgtcaaatacatcaaataaagttataaaattgccttcaaaaaaaaaaagacataggttctcgttggatatgtagaaatcgcagattgaagagtttaattatttggctaacaacagttacagaaatgtatgctacaatgtgtttgacaagtcttaagtaatcttgttgagataacaatttgtataatttaaattatctgttgaaattgtggttttcagcaaaaatagaaaaattaaggaacatttcattccagtgggcacaggagtacagtaaacagagagactagtgtggtagggaaaatatatacttttttttgtattattcaagactaagaatgttacaaaatagaagagattacaatgtacaagattgcaaacagaaggaagatgtgatcaaacaatcaaaaactaattctgtgaaaagaccaataaaaaagacttctgacaagcctaattaagataaacagagatataaagatgtctcttttatttaaccatttaacattatttttgtctaat

SEQ ID NO: 56633 - DNA, 1082 bp, Homo sapiens
actcctgtgcccactggaatgaaatgttccttaatttttctatttttgctgaaaaccacaatttcaacagataatttaaattatacaaattgttatctcaacaagattacttaagacttgtcaaacacattgtagcatacatttctgtaactgttgttagccaaataattaaactcttcaatctgcgatttctacatatccaacgagaacctatgtctttttttttttgaaggcaattttataactttatttgatgtatttgacgatcagcgattagttctcatccacattgactgtagattttcaaaagtggcaacaggtacataggtaaccaaagtatagagcttatttggtgaatcttcatcctcattacgttttcgggacagccgcacacggattcggtatgggacattcttattcctttggcccagacagctttgttgagcctgatatcaatgcgcgcatctggagttcccatctccttcatgccaaatttccgaagctctttgagtgcccgaggggcacacttcttgaagcccactccatggatgtgcttgtgaatgttgatggtgtattctcgggtcaccacctcgttgatggcagaacggcccttttattcttgccacccttctttgcgggagccattctgccgggtccaagttggaaaggaagagcgcgagggattgagggagaaggaaagccgagaatctatgtcatttaatagatcatgctttgggtgtcaagtctaagaattctttggctagtcctacgtcccaaagaatatgttctccagttttgttttgtttttttaagttttatagttttactttccacatttaaacccaggatcacccaggcacagtggctcacacctgtaatcccagcactttgggaggccaaggcaggaggattgcttaaatccaggagtttgagaccagcctgggcagcatagtgaggcttggcctctaaaaaaaaaaaagttacctgtgaagtctcagctacttggaaggctgaggtcggagggtcggagggttgcttgagtacaggaggtcaaggctacagtgagctatgattgcaccact

SEQ ID NO: 56634 - DNA, 1048 bp, Homo sapiens
ccttgaagctgggctcctccgagtccactgttagcacggccgtgatgcccgcttccctcaggtgatctggctccgcgacggccgcggccccaccgaaatacaatcctggctgcacttccagcatctgcccggcacagctgactctgctggcgctggggttgctgagctcgcagccatcactcgggcccggagcctccaacatggccgcgcccagagacaaggcggcttcctgccctaccatcgagtagactccggctagaacatccttcccctgggactcgccagcctcggcggctctgctgctccctcggaggaccacgtcggccgcaggaatctggacttatcgctgaggggcggagcttcggccccattcagcgcggcctttccacccttgttccctctgacccctacccccaaagttgatggtgaaggataagcttccccaaatacagggtttctcgagctcttagtattgaaattttcaggaaagagacatcaggagcagctgaactcaaatgtgaaataaatgtcgcaccagctgaatcagaagcatcattttatgcatttgaagtaaaatttttttcaatattatggagccatctttactgtgcatttcatgattatttttcctttttctgcccaatttcattattggggtgtgaatccttgttgatgtttactgtctatttattttgaagatactaatcctatatttttgtaagtcaatgtcctccggccaggactacaagaaaccaactttaattaagcaagttggttttattactcagtcatgagttatggagaatttcagggcatctcagcacgaggatgttaggaagatcctctacagattttgggcttttatttggggattttggaaagggttgaaggaagcaggctttgctccagactgaatgctgcaggaagatactcagtacagtgagtatattttatatatcttttgtatagggaggacaggtgagagagatactaaagctgtaattggtcaagaagtagcagctatagtactggtataaagatagataca

SEQ ID NO: 56635 - DNA, 3197 bp, Homo sapiens
gggtggcgggtggttgatgaagagatgaattggtttggatctaaaggatccctgggctttgcctagggaggagatggttgcagcaaagacaaaaagaaaatgggaatcccgcagggcgcggtggctcacgcctgtaatcccagcactttgggaggcaggaggatcacaaggtgaggagttcgagatcaggctggctaatatggtgaaaccaaaaatacaaaaattagccgggcgtggtggctctcgcctgtagtcccagctactcgggaggctgaggcaggagaatcacttgaacctgggaggcggaggttgcagtgagccgaggtcatgccacagcactccagcctgggcaacagagcgagactccatccctccccccaaaaaaagaaaatgggaatccctaagcagttcttggttggattggagtataataatcgtttaaatttattgagcacataaaagaagatagtgatgaaatcaaaagaagtctgggaccagattttgaggtccctgaatgctaagatgaaaggagattggatttgtttttgttttgttttatttatttttattttgatatagggtcttgctctgtcacccaggctacagtgtagtagcgtaattacggctcactgcagtctcaacctcccaggctcaagtgaacctcctgcctcggcctccagagtagctgggactacagaccccaccacatccggctaattttttgtagaggtggggtctcactttgttgcccaggctggtctccaactcttggactcaaccaatcctctcacctcgcctcccaaagtgctgggatttcaggcgtaggtaagccactgtgtctagccaggagtttggatttgttctgagccattataaaaattttaaaaattactgttattatttttgaataggtaatagattcacgtggttcagaattcaaaaggaaaaaggaataattattttgtaccttgataatatttcagaggcaatgggcttatttgagaagcaaaaatgaagtgggcctaaactttactattaatagggggctgggctttgtgtgtttttttttttaattgttgctatttgctgttttattttaaaggtctctttttcagtcatgcaggagtcagtcgaagtgtggccataataactgcttttctcatgaagactgaccaacttccctttgaaaaagcctatgaaaagctccagattctcaaaccagaggctaagtgggttctttttttatagtaataattatgcttttgtgatataattttaagaaaatgaaactttatatttctttatcattacaggatgaatgaggggtttgagtggcaactgaaattataccaggcaatgggatacgaagtggatacctctagtgcaatttataagcaatatcgtttacaaaaggttacagagaagtatccaggtaagtaataattgctagtgtgtaatgggctttctagatgacatttactttagcattgtatgctttaccttacttccagcaatccctgagaaactattgtttctttttgaaactgatttagccagaaataacctattcaaaatcacatggtttataaatggcagggtcaggatttgaattcaggcagcccgtgcccagaacctaagcacttaaatcactgtcctctcctaccttagcctgatttctcaacactggaatttgatttttttttttttttaatttttgaggttagcacttgttgcctcaatttgacattaactgaatttatctgaaaatgcagagttgattttgacaaataaatacattttaattatgtcatatagaattgcagaatttacctcaagaactctttgctgttgacccaactaccgtttcacaaggattgaaagatgaggttctctacaagtgtagaaagtgcaggtaaactattttatatcctttggatattttatcttgtctcagtagctgaaaagtacttaatgttttattttcttaaatttctgtaggaagattttgtttaattgaaatttttagttcagatctgttttcagaaagaatataaattcttaaaaagagaaataatcagattgtaagggttattgaaaatttaagtagtgtaatcaatgttacattattttgttctctaagcaatattgcacattttgctgggcgcagtggctcacgcctgtaaccccagcactttgggaggccgaggcaggcagatcacctgagattgggaatttgagaccagcctggccaacatggtgaaaccccgtctctattaaaaatacaaaaattagttgggcatggtggctggtgcctgtaatcccagctactcaggaggctgaggcaggagaattggttgaacccaggaggcggaggttgcagtgagccatgatcacgccactgcactctagcatgggcgacagagtgagactctgtctcaaaaaaaaaagaaataccgcacatttcatccatgttttcatccttttggaagtcattaatgcttttgtttgtttgggggttgcaggcgatcattatttcgaagttctagtattctggatcaccgtgaaggaagtggacctatagcctttgcccacaagagaatgacaccatcttccatgcttaccacagggaggcaagctcaatgtacatcttatttcattgaacctgtacagtggatggaatctgctttgttgggagtgatggatggacaggtgagaacacattttattttctacaattttattttatgatctatattttattccttcttgcattttaagctctattttaactagtgttttgctccatttcttaatttctttatttctgaagattatatctttctagtgtagataagactatcaaaaataaaatatttttcaaaaaccagctgatccaacatagtgaactacttctggttgagagccctggtctaagttaataaatttcctttaaggctatttatatttttttcaaatataagactaacatttatttttaaactaattagaatatattggctgggcactcttgcctcattagctcatgcctgtaatctgagcactttgggaggctgaggcgggaggatcacttgagcccagggtttcgagaccagcttgggcaatatagtgagacctcatctctataaaagaaagtaaaaaatttttaataagaaaaaaagaaaagaaaaaatgtatta

SEQ ID NO: 56636 - DNA, 1061 bp, Homo sapiens
tatcagtttgtctttaaatagctaagaatctgacttatatgctgtcaatacacacagttagtaatacagcatgaaaatcctaacatgcttttctatactttagccgtgatcattttcatttgaagtcctaaattacaaactgatttaaaagctatatatatatatatatatatatatatatatatatatgccacatccatgaaaccttccttaatcaaatctcaagcttcacttttctcccttcaagctccctgaatacaacattcttcctatgagataattgtagtctactatctattacagtaaatttccaatgcattttatctcactgattagattataaactcaacgtggggatcgtgtcttgtttttatatcctatattgattgccaaagataatgatttgttttgtataaaagtgaatgaataaagtaacacatttgctttatttcagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagatactgtctgtgtttcatatatttttaaaagttttgattgttggaatgttatatgatcttaaggtctgtatagacaaaattatgtacaaaaatttgaaactattatatttaaatgggtattcttttatttccagacacataaagcagatttgtttggacatattttggaattatttcactttctttcttttaagggacattagtaaacccatacatgtctggatttttttc

SEQ ID NO: 56637 - DNA, 1062 bp, Homo sapiens
gtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattggggtgagtgggatctgagaatgtaccagggtggctcgggttcgcgtctaaaggtttcttcctccctacttccgcccactcgtggtgacaggtgtggaccaaccctgcctggggagtgaggcccctcgtcactcctgttcgtgcccctggaagagtctgggagtatcgttcggcttctgtcctggccacagggagagtagaatattgtctaactggagttaactgtcgtttttcactattcccactggggaagtaccgggtgatctttttgtgtggctaacactggacgtctttaggaggtttagagcaaaatggctgggaccgccaaaaaggctacaagctatttcctgagtgtgaaatgtgggcggtgagcacaatggagtgggtttttgtgtgtttggtgtatatgagagaatgtggttatatacaagaaattctaatcttacagcttttactattggtttaagcctgatgtccgtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcag

SEQ ID NO: 56638 - DNA, 1027 bp, Homo sapiens
tctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacatggcactgagagagagaatcttcttcttcttataaggccacagtcctatcagattagtgccccactttaatgacctcatttaactttaattacctcctaaagactgtatctctcgatatagtaatatttggggttagggcttcaacatacgaattttggaggacacagtttaggccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgacatatgatgttgagcatcttttcatatgcttatttgccgtctgtatgttttaccctcctctctccttctctcttctctt

SEQ ID NO: 56639 - DNA, 1037 bp, Homo sapiens
tttaccaactgttaacatcgtgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaactgaaagaggggcaagggcagaagcagggagacgttttggaggctgttatagcaatccccatgagttacaatagtagcagtggagtaatgagaagtagttggattatggatatgtacacacacacacacacacacacacacacacatacacacatatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgg

SEQ ID NO: 56640 - DNA, 1045 bp, Homo sapiens
cagcaaaaaccatcattattcagacagtaccaacgcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcgtattttatccaccagatggcctcatacacttgtgattctatgagaggtttatgtcattattgaaagaagttcaagtctgaggatttggtactattcagatatgggagtcatttccgtatggagatctcttaggtagattagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgag

SEQ ID NO: 56641 - DNA, 1101 bp, Homo sapiens
ttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcactaataaatttcagaggttaattcttagaaatctagggattacagcaaatttgatagctgtttagttgagaaagataaataagaaagtatattaaagtatattgttaatgataactcaaagagatgaatttagttggtcacattaaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatgtaagttttgaaacttagtgcttctcttaatgcctgatttaaaaaccaacaaaaaaacaccttttgcttttgttgccttgtttttgttttttttagagtttcttatattgcatcaaataaaagagtgtgctgaattgcacatctagtctttggaggaaaattagggtaaggcttactacgttagaatctaagtgaaaaggtttttgaaagtgaagtggtttgatgaaaagcaaagtatgcatacctccctcttctttactccttctttagaaccaaccctcttattattctcttcaagcccttacaccctcaacccagtcatccactaata

SEQ ID NO: 56642 - DNA, 1051 bp, Homo sapiens
agcaaatactcttagtggaaatcagtaggtgggaataatggaaagaaaagtatccagaactgatatagaactataaataacctcagatgtgaggttgatgaagggatacaaactactgttaggagtctccttccttccggctcagtcaccccactgaatatcttccaaactctgtatcaccttttaccctgtttctaaatcctatagttaggaaacttgatcccttccatcccaaaatgacttccctttgggagtccctgtcttgggttcctagagtcatcatgagaaggtaggtgctggggggaatcctttgctactggtttgcaggtattagaaatggtgcgaaggggattctcctgtcataccaaattagaactttgtatttcctttctctagaattggtgtacagttaatttagggatttcaggtatttttagtattgttctatgggagtgatgtgacatgggcctagatggatgccctgcacacagtgttcctctcttgcagtggaggaacatgagcttggagaatctaccatgtgtatagcaagcagaaagcaagcctcctcattgtctagagggagattttatctcatccttcaaggttgcttgttggaaactgaaccttgagaatggcctgggaaaagagtggtccggaccttgcattctttgcatacccaataagacgtgtaggagcaaaactcataagagactccctggaggtgtgtttctcaagaaaaatatgtctataataatctatttgcaatgcatagcaactcagaaaaacagagactgcctatgttctatttcagaaaaaaagcaaaacttcaatagacgttgaagttgcttatctgtaacatccaagaataggacgctggttaggtcaaaatgtgagctgaatctccttaaattatgtggctagcttagatctcagaagataaataatgaataggcacttcttaataacttctaacaacaaacaagttgagatcatgatatttctttaggctgcaaagtagaggaatctatcagaacaaatccaataggaagga

SEQ ID NO: 56643 - DNA, 1006 bp, Homo sapiens
cacacaaaacttaatagaaagagtaaaataaaattttgactgtcatgagattgagaagagtagagatagtgaaagtctaaattttctctttttttctgctttaaacaatttaatgagaaaaataagtgtacgtaagattcttaacaaaaatcaaattaagttttttaatgtatttgaatatttaaagtaggattgccacaaattaaatttgccaatgattttaactatgtgtgttttttaagaatgtatctataaatatgtttactgcaatacatatgcaataatgtatgttatgtaatttttatttaattgaaagattgtatttttatttttggtcagttacagtgaagaggttaatcagtaatggcttccactttatctatcagtttagagggcaagattcagccaaatgagaataagaactgttagaaagatgtgcagcaagtcaatgattaccatgtgattcatccataggttatcaatacttgatctgacttgagtttacatgagatattcgaatgtatttcttagcataaaaatcccattttaatttttttttttttttttttttttttgagataggctcttactctgtcacccaggctggagaacagtgatgcgatcatggctcactgcagcctcaacctcctgagctcaagtgatcctcctgcctcagcctctagggtagctaggactacaattgtgcaccacgatgcccagctaattttttaattttagcagagacgaggtcttcctatgtttcccaggctgttctcaaactcctggcctcaagcgttcctcctgcctcgacctaccaaagtgttgggattacaggtgtgagccaccactactggctcctatctagtattatatctaatttaatttatggtcattgagctcatttcttagcaacatcacagaaacaaggctttagtcaattttattaataaaaagagactataataacttacagtgtttatcaatcaataaggtttttagttttaaa

SEQ ID NO: 56644 - DNA, 1008 bp, Homo sapiens
ttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgtttttgcaattgagtagtaagataaaaatattttcttaggagaagttatcttagaaatggtggacaggatgagatggaacacaattgaaataggagtctgttgcagtagtatagggatgagttaatgagtgcctgtattaggagagtggaagagggaatagagagaaagtaattactgagacacattttcactggaataaatttggtcattagtatatacttttaacatattcaatgagtgaatgagggattgagaaggactgaatatagtgaataaagtaaaataatagttactattgatagaaaatggatagatttttaaacaatctagttagagggagatagttcagtttgcacataatgaatttgaagtggtaataactgtaagaagtggccttataattaattgaatatatggttctggggcatagccatttaagggccagagatacagatttaagatgtatgtatatatgcatatatatttaaagatactttctgagggagtttctaaggggaaaattggaagattaataaacgagccttagaaaacataagaagaaattatttaacatttgggttttagaaggccttatttaatcatttgattttaacttatttagtttgagcagtgtgttttcaaacctcttttgaaacaactagtaacctatgctttgaaaaaattgttggttaaaataattgtaaaaatgagtatattctgatctattttgatctgattttaaaaccagggtattctgattcattataactttttc

SEQ ID NO: 56645 - DNA, 1143 bp, Homo sapiens
atattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgtggtcatttcctttagaaccagaggcttaaagtccctagtccaaagcgaagagttgtctgtgtgatgatagtattggcatttataatactgaactatggacctatgaggtaagtgaatagatatttattttggacactaatgctaaaaacttaaattctcattattctttagcttttgtcataaactagagaaaaaatgatttgtttttcaagatgtgtaaagagtaatgagacaggagccatgccttcaaagatctcatgatccagctgggaggagagacaagtagaaggatgactatggtataatgtgatgaacataataataacagtgtgaatgagtcctaacataatatagagtacgagttccttgaggtgaaggttcttgtcgtattgatgggtactcgatacattttttgttgagtgactgagttataagggagatacctacgaaggaagctgaacattgaactgtaatatcagtttgccatgtgcaaagtatgagaaaggcatgccaggcaaagggaacagcatgtttaaaggcacagttatgaaatggcatgacatgttcataaaaaagtgaaaagttcagtgtatcttgtatatgtggggagtgtgcctgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagca

SEQ ID NO: 56646 - DNA, 1038 bp, Homo sapiens
tttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttatttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaatatgaataaaagtacagtctagtaagagaatcagatatgtaaacaactgttgtatgagaaagaattatatggatgtcatataaacatataggcattaaaaaaatgaaaaactttttgtttacacacttctgacaccagatatgtggattttctacactgagcaattctccaattctctggacaccaactggatgtcctacaatttgactcaattcttttttaaattttaattgtaaaatattttttattgagacaggg

SEQ ID NO: 56647 - DNA, 1014 bp, Homo sapiens
ccttccgaagtgctgggattacaggtgtgagccattatatctggccaatttaagtcatttctgacactacctggagctagcacaggctcccacaggttaagggctgagtatccaaagactgcccctgacttcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaagctaaatgggagagacgcatagggtaaggtataggggaagagtgcagagctttcatgccctctccaggtgcaccaccctcctagtacctccttgtgtttgctaacctggaagctctccaaattccattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacctcattagcataaactcaggtccagctggaaggggcttattacggataacaaaagatgctcttcttaccccctatcactcaggaaattccaagggttttaggagctctgtgacaggaaccagaataaaaaccaaatatattatttcttattatatcgcaaattcacaggcatattcttgagggaacatagaagtaaccagtaacgctgctagtggcaatcatgggaggctttatgcagtagtactcgatgaaggaataaagaggattagattatgctacaggaagtgacagtggggttaggggggacatctcattgtggaagccctcatgaatcaatagaattttaggaaagaaaagactggaacaaaaaaaattttttgagtgcccccaccc

SEQ ID NO: 56648 - DNA, 1030 bp, Homo sapiens
tatttgtcagtagtatttgtcagtagtaaagaagttcctggttagaggaaggagaagaattattctgcttttatgctgttgtcaatgccaaagcatatcaagattttaaaaaaattctgtttcttggtgtaaagagcctgtaactgctctcctttttcttttctcatttcaacctttttttcttccggttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaaggtaaaggggaaaattaatgaaatatctttcaaaatgaaggcaaaataaggacattttcacatagagaaaaccaagggaatttgtctccagaagacctgtgctataagaaatgctaaagatattttttaaaagacttgggtaaatgataccagatagaaccccagattagcaggaaggaagagcatcagaatgggcaaatatttgggtaaaaagaacaggactttttaaaaagaaactatatttatcttatgtgtgtgtatttaaatgtctttaaaagactattgtctttttaaagcaataataatggcaatttattatggggtttacagcttatatagaagtaaaatataagacaataagaacacaagggggggagggataaatggaataatactcttaataaaatttttatgttgttcgaataatatttcaagattgactgcagtaactgatatcaaagtataatctctagagcaactactaaaagctaacataaagaagtacagctagagccaggcacggtggcttgtgcctataatctcagctactagggaggctgtggcaggaagattgcttgagtccaggagtttgagaagctgcggt

SEQ ID NO: 56649 - DNA, 1006 bp, Homo sapiens
aattgtttccttttcttttctcccttaaacttctgtacatgcttctgttttagcgcttatcgcattgtattgttttcctatatctgtcttcccagttaaactgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtaatatgcccttgaagtctgataccctgacaaaccgcttctgaaaatcagcttacataactaccagggagaataaaaaggcatagtgcaaagcaaatgctgtgtgaaagacaggtttccagtgtagcatatgtgggccactaatgggtgtagattgaactgttctcttgccaagagtcatcaataagaactctttaatgatggcttagttcatagatgtattttggcatgaagatctctgtgtttaactcagtaaacaataggatctagtttcattatggacttttcatacttcttaggaacttgtcattgggaagataattattttagacaagcagacattgttatatgttcagtaacacttatatagcttggtcataaaatttgtggtgcttggactagcttttgggctctttctttaaacttaatggaaagtgccttaaatgccttaatctccataagacacttctcccagactagaatggacctaaagagttctaatatctgtcagtgtttaattatttgaactgaatatgtcagaaatcttagcaatggaagtttaacaaatttaagtatagaatgaaccagtataggaagatttcatataattttgtgatacagtattaaactttttttttttttaatattccagggtgctctggaacagggctcaaattctcagctgatggctgttcaatacacagaaaccactagtagtatcaggtaagacagt

SEQ ID NO: 56650 - DNA, 1038 bp, Homo sapiens
tttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattataacaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatg

SEQ ID NO: 56651 - DNA, 1036 bp, Homo sapiens
gtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttactgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacgttaaaattttttaaatgaatagcgtttgttgatctttaaagaaaacataaatgtgaaataactttagagcttaaaagttttcttcct

SEQ ID NO: 56652 - DNA, 1047 bp, Homo sapiens
atttaaagtaattaggaactcatcgtaaatattttgtacactactctaaaaatctaattccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttata

SEQ ID NO: 56653 - DNA, 1048 bp, Homo sapiens
cttaaaattaatgacattgttttgagtgacagtgccgaaatatatttctttctatggcaacattcttattctactatcctttttatttttaagtagtttcatttttgtcactgttgggttattttaaacaatttaattggagggaaagaaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaattataagtttatttctgtctcatgtataagtttcagagatctaatgatagctacttaatcatcgggatccctgtctccttctgtcttcttgctccataatcctcaacttgcagcttctgtctcatggaacaaagacggctactccagctctggcagtcatatctgccttctagctagcaagaaggagaaagggaaggaggagggaagccttccaccattaccaccttgaagaagttgccatttcttcttacagtccgttgaccagaccgtgtagccttatttggttgcaaaggaggctaggaaatatagtctttattctgggtggccttgtgcccaactaaatatcacaagtcctgttgctattttaatgttacagaggaaggagagcatatattgggtaagaaaaaaaaaaaggctgtttctgccacaattcagtttccccaacaaaataaaaacttggatttatattctttaaaagaaaatatcctctgtagcacagtgctgaatacatgacaggacactgtgctcagtaaattttttttaagtgaacagtaagggccggtcacagaggctcacacctgtaatcccagcactttgggaggccgaggcgggcagatc

SEQ ID NO: 56654 - DNA, 1058 bp, Homo sapiens
gactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatataacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttctgaaacatttttccactgttttattatttttaagatccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatg

SEQ ID NO: 56655 - DNA, 1618 bp, Homo sapiens
tgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttcttcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtcaggacttgccagaccactctttgcaaaattccagtctagcccctaacatgtcatatccaccttccatgctttagttttatccttagtctttatcattttcaaacatactgtgtatttacttacttctctcgcttaccatctgctcactagaatgtgaatgctgtgagggtagggctttcatctgttttgttgttcacttctccactccagcacctgtaacatactgggcacatagcaggcactcaataaatatttgatgaatgaaaacagattagaaaatagaaagtcaaagaagctaagtgagtttccccaaaatgatatggtatagcagcatcaaagctaaaaccaagactggtcttctgatccacatgcagtttggtgctcagttaggccagaatccgaaaaagttgtaagttaagttctgaaataaaactcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacaaggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtctgggggtcaggaaagcaag

SEQ ID NO: 56656 - DNA, 1067 bp, Homo sapiens
tttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttctcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtggtgaataaacagataaaaacacctgtccatagggaactgatattctagtgtgattactgctaggagtgtgtctgagttgaattgaggctcagaagtagatgtgtctgagaggcctcaggagtttggaaatgggggtgtccaacctgtttctttgtcctccaacaggctttattacctgtgcaggtatggtagtaagtctgttttgcatttctttaaggaatacctgaggctgggtaatatataaagaaaagaggtttatttagctcacggttctgcaggctgtacaagaagcatagtgccagcatctgcttctggtgagggcctcaggctgcctctactcacagcagaaggtgaaggggagcctgtgtgtgcagaaatcacatgatgagagaagcagcaagagaaagagggaagatgccagactctttttaacaaccagctcccatgggaactaataaatcaagaactcgctcacccctgagggagaacattaatctcttcatgagagatctgccccatgacccaaatacctcc

SEQ ID NO: 56657 - DNA, 1665 bp, Homo sapiens
atattactgatgaataggagctaagcgtacttggccagggtctccttaccattcacatggaatgctggtccttttgacagttgtttcttcccattgttgaaggcagggaggaggacttagggattcttctctgtattccccactaaaaagcccttctgttccagttgctccaatcagagtaatacactgcacagaaagcatacaagatatacgatgtctgtggacagatgctctgtggcattattaaccctggcagttgctttagccgttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggtggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgc

SEQ ID NO: 56658 - DNA, 1139 bp, Homo sapiens
cttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactccccttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttgccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaaatgaggggacaggattctcctaagggtagagtttcaggaaatgagtgaaaggcaattgacaaatgcaaagaagtagtcactttttaaattgctggcaaagctataattaatccctaggcacaattgtag

SEQ ID NO: 56659 - DNA, 2109 bp, Homo sapiens
tcttgggaagtgatggtagagactgatgggaatagtctttctgcctggttgcaagtcccaaatttttaagggttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaaatctgctgtttgccatgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactctcaagctctttgccactttcctactattttttgattcttgccattttaccaagcttaggttgtgaaacttgacagaaatgtattacaggaaaaacttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcggccatttgttctaatatgtgtgttattagatgcaatagaatttatgaaaagaagaatgacaaaggtatctgattagaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttt

SEQ ID NO: 56660 - DNA, 1226 bp, Homo sapiens
tcaggcttgactcactgtttactattgcctactcataatgcagctactcccaagactcaaactttcagaatgctttcgctggctataattacctgccttccctttatacctttgttgccttgaggatgctcttagctcctcagtgacctttttgctgcccttgtcctgctgtctaccctccccagcagcctgggaccatgcccatggccgttccttcctgcctttttgccctaccctgcaaacttgatctttgctacttttcttcttcctttctgtttttggaaaagaccatttatatattttctttggagaatgtctattctgatcctttgctcatttaaaagttggattggctttttactattgagttccctcctttctaatagttttattgagatgtagttcacataccatacaattcactaatttaaaatgtataatttagtgatttttaagatattacagatctgtactaccagcaccacagtcaattttagaacattttcatcacattaaaaagaaacactaggctgggcgcggtggctcactgctgtaatcccagcattttgggaggccaaggcgggtggatcacttgaggtcaggagttcaagactagcctggccatcatggtgaaaccccatctctactaaaaatacaaaattagctgggcatgatggcacacacctgtaatccttaccccctgcgtcttcccagacctgaacagccactaatctacttgctgtctctagatttgcctattcgggacatttcatatttatggaattatacaatatgtggtcttttgtgtctgacttctttgccttagtgttgtgtttcagggttcatctataatttatcagtacttaattcctttatatggctggataatatatcattgtatggatataccacatttggtttgttcattcatcagctgaggcacatttaggttgtttccatttttgcctcttaaaaataatgctataaacattcatgtacaagtttttgtgcaggcatgtttttatttttattttttaaaatttatcttgggtaaaagtaaaatggctgggtcccatggtaaccatgtgtgaccatttgtgggacttccaatgtggctgcatcgttttacctttccaccagcagtgtgttcatatcttcaccaatgcttgttgtctgactttttgattctagccatcctcctgggtgtgaagtgggatttcatcata

SEQ ID NO: 56661 - DNA, 1025 bp, Homo sapiens
gatttatgaggccagaatttctttttatggattgacaatgaggaacctaattgaaaagagttactggatatacttggggatacaaaaccagcacttatctccctgcaggtaggagggtggtggtgaggagggggacagatctccatcagaagggtatttgggaatgtttaatggcagcaggccaagacggtttgaggtgtgcccccaaacaatggtgatgatttcctctttgaggccagattactcagtctgtaggtcaaaggcctcctcatactactaagcatttggctggacactgctagctgtgtgtccagactgtgtgtgtgtgtccagggctgagcagcacctccttccccttcctgtggtaacgtctttatgaattatgaatttatgaatacatacaatctggagaccgatacctcttttggtatcagggattttctctccctctcgccattctccttccccttcatctctcttccactccttgtgtattttgtgtctcagacctggaatcaatcatttctccaggaagacctggtatcttttaatgcaaaattgtatttcaagaccattatcttggcaccagggatgctaatttttattgagttggccattgtctgtaggtcttttttggtgaacagagctgggaaactacacataaggaaagagcaaggatgaatgtgatagatgtaaacatacttgtgtgttcatactgatatttccaatatcttaactacttctgtatttcatctgatcttttgtccacactgagaattctggttttcaaatacatagggaataacagaatccaatattccataattactcacttgctttatcctacactacacaattaggaatctcagaatagtagtacaaacaccagcaccaattatgattactgaaaacagtccaaaaccttttaaaaaatatgtcatctgtatccttcaccatcttttaaaatggttatactgtattattgtgatactctgagtaatggtccctcaaaaagtattcatgtc

SEQ ID NO: 56662 - DNA, 1064 bp, Homo sapiens
cctcctgcattcaccaggccaagcccttattcttctttagtaccataaatgaggggatacgagaaaaatggctcctttaagcggcaagtgtttggctgcttcttttattctcatcttgtacctcctttactcctatcctctattttcttttgcagtttatctaacactttaattactgttttgatcttcagatcctttgtttgagatagtttttattatttccatttacaggtagggaagttaagtcttagtggctaaatgttgtaacatcccttaggtagtgaaaggcagttcccagtagacctaggcctctagaacccctggaatattgcatgctgcctctcagtgctggttctgataaaaatatctcccctatctgagcaggggataagtaggaatgtgttaaaataagaaggggattatgaaagagaattttattcatgcaatcagtatttactgagtactatggcaagccaggcactgtgctagatgttagggacataaacttgaacaagacagtgttggctgcaagggtcatgtgatgtagatatggtgttgcacaagcttggtataccctgtggactttttagaattattttggtaacaggtgtgaatagagtgcttttcatattcaggcagtatttttggtggcgaggacattaggtaggtatgtgttagatattttgtctctctctcaggctacatacagtttagtggaagagatactatggcgctttattttattttatttttttttgccgctatctcactttgttgcccaggctggagtggtgtggcatgatcatggctcactgcagctttgaactcctgggctcaagtgatcttcttgcctcagcctcctgaatagctgggaccacaggcatgcaccaccaccctggctaactttttatttttagtggaatcgaggtctcactatattgcccaggctggtcttgaactcttgggtccaggtgatcctcccactttggcctcccaaagtgttgggattacaggcatgagccactgtgcctggcctgtggacattactgaaaaaaattaagcaa

SEQ ID NO: 56663 - DNA, 1041 bp, Homo sapiens
gtgacttacagatggagtgctatggtctgaatgtttgtgtcctccccgaatttttgtgttgaggccctaatgcccagtgtgatgctatttggaggtggggcctttgggaggcaactaggtcatgatagcgtggtcctcatgagtgggatcagtgcccttataaggtgagacagagagatgatctctcttgctgccctgtgaggatatagcaggaaggtctgtctgcaaaccaggaagaaactaaatcacctggcaccttgatctcagacttctcagtcttcagaactgggaggaataaacttctattgtctaacccaccaagtctatggcattatttttgttatagcaaccccaactaaggcactgggtgtgtgtatactctgtggcattagaatatgaagttgggagacaaggaaagaatgtagtaattgatagagctaattcagaatgttaaattgtcttttctactacctgtgtattaagttctgtagggaccatattagactgccaacacgcctgtatgtggggttccctcatccggtgagtggggttacttgtgtcacagaagatggagtttggtgtctggagacctacgttttagtactagccttgataccaactggctgtaagatactgagcaagtcacttaatctttgtcagcttcagttttttaactgatagaatgaagtaaagctgttctttgcatgattattgtggagattaaataacgtgaataaactgtaaagcacccttcaaagactacttatcatgtggaatttactggatagtcttcaaatccaatgtagacagtttctctgagcttgcttttgctctcctccagtctcctgtcttctaattcatcctgtttaatccttgttggtgagtataagttaatattcttaattttgttactgttaggttatttttattcttttcaattttctaccactagcatttaaggagacttgcagtaaatgcttttcaaatttcaatattcaacaaatattaatcaagcatctcctaagtataggctctgcagtg

SEQ ID NO: 56664 - DNA, 1048 bp, Homo sapiens
tcttttcttttgtgatctcttttgacttggcgcctaatggaaacttctgcatcagtgaggtccagtgtgatagtaaatgatggaatattgcaatatcacgtgttggctgggatttctgggtccattgcttcatatcccatctgagttcattctgtagcagccatttacctaaaatattttccaggtgtgtgcttattatattagtacgcttaatttgtctatattcttgggtttaatctttgaaattttgaattaaactgtattaacaaagacaagtcattattttattagatgcactgtgttggtaatgctttcctaagttgcctcagaagatcttctaatcttaacaaatgttttgtcatattttatcctttatctgtcttatctattgattcttgcctaggaccaattattgtagatatcatacccgtcttggttaccattgtgcctaaacccagataccatttatagttttatctaaaagtctatgaatgaaatcatactctcttgctgtcttattattctaaaagtgtgatattttatgtgaactagattttataacaagctttcctttttataatctggcagcagtataaattgttgatgtttattcttctatcccttttacatgatagatgaatctgttcaattttggcttttgagtgactcatatgtggttagcattctgctgtggcattgggtggtctttagcattttattggactattttatgaaacatctccaaagaaatatgttggaactggtatttattaccttaatcttattgtctgccttgagaagctgctaactaaatgttttctccagcttttccttaattgcagtgtggttaattcctctcaactgcaggaagccaaggtatttatagattgttgttattattttttgtggcctgtagaagtaatcggcattcaacgaatgccaagaacatgcttggcatgaagtagtacatagaattagatccagttcctgccccatgaacttgatgtgagataagctaactggggaggagagaaggaagagaagactt

SEQ ID NO: 56665 - DNA, 1059 bp, Homo sapiens
ttgagtccatacacagtgtgaagcctttatacatatatatatacatatacatatacacatacatatatatatacacatacatatacacatatatacatatatatgtatatgtatgtgtatatatatatgtatgtgtatatgtatgtatgtgtgtatatatgtatgtgtatatatatatagagagagagcttatatatatagagagctcatatatatatatatagagcctatatacatacatatatacatatatatatatatatagagagagagagagaggtatcgaatataagatttacttggatttttaagagcaaatgtgagatttgaacaaaattttattggttggatgccgtaggctccgggagtgtaagcgcattttcttctgccattttgtctactttcggaaagttcactatacattctcgctggtatacatggttcagtctgtgaacttgttgctttctgactctgtggtacatgaagctgagactgagcaagaatcaaattctcttctgatacctgtgaaggaatttgtccatgtgctctgcactggaacagaataaattaccttgtacttgtgcatttcaaaggtaggtttgggattggtgaaatggattttaagtgtttttttaaagagataattggcattagagatggcatgattggtcatccctggatgcagcctggtttgttctttagaataattgttctgtagaataatctactcacctaaatggaaaaacatgtaggtgatgctgtagcttcattttgctttgttaattttactttcagccagtccttcctctggtcaacagaaacttgagttcaatgacagcaacgttgggaagaaaatttgcatgcttggggctgtttctctgagcagttcatcagcctaataaaatcttttcattgccttgatcttcgcagtatttcagcatttttttattgttaaattaaatttattgagactgctattaaatacaacagtactgtttttcatggacacagtaagaagtagcttcaaagcactttcacttgagttgtttcattcaacat

SEQ ID NO: 56666 - DNA, 1571 bp, Homo sapiens
aaatggggctaaaatcaaggagttggcagggctgcgttccttctggaggttctagaggagaatctgttccttggcttttccagcttccagaggctccctagattccttggctcatggcccctttccatccttagtgctggcaatttcgtccctgaattatggcccctgctttctgtcttcacatctctttctctgactctgactctcctgcacctccatcgcctttggttataaggtccctcgttattagattggtccctcctcattcttccttccccagtaatccaggataatctccccttctcaaggtccttaatttggtcacacctgcaaagtgccctttgtcatgtgaggtaacacattcataggttttggggattaggtcatggacctctttggggggctttgagtctgtctaccataatgggattagagtgttaggctcatagcagggattggagagattccaccccctactgaggtactccaatattgggatcaggaagaactaaattcaaatcctgtttcttctgtttactagctaaatgactgaacacatttcttaatctatcagttgttctttaatcatcaggaaaattgggataatgtcctcttggcacatgtattttacagttatacatgaatgcatgcagcatactgagtgaagtgcctagcatgtggattatgaaccataaataatagttctttgcctccttttttttttccctgagatgggctcttgctctgtcacccatgttggagtgtggcggcatgatcatggatcagtacagcctcaacctcccaggttcaggtggccctcctagtagctgggactacaggcatgtgccaccacacctggctaattttttaaattatttgtagagatggggtctccctatgttgcccaggctagttattcctttctaattactgtgcactggagcagggcattggggtcagaaaaccatatatgttggctgccaagcacgcataagcacctgctaaatgttagctattattattaaatacatgaattcagttgcctctagggcaattattatttttaaccagtcagtacatcagtgtttctcagaatggattctgtggctctcttggaatttaggaatgtatgttcaagtgtctgagagttctccataagaattttaagattttgtttttcatttgatcctaatgacaacaagataaaataagcctgttctggactgttggaagggccgttgtctgcctgagcactgtcatttgagtttatcattcacagctgtgtttgtctacttgtttctacgtgtgttgccatcaaatagttcttctgtaagggttatgccctgaagaaaaataacagaaaattttatatataatgaattctaataagatgaaggacacatgactgcactttgcacagtcatgagttatgaatcaagatttttgcggtcgttggaatagagagacgaaagtagcagaaaaatggagttagtgcatggtgcacggtactgaaggcggggctgatatgtagccatagttcctgaggcagcctctggagttgctgatggcta

SEQ ID NO: 56667 - DNA, 1101 bp, Homo sapiens
ccatgtggtgattccaggcttgagtctgaactcagagcaaggcacatggcattctgcctggcacctgaggccacagcagcatattataggtccgctgtgccttgtgccctgagtatgtcctgttgaggccacttctattcctcctcttccttctacctgggaagcactcccttcccattgcggctgaagcctgtctcttcaaacctcagcccaacttctgcttatcttccagagcctatttgagctttcatcccttctagaagctttccctgatgttggcagagtagttttctcttcttttgtgttaccattacactctagagagacctttgtttctgcatgcatcacagtgtatttgtctttttgaaggcagggactctgacactcatcttgacagcaaaggggtgaattactcaactgtcaattcttttgtaaaatggacaatgtcaaccctgttagaagtaaatgcaataatgggtgtcacgtccttagcaccgtgcctggcccatagtatatacccagtggacacctgtacctcctctccacatccctgttgcatggtgactgggcccagaaggcagctagaattggcaactcaagcccttttggtcaggatcctttgctgggtggaagctcctcgcctactaatgcgggtgccctgtggctgaatctggtgaatccatcaggtccaggttgaaaactactgagcagagccctgctgcctctgggtattctgttcaccacccagcccttttgcatttaatgaatgtaaaaaataatggggcagctgctgttccttactctctcttcctgctgcactaagtctctgcctccctggagaggcatttaaccgcacgaaggtttatggtggaaatgacaaattgcttcttcacaacgagctcaccctgctttctaaccagttggaatcacccttgttcatgtaatattagcaatttacctgtctccttaaccactaaccatcctgagaggatttggcattctttgcagctgttaatcctctcatcacctgagggcttattaaataggtggagtgtacatctagcctttctcctacagtgaacagtcattcatgatcttttc

SEQ ID NO: 56668 - DNA, 1041 bp, Homo sapiens
aacctgccctgagttacacagctaggaagccggctagctggctttcaaatgcaggctgtggggttttataatctgtgttcttatttgtcatgctgtgctagataaacaacaattctacagccattgccagtctgttctctggtactgctaaagacagaggaaggaaaaagctagttcttgcctgcagatgcatccagtctgttgggaagacggacctggaaaccagcatttggggtaaatgctgcagcgattatgcaaaaacaattcagtgagaatgtaaagaaacattatgtgaagcttcttgagaaagtccaagcaggcttcacagaggctgtgatccttgaactcagatccagaagggtggatgagtggggagggaaatcctggacctagaggtgagagagcacagggagggctggagagagatggacttgacagtggatttctcaggcaataagatcatgaaggcgctgacttgcctgctaaaaagctttgacctcatcctgctggtagtagtgacctattggtagatttttagcagagaataaatatggtgaggtttgcagattactaagctctctctagaggtgatgcagaggatggattgggaggagaaaaggccggacaccatttattagtgctggctgctggcaagaatgtaggggcctaaactggagccatgacagtgggaatggagagcctggatctgagaggtgaggaccagcattatgcaggtgttcattatctggatttctgaatgatatgttacctaggaaagcaacagtgatcataacatccaaatattcaccaatgaagccatcacttacagaaacaatccctgtggcaaatgcacccggtgacctccaatgtgccaggcccttgtgtagcctcctccatgatgtgttattttatttttatttatttattttatttatttattttttgagacagagtgtcgctctgtcgcccaggctggagtgcagtggcgctatctctgctgactgcaagctccgcctcccgggttcacgccgttcttctgcc

SEQ ID NO: 56669 - DNA, 1051 bp, Homo sapiens
cttctgctggttcaggcagtagcatttcattttccagctgtaactaaatgagaaattacgaggagtggttcgaatagagtttgtcggtggctctccttttcttcgcccattccattgtgaagatgagccagtaaggctctgcatggatattttctggcaagggcatcaaacacgtttctgagggcagagtccatgttgttgagtaataattaactgctaatggcattgtcttgggtgttgcatagtaaataatcaagaaatagtctcttttcaatgagagtttgaaggccaatgcaaagaccacacacgggcaagcctgaaaggtgctgttttgactaaccttaatgggaaacaaagggaaaatctggcttgttttgtgtggccatgcttaattgcatgatggtgtgtttttcccttgaatttcctcatgccccgtggagggcacacgcatgatggtgctctgccgagccaggattatagaacagaggttcttggcagccgggatgtactggctgctatgttgtctagcgtgctggatcttactgggagctttcagatcggagtctctgtgaaatggaacaagtgaactgagcctagtctgttcctaaaaataagtctctaagaagcaagtgaagtgcttttcagtgggaagcctgtggagaaagagcctggaacacagtctggaagtaaggcaattcagggttcctttacccaacccttttcaggctcaggagagaggaagtgacttgtctcgggtcacttaggggctaggcctcgcacctgatctgttgtatttctctgcctgggctcttttccaccaccaggggccaactgtccagaatgtcattttcctgagtgaggaagcagagatgcctggctctagggtgtgcggcagggctacaggactgagagtgtccaactctcttggccctgccgcactatcctcaggttaactggtgttccccgctggcctgctgttcagggctctgtgggagagagctttgcagcacatgcaaaggaggtatgaggagggcagatggctccaccagcc

SEQ ID NO: 56670 - DNA, 1061 bp, Homo sapiens
tggatgttgtgcctatacacacacaggatctagaagaacatgtcaaactataaactgcttgtgattgtgaatgactgtgttctttgcttcttgtgtttctcagtttcttataatgcacatattaacttttttaaaaataaagtttattttaaaagcctgaaaaaaatagtaattcctgatttaattttattgtctttttctaattatttcatattcatgaaatacataccctgcgctaggcactggggagtatctgtagatgggagatgaaggtatgtagactgtggtcaggcttggcttctgccagctggctatgatgcgggaggaccagcagtgagcatgcttcttgggtttctcacggtgagtctggggatgctattggagcccctcagctcagccctttcacctggcaggggcctcccagcctgcctattccaatcttacctgccctccaagaccaagctcaggacccatctgttttctaattaatgctggcctacagttgccacacttttctcagaatcttgaagcacttacacacccaatttaactctggatcacatcccaccttgtctttttataattgtttcatgtagccttgagagaagagacatgtcttattcatctttaattcttaagtgcctacaaagttcctgacacatacatatcctcaataaatattgaattggatgaattctagttcattttagccaccatgtatctactagtggatcacctactttagggtttcttaactttattaccaccaccattttggaccagataattgtttgttgtaaggggctgtcctgtgtactgtgggatgtttagcagtgtccctggcctctatccattatatggatatatgaaatgccagttgtgacattcagaaatgaccccagacattgccaaatgttccctgaaaggcaagatcatcccaggctgagaaccattgattaattgtgttttagacactgcctgtaccctgccttctgagttaggctataaatactttaggggaaattttgttttctcaacaatgcctttataccgaccgtaaa

SEQ ID NO: 56671 - DNA, 1040 bp, Homo sapiens
cattttgattcagctagaatctgggtgggtgtctgctgtgtgctatgcgtgggtctcggttgctgccacagagagcaaacattttagtgggagagggaggtagatgaacagtgtctggggaacacaggtgtccagagtgcgtattggacccatgcctccacatggcccagccaaactcatggaagtgctgttgctaaaaatgaattttctcatttataaattttctcttttataaaatacccaaattgcaatctggacttggagtctcccatgtgggatctgcagcattcctagggctgctgtttgtttgatccctgggttttgtcagatggatgctttatcaggtcttctatgttgccctggctgttgctttccattccggctttaaattctcatactttgctcccctcatcaagcaaacctttactttctccatggcctcatcccaagggctccctgacatttcacgcaccagcttttgtttttgtttttgcatacgctcttggaatctttgggccaaatgggaaaaagaagttcatatgatctaccatataaatatgttcattagatgatgagtcttactatccagaatttgttgactaatgattggagctgtattctgaaaaaaagaaatcctttacacattatttttattatttttttgagacagagtctcactctgtcacgaggctggagtgccgtggtgtgatcttggctcactgcaacctccacctctcgggttcaagtgattctcctgcctcagcctcctgagtagctgggactgcaggcatggaccaccatgcccattaatttttgtatttttagtagagacggggtttcaccatgttggccaggatggccttgatctcttggcctcccgatccacccaccttggcctcccaaagtgctgggattaaaggcgtgagccaccgcgcccagcccacacactatttttaaacacatttttgaagtggtggttaagctgactgcatggtgctaacctactcaggaattcgcattgaaggcttgctgattttctt

SEQ ID NO: 56672 - DNA, 1029 bp, Homo sapiens
atgggcagagtgctgaggaagcacattttgctcatggacaagggggcatggtatctggaccttgagaaatgggtatcattccagtacatgaagatgaggaaaagctataggcagtgagaagcagagctagtatcctagcaatgagttgggaacaagagggctttaaaggagcgagggtaggaagtcacattgggcttatatcatagagtgcattgaggaccaccatgctaaggagtgttcctattccatagatagtgggaaaatgaggagttttagatcagggaatggcagagctgtgctcttggatgtctcttttatagaaatttttctcttggatgtctcttttatagaaatttttgtcttgtgaagttggcaagatcattgtggcagctcttcttcccaagttgcccagggtctctaacttctgaattcctcccacgtggagccaatgtgtctcttcctctctatgtgtcctgtgccactttgtgtccccatccttcccaactcactccctccttaaaattcttgctgtcctgttctccatgatgtttctaatctaaggtttctatcacaggaggaatgggtgctgccataactcctgagtccattccagaaaccacagatgggttttcacagtgctctgttgcaggaccacagctccacacccaccctcactcccactcccatgtgcagtgccctttgtgtttaatcaaattgagtggggaattgtagccacatagaagaggctgttgcttctggagttctgcaaactataccctgcaatcggctgttgaggcagaaccctactctgattccaacccctcgctggttgttttatgccctgttctgacagttccctgggctgagtttgctcatcacattctcaacctgttcatttagatttgggctacctccttttattgttttaaacctgagcgttccttcagtaaatcctgaatatgtgaagaagaaatgtagtacagagagagagaaatttttcctattaaacattttaaaactttttttttt

SEQ ID NO: 56673 - DNA, 1032 bp, Homo sapiens
gtggcctccttaatgatttccttgcttcctccctgagttacattctcaactcagcaggcagagctatcttttagtattgtcagatcaagtccttaaaattggttgaaaaccccgtaatagatgctaaagaggataaagagctgaacctatatagcgcttgcctgcaaagaatttacagtgtggttgagaagatgagaaagaaccatgttccaagttaagagtgttgtgtaatattaggaaatgtattttatatataacattattataaaatcaatcccctgagtgctaattgccatagcagtatagaaactctttcaagctgtggtagtcagaggaggtttttataaagtgatatttgaagtaaaacttatggggatgttttggatagattaagggactgagcgagggatttgaaagtagtaattacataagtgcagacatgagaaaatccagtttctcttcaggatagacagtgaataagccactgtgcaattgaaatattgtagcgtagtattttatataggtcagtgattttcgaattcttctttttaaagcgatgaaccttttgtcaaaatatcacatggaactccaacttattaaacctgaggactgtagcttctgtgggtgaagcaggatgggcagaggttggttggcatatctgcctgcatgacctctcagccctagagtggcctttgaggctcgtccactgaacccagggctctgaagaatacagcttagaaactgtatgtatgtaactgtatgtacgtttcaagagcagcttggtgggagaagggaagctggctgctttgcgtcagttggtagaacatgttgaatatcagttttgatcttctggtttaggcaatggggtattatagaaagtttgtgatcagtacctgttatataatgtttcaggaaggcttaaatggtcgtggggggtgtgcgtgcagtttttgttcttcttccctcccccaacaccccagtatgatccttagaattctacccaggagtccagtgatggcacccccaaccccc

SEQ ID NO: 56674 - DNA, 1038 bp, Homo sapiens
tgaaaagtatacaatatggaaagcagagcttaaaaacaagtatgagtgcaaaggaacaacaattactgagagaactgaaaccctgaatgcattaggcttatggaaaaggctgaagatgagagaaaaaggggtgtgaaggaagagagagttggcacatggcaaggggaaaatctcaatcccatttttctaactgtcttggtttttttcttctcaagtagagaactgatcttcaaattagaaacactagaacatatgtaattttaaaaaaccgaagttcaaaaccaagaggaaaaaggaaggtattcctcactaccatgtgtccaggcctgaatcactggcttctgggttcctgaaaaatatgattgcaaaatagtgattggtcatcttttgcaaaatcatgagggatggagaagaaacaaaaagattgcaaaaataaaatattgcagtttttagaaagggggcaaacctgcatcaggaattaccaactagtgaatttgtcattgctcctgggcagaattctagaagagatcattaagcagatggtctgtgagaacttggaaaaggaaatcatgaacactgagagctagtcctaaaaaaccagttacccaagtatgttcaggaaatctgccttacagctgttgcgcaaattagctttgagcatttgagtagactacagtgtgaaccagcaatgagatgttataacagaagaaaaaaaacatgatcagagatgctttgctaaaaattcagttctagggcatagaaaatatttatccaaatatactctgtgctgttcagatccctcacaaatgagttcagttctgtgagctgcattttaagatagtcactggcaagttggaatatgtacggaaaaagttaagagaagatggaactcatatttattgagcaagcaacttaacatgtgttgggcattgtgtaaaatgtggtatgtgtgttttaatgcttaaaacaataccatgaagaagtcattaatatgcctattttagatgaggaaatgaaggattatgtaactgagttttt

SEQ ID NO: 56675 - DNA, 1035 bp, Homo sapiens
agttagcccagtccatgagagggcagggtaatgaggaggagtaaaggacctatcttctctgtccacataaggaagttgggaccacaaggtcttttatctccttgttactccccaaccccaccataacctcctactcagcacacagctgtatcctggtagattataaggtgagcttccagaacctggcaggaggctggtgtatccccctgcacagagggaagtgtatctgaatgttgtgtatgtggctgatatggaagacatacatgtatgcaatccatcagcgtttaaagaagaagattggctccagttcggaggaggaggaggaagattacagatctattctgagtattttttagagagttaatatttatatttttagtaattttctggtagaaggaaattgcacaataaaatgatttggtttggtttgctggctttgtctgtttttcctcctgactgatggggagcagttggtttcctcaaggctgacttgttggctgaagtatgttggcattttcctttgtaagcctggaaaagtgagaaatgagggaggtagaatgtgaggaagatgggcattaccgacacctccagcctgaacccttggcggggaaatgacttctgaggatgtgccatcattggctcccctggctggctggctgtgagggggtacctctgccaacccgacctatcactgtttcaggatgtgccatcatgatgtgcacaggcacgaccctccttgggaggaagtggggataagcggacatggcctttggatcatcctctaggacactcattctttacctgggtccaaagccctcttccaccaagaaagggatgaagcttcacattcatgtatgcacgttcttccatagaggaaccagagcttctatcagcctctcaaagagagtcatcaatatatgtcagtgatttggacttaggtacttcctgggagattgcccccaagggccccccatggacagggacattcttattgctcacctgcggagagaaggtggctcagagaagagctggcct

SEQ ID NO: 56676 - DNA, 1752 bp, Homo sapiens
tggtttttgcgcattgtgacattccttttaaaagagttacttaatatttgggtttttacttttaaaaatttctttttttttaaaggacctcatgatgcaacagtaagttttatttatttatatttaggttttttacttttaatcatttttgcttggcactccaagttcgtgttcatcaccaatgagtacttggtgaaacacaaattgaataattgtaccatatttagtatctgtgaatggtaatcagctgttgtaggctgtctcatcttatttttattaaaataacccaattgccaaaagatcttattcatgggaaaaataaattacagtggaagcttgctcatcaaagttatccttatctagactatctcaaatttgtactgcagttacctactttagtagtgacttactctgagtctgatttttaaagtattataatttctttttctagtgactttgtatggagtgtttacaatccacttttctccaaatgtgccatcacgctgtctgttgcttgaactcctggatgtcagtgtttcggaattgctcttatattccagtcaccagggttgttccatgtggatgatacagcattgtgcccgagatgttttggaggcccttgcttttcttcatcatgagggctatgtccatgcggacctcaaaccacgtaacatattgtggagtgcagagaatgaatgttttaaactcattgactttggacttagcttcaaagaaggcaatcaggtaagaaataaccttttcttttctctcgcagtttaaaatgtagtggttgaagccaaatatttttaaatgacaagggtagtttagtaggggcttacaagtcattttaacctaaattactgaaatgccaggggatgcagtaaatcaaaagaatttcagtgccaccgtgtaaaaaaaggacataatgtttgggtcaggtaggaggagccagtgaagcatgagagctctggaattattaaaagtacttaacctacatagaatggttttttaaattttatgcgtgtttggctaattgctgagttactattcctggtctcttcagtgttggggctgtatctcgtggcagaatgcatatgatagttctgccaaatcctcttttctccatggtttatcatttctttgcagtgtccttattatcagcagtgcctaataggtaagagacaatccaaagaagacttctttatgagcgctatatggaaatgtacagcttgcctctgagaactgcccagttaatgaaccaaagaattatggtaatcaaggactaaaaatttttagcatttagcttggcagtgggtttactgcactcttagggaagtaaattcactgtagagatggatagaaagggagcagcttttttattggttgtaatatttactcatcttttttaggatgtaaagtatattcagacagacgggtatcgggctccagaagcagaattgcaaaattgcttggcccaggctggcctgcagagtgatacagaatgtacctcagctgttgatctgtggagcctaggaatcattttactggaaatgttctcaggaatgaaactgaaacatacagtcagatctcaggaatggaaggtaaacttcaccagtgctttgctttggggtccttactttcaacttaagagtattcaatttatgatgatttttttttttcttttgagatggagtttcactctttcacccaggctggagtgcagtggcgcaatctcagctcactgcaacctcc

SEQ ID NO: 56677 - DNA, 1544 bp, Homo sapiens
ctcttactaagttatttatttaggttcactaagccatagtttgctttctttaaaatgaggataataatggcatctatctcataagactactgaggttaataaagaaatgatacttttagcaaacagctcatggtaagtatttaataaattttactgataatgatagtatctgttcttttaactcatgtacacagttctaaattgtgagttagcatagtattcaaggagaaaatatattctgtaaagatttagagaatgagtaatatgacaaataagatgttttaatactgcatcatattcgctttgatagtttatttctgcctgaaaaccaattgaagactcgttacggagataccctgagtcacctattatacattcatttttgcattaaactacattcttatgtggttacttcggtatttattttttattctttcatctagtagatgttcatagagtgctaggcgctgaaaatgaagaaaaaaatgttcttctccagaagtgtgtaattatgtatattatttcctctgttaagattgtaggctcttgctgggcacgatggctcacagttatagtcccagcactttgggaggccacggtgggcagatcacttgagcccaagagtttgagaccagcctgggtaacatagtgaaaccccatagctataaaaaatacaaaaaattagctggatgtgatggcacacacctatatttccagctacgcaggaggctgaggcaggaggatcacttaaacctgggaggcagaggttgcagtgagctgagattgcgtcactgcactacagcctgggtggcagagcaagaccctgtctccaaaaaaaaaaaaaaaaaaaagattgtaggctctcagaagatagtgttttctgttgcattttactctcaaatagtgctatatgcctagtattcaataaatacagactgaataaccaaaggaaaacttttctccgttttttaaggcaaacagttctgctattattgatcacatatttgccagtaaagcagtggtgaatgccgcaattccagcctatcacctaagagaccttatcaaaaggtatgttacacgtaccataaacttgctttgcattcatgtactatgtgaaatggtacgtcttttttttctctgaacagatttatattattatttctatgtaaggaacataagtaatgaaatagttttaccaaatttgttttcaaaggaatgctcttttgctcatagtatcagatgttaagcttttcctggcagctgccttttcactggaagatagattcactgtacctttggccactcatagccctggcagttctggatacttgatggaaagcaggtttttaaagagagtcttttttaactaaagattgagtttgcttttggactactcccctccccccaaaaaaagacccaaaaaccatttcgaataagatagttttttattatactttaaataattactcttgacaacggtctggggacagatacagtttttctgatatctgaatagatccgaaaacaatagatattttgaaaat

SEQ ID NO: 56678 - DNA, 1108 bp, Homo sapiens
gtgctggatgatgattatcttgagaatgaagaggaatatgaaggttagtgttttctaaattatattttaatgtgtctttcttaaataagtctagaataaacatatccgtaacattttcatatttctcaatttatctaatgagaatattgaacaatatgatctctaatatactctcacttttatctttttgaggcggagtttcactcttgttgcccaggctggagtgcagtggcacgatctcagctcactgcaacctctgcctcctgggttcaagcctcagccccccaagtagctgagattacaggcatgtgccaccagacctggctaattttgtatttttagtagggacggggtttcaccatattggtcagctggtctcgaactcctgtcctcaggtgatccaccaacctcagcctctcaaagtgctgagattacaggtgtgagccactgtgcccagccctctcactttttaattcataatgtccttttgactcttttacgtttcatctttacccagttaatgaagaagattaattttcccaacaacttctatctctctggtctgtctcttctagcctttccctatgcttgcatttctccattttagctctcttttttgcttttaacattcattcatttaagacatattaactgagtatttactatgtgctgttgtgggattacttcccgtctttagtatagtaggggatacggctacataaacaattatagttgtgataatctgaagatagggtactatacaatggcagaaaggacaagtacttaacccaatcttagtaactggtgaatgcttctctacagacgttatatctgagctcagtaatttggagttgcttgactaaaagttgaggggttaggaagtaagtagcacaaacacatagatatgaaagtgtcagaaaacagcaaattggtatgactgtatcttaagatatttgttggggagcaatcagttaaagctaacgaggtagccagagtacagacgagtttgctatgtttaagaatttggattttatccgagagatagtaacaccaaaatacagatatgtgaagaactttgcgtcaggtatagaataatatctagtttatg

SEQ ID NO: 56679 - DNA, 1050 bp, Homo sapiens
tattgccaaactagtgataatagttttacatttagtatcacgtactgaatactaatatgtataattgtatccttgctgtttagtcatttaactgatatttattgagcatttattatgttctaggtacccattgtaaaagtggtcaaatcagatttttaaaagtgtggtgataagtgctagggagaaaaacagattaaggaagaaacttaaggagtgctggggtaggtagggtgggttgcacttttaaatgggttagtagggaaggacatctgagaaggtcatatgaatcaagatttgagggaagcgaggaagagaatgttaggcaaaaggaacagcaagatccaaggccctgagtattcctggcagatttgaggaggccaatgtggctgtagcagagtgagaaagaagaatagtaggagattagatcagagagattagggagtggtagggggcttattaagtagagtgagctgggtagagtattgagattacattggcttttattctgaactagggcgaggtattggaagatttcgaatgaaggactgacatgatctgactcaatattagccccagtggtcaaaatgaagtggaagatacagaatagagagacaggagaagtcttttccagagagaagtatccaggtttaagatgatatgaaaaaagtatcagtgagaggaaagttgctattttgagaagttttcactgacatttaaaggagagtgaaagcagcttttgataaactcttggaatcacagatttaatctatctaggcttttgaaaatgtccattacctagttgtcgaagccattcttcatttgaatttttaattcaagcaaacatgattttataaggaatgttacaaaaaacactgaaaaataatgaatgcatctgataatgcaattataaaaataatcagaattaaaatgatacagccctattaatttcataatttataaaaataagatgcctttcttagtgtgggatggtgtagtatagaaaagtatagcctatctgaagcaaggagtatgatagaaaacatgatattc

SEQ ID NO: 56680 - DNA, 1671 bp, Homo sapiens
atacatttggcactgagtaggacaagacctctcagctatacattgaggggttttagagcatccatgtgggcaacccttttttgtgcgggagagcaggtgttgctcttcagtatgtagcctaaaaaaatcttaattatttcatggatcatgaagcaaggatgaataatatcatgtcttggtaaatactaacaaatttgttaggtttggtgacatcatttacagattatttctttatgttgtccagtggttcttccttattgttgatatccataagctggcactggatgctctcagtaatgttaagtaattgtcaagcagcagttacctactgtgttcttaacactgagttgtgaattttttcttaaagcagtactgtagtactgaatattcctttaaaggaactgcagtgagcctatctaagtttttttaaattaaggcttttaaaatagaaagctgatgcttgatcttgcacaatttttatgtctagtatgtatgcttgagtgaatgtgcgagtatgaatgattagagaaaatttgagtcagtgtactttatagtgtgaatcctgtgagctaatacagtctatacttatttcttccctacctgtttcacatccgtaagatttaagatatacattttttgagaggtagtctgtctgatacaatgtaaatgacaaaacataattcctgagaggcccagaacaaactggagtctagcctggagttaaattgagacttctaaaatgattggaacaaagactaagttgtgccagatgtaaatcaacccctcttttagtttactttagactttgtattagctcatcttttttgtagtaaatctatagttttaaggtttctcaagatgtggctctacctactatgatgaaaattgaagtgggtcaaaagaattagatgtacagtgaagggaaaagaaaaaaaatgggcgaagagagggtggaaaataaaaggattcttttttcttcctttctgtttctcgtatccctgctccctttttcctccccttccctcattctttgcctctatccttagctgaagacaaactagaggagcagcatcccaggtagtttggcttttgactgcaaggtagttaagaaaggtgtagatataatgaggtagaagtagaaaggaagaaaaactcaaagaattcttaaaaggattcatagcaacataatgtgtccctgagtagaggatgctgctatgcgtgagttcatggacacaagttgattacatggtttttagaattataattatggattcttcttatttcatggtaggttgtctttaaagatataaaaattaggatgcctttatgaagcactgattataccaaaaaaaaaagacaagttatatacaggttattaatttttttatttatttattttttcctaaggaaaaagtcttctatctttccctgctggaagcctcctcatatttccttatgtttgccatgcaggttgctgagagtccagttagaatttgcattttacagaatgaaatactttaccccattcaaacaattattgtttgacattttagttatttataattgtcaaattcaggactctcctttaatgtttattatgaaaccaaatttggcataaggaggctgatttatgaattaccaaagggtcttgtggcatgttccccaatacat

SEQ ID NO: 56681 - DNA, 1537 bp, Homo sapiens
aagtttcatgattaggatgaaatatatacatagggattttggtttattgaagttattgaaagacctagaaattttctttttgagagaaagggtaaagaggtgagggttcatgtcacttaacccctacccttttgggcaaattttgtctcaggtagtgtttcattccctaaattaatacctgtgcttccttgcctctcaccttcccagttacttctttggggtattactgtggcacattgtacacccagaaaaggcacatacagtgattattttgtgggaaatacttgattcttttgaaatatatttggagggggtagctagctagccactgtcaaaactaatgctgtatttacaggacaaaaacaagtagagttggacacctcagtaagagacagcattaactaaaagtactgactgccttttaaaggaatttttaaaactattctcttgcaataagagatccgcatttattaccactggatgtcttccttttttgtggccaccaatatagcagctctctttagagggattccctttctgctatgccttgagccaaactggctgcttttagaacaaaaaccataagtatggttttactcgaacttctctttgtttttattgagagaaatattgccttctttttggtactccagctgctaaagagtgctgagatatgttaaattattttttaaaagaaaatctccaaatacttatttaacttgtcttctagattcatgttgcttatattttaactattgagcaagtttattataaggaatgctgccatatagagaaagctgaagagaaaccatgggcagaaggcttttttctgtcttattacactggaccttcactctggtaagggcatcagttacttttctggaataaaaggcggagttagagcacttatcagatgctgtttcatggcttgttttagttaatttatcatgcagataactaacatttgggtatctttttgttttaggtcttattttctgactgttaggcctatcttacacataagttctactatcagtatacttggcagcatgacttttttttttttttacagttaatttaatgaaaatcagcaccattgtaaatgatagtaattgtaacaacatagttactgggtgaaggagtaggggagacactcagtaaccatctatttacctagacacttatgcaggggtacatgctaggtggctttattcagattcgggtacattggaatcacatcatgactttgagtctgatggctgtgtagataaagatttaagcaagtgccttgtgtttgctggaaaatattaaaactcatttgggtgaaagcttcccagatgatgataattaatagcacttctgcctttttcctggagtaacttttagattgagtcacatatgatagtataaaagtccaaaattttctgggtttacctttgttttatttttcatatatatattcactgtctgcctggaaatagccttggtttaccttatttttttgtatatgtaaaactattcatatttgattttattc

SEQ ID NO: 56682 - DNA, 1029 bp, Homo sapiens
atgtatgttttgttacctaggttcatagtattttaatttaaaggcaaagagaagcattctacttatttgtcttataaaccattaatcgttttttgtgcagaagagagcttattttgttatactgctttgtataatggaaataagtcacattctgggggaaaaaaactggaattgtttgtattttgtttttttggggggggatctttatgtgaaaaatcagagctacttgttaccataagcccttactatcaacaagataattatttgtaatcacttttttatcccaggttggaattgctttccccttctaagttatcttcccttaataatatttatgataccaggacagtgagggtataagagcaaatgtagtgaggtattcaaaaatcctgcatatatggactcaaaagttctttagttatttgaattatatatagctatattattttattagcttgggttgtcagaagattgccaattttaagagtaaagaggagagagataagtaataaaaatagaggaggggaagaaaatggctcccttactggtcttagtaatcttctatatagttaatgagctaaaaaatgatacttaaagttccaggtttggtaccgctagcatagaaacattgcctttcctacacattcctcatcattgtttcctcagaaaattattttaagagtttgtgaaaccagattaaatatctatattcagtttggcctaatttttaaaaataaatatttatactccagcttttgtgtatttggtgtacatcaccacttatgcaaatcaaggatcagaaaactggaggttagccatctccattatttccttttgcacattgggtacagtgggtggcattagtatgcactagctgcaaagtcacagcaccttatggaaataagtatgtttattataataaaaaaaagttaagctgcatctctgtagattatttactttgcagactgtaaagctgccctatcttttccagcagaatttactcttccattcttaattcttttttgaaat

SEQ ID NO: 56683 - DNA, 1037 bp, Homo sapiens
cagacacacaccccagcccgtgcgccccgcagtcgcaccccatcctccgccaccccgcgagagggtgtgtgggctgggcagccgggtggatggcggggccagggatggaatgagcgcgccccagatggactgggggcgttgtgggaggaggtctgggccagtgtctgagtccgagggggtcgtgtaggcgtgtggggttgggagtggggcctctcccgggtgggcagtagagacctcgaggctctcaggctagggccttgtggacagttataccaagtgtgggggcctgtagtgggacaggagatcgttggcactgtcaggtggaagcgagttggtgtgtcttgaatatatgaggaaaagatttgagaggtctgacaaagacaggggatacatttggaggacaggacagtgggacaaaacctgtttgcttgccacttttttctttcttttttttggtttggtttgccatgatactggtagtgagagagaattgaaatttctgggtttcccctctcttggccaagcagaaggatggtattggagggctgagcacacgtatgctgaacatatggctgcttgaactttggcctgtcgctgtgctacacttacttctacatggtttatgaaatctgaaatcaggtaataggattatgatcatatgtgtgtgtcatttggtattgcaaaagtttaaggacttttaggtgaaattcactgggtgtggatccaagagttcgccggaaactcaaggcagttgtctattccttcacggttagtcagttggctcacttagctggagcaaagaaagacttcataggctgtgctgccaagcatttataggattcagttggtggttatgtctcaactctgatactgtttttcaaaagctttaagaggtttacttattcatttcgagggcatacgtataccagcagagataggggctgggtgggggaagccagaaaaggagggagaaatactggatttctttaatactggtatttaaattctaataaaaatatatttgataatggtagatt

SEQ ID NO: 56684 - DNA, 1077 bp, Homo sapiens
ccgaattcaggtgttcctcccacctcagccttccaagtagctgggactacaggcatatgttaccacatctggctaatttttgtgttttttgtaggggtggggttttgccatgttgcccaggttggtcttgaactcctgagcccaggcctgtgctgggattacaggtgtgagctaccatgcctggcctctaatcttatctatgtagtctgcccaacccttaacacatggctagattgtgcctgtttgtgaactttctagacagcacctatctcctgttgcatttgtctgtattgggcaagtagattaaatatttccccattttcttattttttagcactatgaagtttaacattttactatattatcacagaatatagctctttagaaaacatttgtcttattcactgattgttatatgtgtattgcttgtctctttaaggaggatccaagtttttaatgagtagagaaaatagatgtgttattgcttctttgcagaagttgctaatgaaatgaaatgtatttttccttattataggttgttctgtcttcctgaatatttcattatactgactacaacaacacatgatagtatttctatcattagagatacaaggaaaacatttaaatattaagcagtcaggtgttctttcagtggtagcttagtggtcagaggactaatacagagacaactaagtgtggtagagagtgtgaaccatgtcatcaggctgcctgggttcctgtcccagctccactcactggttaggttacttagcctctctgcctgtcttctcagctgtaaaagagtggtaataatagtgcctatgccatagtgttgttgaaaattaaacaagaccatgaaggtaaagtacttagaagtgcctggtacatattattgtcttacaggtttgatctcttacaaatattgagtgatggaaaagcagaagttaatttttttaacatcgttttgaaatattcttatttttagaggggaaaaaagccctcaattttggaggttggattttgacatgccattaattacttttctcttttaggtttacaggtacatacattacaccc

SEQ ID NO: 56685 - DNA, 1039 bp, Homo sapiens
ctttgaccttgttggggaacataagccacaattaaggtatcctataatttgagtcttctttatgtcctttttgttggactatgtggagctagtctacatttatgacttttcatgtaaactaaaatccggaactattagaaccaagtatagcataacacggtgcaaacttccttttggcttagtgtcaaaggaaagatatttatctgtagcttaaacagtaagggtggagaaggagactttatgttgacattatatccttttcacttagccagaaactaccgtgtgtctgcaaattcataacaaaatgaagtttctgcagtaagttatcaaagcgaagagaagccattgtgaagatcatggcattgtatttcaggtagtaggaagatcctggtaattgtatcagggacagtttttacttccccacacccccacctcctcagaatgggggaatgaaagcattgtccagtaattgcaaagtatctggtggttattcagatgataatggacatttttacaactggagtggaaaattatttatttctgaaggtcgaatataagtgaccactgtactccttgttgaagagagatcttgctttatttcttgaagttttctgggcagttgtagaaaatggaatgtaaaggagcaactagaaaatctttattttacaaagctgagatcttgaaagagaagtaattataagctttgagaatgctgtattagtaaagatacactgggaaaacctgtttgcttgataaaaattcccattctttattaaaacaaatgcatgcttatttgaacacagatctaccaattttatattacaatatctaattagtattcagtcttagctttttttgcctatgagacattttcctattaatcataatggtgcttctctaccatatagcactatagtaaagtaagtggattatttagaagaaatgcattcttaacattatctcctctacattttttgaaatctagggtactgatgtttttaatagatttgttttattttaaaagtaatacagccgggca

SEQ ID NO: 56686 - DNA, 1044 bp, Homo sapiens
cagcccagagccattgataaattatcacatcactggttttcagaattatttttttgaagtatagaatcacttatttcaaacaaaattgagtatacaaaacagataaatatgggtgggttttctaattaaagttggagtgggaggctagtgacctgcctgctctaaacccctttacctcctactcaggtccctgaaacacaaggaaaatgccaaaattaaagaaatgcttttttcaaatgaaatatcgggcaatagaaaatgagagacaaaatgcctaacttaggtcttttgtcttgtgaatcccagagaaatttcattttatttattatgaaagtaattgaggtggttaaggataaattaaataaaaagtacaagatacatgggggatgttgactcctgatgtaattattcccactccaatgtgatttactctgtgctagatatatgtatatgatggaatttctagcccaaggtttagttaggtgataaataggaaggaaataatatacctcatttccagttggaaagtgcctgtcaaggtatataaagatggatagttgattgtctaaagttaaagattcttcttggctttataccttttagtgtaagcaaagttgtaaatgtcatctttgacaatggcaaatctccaaagaaacatttaattcaatttcctcctctactgtttttctctggtggacaggtggtagagaaaacgaaccctacagaaccagttggagtggtttgccgagtggatggagtttaccaggtggtagaatatagtgagatttccctggcaacagctcaaaaacgaagctcagacggacgactgctgttcaatgcggggaacattgccaaccatttcttcactgtaccatttctgagagatgttgtcaagtatgggcaagatgggggccttttaaaattatatttattgttaatcagaaactaagacacttgagagggatgcagacaccccaagtccatatcccacagaattcatctttcctgaggatcacttatcaaatggacatttatctcatgttg

SEQ ID NO: 56687 - DNA, 1038 bp, Homo sapiens
tttctcattttgcattgaaaaagaaaatttcagctttctttagtccaagggtgagcaatattttattcatcattcagattggaataggaaagcctattgttgagaccaaagccttagctatgttaaagggttagaagctgtgtatgcagtttcataataaagaggtctttatatggtttcgctctaggaagtttgtggtatatgaagtattgcgagaagatgagttttccccactaaagaatgctgatagtcagaatgggaaagacaaccctactactgcaaggcatgctttgatgtcccttcatcattgctgggtcctcaatgcagggggccatttcatagatgaaaatggctctcgccttccagcaattccccggtaagtcagtatcttttctcttttgtatgaatcctttcttggacttttcctcttggacttctctctctctctctctctctgtattcctagatcttttttaaaaagcaaagttttgatgtgtgaacagttcctgatgtgaaataacagtagctttgcctattataaagagaatgattgttttactttcttgtgaagaggagtctttcagatctctctttttttaatttttattttttggaaacattgccaccatgacagcaaaaagacttctactaaataatgatcagaagatttttttttttttggtgtgccatatggttaaagcccatcagtaacacactataccacagggcaagtccttcagccacagaggattgtttgttgttgcccatatatctgtggcctcaccactattttttttttttttttttgagacagagtcttgctttgtcaccaggttggagtgcagtggcacagtctcagctcactgcagcctccacctcccgtgttcaaatcgattctcctacctcagcctcccaagtagcagggactatacaggcacatgccaccacacccagctaatttttatatttttagtagagatgggctttcactatgttgaccagagtgctctcgatctcctgaccttgtgatccacccgc

SEQ ID NO: 56688 - DNA, 1047 bp, Homo sapiens
gaattgcttgaaactgggaggtgggggttgcagtgagcataggggtgagactactccgtctcaaaaaaaaaaagttaactctgtgagagatgattataggaaaaatgtttatcttattaactgtagaaatgatcagagtaattttctttttatatttttgttttatgcttttacaagtcagtcattaagtctactctaaaatgtctattaaatagattttgacttttatattctgcatctcaaccttttttggcatttgtgctttaaatcatcattatagcaagtccagcactgcatgacaagtgcaaattttctaattgtgtttcatttcaatcctctttttagggattagaaagttatgtggcagataaagaattccatgcacctctaatcatcgatgagaatggagttcatgagctggtgaaaaatggtatttgaaccagataccaagttttgtttgccacgataggaatagcttttatttttgatagaccaactgtgaacctacaagacgtcttggacaactgaagtttaaatatccacagggttttattttgcttgttgaactcttagagctattgcaaacttcccaagatccagatgactgaatttcagatagcatttttatgattcccaactcattgaaggtcttatttatataattttttccaagccaaggagaccattggccatccaggaaatttcgtacagctgaaatataggcaggatgttcaacatcagtttacttgcagctggaagcatttgtttttgaagttgtacatagtaataatatgtcattgtacatgttgaaaggtttctatggtactaaaagtttgttttattttatcaaacattaagcttttttaagaaaataattgggcagtgaaataaatgtatcttcttgtctctggagtgtcatttgtacttgaagaaattatttcattgagaaaatatgaaacttgggagaaactttaagataatgcataaaaacaaattgatgcttcagtgaggttgcagagtcatagaacttctttcagtgaatatcta

SEQ ID NO: 56689 - DNA, 1058 bp, Homo sapiens
tctgtcataattttgttttgctgtatttatttatttactcctcagtaagtagttattggatgcctagtctctgctggacactgttctatgttttatgatgaacaaaccccatgaagttacaagcatttataagcattcattgctttaggttctagggagtataatatgaatttgactgtgtgaaacttgatttagaaaattggtatccacattgggttaataaaatttagtttttaaagtttactgaactgtaatttaaaaataatacagaaatagttattaaatggtgattttcagtggagcaggtgttatgccataaataggaccccaaattttatattttttataatttttaaaaattatagagcaactttagctttacagaaaaactgagaacaaaatgcagagttctcatgaattccttctaccctttgcacaatttctctattattacaaccttgtattagtattatgttttatttgctatcagttactcaatgtgtatttattaaacataacaaaataataaataaatttattatttatgccctatttgttattatgaaaagaatacatcatattgctgcctctcaagctgtttataatgttatgtagctacagtttgaggtttctcatttattagaaaaattttttttctgtgcacttagtgcatgccttattcagtgctagggcttaacacattatctggacatagtagacatttaataaaatatctgctgagtatacagacaaatgaaatgaaggatccagaagtaaaagacgcaattcttgtccttaggaacttaggaaacaacagacacacatagcagtgactggagaaaatttcagaaatacataaaatatgattaaatctctgataaaggagacattggtataggcaaatgaggcataaagccattaacaagagccccatcctctttttcctcctttttgggactgtacttttttttaattttttttatttgtttgagacggagtctcactctgtcacccaggctggagtgcaatggtgcgatcttggctcactgcaccctctg

SEQ ID NO: 56690 - DNA, 1025 bp, Homo sapiens
ggaaagatgtgggtcattatccttggagctgacctaggcagtgaggacccagagtgatctggcgaacacagactgtgctgggcatgtggagtggaggggaggtaggaaacggctgtctacttggggcagaggattgggttgaggagtggtggaagataatactggaaaagaggacacttgccagaatgtggaaagccctgactgttggctgggctaagacatctggacagtctggacaccattttagggattcagcacgtgcgttttacgtgctctagcagggaaggatgactttactgttagagatgctcatttctgatgtccctctcgctgagtgtgagtgcagtcctgaataagattaaaggtgtcataactataaaccatttggaaaatgtaaaaatatatatgcatgagacacttggagcaaggattttctaaggtctcaatttcttgtttttgctttgattgttatagcttataagagtagatttaagggttagccacaaactctattactgtcagagcagatttgggctgctaggtagaatcttattttcactgtttcaattctcatttctttgtaattttttgtattatactacatattttagccccaaattgtgggctgcaggaacaacgttaagtatttcttgctggctgtgttcactgaattgcttcctgagcctgaacttgctcaaacttcctgttttttgggcacagaactcctggtttctccatttatgatggatgagaggggtttggagtctctcttctagactttcatagcatgtttcaggatttctcactgatatctaattgtcttataagagacattaaatttttttcacactcaaaaatccatgatcccctctaggtaaggtctgagtctctgtcaaacattttcgcttttgtgtaacatttagcacagtatttatcaggcattattttgtttgggggtagaggaggtaggcggcggtgggcagttgggaccccccgtacttatgttctgctccaatattgtcttg

SEQ ID NO: 56691 - DNA, 1041 bp, Homo sapiens
taaggccagtagtagggtgaggcagtgaagcactcccctggagtacaaactttaaggggatgccaaaaactcagctatcaagataaataaaattttaattcaatattgaaaaaaatcaagttggcaaatgacagcctgtgggccagcagcctgtttgtaaatacaattttattggaaagccactggaagtaaaggtactgtggcaggggagatccaggctaattctttgatgtgaaaaccctggttaggcttgtgaatgttagacacattagaccttagcttgtgattgatgggaaaaatatttctgaagaaaaggaataatggatctgactgcttttatgggtttcctggggttactgtaacaagtgatcacaaactgggtggcttaggacaacagatattgattgtctcacagttctggaggctagaagtccaagatcaaggtgtcagcagggccatattccctctgaaggttctagagaagcatctttctttgacatctaatttttgatggctcttgcaatcactccaatctctgccttgatgtttacatactcttcattgtgtatgtctctctgtctttgtgtccgtctctctgtctttgtgtccacatctttttctcctttcccttagatcctagtcattgggtgacatcccaatccagataacctcattttaacttggtaacatctgcaaagaccctagtttcaaataagattacattcctaagattacctatgaatataaccttaactctttggttccttatttggaaatagggtctttcttggacacgattcaacccaccacactgttaaagatatctttctaggacacaattcaacccaccatgctattaaataggtagggatgtggagagatttgacttaggcgcagcagaaacattatccattcacagaaatctggcagcggagtcaggggcagactcctgacatgatttaaatacctaagaaaatatttaaggaaaagtactttagttcctttggggcgcaaatattataacctttgctcatgtcacat

SEQ ID NO: 56692 - DNA, 1034 bp, Homo sapiens
tcccctcatgatgttctgcgggaaaattgtgcacacttttgttgtgtgacttaggttctttaactcaggctggttgacatggagcttggttccagtgatcagtgctggctttagatatgatttgcgcatctctgcaggctagtgtcacgctgcactgtggatctggactgtggctcgggtgccagttgcaacatagtcttcaaggatagccaatggcgagacaacagcactctgtcatgcagctgaagttatggaaacacatgatgtcacatgaatgtctattgtgtgaggtgatggttaatacctgtgtttccaagaaagtgccaggtactggctagtcctcaccacaaccctatatgtggtaagggcagttattaagcttattttataactgaagaagcattagcaccaacagagaagataacttgcccaaggtcatacatgaaaaccaatggagaaattaaggtttcaacctaggcagttaaggcctaaagtctgtgctcgtgaccaccaagctatctcaccggtcccctgtcaggctttttaggggataaagtacagagtaaagtagaactttcctcaaagactgtcttattggtctcacttattttttttttttgttagtctttgggtttactttaaattgatgggctgctggaaaaaatgtaaattgtcatttaaaaagaaggcatcaaggttttgtcttaggttaatttttcaaagggcttaccaagaacacagaagacagaatgccagctgggtgccgtggctcacgcctgtaatcccagcactttgggaggccaaggcaggcagatcacttgaggccaggagtttgagaccagcctggccaacatggtgaaaccccatctctacttaaaaaaaaaaaaaaaaaaaaaaaaatagccaggtgtggtggtgcatgcctgtaaccctagctgcttgggaggctgagttgggaggatcccttgaacctgggaggcagagattgcagtaagctgagatcatgacactgcactatagcctgggtgacaagg

SEQ ID NO: 56693 - DNA, 1075 bp, Homo sapiens
gataatggaaataaatgggctttggaaaattacatgcaaatatcaaagactgtgatttgttacttttggaagaaaagaaaatgaaaataaacactatgaaacaacagtttctatcaagcagatgatgcaggaggaagaaagagaaaaaaactccattagtgatcattaaggtcccttgtggtccccaagaccgactcaagttgcttttggggaatggggcttctaacagtcctgaactctggccaccctaactctaaagggatgcaggaccctgtgctcaagccaagcatatccatttatatatatatatatatatattttttttttttttttttttccttgggagaatagtgtgattgttgacttagctcttggtcctggcctgtgggtctctgaagagtatggatgtggcaagataaccctcacagaatttttcagtggtttggacacatacacagtaaagtagaagttaagacactaaaatcagtgaggtttttttatgagcctaagtgggaggtgatgagttgttaaaaaaatttatgcaactttttttttcttcctgcttcagaggtttttatgactttggtctttgtctctggtgtagtgataatctgttgtgtcgtcatgaccagcacctattacagtgcttggcttatataggcaatcaacaaatgtttgatgaataagaagagggagggggaaaaaggaagtcaaggaaactcccaggcttttctgtatttatttatttatttttatttatatttatttatttatttttaaatggagtttcactcttattacccaggctggagtgcaatggcgcaatctcggctcactgcaacctccgcctcccaggttctagagattttcctgcctcagcctctcgagtagctgggattacaggcatgcaccaccacgcctggctaattttgtatttttagtagggacgaggtttctccatgttggtcaggctggtctcgaactcccgacctcaggtgatccacccaccttggcctcccaaagtgctgggattacggcgtaagccaccatgcctggcttttttttttttttttgc

SEQ ID NO: 56694 - DNA, 1031 bp, Homo sapiens
ccatgtgtgtgttttcctggaagctgcatataggacactcattgacggggagcccgtggtctggagctagtagtgagatggtaaacattatggaacaagcagccctttcaggctctcagccttggcaggatagtatgaaaaataattcttgggaagctggggactggtggcagctgcttctcctcagcctgcctgccaggccctaccagagcttggagggctggagctccctgctgggcctgccacagcctgtgctggtagttttccactctgggaaactggaaaagtgaattggcttctctgtccgggagattggtgggtagcggaagcatcagaaaaccgctaagacaactcagcaggaaaaaccaggagacacttctttgctgcagggtctcttgcttcccttgccattcccagctttttcatgcttctttacagttcatgatagaacaaagacagactggtgggatttgatgaacgaggaagtggaactgggggaaagcaaggagacctgacatttagggcttgggccaacttggcagttctgagtcttgactattggctgagatcccttccacagaaggagtttacccaaaataggcacattcaatgggaaaaccacactggtacagctcagaagtgccacgttggttgccctgggcttttcctggttccaaagattcagtaggatgagaaaggtcatccaagatcatcttgtccattttcctgtgccttttctctaaggcccttgggcatactgagtcactgagaaactttgcctattttcttaatgtgactattgctgatttactaagttcttatctctgaattgtctatcctcatccttatattactttgtcacaatttctagacctccatcctaactttcgttgtctggagattgtgtgcaatacttgtagccctctctgccttttcatctacttatttatttgccaaacgtgtgttaagcatctcatgggtgctgtgtgttggcaggtactgagggggaaaaggaagaatctgacatgatt

SEQ ID NO: 56695 - DNA, 1050 bp, Homo sapiens
attattttaggaaattgccttacgttttacatgatccagtgactaatgaatcgaagttcaagcatttgtaataaaagacattttatattgggctatgctgtaatataatattgttattgattcattcattcacttagtgttccaagcaatgtgtatttctaaggcaggagagtggcacattagctgggtactttaccattgttttaaatcttatcaattatttgaatcatagatatgttacacatatcttcttattggtcttttgatcattttgcctgagttgtaagagttagtttatctccaggaaatgcccagcaagagtactgagacatcttcaggagaaatgatgatgctgagactagatgacttttgtctaggttcatctctgtgaagtggagggaatggaaaaattcaaagacaaagattttgccctagatgtcagtgccaaccagcctgtcctggtggctgtgaaaatgctccgagcagatgccaacaagaatgccaggtctgtggtctacattttgaattttcctttaggtatttcatctttaggaccaggaatactcctggatacttctgagcaattttttcttttgagatgggaaggtcagtgagctgcctcccatttccactgttatcctttttcttattccgatggggtcggcagtcctcatctttttctccacctctctcaaacacaaaggtacattttccattgtacttgccacatatttacttcctaaccccctgtgcacaagcactgtacttgttcccaacatatacaactgtctaaatgtgtacttctttggtctttatacacagacatactcctgcatgtcattacctcctcttgacaaagtcttcagaatcacacatgactttcttgctaagcctcttccagtctccttttttcacatttctatttattttctcatcccttttttctcttttatgctccttttcttctatttgagcaaccctcaaaatgagaagctacctctatttggaaaattatctatgaacctcaaagcaaaaggatccacagttctc

SEQ ID NO: 56696 - DNA, 1239 bp, Homo sapiens
gcctcactaacaaaatcttgctactttatgacccaagggtgtctgtcaccatgtactcaaacaattattagtcttggtcaaatgaatacttcttttgacatgattaccaccacagcctttaaagagctctgttttcgacaggctactaaatacatgttgcaactgactgatggttcgtactgcattaagaaaagtcagtatgagaaaataaagagtaatcagataagccaaagatggttgttcacatcatacaaagtttcttcactagtaatagagtgactccatggctttaaaaaaaaaaaggtaaatatcctcgtgcacttaagatatgattttcagtgaaacattttactctgtagagtggtttttagcagcctatttttgattcagcaaatattaatcactttctgtgtggcagggattttgttagatgtgagggatagaaatgtgaataagtcatggatcttgttctcaaaaacattacaattgaataagggcccatgatatttcaggaggaatagaatgagacagatccaggtgtcaatttctctgtcctctcaaaagttatccaaagggaaacaagatttggcataatgtccaggaataggccttggtgtgcattcttctctctcttgattctgactctggcaacttctgagtttatctatgtctgtatcctcccaaggaatgattttcttaaggagataaagatcatgtctcggctcaaggacccaaacatcatccatctattagctgtgtgtatcactgatgaccctctctgtatgatcactgaatacatggagaatggagatctcaatcagtttctttcccgccacgagccccctaattcttcctccagcgatgtacgcactgtcaggtaaacaagccaggtcttccttctcctccctgtggtcatgagagtaacctgggatctgaaaatagggagcagtgagccttaaagtgtatcaatgttctgggatggtgggggaagtcagtgtgcagggaataatggagcagctgccctttggggaaacgcaagggattcatcaagagtagagaaagaatgttgagctttcaaccctagtttgttgataccattttagaatgtgtacctttcacatcttcctgtttccataggctaccttctgtcttcttgtctatttcctcagttacaccaatctgaagtttatggctacccaaattgcctctggcatgaagtacctttcctctcttaatttt

SEQ ID NO: 56697 - DNA, 1068 bp, Homo sapiens
tggtcacccctaggagcagtggaccaccaggttgcctaaagagggatgagccagcccaggtcagaaacagaggaggtcaaaactcccgtgttgatcagtaatgagatcaaacgtgtgactggccattgcactccaggctgggcaacataatgagaccccatttctcaaaggaaaaaatatttaataataaataatatcatccacttcacagtgtggttgtctgtattgagtagaaaatgtgagtagtcaatgcatgctatttacacctgaatctcattgctgtcacttgttaaagtctatctttcaacactgtgattatcactgaactggtaaatgagagtcctggattcactgcaggcacttaaactagattcctctatctctaacataaaaaccattgacttcccattcagattttgcctttctcaggagcattttcccaaggctaccctagagttgaaaggttgacctaacactcagttgcagagtcaaatagcttatggctgcgtttttttcagctcttggatctcatccccagagaaacagaaccaagctgagatcatgagaatgaaagaatgggctgtttctaaatactccatgcacatcttggcattttcagaattccttgcctgtggtgggggaaggggtatagctgcagattatgaaatttaacagggtgttgttgtgcacaggttattctgatttcccattcttttctttacttaaatagggcaagttcactacagcaagtgatgtgtgggcctttggggttactttgtgggagactttcaccttttgtcaagaacagccctattcccagctgtcagatgaacaggttattgagaatactggagagttcttccgagaccaagggaggcaggtaagaactgttggggatgaatggatgtggacctgtgtaccttgaaggatggagaatggcaagtcctgccttagcaggagtgggccgagatggaagacagactatccaggtgttagtctttgtcactaactatccagatgatgtgaaagaccagtatcctccccaggcatccatacactttgctttat

SEQ ID NO: 56698 - DNA, 1007 bp, Homo sapiens
ctactgctgagtatacacactcttgcctctgagatggcgtgaccagcagaaaagaaagctcagggctgtggcttcagaattcatggaaacagagccactgtcaagaaggaatctgctcagagcagattctgagttttcacactccacaaatcctcagatttagtgggaagctggaaaaaggaactcttaattccaattgaggagaaacaagaaaacattacaaatcagtttcccaagctgagaaggattagccttgaccccttgggtctgcctctgttgccctcaccagtttaccttctacaacagtttctcaggaacatgtgtatttccccattcagctttcagcattgctccacgccacagcataagcatagatcccaagtccacaggctccattttgcaggtcatcttctgatcctagcaaatgtcctttccccatagttgtcctatgcctttgggctttagtctatcccaggactaactgtggagaaatcattggtttgagagtcaagagagcattggtttgggagctttaatcctctttctgcttcacactaagtgtgtcatcttggctaaatcacttggtctttctgcattttgttttcttatttataggatgaggaaattagattaaatggttttgaggtcctttcttgttctgatatgtccagtactcactggaaaattggatctataactgatgggtttagtaatctggtcatttcttgctctgaaaattgtagtcagcaaaagagatcatggaagaaatcactgtaatggtagtaatagtaacacatgccatttgtattgtgccttaggtttaccaggtgtttccaaatacattagcatatttgatatgtgcaggactagataccttgggacctgccacactccactttcaagatatgtattagcttcattagaattaaagggacttgaactcaggacctgcagcctattcttctttatccacatgtctctggtagggctacatccagatcacacca

SEQ ID NO: 56699 - DNA, 1049 bp, Homo sapiens
aatatgtattatcatgtaatacatatctgtgtccttttctgggatgaggaaggcttcaacttctggcactgagaactttgtattacagacacaggtttagtttctagcttagtcatgcctttagagtttagtagcacaaatccatgcaacccaacagaatacatggtgagggcctagtatgtagaatttgaaagtagttcaaatttgaattagaagaatgaagctaggacttatttggaaaaggagatagaaaaaaaatgatcagaaactgtggggccttattacctttgcagtaagttatcttcttcatgatatatgtgaattattttatgtgcagattgtgttttgggattgtcagatctaaacttatattcttgctggctaatgtgctgatagccaggtctgaaacttgatgtgctatccagacacatatgatcagaaaagatctagagtgcaaagaggtgcctgaggagcaaaatgtggttttaatgttgtggaaagatcacttgcaagtatataagactgtataaagaagaggactgtgtgcaagtggggtgaaaaaaaaggatacgtgaatgtgcatatgactgaatagggaggaaggtcagggctagaaaggaggctacataaaaaggggcaatggagaatgcacaggaaagacacaggggaaggtcaagtcgagcaaggtagaaacaggagtagctagagccattgggaatccattttgaaacaagaaggagttttgaaagggaataggaaagtaagtgtcttgaagtaaaagataaatatggatggagaaagaagaaattctggatgatagagatgataaaaatatttattaagaaatgaagtcaggttcagtgtatgaaatggaaaggaatttttcagaattttaagaaaggggaagttcctcttggaaaagatatagcaaccatcggggaatgaccttttcatttcagaagtggatgaggaaggtggtgtgagcatcaggtatattctggaccatttcaagtgctggtgagaagaaaggaactctttgcctgaactgg

SEQ ID NO: 56700 - DNA, 1026 bp, Homo sapiens
atttcgccagtttttccacacatattcatttagttgctggatacttttaattcttgctgatttgtaaactggccttgcttggatacaacaggaaagatactatctggataaagttctacagttttagagagactattaacacattaatgtgttcctttgtcatgagcaataccctgcctacactgcttctaaattttctgatttgtttggctgtttggcatctgaaacaatccaagacaaacttagaaagattaggcaacacaaaacacagtaagacctgttcatagcttgttgtctagaaaaccaggtagcaggatattctagatgcttcctgctgcttctacgtgagtaggattagcactggggacaaaataaggagtttagagtaaaccagtatttcagtcaagagttagttggcacttagttaatggcactggaaatagcttgtggagagaatagaatacaatggtatagactcctaatgtttgataaaatactattttcagagtggtagagaggttttatttgcctaaatagccgttattaaatggaataacaaccacattagaccaaattaattgcaaacacagcggcaacctggggagaagttgaaactccagttttgtggattacagttttgagttttatgattgacatttttaagtcccctatttaaggggtcaagattataacaatgtgtgtcttactaagtttctaggtcattgtgagcacttgataaatatttgctgaatgttgtttttttgaatgaacataagatagaaacaaaaacttctcatccagttaactagagtgaatgtagggagaattgttttgcttgtaacatggagagtttattttcaagtgaggaaagagaaaaaaattactcagacttgttcctggtgaagtgcattctctgtttgtatactttttgatggagaaattgatctatagaactgcttaattttttgaggcatttagacagcaatgaaaggtagttctccacaggacaccgaatcaaaaggagag

SEQ ID NO: 56701 - DNA, 1004 bp, Homo sapiens
cgaggagagtgggtttaagagatagagggttgctgcaattccttattgagaggacagagctggaaggaattattgatcagaggttttacttaaagcccacgatgactccacagattctgtttgaagccactaccaaagaaagaattctcaaatgtttactgtagctaaagaaaaactgttgagaaagaaatgctgtaactctaatgtgctataaattcttctgaacttgctgtggctaatatattaatttaaaaagtattttttgtctttcttaggcctccttgattctagtcactctagagatagaatacacaatcttgtcctgatgtttttacttgcaactcacaatcttgtttggtggtttacttgcaggtttcagagattagactgtatatatctaaatgctgggatcatgcctaatccacaactaaatatcaaagcacttttctttggcctcttttcaaggtaattttcgttttatggatgaactgattggaaggaatgtgttcatttttctgcctagttttgatggcatgttaagttggggggatgaaaggtaaggggttgttgaaaaggttgaagacagaaaaaggagatgtcgcaaccatatcatgaaagaaaagcaatcctcttttgtggggagtgctgaaagtcccgttttttatggtattctaagtctccaggacattctaaatggtttagaaggtcattttttggtctgcctggatatgcctattagcaagaacattttgaaattaggcagagttctcagagagtctccaatttccaggaaagttactttgaactgtttcccagctgtatgtcaggtgctctgaccagtaggttggggaaatgcagacaactaatgtttcctgggagattctcgttactcattagtgtagtggctttcaaaaatgttgaaacacaaccaggagaattcttatttataggaatagatcttactttgtgacccaatacacttattcataaataggcattcttac

SEQ ID NO: 56702 - DNA, 1028 bp, Homo sapiens
ttataagcatctaacaaaacccggcacataatcaatgttcaacaagttattattactctggaattctataaattacctctgtacttcctcccttgtcaccctgaacttagtgaagtttccttcacttggttttgctcttcaactcggaccccgaaaacgctctaaacgctggcggaagtcacgcagagatgggctagacgctcaaccccggtctcttccccgaaaccgcggtgctcccacttcctgcagtccgaggttccgactcgacgccagctccgcgagcaatggttccgccctgcgccctgccccttccatgacaactccagtcccacctgcctggcgtctcttgagcccaaccggcatccgtcgcggttggacgtgggcttggcggaatggggcgggacttccagtaggaggcggcaagtttgaaaagtgatgacggttgacgtttgctgatttttgactttgcttgtagctgctccccgaactcgccgtcttcctgtcggcggccggcactgtaggtgagcgcgagaggacggaggaaggaagcctgcagacagacgccttctccatcccaaggcgcgggcaggtgccgggacgctgggcctggcggtgttttcgtcgtgctcagcggtgggaggaggcggaagaaaccagagcctgggaggtgaggggcgggcccgtcgttactttttatttgatgttagtcccagaaacaaccagagctcagttcctactaaactaacgggtgttttctggtgcagcatagaccgaagaagacgagcttgagctgaaattgttcaagttaggcatacatttatgtgtgatttttggaaaggcggtggtaatgtggtttatttggctgcagatgcttgtcagctttttacacatctccgttgccaaacgtttcttaaccaaatccaaaaccatgaatgaaaaggtaaaaatatcacacctaatccaaaattcaaaggaaaagagcagcgcatatatagcactacgcatgcataacgccatcattgttcctt

SEQ ID NO: 56703 - DNA, 3106 bp, Homo sapiens
ttgtaacaagtattataacaggggtaaatgcaaggctctaggacaaggtttcttttcttttctttcttttttttttttttttttgacacagggtctctgtcacccaggctggagtgcagtggtgcgatctcagttcattgcaacttctgcttcccaggctcaagtgatcctcccacctcagcctcccaagtggctgggactacaggcataggccaccatgcctggctaatttttatgtgttttgtagagatagggtttcatcatgttgcccaggctggtcttaaactcctgggctcaagcgatccacatgctttggcctcccaaagtgctgagattacaggtacagggttttttaacatcagcatttattgaccttttgaactggataattctttgctgttgggggccaccctatacatcgtaagatgtttggcagcatccctggtctttatccactagattctagttgcacccacactcctgtgctgacaatcaaaaatgtcttcagccattgccagatgtgcccttggtgataaagttagagaactactacgctagggggacacaggtaggaataactcactacgtgaagacattaggagaaatggttttttgttttcttaaaattctcactctggtgataggatttcctatcaattatatcatctattcttactcagttttttttctctcttctatttgcatctacaaccttattagccatctcactatatatgtaatgaataggatgtcaaaactgaatacaattttttatgccctatattactgttgtttatatatagcttctgctgatgatgttgcctatatgccttgctttgagaattaattattaggattggtcttgttaagctccgtggccctcaaatgtaaaagagaagcacgtggtttctcatctatctattcaaccaaagtcctccttcccaaatgtgttgttctcttcctacaaaagagaacgacactagaaaattagcagaaaataactgtgtcaccttagaataaaagtaattttaggatacatatataaatacttgtatttatcttactaagatatttgatgatagttaacactactatgaatagttcaactttggctcattttgtcattatgtttattagtttccagataatgagaactactgatcatgtggtatttctcattgttttttcttccttcagattaacaggaaacttccaagatggaaactttgtctttccccagatataatgtagctgagattgtgattcatattcgcaataagatcttaacaggagctgatggtaaaaacctcaccaagaatgatctttatccaaatccaaaggtaaaaggtggttacgtttgcatgtggataatggtatttagggaaaaagtaagctactaggtctattgtgtggcaagaaagggatatggcctcctatttgatggagaccagtcattttcattgagagagaatctctcacctagcataatttaaaaataacactaagtttatatgtgtggtgacttctacattcccattaggattcaattctttaatatagtcgttttcttaaaaaaaaaaaagcttctaaaccatattaaagtatattaaattttttattattattattggaatggtggtctgagagtatcatttattgatagggcttcaaggaacttattccaagtggttttcaaccacaaaaaatgcttagaaataatcctctttggaagcctacagattaattttcatgcattatgccccagggggaattgacttgttttgacaggtattgttttttatatctttagttattaaatacaaaatgaactatttatgtgtcacagaaaatcccaaagtctccttccagtttcttgtgttggacttgaagtgataacgtagtaaaacctggtgtaatggtgtagaactcaaactttctgatgtcactaccctctttgattctcgaaaatggaagaaataccttagaataactgatgtcttcaaactgagtaaattcagctttcttaaaagattaccacgttttccctatatttcccgtcttaatgctcacccaataaacttgtattaatatatggatcagaacagattcacaggtcagcatttaggaactgctgttttagaagatccggtttttaaaattctatataaccctattacatttatacctcctgatcaagtgttcccttaaacttcaaatctaaggaaaccttaatatctatggcagcaaacaaggtttcctgtgttcacacacacacacacacacacacacacacacacacacacacacattttccatgtgccattatttctgccacatgcctgacagcctgttctgaaagattaactcttcttcttctatttcctaaggtggatgggttgcttggattggatttgggtatacttgctctcattcttaaacagctgatcccattgaccacttatatatgagcaaactaagcatcataaggtgttttaaaatttggaaaaattaaggaatatttcaagggaaatggaataattttgttgcctttttcttctttgctttcatcgattataatattgtatggtaatgatgatagtgacatagctttagagttatgcatcggagtattcaaagttgttttttgctgtagcctgaagtcttgcacatgatctacatgagagccttacaaatagtatatggaattcgactggaacatttttacatggtgagtttaagatgaggcaaaattatggggttttttttgtttgtttgtttgttttgttttgctgcagttctgcttacaatgcatactggcttttaggataggaagttcttgactttatttttaacaaattcaaagacatataaaattagtgtcacttacaatgggatcttatgcacaataatggtttatatccatagatttagtaagatgaaaaccatagtaaaagacttaaatgacacagatcattgatgcaatgcaattgttatagatttataggtttgttttcagagactacaataaacaatagctaagtcttcatattgttctcttttcaggaagaactcccaaattagagtagaagatatgcagtaagattga

SEQ ID NO: 56704 - DNA, 1052 bp, Homo sapiens
tatggttgatgctgtcctgtctacagtgagtgagttctcacaagatctggtcacttaaaagtgtgtggcaccttccccattgtgcttttgctccctctggctatgtgacatgtctgctccccatttgccttctgtcatgactaagcttccagaggcctccccaaaagcaagcaaatgccagcatcatgcttcctgtataacctgcacaactgtgagccaattaaatcccttttctttataaattacccagtctcaggtatttctttatagcaatacaagaatagcctaatacacacaccaaatctcttaacttacagtaacttgatggataaatatcaaagtcgaatttaaggacaattaaagctagaattttacattctaatataacattatgactattcttttaatgataaaagataatttctatatggtaaatagtaattcttacatttgataaaattggtatgatgaatccactatgcaaaatcatacttacatattatttgtagtcatattcccaaatttatagaacactttttaaatggaaggagttttaaaaaaacatcagaaaaacagcttttctgtggctctcaaaaggaaaaaaagaaattcaacaagatattaaaaattcatacttaaaaatgggatatactttttaaaggcaatttccttgaagttgtttttttcctttttttttttttttacatttactgatggaaaggtgaaatggtagatcgaagccagacattaaaactgttttaaattctcacttacttggacatagaatatcagcagtctcaaagtcattcacccggcagataggcaaaaatgagtcccttgaagatgaagtacaaaaagactattgaaaagtattttgcacattaaatgctaagctataggatataaacatcttattttcagaaagagatttctggatatatttcttaaggtcagtggacgaagccagaattctactataatgtataaccctatagcactgaaatctattttttctgtatattaatcatgtagtcatgcaatactaaagtata

SEQ ID NO: 56705 - DNA, 1612 bp, Homo sapiens
aactcttaattatataatacatcctttggcttttgttgttgttgttgttagtgtgttagcctgatttgtttaaagccattagcttactgtcctgatttatgtctggaatattgtcttatgtaggtgagcagtaactgcctggactatcttccttcagatcagttgattccatcaaatgtttactcctacaacaaagttttcatttatttgttttgtttttgacttataggttatgtagggaaaagaatcactcaacagttgtgatttcttggccttccttatatatatatattgattttgagcaggatttttaaaatctcttctaatttatagatgtctttgaggttatctgttttagatgagagattttctaacctgcccctggttaaaattgcctttacaggcagacattagaatataacagggtaaaagatgccaccaactaaatcaaaacaagaatgacaaagtggagagaatatttgcagcacatgccacaaagccttaccaactctaataacaaaacccatgtaatattcctaatatacaaatataatatgcagaactacaaagcagtcctgtaaactgacaggaaaaatgataactttaaaaaaatagacaaaggctttaaacagggagtttatataaaaatagctaatatatcagataggcaaaaactaaatttgaaaacgttcttatagaagagacttgaacacgtgtaagtgttgtaaggaaggactagtagcggaagaatggatggtatgggagtaagagttgtgaggcaatgatagccagtgcagaggtagagaaatcagcattaccagaaggcatacaatattcatgttattaggagtgaagttagaaaggataggtatgtgtgtggatggatccatagatttgatagtagaaaactgaaggagctcatgtgatttttattttctgcctgtagtagaggccagatcattcattttaaatgattgccacatgaaagggtgtaattcagaaacataaaagtagacaatttcttcatctcagttatttgaggacaggtatttcattttagcctttcaaaagtgaagagcagtattttaatctattttgctgtgttaagttctgttccagttgaagagcaagaagagttcaagcagctttcagatggaattcaggagctacaacaatcactaaatcaggattttcatcaaaaaacggtatctgttgtgaggcaccttaaactttaaaaaacaaaatttgtttgtagatgtggtgggacatatagtggaggtaacagcacattgctttctctattaccaaagaaacagaatatatttctgtgcccatttgtgccccttataatggatacatacttctctcaaccatctagaaccgtgatggtttttgttggcaaagttttttgttgtcttattgaatagaattttttagggttttcctaggtttaatttcactgcttccaaaccatgcactgtggcaccctggatactgcagtaaaccctcaagaatgcctcaaaatatcttaaattttcaagggaaccactgtagtactcagcatctgtcatatcctttttgaattcaaggtagttcacagtttcagtttttg

SEQ ID NO: 56706 - DNA, 1039 bp, Homo sapiens
attgtactatttaaagaagaaatgtagagaaaatgggagcaggattttcagggatcagtacaaatttagcaggcagaccggagtgggataatgatattctaggaggaccctactggtcaaagaaagatcacttatacttgtctaaacataagatcagaattaccagattgtagggtgcagtagggaactggtgggagatgagactagacaggaagagagttaagagccatgtaatgaaaggctttgaatgtcctgctaaggagcttgatctttggcctatagacaaatgtgagcaattaagtaggtaagtgatgtgttcagaatttaattttaccctcattacagagaacatggacctaatttctttgttctttcccattactagaatggtaaatcaccaagtttattatatctaatatataaaaatgttttctcaacagaatgaactaaaattgtcggtggtttctttgaaagaaatacaagagagtttgaaaacaaaaattgtggattctccagagaagttaaagaattataaagaaaaaatgaaagatacggtccagaagcttaaaaatgccagagtgagttttctttttattttaatgcttttgtatctaaaaaaaaaaattagcaaattcttgtttaattatgtgttaatttttggatttctgaattatctatacttctcttcctcttaaacttttttgaccttatttctaatctgtagcttttctctagagtgaatatggggaaaataaatataatttcaagacatttgttcaattatgcaacaatttttcgaggcttttctctgggagatcaaaacagaaatgctgggtggtgagatttaattactttattacaagggaggaaagtattaagtaattttacaaacaattgtaattataaattacaatatatactataacaaagtataaggtatgcatgtgtgtaggtaggggtatacgagaaatctctgtaccttctgattaattttgctgtgaatgtctaactgcttgaaaaattaaaatctattaatggt

SEQ ID NO: 56707 - DNA, 1154 bp, Homo sapiens
gataactaacattacatttgataaacaatttcttttttgagataagtagggattagaaggtgagattgccccaggtattctttcccaactacatagtcccctcatctgccattgtgttacccaaaaaagatgtgtatctactgctttgaattgtttctagcacctacccttttccctttatttgtactactttagttcagatcctaacccctcaactctagtctcttagctaatcttaacatgtctccctttcagtctgtactgatagaaaacacctctctagttgtcatgtcctttctcagtatctctgatgcctccttgttgtctcttctggttcatctgcatttttctgccggactttcaggttttaaagagttttgtctctttttaaatttgtgtttaattatagttcatcctagaaaatattctttcattttatttctaaatcctaattggttatgttgactttaaatacttcttataaaatacagagcctgaacttggaggaccaaattgagagtgatgagtcagaactgaagaaattgaagactgaagaaaattcgttcaaaagactgatgattgtgaagaaggaaaaacttgccacagcacaattcaaaataaataagaagcatgaagatgttaagcaatacaaacgcacagtaattgagtatggagttgttttcaattttagtgtattagaaagcaattatgaaaaacaaatacatttttcccccaggatttcaaaacctcggtattttccaaaagagtttaaacagctttatctttatttcacctttagttgactaaaacagatgagttaattataaaacttatactgctagttctagatttagagatgtcttagctactcttttcctgggtatacagttccaattcctttgcatcattcttcagaagggttctgatgctactgattatttcattgcactttagagatagtggtctagcttgcatcagaattaactaaatggcctatcttatagtccagcttgtctgtagagttacagcatttgtgttttgagaaaaagtcatatattcaggtaagaagtaatactttcctaagtatgtaagtatgtttttagctggtacgttagggtactttattggtaaaatacccatcagttctaagaatg

SEQ ID NO: 56708 - DNA, 1050 bp, Homo sapiens
tgcgtcagagatcatctgagtatttccttcatacttcctcttgcagatgaaaaagggcagaacttaaggattttatgtttgttgccaaactgccttgtagaaaagttaaactgattcacattcccaccaacagtacctaagtgtgtacaactggggaaatgtaacttaaaaaatcttcattttaaatattgattgattgattgatttactcattcactaacccaccaatgagggaaaaaaaatctcattaatatattgagagaaagagttcacactatgttgtgatgtgattatagtaccacactttggggttttcattcctttgcttttatatcttgagaagagttttaggtttgtcaaatactgacacatggtcactttggaatcaaaactagaattgtgtttgcctttttagttgctgaagaggattaaatattagctgtctcgattttctttcagggattgcaataaagttcaagaaaaaagaggtgctgtctatgaacgagtaaccacaattaatcaagaaatccaaaaaattaaacttggaattcaacaactaaaagatgctgctgaaagggagaaactgaagtcccaggtgaatatgtgttcataagaagttaatttcaaataatctctcatgtatttgagttgttaactgaaacaaaacagcttacttggtctctgtgtaatgagacttttaatgatacctaaaattatttactctttattcttgttttgaatatatttactgtaaagcttcataaatagtcctaagtttaatgagaacaggcatcttgtctcctacatttttatctttaaaaatgctagtacagtgctaaacataaaatgtttacctgtttctattcttttaactgccaatgtctctaacaagtagtatattcctaatatatttattaaatatttattgtctccttatcttttgaagtttgatttatgtcttcaagagtgttctaccagaacaatagttcaaactgctctgccagaaatcacaaaaaattgctatttattatgcaaaatcccttagcctct

SEQ ID NO: 56709 - DNA, 1013 bp, Homo sapiens
tcagttaaaggactcctgtcttttccacataaagttctgccttgttaagagtttttcaccatactttagcacaactgttacttttaattcagaattttacttttttaggttttatttatttcaacctagatttcaaaatgtcaaggttagtttaaatctatcattctgtcttccaccttaactatttctcattgcttagtgtcacctgcagatttgatcagcatgcctttttcttcaaaataaaaatgtttactagaacaaggtcctttgctgcattataattttttcatcctagaggcgtagaactattgatcaaaactttgggtacaattcttcaacttgctaagttgttcttacctaccttgattcaggctacgttgtgatatctatttgttacacaaatgggaaggtctctaaatactttggtaaaatcaaatactttttgtcaaagaactcttcttagcttactttataatcatccttcatgaaaagaaaaaaggatatgattgccaaattgttctttgtgcagttctgttgcattttgtgatcatcatagtcttttttcattaaatgttctttcccatagataatttatctcttctagtttcaattattatcttcatttggatagctttcaaaaatctatgtttcttgttctgtccactcacaacaaaaataatattttaaaattacattcaacattttcccacatctgaccttttcttcactttctttcccttttctttttctctcttttgctcaacttcttcataaatttctttgtatttctcaattgcatcatcattttctatcacaaagcattgaaattttggacttgctttagataattctgacatccagataatctccaagttaatttcatgattgcttttacatggtggtactcttcatacatgtacatagcccttcatacatacagcgctcttattattatacgtctgtcacataattttgtagtagtcatggattgcagcaacatttgctaagtttct

SEQ ID NO: 56710 - DNA, 1082 bp, Homo sapiens
tgcatggaataattattattctgtttcattttctacttaggaaatatttctaaacttgaaaactgctttggagaaataccacgacggtattgaaaaggcagcagaggactcctatgctaagatagatgagaagacagctgaactgaagaggaagatgttcaaaatgtcaacctgattaacaaaattacatgtctttttgtaaatggcttgccatcttttaattttctatttagaaagaaaagttgaagcgaatggaagtatcagaagtaccaaataatgttggcttcatcagtttttatacactctcataagtagttaataagatgaatttaatgtaggcttttattaatttataattaaaataacttgtgcagctattcatgtctctactctgccccttgttgtaaatagtttgagtaaaacaaaactagttacctttgaaatatatatatttttttctgttactatcatggctgttgttttgtttattgacatagagttgtggcattattgagtccggactgtgccctcagcattgtggttgagatctcatttgatccttacttaagcaattctaggtagatatttttattactacatagataaagtaattataaaggtcctaaaagatcagatagctgaagcaaaatttgaactgtactgtctatgatactgaagtctacaatgtttcagtgtaccacagttttcaatgtagttaattgaaagagaaagtttgagtttagtagtcgatttcttcattgatgcaactggcattttttttcaagaaaaatgagttaatatgtataaagtgactaaaacagtgcctggcacatggtaaacactccataactctattagtatttaaggtcatggaagctccaggtactttcctctttgtcagagataataaaatgttattttagggagtgaccaggctttcaatgaaaggcaaagccctggaatggaaggagcagcaaaagctgggtgtgcagggaagaacagatgaggatacacaaattgcgctattgccttgtcccttcctagcttctctttaaatattcatgagttttcattcagagaaa

SEQ ID NO: 56711 - DNA, 1354 bp, Homo sapiens
aactttgatacagtttcagggtgctccagacacccgtggccacttcatgtaaaccactgacaatttctagagcactttgagagactacaatgtgaccgtgatcaaattttgtaattaaacctaatgagggcaacagacacttctcaaataagagatgtgtcaattacggcgctcccctgctctaagtattcacaaggagacgataaacagtttctttattcctccttctcctcatcctcctcctcctcctcttcttcctccttctcttcctcttcctcttccacctttttccgggcaactttagcaggacctttgcaccatcaaactttcctttcgacttatagtcagcaacatccttctcatacttctccttcagctttgcagccttagtgatgtaaggctgcttttcactgtcatttaaattattccacatctcactcaggttttttgccacgtctccaatagagatgccggggtttgtggatttgattttggggtggaattctgaacagaacaggaagaatccagacggtggccttttgggagcattgggatccttcttcttcttgcctcccttagctggtccataatccttcatttcccgatcatagcgcactttatctgcctttgccatttcatcaaatttagatttctgtttcccggacatgtcttccacctctcagagcacttcttggaaaattccacaaaattgacagggacctctgggtttttcttcttatgttcttctctacttgtctgcacaaagaaggcataagcagacatcttgccctttggtttcttggggtcacctttagccatcctgactgtattgttcgctagtctgggcagcagcagggcacgacgcacggctcagcgctccccagcctcgcgctagctgcctccacgagagccgcctcaattgatataaataaatggttaagatggtaaaattttataagtatattttacctcgataaaaatgtttcagcaaatgtattgaagacgtacaacatgatgttttgacatacatatacattgtgaaatgattgccacaatcagactaattaacatatctctctcctcccatagttacttttttatttttgtgatgagaatactgcttcctttctcaattggatggcttttcttttcttacctatttaagatttactgtcctaggaaattttaattttataatacagtattattaactataatctctatgctgtacattagatttctagaacttagtcattctgcatacctgaaactttgttccttttgatcaatatctccccattttccctactccaagtccctggcaaccaccatattattctttgcttctgtgatt

SEQ ID NO: 56712 - DNA, 1079 bp, Homo sapiens
aagtatgagaaggatgttgctgactataagtcgaaaggaaagtttgatggtgcaaaggtcctgctaaagttgcccggaaaaaggtggaagaggaagaggaagagaaggaggaagaagaggaggaggaggaggatgaggagaaggaggaataaagaaactgtttatcgtctccttgtgaatacttagagcaggggagcgccgtaattgacacatctcttatttgagaagtgtctgttgccctcattaggtttaattacaaaatttgatcacggtcacattgtagtctctcaaagtgctctagaaattgtcagtggtttacatgaagtggccacgggtgtctggagcaccctgaaactgtatcaaagttgcacatatttccaaacattttttaaatgaaaaggcactcttcgtgttctcctcactctgtgcactttgccgttggtgtgacaaggcatttaaagatgtttcctgcattttcttttttttattatttgtaaggtggtgttaactatggttattggctagaaattctgagttttcaactgtatatatatctatagtttgtaaaaagaacaaaacaaccaagacaaactcttgatgctccttgctcggcgttgaggctgtggggaagatgccttttggagagactgtagctcagggcgtgcaatgtgaggctggacctgttgaccctgcagggggcatacatttagcttcaggttgtcttgtttctgtatatagtgacatagcattctgctgccatcttagctgtggacaaaggtgggtcagctggcatgagaatattttttttttaagtgtggtagtttttagactgtttttaaacaaactgtagaactcttcattgtcagcaaagcaaagagccactgcatcaatgaaagttcaagaacctcctgtacttaaaaatgatttgcaatgttctgttattttttttgtatgtttagaatgctgaaatgtttttgaagttaaataaacagtattacatttaaaaaaataaataaatatatgcaattatgtgtcaactatacctcagtaaagctgaaataaataaataaataaataaa

SEQ ID NO: 56713 - DNA, 1181 bp, Homo sapiens
atagtttcaagatgtgactgttgaatgaatatgtaattacttgggtcttgaaatgcgtgtaaaattagtacgcagctcctttgttgaatgttatttgtgttgtgcataacattctagacaaagcacctgagaagtgatgttcagacctctaagtcttccaggttgccttgccaaagcttaaccttattgcaaacctgttaattgcattattttagctgtgagacaacttttaaaagatttatggactgtgcattcaaatatcaaaagagttttttccagtttgtcacactttttagtttcttttttctattagcccagagtaggaaacttaagtgtgtgtgtatatatatatttatatatatttttttatcttctctcttttttcttctttgatctctgatgcttatttactttgagtgtttggtttgttgagatttgtttctaaccaagtatgagttcctgctgatcttgtttcatgaaatgtagaatcaaaatataaaagcatatgtgataatatggactaaagagagtctatttttgaagatactttatcagatttttattgaaaggaagcctgtcagggcacttaaatgtacattgtggccaaagtgcttaattctagtttcctaattaaaacctactgaggcagtagattaaagtgggtgggtgtgaatagagatccggttcaggtgagggttaaagagttcgctccttgttcatgttggctcaagtataatgataggaagtaaagtagtcagtcgtattggtcaaagtaacattctaaaagttttgtattttaaattttgtgtcaatacatttaatgtttagagacttaaaaaaatctaaattaaggttttttgtgttgtctctagaataacatatttaaaaaaacaatttacaaataatgtaattgaaagtgataagagtcattgccccctgtgttaagggacacacacacacacacacacacacacacacaagtcttggattaagagggcacccctgggtgaaagtaggggaaaaaaaaggcttacctccctcttagtcttcaacttgtgtgttggaaggattgaagggaaggcaaaaacctctcctggaatgttgagtgttgtgttaaaggtaggagtcaactgtggtctgctgaaaagaaccctttgattctaaagcacgattacttggct

SEQ ID NO: 56714 - DNA, 1870 bp, Homo sapiens
gggtagtttttattctgatacattttcgcttttaaaaaaataaatgctaagaagaagtgccagcaaaatgctcgggtggcaattctcaaagagcagctaaaaaaccctgtcaagacctatagcaatgtatatttcacatgtggcttttatctgctcgctcattctaggaatacagagacaattagagttttggatcatttaatataacactttcttttggatttttaagatccattccttgtcttctggcatattagtaataggctaagttttgcatatgtgtatatatggtggtaatggggttggtgggatagaagaaaaggagaaaaagtcaagcatattacatttctttaaaaaaaccttgaatatatttttaaacatttcctgatgttttttattcctgtgtcaaaatcacgcaagtttaaaaattaggaaaacacgaaaaatattgaatgccatttactaaggagaatatttatagatagcaatgaatagctgcaattgttgtgaatagtttttaattttagaacataatagctatatatggcacttttcagccaattttcctctgtgcattgtctgcatcaaagttaacgcaaatcaaatctttggaggaggttaaaaaaatttattttttgctccttaacacccttttgttctctctctttccttttctctctgtgttcaattaacacccccatcacagaactgtagtgtgtgtgtgtttttttaattctactactttatttcacttttgacaccctcccttattattctcgcctgccacttctttttaatatagcaattacattatgggacttctcctctcctctcccctttaaagcattagagaataatttgtgtgtctatgtatatgtgtgtgtgtatgtttgcatatgtaggtggaggggcggtgggttatggaaggaagctagagattgcgggaagagaattctgatggtattaggccttgagcaaaataggagtaaaataactttaaaccatttagaagcagcctctgatcagattccttttggggttgaagtggtaggagtcatttttgtagaaggtcatcgatagccagcaaatgcaaaaacttttcttgctgatgagaaaattcaagaatttggttcattttttttttttctccctcctggtaaagatgcagaggaaagaaaaggggatcaaatgaaaggaacttacaaatcagttttacctgatgctatctttcaggtacagtgtgttaaggcagaagtaatgtggttagaccctatattatttatttattataatgtggatataagccgtagacctacaacaatataactctgacagacataatataagaagaacttgtaatgagaaatgacttttctttttagtcacttttgtgtattccatttttagtctactactagaattagaacaattctggcttttgagaagtgcaaagagcaatttggtcaaagctgccagaatgagaatttgggaaattttggtgtcatttttttctaacaataggagtgtctgtgaggattggacatgagagcgatttaggttatactgaaggatctggaaggggatttataagcggggaaacatagaaccttgtgaactaagagctgtggggcattgagctgggccgggtgtgggtgggttctgtacagtaggctgcactgttggctgagaagggggcattacctgcctgtgtgtttagttcactgctggtgccagacctattcacatggttttgcccctgcattctgttgacatccatgaactttttgttgtggttgttggcaaaattataaaaatacccccaaacgagcaaataaaccaaaacctagatgttgcacataatttaaattgg

SEQ ID NO: 56715 - DNA, 1022 bp, Homo sapiens
tgtttgatagaagacaacctgaccttttcttgcccttctagtacattccttatttaggaaaaatgttatctttgtcataaggacagccttgattcatagtagatttattcttcattatttttatagctttcttgaaatatatttctaacaccatgaaattcacccatttaaatgatatacagttaggtggcttttagtgtattgacaaagttgtgaacccattatcacaatctaattttagaacatttttatcagcctccttgccccctaaaaaaacccagtactttttaccaatcagtccatatttcccccttcacctagtccctggtaaccactaacctacttgctgtctttgtggtttttgcctattctggacatttcacataaattgaatcataaaatatttgatgttttttgactcatttcttctgtttagcacgttttcgagggtcatccatactgtagcatctatcagtacttcatttttctttatggccaaatactattccgctgtatggatataccacattttgcttattcattattcagttgctacagtaacttaaggaatggacttcagttactgttcacttaggttatttccatttttgactattatgaataatactgctatgaacatttgcttacaggtttttatgtatgaatatatgttttcatttctctggataaggagtggagttgctggctcgtgataactctatgtttagattttgagaaaatgccaaacggttttacagagtggctgcagtaggcacattttttaaaaacagctttattgaggtctatttgatatacaaaaatctgtacattgtatatatatatatatatatatatatatatatatatatatatatgcttttttttttttttttaagatggtgtgtcccaggcaggagtgcagtagtgcgatcttggctcaccacaatctctgcttcccaggttcaagcgattctcctgcctcagcctcctgagtagctgggattacaggcatgggctaccac

SEQ ID NO: 56716 - DNA, 1357 bp, Homo sapiens
tgatgcccaacaaatgctagttgaaggaaggaagggagggagaggggaaggaggaaaggaatcacaaataattcacctaaatctactttggatttacttatatttttagagtgaatatcttaagaaattatttccaaaagccaagtgcagtacggtgcatacctataaatcccagctactagggaggttgaggtgggaggatcacttgagcacaggagttctagtccggcctggacagcatagtcagactcagtctctaggaaggagggagggagagagagagaaagagagagagagagagagagatctaaaagtagtattgtctgcttgaaggatactagtttgttcatcttatgtatgctcttatgtgatgtgtcgagaattagaagacaggatggaaaagcctcttagatctcttagatctattggatcactccagttaagtgctcagagagaaaggtttctggtttggatcagcatgttactgaatggggagaagttcttgaatagctctctgttttctgagttaagattttgtgttttggtgtgtgaagagtaagaggggtatcatggagtagatgggggtgaggtagaatgggaggtgtgcaagagaggacacctgaggaccgtgtgaaggcaagtgataatcagactaggaagctggctggacacaaccttccagtgggagaggcggaggtgagggggcagctgcttctttaactaatcaagggctcaggttccagtaccttccttttatccccatccacagtttggcctgtctcttctcatctgcaaaatctcctcttttctttttccccctcttttaaaagctaaactaattttctgtctgttcatgttgaccttttgtccagttttcctcccatcagatgaaccaaaatactagaaaaggactcttccatctactactactgctagtaataataatagtaataaaataaataaaaccaggaagctaaaaatggaaattaactaattaatttgacatcaatgaaagaggttgtagaactggaggcaagggaaagaatggaatggacatctttctgggcacactcctcactccttccccaaccccttccaatgtgagtatgtgtaatttaaacctcttcctggggaagagtgaaagaagaattttacccacctttttccattcccctcctcccttagtgaaaattcctagtcatggtctgtgatatctcaaacttggctgtcactttttggggtcattccctggggatacccttcccccaatcccagggcagttctaatgtttctgagtaaggagtagtgagaaactcagttttccctgcaaacttccctcctcatcagccccactcag

SEQ ID NO: 56717 - DNA, 1050 bp, Homo sapiens
tcgtagagacggggtttcaccatgttggccaggatggtctggaactcctggcctcaagtgatctgcctgcctcagcttcccaaagtgctgggattacaggcgtcagccaccgctcctggcccccagttaaatatttctggaaaagagttctgttcacaaaaaattttggaatcaagggaaaaccttattaattaagatctttgataatgtggattctaaataatttcgggctaagttgaatgaaaacttaccttttcacccatgaaaaaaggagctctgtaactatattagtagcacaaacgggttcatgtgaatgtttaccctgcttaagagagtaaacttttcagagttagcagcagcatttgcatacaataaatgttctaattactaatgatccttgccaattaattaaaagtatgtctgtcatggcgctgctttcttggcagtgcttttattgatgatgagcttgtgtgcatattaaataatacagtgacatttctttttaatgtttcctaacccaggctttgtatggcagaacattctgttagcagacttgtgcaggttttcctatcctacaagtagagaaatggagagatccatgccctaccctgagcctgagagtaacttggtgatagtgtctgcattctaacccagtgctcctgtatttccttggattcttgtttcttgtgagcctgtaaaggcatttgcaaagttggggccttctgtgaacaggggtgctgtggcactgcagttcattgcagtctagactttccacctcccctgtggcacttttggcaagttgacaggtataattgatgagttattctaagaatgtgattcctgagtaactctagagtggagtgactgtgtttctgagtagttaatgtggctggggggaaaggcagatgaaggggatgggggttgggaagctggagggaggtggggaggagggcctttgttcaaatcaagttgtgttcaagtctgtggttttaagagagagcaacagcgattctttcctagcatatgaaatcttcacagggctcatagttt

SEQ ID NO: 56718 - DNA, 1011 bp, Homo sapiens
cagcttaccgagtagctgggattacaggcacctgccaaatttttgtatttttagtggagacggggtttcgccgtgttggccaggctggtctcgaactcctgacatggtgatcctcctgccttggcctcccaaagtgctgggattacaggcatgagccactgtgcccggccaaaatagagttactttaaatttaagtagaaaatttaaaatttttaattgccacattaagaaaagtttaaaaaaggtgaaattaattttaataaaatattttccagtatattcagaatactatttcaacatgtaatcaacataaaaatgttaatgagatattttataatctcttttgtcctaagtcttcactattttgcatgtattttaccaatttagaccagccacattaagtgctcagtagccacagtggctagtggcaaccttactagacagcacagatctactccaaatatttaattttatagatcaggacactgaggcccagaactgtgattaactaataagtggcagaaatgaaacacgtctccctccagagctcttttcattatactgtcttcactctactgctttgaacgtgaagacaaaagaacccggtttctgttcatacttttatatcctctcttatgcagtctatagcctgggcttggaacttagagccttaacagactttaagacagtaccacgtctgaacctagagttatattgtattctttctattagcagagagctttctgattcctaagaatttccttactctacaagaaatgggatttctgctttgcaaagttcccttcagtggaatgaagttattgttgcccagagcttccctggtacaactctatggacttgggcatgattctccctaaaaatccgtggaagccgtgatcagagcccttggaaaattgctctggtgagccaagtgggcagtggcagtagagcagttttcagtagtggtcccacggtggcaagttggctgtgaagcagttgaggatgacatga

SEQ ID NO: 56719 - DNA, 1729 bp, Homo sapiens
atgatcgttgtatattcactggcttcaagaaaccaccagtgggaaatcttatttatggagatgatggttatggttatgattattgacagccattattataaacatcattattatttagtgttaatcaacaacaggatgaaaggtgctctaaagaacacagaattagaccctgtctttgcaaatgggctcataagaaaagaatgacagaaagagacacccagcctgggctagctaggaaaaatacgttttagggaaatacagctgacaaaatagctccaaaggttgtaatttttagggctttggtggagttcaatatggtactctgaacacagaaaaatggaaagtagaatttctcagtaaaagaaagtctgttgtttcagtccagttttactattagagtgagttgtaaagaacaagtaaaagggaaaaattggatatgtgtttttgttttgttttattgccctgcaggtcccctctttttttttttttcttggtttctcaattttgaactttaatgcattaatacatcaggtatcttttacaactaaagtagcccctgaaatattttctgtgcagaaaggttaccttcaagtgcattagggtctcacattgacatacaaattcaggtttgaatccttgcaaaatcacatggtaaaatcgggcctcatttcctacatggtaaatatgcactctccttgagatggtgcatgagctttctagttcatcatagtccctcccatgcaaacaccttactcattaacttttatatgcctgttccttacaaaggcatttttagtttcaacccatatatttagagcagtggttctaaccatgggtgatttgcccccaggggccatttggcaatatctggggacattactggtttgtcataatgcaagttcatttttatgtcatatttttactgtgtactttttgcattttcaaatgactttgactattgccagagtcattatagacctgcctatgatgtaggagtttattgtatctagtggaaaacatacctgtttgtggggcagaagcttctgttccattcatcctgattttagacacagcatttaacttttcaggttcagttccatatgtataaagtagggataatagtgacatcctagtgtattaagaattaaggtgttattatttctgtcactgttacttcaccctaattttgtttccacactcatctctgagcttttttacttcttatgttgttcagtgttttctaaattaaaaaaaaaaaaagaaattatccaggaggaactccagggtcagagaaatttagttccttggccaaggccacaccacaggtaagtggtacagcgtggatatgagactcagtctcctgaattggatcagttacttgcatgcaccctgtaccctctgtctttatttgggttggaaccctgggggttcagtgatcctgttccaggatctacacttagcttggacttcttgttggttttcttatgcttatttttgttttataaaatgctcaatggtgtaacatttcctttgaggaatcgttattcattaaaaagtctgaaaacagtgctttaaatcatgtctgcttctttttgtacaaccagttacctcacttcttcagccaggatgggtttatgtggcccctcagggccttctaagaagactatcttccctgtcttttgtggaaggaacagagttggttgttgtcccctagaagggtggtcatctc

SEQ ID NO: 56720 - DNA, 3373 bp, Homo sapiens
ttgagcatttaaatgtgtagggtgctgggtttatgtactcaaggttgcttgcggggattatttagctggtttaaataaacaaacttttaaaaggctttataaagtaaacaacatctatttgcataccaattccaatttatactctgctcaaaaataggtctgatggtgcctctttgtggaaacagtttatcagtagttagagtttatgtctcataaagttttaagattttatttttcattaaaattctttgaattcagacacttttggtaattcatgccttccctccagtttccctagattgggtagattttcctggagttgcactctctatttttataataacataagcatattgatgatagtgaataggcaaaaggctgtgggtagtgtaagagcaattcttttcagcttcaagggatttttaaaaattctttcattattcaagagttgtaatttgttgtgtatatttaaaataactctcatctttcagtctctccaataaatgcattctgctatatggccaggtgtggtggctcacgcctgttatcccagtgctttgggaggccaaggcgggtagattgcttgaggccaggagtttgagaccagcctggccaacatgatgaaaccccatctgtattaaaagtacaaaaattagctgggagtggtggtggacgcctgtattcccagctcctcaggaggctgaggcacaagaattgtttgaacctgggaggcggaggttgcagtgagctacgaaaattgtttgaacctgggaggcggaggttgcagtgagctatgagaattgtttgaacctgggaggcgaaggtttcagtgagctgaggtagcgccgctgcactccagcctgaacaacagagtgagactctgtctcaataaaaagcattctgtataaatctatgatatctgagaatccgatgtcgtatttgcttattgtctctctttcctgctggaacataagctccatgatggcagggactttgtcttgttgctgtatccttagcaactagaacagtccctgctgcatggtagagtcttcatatttatttaatgagtgtatgaaacagttcattctttgtgcatggaaacatgatatttgcacattttataagatatattacattaatactaatattaatactgccttacatataacaagtttttttatgagaggaatttcagactcttataaaatcatttatttacagaagatggtataactaactctgacatgaggtactggggaagtatttcaaagtgacgttggaatgggatttctggatattgcaggatgcaagaggttgctgaagagcaagtttgtggcacaccaggctgtgagagcaccgcatgggcaaaggcccagggtcatatgatctgcagggccataacaggagtaagtagattggggtcagattatgccaggcgaggaattttatcttgaaggcagttggggactattgaaaaatcagaggacagtgcaagggaaggggatgagaggtaacaagatcagatttgtactttaaggtaattttggtgtctctgtggaggatggattaaagtgggggtgagattagaaaaaaatgagctagaaggtgagagatggtgtagtaagtgggatgaatgagtttaaaaagctatttttgcgattaaatttaagcaatttgctaatgggaaggtggtttgagggagaaggaagagttgatgttaataccaaggtttctagtttgtaagtgaagaatagcaatgtctcaaaggatatcaagattaccagaggctgaagaaagctactgaggaaggttagaaggagagagttgacgagttagattttgagtagcctgtaggatattcaagtggagctgtccaggaggcagttggaaatatatgactgaagcttcagagagaggtcagggctagagacataaatttggatataatcagtgtgtaaatagcgattgatgccgtgagagggaatgcagtgatccaagagagcctacacagtatagaagcagaccagggccaaaccctgagaaggccaaatatttggcaaggtggttagtggagaggttaagaacaggattatcagagaggcaagagaaaaatctggagggagtagcatcttaaaagccaaggggagtttgagaactataggttcatccgcatcattagatgccacagccttcctctgggctcttatacttctatcttaacatatattatgttaacttcatgtattttctatcaggttttcctatgtctgtgagctctgtgaaagcagggataaaaagtgtttcatctttgtgcataggccagaaatggcaaataggtttcatttcatgttccaagtctgagtattctcagctgagtccagagtctgcagagaagagtgccttcatccattagtgatttctgattagtgatttcaggatcagggactgatggcaacttgccctgtatttctcatgtctgcattaggcacttattcattcattattcaacagatacttactgagtgcccagcatgtgccaagtactgtgccaggtgctcaataaatgtttattgaataaatgttgaatggttaaaggaaggctcgcaacatcctttagaaggaatgggaaaggacctgagtgaggtgagccacctctgagagcccagctgaggccattttcagtgttgtgtgcctcaggtcatcctgccttccacctatgcggagtgtactggttaacacaaagtctctggtaaaagaatgccagattttaatgatttttaacaaaaatactttccacttttgtaagtatttaacttattagtgtgcacttgcatctcacttgatctttgcattaatccagcaagagagataggccatatgttgtcatctctattagacagatgaggaaatagagatatttattactaaaaatttgagtaagaaagcaaacactgagccagaattggaactgaggtctgactcccacttctaactcttgagagtatggctcagaaatgggcatctctagtcacaaaatgtggctgagctgtttgggcaactagcagagctggacaccttgtgattcagaggggctttcccatggaatgcagggggccacaggcagcattttggatggtacaaggttggtaggaggaagagaagaaatgattggctcccagaggcttcatgggctcccaattcatgattctttctctgtggctaatttttgttaagtataagaattccaggaatctcttaggaattgtggagactgctttctcctgaaatataaaacatctgctcttggtctctttggagctccactgtctgaggggaaaacagggaaaaagaggtaatataaaacagacattgt

SEQ ID NO: 56721 - DNA, 1084 bp, Homo sapiens
cacctaagccagtgactggcacgtagtaggcactcagtctttctttagttaaatacaatgaataatttaatgttgggggggatatggtaaaagaagaagaggagagttggaaaactcatgggcatcttcaacagacaggagccccatgactggggggtgtcttagcaaaaggcttcctggcgtcataacagaagtagtcacagaacccccaagaccggaacctgttacaccagagggttggtgcacattcacgatgccctctgtcgaagggccccaccttccatgcctgcgcgtctccttttgttctgtcaggtttagcattgaggcaattggtggccgccgcctcctttgcctcatctgccccaaatccctgcttgccatcagcccaatgcagcaggctctggtgccaaccacaatctccccgggaaagagatttgagggactggaattgtgagagaaatgtaagctctgagcttgacggtggtccatgagcccctccccttctcacctttgaagcaagaaggggctggttccagggctctgtgggaaagctgctttgaagaatggtgaacttgggccacggggcatcattctgctttagttgagggggtccctgttgggttccaaagagaatgcggtggggttaacataaaagcagagtttagcagtgaggaacccattggtctatggcctgctttcttaattgttagtgaattaagccaggaaggcactgggggtggctggggagatcctttgtaagaggttaaggtcttcatagagtgatgataggattagcaataatttggtggaaacaaacaagcagaataccaggagagctacaagcgatcggttctgtactgtgtccctgtgttctctggttcaccaaggaccttaggcctgttgtcctaaatgatcacagggctggcatcacccttgctgtgatgggctggcaggccaatgtgcttggccctcctgccaaaagtatctacgcacattctgccatggatggtacatttgcatgctcccctctccttaaaatctgagctgggagatggggaagaatgaaaggagaaaatcaaattaa

SEQ ID NO: 56722 - DNA, 1267 bp, Homo sapiens
catcaactcccaggatgaccttcctctggtatttctgtggggtgtctgttgttggggaagcagaagcacaaagcagaagaaaccaagcacagttccttgcccagaatcactcgggaggcaaagtacaattccgttcttccttatgttgggaccttcggtgattgggtcctccttgtgtgtggaagtacatgaaagaaggatagacaaaattagagcatgttttcgagaccatttggttcagcctctctgattttacaaatgaggagagtgatgcaaagtgtggttaagtgactataccgaggacacagacctactttatgacagaggcttgggagccagattttaggatgccggtagttctaaagtatctagctgtgctgccgtctgaatttctggttcactccatcaggtcagcccatagacacctcctttttcttaggtcggacctatcttattcgtttcctcttttgttctctgcagctgccacccccactcctacctcccctattctctatgttgacatgtgacttggggcacttgcaacgtccctacctaaaattgatgtttgccacctggctgctgactggtgcgctatgctgcttcactctgcctgtttcaaccctgtgaaatatggaagcagatcataaaaaaatggactcccacacattttgcagatctaaattgggccttaatataatgtacttggttatgacaaacaggttttctagggcatgaccggcagcttaggctggcttccctggtcatgtcagttgaattctttttttctttttttgagttgggagtctcactctgccgcccaggctatagtgcagtggcatgatcttggcttaccacagcctccacctcctgggttcaagcgattctcttgcctcagcctcctgagtagctgggactacaggagcctgtcaccacgcctggctaattttttgtgtttttaatagagtcagggtttcaccatgttgaccaggctggtcttgaactcctgacctcaggtgatctgcccacttcggcctcccaaagtgctgagattacaggtgtgattcactgtgcctggcctcagttgaactctttaagattattcaactctttccttaattcttaggtagtcaggattcttcaaaactttatgtttctctgggagtcaaaggaagtttatggacacaatttctccatatagtagcttatttctgaaaataagaaaaatgagtaagttggacctcatttctttttctaacaatgtgtgggt

SEQ ID NO: 56723 - DNA, 1028 bp, Homo sapiens
ctgatagatataaaagaaagtaataataacattcttttttttagaataattttttttttcttttcaggcaagtaactatttgttcaggtgtaatattcctgattttatactgtggtgattccctatagatgacaactgctcaaactctagccttctaaatgttaggtaccaaattgacctttttgtaatcaatttgtttttatctagctttattaacagccagccgccgcaccgttgattggatcgacgaggtggtgatgtgaaacaatcgctaaacgtggccaaagtaaccagactgacttttgtgtggtttttgttttctggacaaggattctgttagttagaacagcatttaattgtgcccaccacaactaaataaaacccacgagacagttacaaatgaactgtcacaagaggggaggagtgaagtagaaggagccagagggagagcctacaggccttctgtgaatgaccacaaaccctctcgactttgggatttggcctccctgggttggatatgcctggaagggtcgcagaggttaagagccaggagtctggggaggccagggtattgtgtttggttacagaggtgccttccaggtgatcaccatggaaatgcctttcactggggtctccagagatgaaaaattcaggatatgtctatgtgaaatatggtcttgtaaaccatgggatagggatgggaaaagttggcttagtctctctctctctctccacctctggagtggcagctgtgtgactccctgtaaactttcaaatggtggttcttcatgcccggggatgattccgtgtgtcaacaagtctgggcagtctttgatgtagccaccagcgtctaggccaggaggcacactgctgctgcctggtgccctcatgatcattctctgtgccttctgctgccctctcagcccctgggtctccctccccaggtcctccttactcctgctcctgtgacgaggggtgggaagctccgtttactgatctatatattattgtgttggtgggaaacactg

SEQ ID NO: 56724 - DNA, 1052 bp, Homo sapiens
atcagtttaataggcattggttgatttggattgcaaaatataggtgccctgattagccctctatatggacttgcgttgttcttcagccattcaaaagctacctaattatgaatattgaagtataatgttctggcttttaacataaggcacttaccttttaattggccatcagctttgtttttagcgcttatgtacctccactgggattcaaatgaaatggggagataatcaaccagtaagcagagaaaagggtaaaatgatcagggataattaagtggcagcagggaaatttagggttagacaacagggagagaaacaaaagaaggaaactcacaggaaaccagctctctgccacactgccaggcacaccccttttgaaaccacctttgattccctctttagcttacaggtgggacacatatagactttgtggctgacatctatcagcttgagcacaaacttgattcctccctgcgcctaaactcagagccaggcagagggtggggcattggatcttcactgcacaaacttggcagaggaaaaaagaccattaagtgaaggctaattggaatctgccccaaactgcactttgttggagctatttacaatatctttcaagcagctgacttacttactgggttattcagtgaaggggcagtgagtgaggggatcggtggggagtgctcaaggagaggaaaatgacctatacaaggcagtgggtgctttcttacacctttgaaaaattaactcctacaccatcttagtccttggtacaaagcctaagtactcgccttgaccacagggagcagttcacctcccttgggtcatgtgtccctttattttctgaggaaatttatggtctagttccagaaaattagcctagatacacacattttttttttccccatggaatttcaggaagctgaggaactcctgaaagaccatccatggatcttctagttttttcaggttaaaaaaaatcctgtttttagatccagaagtagggctggaagcaatttttatacataattgtggagagtgaagtggagaaa

SEQ ID NO: 56725 - DNA, 1532 bp, Homo sapiens
tggtggctctgcagtcttaggctggcctagttgcccatttcataagccacacaaggctactggactgaaataatcatgaaacaagaggccatccctcttgttgcacagtctatctttttggccataattaagaatcattcacgtccagggtgcacatttagccaatggagtttcttaactcctttgagaaaaggatcaatggacatacctgaacagaaaggtttctgtggttccataatgtaagagttccaagtgcacagaggatgattcctgagtctgcccatcgaataggcatttgggtagattttttttttctacaatttgacttccatcttccttaagaatgagaagttaggaccagaagaaaagctcccatctttcacactaaatacgttctataaaaccaagcaactttgattcttcctccctgtaaatgaaccctggttgcatagcttttgatgtgtcaagtcaggtgtcagacaagctagagggtataggaaatacttccatttaggcaccatctaagtttacccagcctctcttctgcattgacattggctgtaatccttgtaaatgctgagtatactcttctttccgtgtgggcccaggaggcaaggctaggctggaagtgatcactaggtaggagaaggcgtcttgttggaaggagctggtgtaaaacagcgggttgccaggcctctgttcccagcgttgtctcttgtgaagctgttccaaggaagccacatttctctctgggccgcactgttgtgagtgcctaggatgcttccggtggatctgtgtgaaatgtcaagtccacagaggttagcctagaatctctgtgctgaaagactagcaggatttttggactccaaagttctggattgatctttttctatcgtaatgactagatgagtgaggttctcctgattgtttctgaggctgcttgttccctatgccctcagcctgtgaccaaggtatagctcactcggactgagtgcttccttgttcaggatgaattaagcacttgatgtgcacatgctgttaactcatctcccccaactcctttgaattctctacccatcatgtacttggccactttcctgagccaagcacttcattatcttcttgtcctgtgagtcctaatagatatatttagaaacacttctatgaaatatggaatccaggcttaaccagctgtttgaaatcacaacccacaaccactttgctggtgtgtgctcacacacacacacacactgacacatgcttgctatacatacatacacacagtttccatcttttttttttttttttttttgagacagagtcttgctctttcgcccaggctggagtgcacttggctcactgcaacctctgcctcccaggttcaagcaattctcctgcctcagcctcccaagtagctgggactacaggcacgtgccactacacccggctaatttttgtatttttagtagagactgagttttgccgtgttggccaggctgatcttgaactcctgacctcgtgatccacctgcc

SEQ ID NO: 56726 - DNA, 1008 bp, Homo sapiens
ctatagggtggaaaaatctcctttagtcagaattgaacagttttcatgaagaacatgttacaccatgtagaaacatgggtactgcagggcataggtggcactagcttatgggagcctgaattccagaaacttgattttactttttgtttaggattaaaatgccaaaaagagggaggcttgcagtatcacacttcaccaccaggtaaagcttttagaaacatatattcagtgtgaaaatgccccaagtttgcagcttcttgacggataaagacagttacagagacaaagaaagttagtgttttatgaattagtcctctactcttgaagtagtatagcttatcggcaatgaggtacatttgtatttttttctcggctgttcttcctgaggaaatacaccatgttaccattgaggaagttcttcttctctctttccccgtacatttttattgtacgcagaaagacagaagaaggaagccctgaaggaagattgtgtatgaacccaggattctgttattacgtctgatgtttgtttctagttaaaaatgagaagtaatttttgggagggagacagaaatgggaaaagtttataagcgagccagtggaaaaagcacattcattatcagtgtctttctcactgagtcgtttgaaattggaaaattagcagcttctttgaagctcataagatctttcatctttgtgtatgtgagtgtgtgtgtgttaatactaagtggagattctttctcttgccacttatttggtttttctgctaataatgaaattataatgagatccctgatgggatttaaaaaaaaaaaaaaagaaaaaaaacaccttacatgaattatcccattcccccaccctccttctgcctttctgtaaaatctattctgcataataggtctttgtttctggatttgtgacagaattgaaggaggccaggagtcggaactgcccctcattgttctttttggtgactaggatacaaagttctgttcggcacagagtact

SEQ ID NO: 56727 - DNA, 2698 bp, Homo sapiens
agtgaaatcccttgggtttatgagtacctgacttggagaagaattataagaaacaaaatttgggggagaatttaaaatgtcattatttactttacaaaaaagttttaaaaattttactctgaaaggcttcactgcaggtttgctttaaattgctaagttttctagtcctgtagtcatctaatgagactataaatcagtttacaactgatactttagaagcatattttttgagtaaggtaagggatatagaacatgcagcatgacagtcccctatctcctgctctgggttgcaatggtctctttctccgagtccgaacagtcaccttgacaatccttgatggcagtagggagcatttaatccaactgtgaaataataaattagctgtggagtcaccaccagaacagggaatcctggctttatgcacctggctagtttgcactccctgtgaaaccatcacggttccttctcattgcagctgagctttctgaatcttttaagaactgaattgatgggatgtggaatttgatagccgataaattaaggatattggtaaatgtagcaactctattagaagatagcatttccaagatcagtagcaacatttgcttgcgttgtttgtgagtgtatctgtggaggtcctttatatctgtatctctctctttctctctctatctagatatatatgatatgtggggtgctataaaatttttagtgccttagtttgggttgaccgccttattactcacgagtgagctatacaggtcttccttaacaagtggcaataaaggctttacagcaccccttacaccgtcacatatttttgtttaggccacatattgtctttttctttttaagtctccctttgctcatgtccctctcaagtacctttgttgccatggcaacagttccatcgtttcttagggtagagcaggatgacatctcacgcaagattcttgaagtcagtgcttgtttggactgacctcaaacactcagctggggccagtgctgtggcccttaccctggtcatctgtgacactgttttctcttttttgctcgaggctctgtttattagactgccatgtctgtctctacattaatattggccgtgtctccatggacctgttccaaggaatggaaagaagctgatactcatgatctaaaattgaaaaaaaaaatgttagtgttaagcattttgagttaaatatggagctttgtgagtggttggatgcatagtaaatactgtggcaagatggaaagagtgagggcagctcatcctctgcatgtcaatgttctctttggaattccctcacgggctcagttttgacaggttaccatgtgcatttttcagtcctctctgtgtgtctttaagacccagcagacctaccttctccctgactcatggaatattagtcctaaaagggagtcacagaactgagtccagtgcactgattacattcttagggaaactgagacccaaaggggcatgtgtcttgctaagatcactcatcctttattggtgcagatgggatgaaaacccacatctcccagtcttcagttgggcttcacctttgctacaatttgttagttttttaaaacagaaattatttgaaagattttactgtcaagctaatttcctctcaagccactgcaacatttctgtaaaaagtggctgtagccatagtggagacctcatctggcaaatgtggacaggtggtgaggctgtacctccaaatttcttaattctttttccaacaagaaggttggcttgccaattctttgatcaaaggtaggagtttctgtaatctgttctcttaaccacatttgggatgcttgtatatatgactacatatatttatatattttttatgggcaatattttgactgtttctcttttgaaagacagtgcgaatgagtatgccaaaaatcacagatgatatgagaaatgctatcaataaaagcattttttcagaaaggtgaataaagtaaccccaagataacgtaaaatttttcctaatgttattttgcaaagtcattagaaaacctaatgcttgtgaccaatggggtgatgctcgtgggacagtacgtggctgacgttgtggttttcactgggcaaaataattcagatctacgagtcttttggcatgggcatagacagaaagattgcataatttgttcttggatgacgtgaaaaagaaccctgaatatatttttcgtttctatgcttccaaagtctgagtgggatgttttacatggatgggtaagatgggattttaggagacagataatgctctgttttagatcttcacttggtctttccaacttgtaggggtggtgtggtgatcacctatttgactagtggttatgctgttttcatatttaagctgcctgtagcaattcgtgatttgctatcagtacatctgtcaatctgtaatattacactcaatatcattcttcttttacccaaatatttggtaaaagagaaagctaacatgcactaggttcctaccaagcagataagatgagataatctatgtaaagtacatagtataaccctgaaagggattattagtcccacttgacagatgtggaaaatgagccctagagagattaaataaaatagaaccttctatgactaagtgactaaattcaggtctctgatttcaaagcccatactctttcctctgagttgcattgccc

SEQ ID NO: 56728 - DNA, 1108 bp, Homo sapiens
aagagtacagcaattaatgtgcatatgaaatccgtaagataaatcagctattgtagcacgtgaaggaaattaatacaaattaaggaattggaactgatttgggccatattcgactattttcatattaagaaacattattttagaagatctgtttggctgcagcggagtcaggaactgggcaagcagtgttgtgacttgcttgttccacaggcagagcctgggcagcactcaataacacccctcaccttcataggccatcagccgtagagaggcaaattagagcactggcataagccacaaatcacaggctgttgttagatttagtctgacccttagcatcattttatcggagtcctcttgaatttaatgtgattcccttcacaccaccccctctctggacaaatactaatattgttattgttatcgccatgattacttgtggctgacctaatacccttctgccctgaaaccacaggaccttgccgcagcctaggcattaatagccctcacagcacctcattgacatggctgcactggagttgaagttacaaagcaggaagtatcatttagtgcccctgctaccctcgcccctttcatctttattatgcagtttcttcttatggtgctgcccattttcccaaggaattaaagtcgcagatattttgatttcaggggagggtgagggggaagttgggctctgagtgtagagaagcaagagctggcacacctgtccttaggttcacagcacagcctttctcctgctggacacaggagtaggatgaaaagccaacatcaataaccttgagtatatagtttcataatccatgaataatttcaggaattacagatgtactcttagtgtagaacatgcagaatgcccaccgtggattcaacactgtgcaaactatgtgtttggggttttttctcaattggtggctttatatcaacctccccagcacacttatatctaggcttttataatgattaatacactaggaagaatcagtggtacggacacattggacatgtggtatttatggtctagaggatattattaccaggaactcattggtgctctccacaagtttgatgttggttgagcagtaaa

SEQ ID NO: 56729 - DNA, 1902 bp, Homo sapiens
ataccaatgaggttatcactttggatgatctcactgaattcagactatacttggaacgatgcttggagaattttctaaaatcctatggagagatttagaagaaaatgcatatgcccttgatagtattgacagactgctttccctgataggcagagccgaactctatatagtgcctcctaaaggggtcatttgaaaagttaacatattaaaaagttggaccaaagtaaaactgagagaaaaaatggattaacgtgattcttatgtgggtctagcgtgaaagcagcggggctggtcggacggtggctgaggccgttgactataagccaggggctcctgagttcaagtgcctactgggatgctaacttcctgtgggattttgggcatctgttttttatcgaccaaaggcaggaggtagggtgagggagtcctgttattcagtaggcagctatttgatttgctcaataagttgatgactttggccctgctgctgaggagtgacagattgtgaccaatgaggttaagatgactgtaggacaagtttgccctcagtgaggagaggcctgccaagttccactgacgtttggttggggaccacagaaagaaacatcaccattcaaggtatttggcccttattttgtcctagttcactaaatggcagatcctggggaggagattatttcaccagtggattcttcagaggtatgggggcagacagaacaggctttcttctccaaaagttcaagcttgctgactcaagcttcttactcatctctctggcatgtcactgcactcaggagaagatttgtgcaactatcaggtgcaaactcaagtatcaccaaagggatactttctgattaaatagagccatcgtgctctggggaccatctcaatatcagtggaatattgagggggtctattaatgtttatacgttccttcgaaattcagcctttttctttgaaagctgtaaggcagcagttaagggcactcgtactgctgctatggctgtgtgtgtatgtgatgggaaaggctggttgccaagcagcggagaatggacataatcatgctgcctagcaacagcggcagcgtggtcacttgcgcagatttctgcgcctcttcctgtttggtctgctggaaaatacagatggcttctatgggtcgctctctgccctagccatagtgagaggtaggaaaacattatgaaccagggtggaaaaatacacaagtgcatgttttaaagtgattcgtttccaaactgcctagggctgagcagggattcttacatagcattcctcagtttcccctttgaagatattgtgcactggcacgttgacttgtaagcaggaagaggaatctttgaaaagtgctaggcccctctgggtgctgcctctactgagcccgagcctttactctgcatgtgtgaatataaagccaccagttttctgataaagacacacacatacactcacacacactcacaccatgggtgaaaacgacaagtggagcagagcgtgactactgattgttctttgaggccggaggaacaaagcagtcaggagcgataaaggcaggtgatccctgctggtttgccctttctcccagctctgaccgtcaccgtcacacatgacattcttgaatgaggtcacctgctcactacagattctaaaaggggcttgcttggcaaagacctccagggtcagagtgccggcctttactgtttttggcagttgtgtgcatggaacattggaagcgtttggaacggaatgcttaaggaagatattatttggcagcaagaaaaagggagtgtgcagactccccctacccctcctgggatgagtaggtactgcctgcccgttttttctctacaggagttgaatagtagccagagtacaggcttggcatca

SEQ ID NO: 56730 - DNA, 1046 bp, Homo sapiens
cgatgtgatgacactagcacaaaggacagtttatagttattttctgtggttcctcgttttttggtgttttttttttgtgtttttttttttttttttagacgaaattttgctctgttgcccaggctggagtgcagtggcacgatctcagctcactgcaacctctgcctcccagggtcaaacaattctcatgcctcagcctcctgagtagctgggattacagatgcccaccaccatgcctggctgatttttttgtattttagtagagacggggtttcaccatgttgcccaggctggtctccaactcctgagctcaggcaatccgcctgtcttggcctcccaaagtgctaggattacaggcatgagccactgcagcggccggttccttgtgtcttaaagcaaacacaggcacagtattctgggcaaaccagatgttaatagcttgacctctctgtcaaaggaggacttggttgcttaagacccttaaagctgtcaaagttatagcttctccaggatactatcatcctcacccatttcttattctctttgcagggagagatcatctctcaaaaagctcccatcagagcaaccattctgggactttgagcagaatgcttaaggcagtggttctaaaattccacaccacctgttcttccagttgtgtcctctctgagctgcctctgacggtcacattccatggccatgtgccacagcagacttgtgatactgattttagtgttgtccttggccattgggggaagggaggaaggagagagaagagaaggggagagaagaagagaaatgggagtggggtccattcatccatctctcttgtcattaggggcccagcagttcccactatggtacctaggaaactagcttggacctggaggccatccagtgacctagtctgggccagtaaagccaccaggccattttcctgcttcggacatgctttctcagctgccctcccccttagctaaggctgaaatgactcatcttcccgtgccctagttccacggggtttcatctctgtgactcgggacaga

SEQ ID NO: 56731 - DNA, 1697 bp, Homo sapiens
ctctgctctctgcttggactggtgtcactgtgatcattctaaggtaacgagccaccttttattcttttacccagcccagttgtttcagatgaaaggatagagaagctggcgtctgctgtgatggagttgatgttttattttaagataaagtatagaagcaactgattgatggattataaactgggaggtccaggataaagcttcattctgagggcatcagtatatttcactgggagcctcctgggcattaattctgccgttaattttgttattagaaacctagccaaacaaagggaggtggcgaagcttgaggctggtttaaccttgatgaaacagtgatttcaccaaggatgatgttgccccatccatcttcatccatcaaggcactgctgaaatatgctaatgaagcccaaagataggagcacagagcagttaaatggggcgttgcagacgctctccctacccccgtgacagggtgatgccatttactctccagatttagtataggaaagagagcaatgctgacgtggtgtcgtggtggaagatagaatggaggctccacctaataaaaagaaagggcaaagttcagggtatatattctagaagaagatgggaaaacttggtttttggtgaaggggttggttttcttaattctctttggctcactttctagccagtccacacaagaaccagatatgtggcatactgcagatagggcaacatttttaagttccagaatgtgacctcccaccatgtgccaaagcaagttatttgttaccatgtcagtctgcagcactgtttgtttccaatggtacatgagctaataccttggctttatttatttatttatttaagttacaaccttttggatacttatgacatgctgggcatactactgaattattttatatgaattaatctaatcagattcttacaaatagccaacgaagaagcaaagttatcacatatattttatagatgaagtttgagaggctaaattcatgtccaaaattatgtaaccagtaagtggcatggttggggtttaaactcatgtctacctgactccaaagcccttgtacaaaatcactgtggtctgaagactcttatgtaggttatagctgagaatccctgataaccattgggagcagcttgactcacatatttattgcttgtatattctttgggttcagtttaactttaactttggcattcccttcacaattctttcttttgtaaatagactataagctctctgaggtcagcagccaagccctttctctaatctcctaaatgtcgatgatgtccctagtttctatgtggagtgtttacttttggcatcatgcttctaatatagggttaaaaaaggctggccagctgctttctggttttcatttcatacattagatgaaagccgtgggggattttacttgtctttacaagttaattctacaggattcacagttaaatttctgtttctttgaatttattggtggatccacttttgtttcctactagtacattacctatctagtctatatccaactgtacagaaaaaagtaaaccgcaaatgaaattttattattatgtattaaacagcatctttggagcagtctatattaggaggtgtgtgtcaaattctgctcatcttaggaccctagacagttcctctaagagagcctgccacccttcgcttacaa

SEQ ID NO: 56732 - DNA, 1073 bp, Homo sapiens
gcaaaacaattcctaaatctaaaacgtttatcagcttttgtttttttttttcctaaatggagataaagttggaagttaaaagcaaaaaagaaggatggattaaaaaatatttaaataagatgccaagtaacatgaattgcctgaaatagactgtttcaggataaaaactgtatcttggccttaatgtgtcttgtgccatttattaaatcagttctgaactttggggactccagactgttattaaagagttaataaccaaaggcttcaacgtccaggatgttgtgtgggtcagtgtatcttgccaagaggtaacatcagccagtggaatcagttgggctctccgtctggcagatctgtctctttcagctgctcctcctccagtttctagtcttggagttcatatacagtaaatctttctcttaataaagccgtttttcaaatctgactttggactagggactgctttttctccaaatgcaacagctgttaaacatggtgcattgggcacggtgtatatctctttgtttagttttgggtttttaatatgagcagagacataaaggagtgggaggactctatcgatttctttctacccatgagtcatccactgggtttggaaataaggcctccagcctcaaaaggcttctgggctccctgggcttctcacccttaaggatgaagcctattgtgccctaataaccagtacaggattcccccccttcttttggtgagatagaattgtagagctcaaggtgtccgccagcagaggccagaccttttggcccctatctgtcccatttacatggggaaaagcatttttgcccccttgctctctggtccttctgtcactgtctctgttcccaatgcactagggagcattaactccctgaaggggaaaaaagttcacaaaagaaatgaattatgcatatggaattcatttccttgatgaatagggaatctgaacaaactccatggctgtttgattttaaggcagaggagaaggggggcttagggctaaagagtatagtggggggtgatcaaaaagaacttggaacaagagaggtgggagaaaa

SEQ ID NO: 56733 - DNA, 1935 bp, Homo sapiens
catggccctcggaagagtgtggagatgtcccaggacagccttcctggtagtaaggggggcagccctacaggctcgggggtcccaccccaacttcaacccctgcacctttgtttcatggattttatttgcttgggtttgtgggaaagagtctgcttttaagtaacctttgaaacccagtggtgcagagaatagaccaatgcctagtatgaattatttatttgtttattaagattttcatggcaccttccctttcaaagctcaaggcactgaatgaactcttcaaactgatagcagttagcactaaaggttgaacaggggccgttggaggaggaaccactagggaggatgagaaaagagggaggaagagcagagagaagagcacggcagtccggaccccagagccaccactacagccaaaggaggaaaatcgtaaagactgcaggcttcccaggaaggaatccagccctgctgggaagttgttttgttatcagggaaagtcacttccttctgtcagcctcctccatgaaatcgaggtgacctagttgaccccctgggcccctcccaggtatgatcttttaagaagcctgaggagctttcctttttaggtgagcaggcctaacccttctgccaagttgttacggcaataaaaatcatcataaaattttttttaatgttatgcataaacctttcaataacaagtatatttggtacagagtggttttcaaccctggctgaacattaaaatcacctggggaacttttaaaaaatattactggtgcctgggatctaccctggaatgatgaaatcagaacatctgggggctggtgctgagcatctgtattttctcaaagcaccccagctttttttttttttttttgagacagagtcttgctcagtcgcccaggctggagtgcggtggcgcgatctcggctcactgcaaactccgcctcccgggttcatgccattctcctgcctcagcctcccgagtagctgggactacgggcgcccaccactacgcccggctaatttttttgtatttttagtagagacggggtttcaccgtattagccaggaaggtctcgatctcctgacctcgtgatctgcccatctcggtctcccaaagtgctgggattgcaggcgtgagccaccgtgcccagcccaccccagcttttgtgttatgcactggggttgtgaaatacccggggacctgggaaggctgacaataggaggtgagcttgagtgtgcccaaagaaaggcaaagaaaggcttattattaggggtgtgatttaagtgtttccaattaacagtggaggaaggaaacttaaaactgtactttgaagttaccaagctctaggttattcttatagtaagtgtagcccatttggcttgtgtaacttatttttcacatacttcaaggccaggaaacttcagaagtgtcacagcaagttctttggccacctcctcactagctggctcccactgaaagtgttagccacatgccagctaccgttgtagggaaatcacacttaggatattttacttgcacgcagcagagaggttgctgttatcctccccattttacagagaaggacatggaggcccagagaggctacataattttctctgggtcccaaaacctgtaaatagtagagaaggggatcaaacttgtttatcttactctaagctaccccactctttctactatacctaatgcctcttagaatgaccctggacttgttgatttgtcagctgcttgcccttggcgggagggcgtttggctttctttttcagataggagagaaaacatgagaggagaaatcagcttctgcagagattaccttagagattgagcaaggcagtgtaatgtaatgaaaacatgcaccagagcaggggcctctagccccaggggcaggcttgcaattagaactgggctaa

SEQ ID NO: 56734 - DNA, 2662 bp, Homo sapiens
agaaaattgtgggagggtccaaatgagtaatatgggaaacatgctttttgtttaactgtgatacctttggtatcacagttttgtgattgatgtgacttaggctgtttgcctctttcattccaagatgacacacctctgtggggttactttgtgttcattctggacctggatcattttcagggggtccatgctagaatgtactgcaatgtgggaacattggcctacagatctagttaggtcctctcccaccgccatgcgcttagtcacttcacctgctgccttccaaaacaaatgggctgtgtgtgtctccttcccttaacaaagtattctataatcatattttctagcttaaaacaaaattagtcttttagatgtaaaacacatctaaagcacttttattaatggatcgctttccttcagggattacagtgcttagtatgaggtgctgactcatctattttcatgccatatagggaaggaaagtgttaactattttcgaatgtagagaatacttttgttgggagtctctaaaccttaaacccaggacctgtttgacaaaactgtcatcctcccaaccccttgaaaagataatgccctaaatctatcagttttttccccccagtatgcgaaagtggctgttttctggtgttagttgttcctatgtgtggcttggagccatggccacttggcttcctagattgtgtcccatgaattcaagcataaggagctcccagtctgctgcacctggcctcccttgtccttcacatccctgcagcatactgtagcaaactttcaagttagctttttattgcattccaccccctgccagggagcaaacttaaactcatgcaactcaaaatgaccatgctgggtctgttctaagtttgaatttggaccttgatccagccttcacatactttctcttatgaattcctcttaatgctagttaataaaaatataatggctttcatgtcccttctcataataacattgccagctttgggggttctttgaaaactttgcttgagaagtccatggccaaaaaaaaacaaagatatttggctttaaaatatggtctttgcttaccaaactcctctctctgaggaagggagagaaagagttgaaggtttctgggaaaggggcatagaagcaactcttaactctggccatgtggatctgcagacaaaattagggcaaatgtagtgctacagatcccatccccgggcctcacattgtggccagccatatggagtcagatttggagactttttggagatggggaagccactggactcttaggcatctggtgtaaagagagactttttctttgctactttttttttttttttttgagatggagtcttgctcttttgcccaggctgcagggcactggcgtgatcttggcttactgcagcctccgcctcccaggttcaatagattctcctgcctcagcctcctgagtagctgggattacaggcacctgctaccatgcctgactagtttttgtatttttagtagagacagggtttgaccatattggccaggttggtcttggactcctgacaagtgatccgcccgcctcagactcccgaagtgctagggttacaggtgtgaaccaccatgcctaactatcgttgctactttctattggaagagaaggcagccctgatttagtctgtttacagtctgcattatgtggagaatagagagccatcatagtccctaaaactttccttgccagttaacccagcaggacaacctgtctttgtctcttgacaactgttaactgagaacagggcccttgctcctctaggtgtgcacattaaggactttgcacagtgtggatgtagctcatgctgctctgccgtctagtacatgctgcttgaattttcatcatcatcctccactccttccacctccaagaaaaaaaaaagcgtgcaggaagtagcatttcagatccttctccaccacctctgcttcccttctcccttcttttcctccttgcagcattccctttagtaccagggagggatggtggttgaaaatggggggaatgatgttgctcagaaaaaaaaaaaatcagcctagaccttaagaggtgaggggaaaggaaagaacacttcaagcatagcccagcccaggcatgtcagctcccaccccagcctccttgtacctcccatctctgaaggagggtgatgaattcggtttccaccaacattaaactgataaatgaaatttgtatgttaaaacaatgataatttaattgtattttatttccttctttcccatccacacttggatctcacccccctccccattacccacccttcagctttggggagggggtggtggaggctgtgcaggggagggggtggtggaggctgtgcagaggcgggggcattgcaagctgtcggtttgcattgtgcggacggggaaaggtctctacctggctcattttgtcccctttgcttaggctgtcactgctgacagtcctcatgtttatttcatctcgcgtggtggctgtctcgtttccctaccctccgatgtcattaacgcacagagagcgggccctgcagtgttgagcctaatgaattccgctgtggctgctctgctccccacctcgttaccaaagctcaaggtgtcaaattaaacccagcctaga

SEQ ID NO: 56735 - DNA, 1207 bp, Homo sapiens
gggcccacaaacccatactttaaatggcttggaacttacttgtttctttgcttggggctcattgtctgcttcattgtccttggctatttataacaataggtgtgacaatagaacagcctgttccttctttggagttttctgtgttagttatttgattttaaaattctgctcctttttcccaagattaaaatggaattttgtttctgataaatttttaccattcttttccaaacagtagagtcaactcaaggatatcacaaatcgggactagaaattgctggcagatattccgtaaacacagtgcattgggggtagggtgtctagctctaatatttgcattttgtagatggggacaatatgaaaaactttgtcactccactaagatttttggcacttagaatggcaagaaaatccaggttcccttacttataatgtagtgcttttaccttgaaccaaaaaggtaggatgtgcgtgtgtatttccagggtctctatgatttgccatttgtattaacagaaaagaggcccagtctttggaactctggttagaggtgacatcatggcaaaacatcaggcctcaggtttcattgattttaaacttactatgtcgtgtgattatctcatcgctgatggcctttgtcattaaatccactgcttcagctgggttgaacacatttgaggaggaacaggatcaagaaggtttttgaaagatatggacaagtgatgtgagaaatactggaatttaaattctttccttctttttaaaactatccctggtgatatctgtactttctaaagagtcaaaatgggaagagaatggtctgagagtggagatttggtggcatcacatcagtagttctactttcttctccattcccacacacataaacttcatgaaaataaactcagttatgtagcatttaaggcctattcagaaaggattcagttgtagtcagtcaatggaagaaccaagatagttaaccaagtcttaagcatttctctattcattcagcagcatttatcgaactgggtataagaaatagataaagccagcctctgccatcaggagcttgtgattggggagtaatgtgtgatgtgatctgtattatcacagaggggagcacagcatgtgatgggaatggaagatgggctcctagcgtggccttcttgggtcaaggatggcacgctggattggataactcagggga

SEQ ID NO: 56736 - DNA, 2971 bp, Homo sapiens
taagacggaatttcacttttgttgcccaggctggagtgcaatggtgcgatctcagctcactgcaacctccacctcctgggttcaagtgattctcctgcctcagcctcccaagtagctgggattacaggcatgcgccaccacgcctgtctaatgttgtacttttagtagagacggggtttctccatggtggtcagactggtctggaactctcgacctcaggtgatttgcccacctcagcctcccaaagtgctgggattataggagtgagccactgtgcccggcctctgaagtcttttttaaactgcctgtcttctacagagcaccatgctatgggagtgtggtctggctttgggagtagaaaagtccaatgttgagtacaacattgagatacatggctgttgggaccactcttaatcttccaaggatgaccaccatttcttgtagtggtttactgagacagtcaagacagtgtgaatatttctggtaatgttcagtgaaattttttcttgtgattgacttactgtttgtgtttgctgatctggaacttcagttgacctccttgactgcaatcatttgttttggttttgtgtgtgtgtttgcactgggctttagatttgtaaaacattgtatatagttaatgtgatgtagcctccctaaatctcagtgaataggattttacatggcatcaatatgcagtgaaactactatgattgtcatagtctaacatggtgtaaggacctgatgaagattttgtatgacaaatgaggctatggctgcctttgggattagtagatatatggaacaggaacaagaacaagaaggcatgtaggataggtattcaccataacatgaatagatggagattatatagacagttagccttcaattgcaggtggagaatggaattaatatggaacatttaaaaatattttagaaatgatatttttaaaagagagtcaaaataaaatgctttcatctgattatttgaccagaaattgggctgcttaatataatgaataattgttaggatctatcgatatggctactcagtggtaagaagtgccacataaatattggtctaatacatatataattatgtaactctagccaggtagctggattaaatatgggtaacagcaaaagcacttctgtcctgataaaagtctcagttacatttaaatacttaatataatcagctctttttcaagtaaacaataattcaggaggcaaatgttcagtacatctcatagaaattttttgtcttaatttgtttgcctgtacaatctgcattcttcttattaatttaatccatattttgaagtcagaaaagaattcatctcatttgagttagtttagatcaacatactgatattgctgaatagtttcacttccctgaaactaaacatatctattcctttcgtcttagacaaattatgaggggaaacctgtctgaaatttggctaacacatggtgtgcatttgatgccactggaggatttgctttgtcaatttaagattgagtgatggctatagaggaaagtgacggaaaaaaaaaaccttcttaatgtgaaatagaaagtataaaggacaataaaatgctaaaatgtacaggaaattcttgtaatatgactaataatgtatgagacttgtagagatcagttctgctacaggtattcttatgttatataaatgatattataatatcctattacatatattatattatcatactataccaagaatagataatatttttcatcaactggtgattcaagtgtgagtttatacatgggttgactgtggattgtatatatgataccaagcctgtgtaaaataaaacaaaaacccccttcaaactcccatatggagtatttgactaaagcaataatattaagataacatactctattccaaataaggatataatttgctgtttgataaagcaaaacaaaacaatggagtgtattggtactgttttccacagagtgggaagataagaacacatgtagagatgataaaatgtcattggctccaagagacaagcttccgaaatccatggtggttgaagaacatcaaagaggagcaattatttcagtcattagggcagttccacctgttctaattgaacatttttaggatgtagaagatgcatcatacattggtatctattcagaaggtggggacatctgctgtctgtcatgtatctgggagatgtttatctcaacaggaggcaataataatatggtaaaccaaacctaatattatcatgatgcattaaaactgggttaattgaagcaataaaatcaaagtaacagtaaatgcttatacaacatgttaagtaatatttacttcaatcttagaaatgaaatgataattttacattctagcagatgtatttcttgatacctgttctgagaggacagaaacaaggctcaaaattcatgcaagaggctaataacaacttagttgatagtaaaatatggagcattggatgtagagtgcattaaccttcttgtttaatctgagttgacctataagtgggcatattgttttttggggaatcgggagttttctcaagtagaaagaagccccacttttcctttgatagggtaccagtcaaggaaataaatgctcttttttctacctgagttagatttgcctttcatttgctcaccctgatctgtgtggctttattgaccactacagtttaagcccatgcaacctgcatgctgtgcaagaaagaaaggtgatggacagatagtcccagagttaaacttctggtgcctttgccactccatgtcttgccatcttatcatcatagtagctttgggtatggcctcctagcagcttcattgttatgcctgtgggcattcgtgtcccactgtcaggcagattctgggggactggggagccagaatgatgggtagcaggcaggtggtagatggggagacctaaagtccaaaagctagacc

SEQ ID NO: 56737 - DNA, 1052 bp, Homo sapiens
caaataattatattagcaaagtatgttgaagtgtgttggcgccttaaataaaatatcaattgccaggtacgttaggggtgaaccccaggccaactttcatagtagagctatgactaatcagatggtgtttaagttaataactcttcccagaagccaagtattaaagaaagtgaaagatggtggtcctttgtgtgggaatccaagcacctgctgaatggtgcctgattattttgtcagggggtttcaaacagtctccccatttgtgacaggtaaatcctgaaagagcaaaaaggctggattgtcagtcagagactgagcagccactttgcatttggtgagtttgttgaattacctaatattaatctacataaccaagggaagtgtctgtctgttcaagagaaggacatagatgtctcaactgaaacaggttaactgaggtcatggagttgagaaagtctgctttttcctcatcttcatataatgaagtctttccttctcattatgatctgacattaaccagcaggcggaccatgtctaggtgtcttgaccttttgaggttatgtggcttcctctgtaagatgagggagttttttagttggtgtccctctagtcatatgtctgtgctgcctttgacaactggtgttggccgtaccaaaactgtcaccacaattgggaagctgtgggaagccccggtacatcctttgtgttgccgccagtaccaagccaactctggattcccacagtcaggtgtgaccaaaccaaaactgaccataccaaaactagtcacaatatcaactggcacaatgtattagagtttttggcttgagttgaactcctatcatatgagacaagtcctggcatcattctgcattattctggtcgtgatggtatgtattagtctgttttcacactgctgataaagacatacccaagaccggacaaattccaaaggaaagaggcttaatgacttacagttccacatggctggggaggcctcacaatcatggcggaaggcaaggaggagcaagtcatatcttatgtggatggcagca

SEQ ID NO: 56738 - DNA, 1067 bp, Homo sapiens
gatgtgactcctgggtaccgttcactattcccacgaatccctcacctcccagaggatgtccccatttgcaatactcttggggtgactgtctaacatagtggtctctcctgggggtttctcaactgccacttggcgtctcagcccttcttccccaaagcctcaaaagctagatggaaaggaaagaggctctgttcatatctgcattcagtggacatattacaaatgctaacaaaaggcttaagtccattattattattattcttatttgttgtttttgtatataaatatgcctaaggtttcaaagatccagtgatgtatttagctaatgcttatgttgttataatgtactagggtgttcattctcagattggtctgagtaagaaaaatgaaataatgatagctgctctaagaagcctgataacagattctggctgatggagcaaatattctgctgcttgataaactcatagaactgtggggcctctgttattgctattttagtaatggaaatgtccctatactagtttccaagaatatcagtaaataacacctatgggcctaggagaggtgctgaagcaaatgtggaggatgagggacgggaaggagaggattcctgggagttactgaatttttaaattggaaagggttttagagactaagccatttgcctaaaggaaaaaaagtagtaaaaataaataataatttactacttgctaccttctactgagtcctaattatgtgctgaggtttttattagatcgtctcattgaatcttcacagaaccctttaaggcaggcaatgattctccgtttctcagatacctagactgaggcttagagatgttatggaaccctctttgtcacagagtgtgttctgtatagagctgagatttgaacccgaatttgctgtgaagcaccaagatacaccctaagaatagagcctgacatcgtgtctgtcttaggatggttctgcccattctagttaattgctttgaaaacttcattgctcaccctacccagactgacactgcttctgaaggttttttcaggccaactgctccatcttca

SEQ ID NO: 56739 - DNA, 1047 bp, Homo sapiens
agcaatttgtaagggatgggtatattatgcttaatgtttccccaccagacccgattgtgtcttgatttggggcggtggttcgactttgagggtcagactttactcctgtagcaaaagttggacaaatgtatacaaattctctcacctctcacacgccaacatcttcctccacccaccccacctccaccatgacttaggatcacctgagagagaaatacaaggtctcccagccagggccctgctgggctgtctcctgaggtgatctttagataggtgtcgataacagggagcctccgagccctgccaaaatcacttggccacagccccaagataatatttgaagttcttgtgctcaagagtgtcaaagtgtaacatactcttcccctttcgccttaccttccccaggcgcagccaacacttgacatctttttatcagatgagcttggcactgccaggaccggctcctcgcgccaatgtggcagcagccacagcccctcagcttgttagactgaaagaatgtgccgttttaattaatgatatgtaaatatccttgaatgggccgcatttgcatattaagagagatttgcggaatctgcggagtaatatattttaattaaggattaattaaaaataatgggaatttcatttcgcctggcagaatccgtttagattttagcacacgtctgcttgggagtctggtaggaagactgtgtgttacgattcccgcagatgagagaggcactcctgtgtttatcatcttggagccccactctggggagcaaagggaatataaagggggtaacattttcctcttacctcccccatcacccacccctcttcttccctcctctttgtgattttagggctgttttggtattctttatggtaaagtaagtaaatggctctgagacacggaacactagttgtgttggcaattatgttaatgggatgctattaggctatgattctatatgagcaattggggagaagaaatgccttactgagagagaatgatacaacagacgtctgtcttattgatatagctcc

SEQ ID NO: 56740 - DNA, 1623 bp, Homo sapiens
cagcccaactgggagctcatcagacagagcctgcttgcccatatgccttaccttccctttcttctccagaccctcttgtactttcaaagaatgaataaattaaattgaagagagtccaccgtggattcttcattattaatttgtttctttttatttatttttcatgcatttttcttactctggttgtttttctttctgtttttttttttttccccttttattcccctgttgacacaccacatatacagccctcccttctctctctgtgaacagctctcttccctgtatacgaacagtcatggagagtgatttctctgcagcgtgtctgtctctacatagatactcatgggtgtaaacacaccagagagggccactgcatgtgtttattgttgtactttttccctttgataagctgtcatcggtgggcactgctcaggggacttgatcccagtaatctctcgaccccatggaagacatttaacacccttccagaccctgtgctctgcctctgtctctgaacctttcactctcctttaatgagaatttctcctaattatttcagtggctgcagcagagggaccgcagtgtacttagatctcgatactgagacgtgactgttatgctgataaaggcaagagatcaataatttaggccccagctttaatggcaaagctgagagcttaagtgtctgcattcaggttgagtcttagaggttcttggagtattaataatttccataagattttttccccctttcttcttgagctgcagctgatcagcattcttgtacttgctaaattgtatttataaaaagatattcacctcctctatttgaacatatgtctgaatatcacataaatgtgtagcggcgtgcctttgcatcatgtgtgtacatctgattattcgcaactgtgtgtaacacatagcacatacagatttctgtttttgttcttatctggggagtgtccttcctcacattgcctttggcttttggactacccataatttgttctttcaaaattcatctggtaaatatgtaaccacttcaaaggcaggagtgagatgtcatccttttcctcctttcttttttttgttttcttttttcttttattctctgtctaatttctcctgctatcttaaagccacaattgtacttgactgaaaagggcaacaccaaagcattgagctcactcagatgtgggtgtccatgtgtatgtaatatagttctgagtttttatatagggtccttctttgagggattccagcaaacctgtttgaacccaagcaaatccatacaatacatacatgctaacagatatataaatgccatgaaaatgatcatagtatatgatatgttttatattaaggttgaaaaaaaaccccagcataacacagttaaggggctttcttggaagattagtcaccggggtgtttgtcacctatactaagaggtaaccagtgctccccagaaagggttggagtggggctgggagcgcccagaacctggatttctcccaaaggagacaacttgttctctagtgagtccaagcttcaggggccaccacgtctctccgctttcatcagcccaacctctctggcatttttttcttctggaaaattact

SEQ ID NO: 56741 - DNA, 1002 bp, Homo sapiens
ttttctttaatgcattactaattcagacaggcccttctggttgttctgaattggagagagagcagacacttcagttggatttggaatcatccacttttttttgcaggtatttcgaaaaaagcctggttttggtacagctcttccagaacccacgggaagaacctgttcatcagctcatccatccgtctgctgagtaaatgcttattgagcatctactgaatgccagcactgttctttgttcttggaatacatcagtaaacaaaataaggaaaacaaaaccaaacctcctgacctcaaggagcttttattttaggaatgatgtcttttagtcatttaatagttgctgtttttattaactcttaactgtacccataaactggatactttcaacttaaaaaaaaaaaagagaaactaattatgtgccctaaggatcaccaggccttaggttctacctttatttttcttctactgttaaatagcaacctcattcctcaggctgctgatggaattggtaactgagtaatcaggccactgtgctcggggacataaaacctgtggctgctgccattgcagagtcccgtcatggatcagagttcgtccctgggaaacaacttgtgccgacggaaggagttcttcctttgctcccctcatacctcccttccttgcagatgggatccttgcaagggcagagcagctcttagagttgtcaggcccttttctttcattctgcttattttcccataggcgagtactgctcagaacccaggctgtgagttttttgatgtggaaagctatttactaagcatgtcttgacgcagaggatggagggaaagaaagcctccaagagagtggtgattctacaaccatcatcaaattttggttgaaaactcaaagctgctgatatgtattagtaagcagataacagtaacatcctgtatttgcatggccctgtatcagtcaatagcattcagatttgtgtggtggtgtatagctttccttatt

SEQ ID NO: 56742 - DNA, 1028 bp, Homo sapiens
agcctctaactcctgggcaccagcaatcctcctgagtagctgggaatataggcatgtgccaacacaccaggctaattttatgtattttttagattttcatagagatgaaggggtctcagtatgttgctcaggctggtcttgaactcctagcctcaaatgatcctcctgcattggccttcccaaatactgggattacaagcatgagccactgcgcccagcctgtaattattctaaagatttctttcctgtttatgtacagaatatctaacagctatgcttacctttaaagcagccttatgaatatccttgtgaattccttaagctcaagggtcttgtttgcattttgtaggtatatctgtagatagatcttacctatctctggcaggtaacattatcatcatgttttccctgtttctggacactttgtgaaagcattgtagaaataaaagaagtctttattctttgacctctcttatgcattatgaattctgaaaaactgagggagataaaaggcaatctatgctttactgctttccctaagttttgagaagcaggcttaaaaaaatgctttaaaaattttagatgccataatacactgaaaatagggatctcaggtatttgaggcagaccaggattcttctttgaccagtcctttcactgaaaagactgtatttagatatttctctgagtgttctagattcatagacccaaatgacctctctgagcatcaagatacatgaagaagttacttcctgaggataataaatatgaaaagagaattatcaccctctgctttcagaaatcacttaaaaaggaagggagtgcttttcccatgaggttcctgagacagagtccttatgtcaccttgtattggcaaaaagatctggggcactgtgtttgacgatagcacttctttgttcccctcccgatatatttacagaatataatcctattttgcttgcactcatttccataatactgaaagtaaataaaccttatataacgttttatggttaagaactacttag

SEQ ID NO: 56743 - DNA, 1065 bp, Homo sapiens
ctgctccactcggtcccccttcccacctcttacagccatgaaataatgtgagagtatttgtttcccctgcaaagggaagagggtccagagacaaaagggaagttagtattcactggaagcctccctgtacaagcaacagtgttaggacttttatacacatttttacaattattacagcagttctcaattattgaaacagagggtaggcatttcccctttttcagaagggaaaagtgagaattaagttaattccaaagtcacacagctagtgagagaaaaagcctggacaggaactcagactgtatgactccaaaggctaagtgcattctatacacacaggccgccctcctggcagtgagagttcaggatctgttggagaaaacctcagaccatggttttcttgcagcttctgctggagaacattaggtgcctgttcccccgtggtgagtgttacaaagtgcagcaccacccaggggaagagtctgggccttggagttagacctgagtttgaatcctccttcagatatttactattgatgacattggcaatcaatgctgctgaatttctccagccctccatttattcatctattaaggggagagctacctacagggcggggaacttacaaggattagatgaggggatatgtgtaaaggcctaacacccagtaggtgctcactaaatgatgttccttattattatggtgattaccactgtactcttttcagatgaaagtgttcggtcacctggaacctgtgagtatgtggtttttgatctgtgactaaactgttcacccatttcccagtttctctgctgtgtcaaatatcaacattttaccaggtttctctgttgttgccaaacctgtcatttttatttggtgtggcttcttgggaaacttccatggcccatttgatgggaatcaaacagagtgaaaacaaggacagatgcagcagaggtggcatcaggaacaaatgggtcataagaacttaccttggcagcagccccagaatggtcaggaggaaaggcactttaaggtatcagaaggtagaaaggagaggttggat

SEQ ID NO: 56744 - DNA, 1016 bp, Homo sapiens
gagcccttgggggtcgaggctgtagcaagtcatgattgcaccactgcactccagctgggtgataaagtgagaccttgtctaaaaaaaaaaaaaaaaaaaaaaggaaatagtttagtgtctagcttctggtccacttgtactggtgttgactatgtatcagcccagcttatgtggctacagggattctcgttgcacatctgaatgaagccaaaaacatacgcaaggttttaagagtatttgatgtcttattggcaatatgaggtggaccagccatacagttagtaacataaccagcattggcttctggcacttagttctgagttctttccgaagaacttatatatgcagaaactggacttagcactcacttaaagaagaaataactttgataagaaccaggtgggttgttctttctctttattggtttcatgttttcagatcttgctaactctccccagctgtgccctgcagtggagacctatttgagactctgttatgatatgcccaagataccacacatgccctaggctcttcccctagcgacaaccatggtgctctctaggaactaatctttgtggcaaagacctttgcccgggggacacctgcctctcccagctcttttcccctcatgtcaaggaccatgcatctcatgctatcttttcatcgtcattttctcaaccttagggctttatctttgaaacgtgtgcatccgcctttagacactttatcattaactggaaattactgttcagatagacttgaggataattattcacgttattaaaaaacattcctcagttcggtaaagtatttggtagcaagctcctataagtagagagagtttctgatgtatttgagtacagatcaattacaacttgaaggagaggttggtgcattgctgaagaacttttaataaagttgcaggtgctgtcagaaatggaaccatacctgaaaaataataactgaaatttcttcagttccatagcattgcaaaacttacttccgcatttgctcat

SEQ ID NO: 56745 - DNA, 1290 bp, Homo sapiens
atcgcatctgaggcctgccaggagactcttaacatgctaacctgcttgctatacccttattcaaaattctttgatggaggtcccattgtcaaaagctgcagtcctgaatctcaaaactgttgtgccatgatcagttgtgaagtatgtcacaagtaattttgatattaataatggttcaagacctaaggtttgcaaattatttaaaattttaagctaagtcaaattatcaccatataaatgtcactttcgctcacttgaattcccatatgctttctttagtggaagagaaagagtggcattacagtctgctgagaattattcattttggtctgtaggatgaaatctaaactcctttgcataacctacatgaaccttgtgatctagtccttgcctacttcaccagggctatttctcaccatttttttctatctcatcatatgctacaaatatactgagttacctgtaatacctaaaacctgccacttctttcttatacctttgaagattgtctcctactagcgatttcttgtacctgttatcccctaaaacactcttactgatcattcagatcctggctgaggccttgcctgagtatcctgacccagttctagatattcctcttcctttgtatccactttgccttgtatattccttcattgtagcttataataattacatggtgtttttagcatgttcgtttccccgttggactgtaagttaatgccttttcatgttcttctcccaatttttagtacatggctgaacatatggtaggtgctctgtaatcttatccactggtcccaacattcttcagaatcaggcaactttagtaccacatcataacttaatagataaaagcgagagagccctggacagggagtttgagcagctagtcctagctcgtctataatgattctgtggcccttgacatgttacacaaaacttatatctatctcagtttctatgtgtatggtctgtttgtaggacttccctatgaaatggtggtttagaccaagttggaaggtgtgcattgattggaaaatacaggaagtaggatagagtaggcaaagtgaggcccatgtgcttgccattgatagtctgtcattgaatgtctagctgggagtaataaatggagacccagtcgttatttgagcatagatgacatgttctgaaattagattgaaggacttctcatctggtaaaaatgtgccggatgtactagagtgtagagagagtgaagaaacagatttcagccaggagacaaaaggatctgggatctgctatcttggg

SEQ ID NO: 56746 - DNA, 1056 bp, Homo sapiens
tacttactaactgagacactctcctaaatactctcaagcattcactcaggtaatcctcacaaccacactagaacacgaggtaccacaactgcctccattttacatgtgaggacagagcacaggggggttttgaaacaaggtcccaagccagtagtcaggtctggcttccatgatctggaaccacagcccatgctatcagctatagcactacaacctcagaagagggggaaacttaaagaagcagtaaaatcataaaaaggagactcaagaatttaaaaagaccagcagactgagtctatacagaataggcatgcgtgctctcacatagcagcgggcctgggtgatcatcagcattcctaatgataaatgacgtgggtcacaaagaggaggccaaataatgtccaagatccctctctatctatctacctagatattttttaaaagaagctagatggaaatataacatgttttagaagattactatcgaaaatgatgaaaatacaaatagttttggtaaagctccagtaacagggagccaagctttcaaaagtgatttatttttcagtagttaacgtttttgtgcctttctacctgctcgtgggttccagagtctctgttgcctggtgtctccccgagaacaaagattgtggatccccaaagtacctccacctcctcactggactcctgctccagaaaagatgaccataatctaataatcactctaccgcatgaacagggtgtcacacatgtgcttgactgtgcctctacagtggcaggtagagcgagtgcagtgcaggaaatatcagcccttttctaaagcactatgaagatgaaagggggaggtggtcaggggatggagaggacggaggggaaatcacttctttgtctaaaagggaaatgccaggactgtcccttcaggtctgttaagtgtctataggatgtggaggaaaattcttcttctcgttgctcccacctctccccatcccctttattctttctcactttgtagaataatataaaaaagcccagcagaaagggagctgtgatgctgtcgtc

SEQ ID NO: 56747 - DNA, 1166 bp, Homo sapiens
tcattaccacgagcctgaactcatttcagctgagacgaccagttagccaacagcccaggcgtacatgtgacagcttgggtgtctgcccctgctggtcatagctaccgcttccgtcactggctgttaatcagaatatgagaaactctggccatttctactggctggactccgtgtgctgcctgaatccaggtgcatgcagagatgttctcagatctaagagaggtcaggaagggaaagggatgattcctcctcctaccttttcctaagtcccttctccacacatccaattgcacccatgagaaccgaaccaccatgttgaatggggtctggcattcagagcaacttccctacaaatctctttttattggcatttcctccaatttaaccagccctgaattgcatttgaatcagatgagagaaagagagggaaggagaagggaggaggtccctccctctcttggaaaagcagctcacaaccagctttatttggtaaaatgctgcaatagatgcttgtcagaaataatttattcctgttagctgtaatctgaaggaaaacagatacaagtcctatagttaaaaaaaaagtaaagtagtcttgctttcgctgacagtacaaaggtgtcatatacaagaaggattgacacagaccaaggggtcttgtgggaaatatgataataactataaagaagacagattattccccagttgccaacattcaaacctttttacagtcagttcaaacatataaaactttattgctctagcagaaaggggaacaatttctggttgcacagctttcccagggctgggtttatactgtctgtgttattgctctatagtggcattttaaagtttattgaacaagacttttacaattgaaggaagtatataaaactgtaaatttattagatttttcaggataagtgccctttgtagttgtgctcaagaattcggagctatgagaaactgctagttacaagacttattaatattaaagactgagagtacgcacattttataccttaactgatctcaaaaataatattattatattactgaatgtcagagctctgatactatagaattggatggatacacacacataggactctatgtaccagatgtgtttatttttcactggctaaaaagttagctttcgttatatc

SEQ ID NO: 56748 - DNA, 1648 bp, Homo sapiens
aattaaaaaatatattgttactaaacaagatgaattacaggattatttacttgcagaaatatctgactgttgactgcttttaaataaggtgtttcccccaaagaatgtaacatagctcaatctttaaaatttttcatataaattttggggatcatatcactatgtggaaggagatgccttgcttgcttacttaagcctcaggacatgtgtttatggatataatcacttatgaaaccagacctcatattctttttatattatgttatgattagccactgatatgtgtttgcctttttgatttttcacatgcatatgcagaaacatgtatatgtatatattatgtgactaacacagtgaaggatatgaaaagtatgaagacaattttgattataattttctcatttgacaagttcaattttgaggtaccatcaacttgcctttaattttcaatttgtattctagaattccttaacctcttcagaaggttttcatggtagatacatttaaaacattcaaataagttgtttatagcacctgttcaccttcatgctgcctgatgttattcaagtacctatgtgtgaatggcactttgatctggaattctgtgttaatttgtctagtggccatagcatttacagaaataagctaaaatgttttcaaaaggacttaaattgtaattggccttttggtttttgattgctgagttttggaattctatggttgatataaaaaaaatctagacacttgtgacttactaaggagtatcttgaaaatgtctcaattctgttattcagtggaactaccattctcttttgcccctatgacctctgatggctgagcggtgttagccatatactgtgtgtcttttcacctcttcttgccatctctgtgggtcactgggctcctctggaaacttctgtaggcagggcagaggtttccttttgtgtttccttttagaccatgccttaagaagtatggtgtgacttcctttattcactaaatgtctttctgataagctgtgcatgaattatatgattggaaagcaaatcatattagaatccactagtggagtctggctaggatatccattgtaatcctcctagtaagtcataagatctattcacaatcacccctttagttatgcacggtttccttaaatcataatatatcttgttagagtttttaaactactaatgtccattctagtatggtgatatgtatgatagctgtgtcctgcctggattcatgcagtcacatatatatgatatacctttttttgaacatatgacaatatgcatagcccctatttggtgaactgtcttctctacaaattatagccttggtgctttacaaggttaaataacacagtctctaatttaagtaacagtgagaaccaggaagatttaaacagtctgagtcaggcacacataaccctaccctcaaaagcactcatagctaagtgggggaatcttgctgaagtcttgttaacttcctgggtttcaaagtcccacttccaggtaccatggatgaggcagcaggcatgcaattacagaaaaataaacctttagtcaaacaaaagaagccactgaaagaactgaaaaccccttcctagtcccagctaaattcccagggaagatttaggacctgt

SEQ ID NO: 56749 - DNA, 1030 bp, Homo sapiens
atataccgtttttccattttctcttttcagtttttttctttcttataagaaagactccagatgttgaatttaaactgggggatgtcttcaatgccattgaatatattgagcgtgtaggcaggcagtggaaggtgctggtttttttcttttttttcctttttgttttttgagatggagttttgttcttgttgcccaggctggagtgcaatggcgtcatctcggctcactgcaacctccacctcctgggttcaagcgattctcctgccttagcctcccaagcagctgggaatactggcatgcaccaccacacctggctaattttgtatttttagtagagacggggtttctccatgttggtcaggctggtctcaaactcccgaactcaggtgatctgcccgccttggccccccaaagtgctgggattataggtgtgaaccaccacgcctggcggtgctggctttctttggtaaaacggagaaaagccttgagggtttaaggaggagagaggggagtaaaatagagaagaggatcaggaaaagaagaacaagttgaggatatttaattatttgaaatattgtgaaacatgaatattgatgagaaggatgaacagggatgactaagtgcaaggcagggcgtgatggcttaccttcctccaagtcccacctgctgttgttgaccccatctggccagccaggcgtgaaccttagtctagcaacaataggggcaacacagagtgcatctgctgctcaatgcagggagagatgcactcttcatcttgtaccttcttgctgtcaaccctttctctttttttcttctgctcatttcttaccactctgtttatggtaacatttgaggggggaaaatacatcaccctatgaaagaacagggtggctgctgactttgtaccaacagcagtgaaccagggcctagttgtcagcaaccaagacctctgctgacccagaagcagacaggtgaccctttcaccaaaacttcaatcatcagtcttctcttttctttttttgaaacagag

SEQ ID NO: 56750 - DNA, 1169 bp, Homo sapiens
ctagctaatgtcttattcagtatgaatagcagtggcgtttgggcagggaggtgatgagatgcctattaaggtaacagaggtgtccaatggaacattgcttgtttagccttatgacctctgtccaagggagggcttcctctgtactggaactgtggttgacttagggtttctgcggtttccttcctgaggtatatttacagtgactgtgccttcattgcaacaaattttaggttcatcctcttgagcagggggaaggagcctctctcttcagaagcatgtcaggatatctttggtaggcatcatgttctgtttacttgaaccagtgagaagatggccgagcaagcaaggataagtgtacgtgtctataaaggtttcttctaatcctgcgagtctgtaagcattctagggttcatcggaaactgtctactcccatttctggaatttgcctcttggcatcatcatgcagggggctttttctagtcatgctttgtggtggaaaggtcagctgagcacggaggaacaggggactcactgcttttctcccctttgggcccttgagcaggcatttgactgctgcatatgaacctgggagccatggggtcttaaggctttctacttgattctcagtgtggccagaattctgtttagggcactgctccaaatctcggtgacactccatctgtaaaattgggtggcagtgtagtgtgtgtgtgtgtgtgtgtgtattttcttatacaggactggaagagaatggaggaagaaggataatgacttaaaagcgaaaacaattgaattctttgagctacagtgctgtgtcctgagagtgcagttattttccactgcagtaatgctttcaaaaacatttatctagcttctctcactttctcatttgctgtcattggtgtgaaaaatcgagttaccagaaggttcacccatgttccacaggtatgaatactgaacgttttatttagtgtctcattaacagctggcctgtggctcctccttctcggcttgactctgccctgtccagggaaatggggaatcacgcttaaggattagcagggtgcctattttcacttacagtgcttcattcctgtgttcatgttacctattccctttacaaaatatgaatgagtatctttttgtgacaggctatattctaggcactg

SEQ ID NO: 56751 - DNA, 1053 bp, Homo sapiens
attgagcacctatcatgtaccagattgtacatgtacccagattgggcattatgcatctgtcacccccaaatagtgaagtaatatactggacatattggacactcctactaaaacccaatccctttcctggcaccagactactgcttcttaaaccaagaagccaaagagagggaagagaggcacagtgcagaggagtttcttgggctaactctttagaggcttatgctccactctacctgctaagctgtcagcagttgtgaacccttcccagaagctggcagtctcgcaaacactgggaggtggccagactggatgtgcttggagcattggcagtcatcaaagaattaatgttggacgagcaggggtggcgggcatatgaaaggggttgcagggagagatagatagatgaatatacaaaccctcagtcatgccatctgaccatctgaggttgtgtgcatggtggaaggccaagaaacacattcagagaaggggcgtggacttgtctaaaaggacgttttcctttctgcctgggccagccaggcggcagagccctgcactgcctgtgactgaggaagactctgttgctatgcgccggaagcttaattttattattgctctcccctatttaatgtctgtctctcaggcagctggtgatgttttaatgaagctggaattgtatagtctgtagcgctggataatcataagctgccgagtcagaatcaaattaataattcatgaaattaaagtgtataattaatttgaactgtgcagatgagaagaagggccagagcccacagcctggaaggagctgaagtgtggggagtgtttactgaactcagcttctatttccaaataatataatctgcatgcaggttaggggtagtctgtgggtctacctgaacacgtatgcttaccagaaacaaggttctttcaactaaaacctggaatgactttcttagaagttcaaaagcattttaattgattttgatttacccttccctggccccaaaagaatgttgtttgaacagaaaatgtgatactgggttacaagtc

SEQ ID NO: 56752 - DNA, 1050 bp, Homo sapiens
gcaactcaagtgcctcattaaaatggggaatggtctgcaatttctaaaccactcttcctttcttgtattcctctttcaggcaaatatgcagcattcatctttgttgcctctccaggtgtgagaggcagtgtaacatccaggctgtttacataacttgcggagtgttttacaatgtactctgcagacaattgctcggatccctttattgtctttttaaagatgcctatacaggtgggtcctttttcggtttttgaatgatggatgctgtggtatcataggaaaaagaggaatctctgggttagcttttcattagaaaatccttgtcatgtttaagctcctaagcaggcagcttgaaccccccacccccttcctgcatccagtagacttgcagggaatgagaaggcaaaaccagcatctgtgattgtccattcttctttgtcaggcctttcagagttcctgttctagagggacaaatgactggaggccatgatacagactaatggtgcataagcccccaaaggtttggattgaattgaggctcagctgacttcacatttttaggtcttcagtatgtttatttgtccctcacatagcggcttgatctgtctgcctgtgtgttcacatagttaaccagaaacgctaggaggaagttgtaccagtgggatacctccttaggattcaagggcctcccgtgtaaccatgttctgcacatcagctctctttgctcctctcttgatctgcgtgcttcccctaacttgcttctgcttgcatggccttatcttctctaacgcctttctgcttccgtacaagtttcagccactggtggtttgccaaactggctgattacccataaacacacaacatggttctgttttgctcctagcaatccttaaaccattgcatgtctaacattctcagactaattcacaaatcagaaacatctgatgcccaacccataccaaatgcatttcagggcaaaaattatgctcctataatgtctggcttcctgtcttcaaggcactttgcttacatgactgaatcctcactgtg

SEQ ID NO: 56753 - DNA, 1007 bp, Homo sapiens
gcccattattcagaattataatgtattttgatttagacaaggccagaataatgaaattggaagaaatgcagaaaatatgggcattaatgttaactaaacatacttcattcaacagaaggagggaagctttctcagccaaagaattattttcccaaaaatgcgtatataaaaatttttttattcagggcctctggtttttaactttataacaccggttgagtaatttttaactgcaggatgcatctctttcccgatattctccccacccaccgcaacatatttcagtttaaatggcctgttatttttcttcatagagctgtgtctctgcatgggtgagaactacaaaaccagtcaggaggaatttgatacgccaagtgggccagctcattataacttctaggaaaccacaagataattgtagggttactgctggtaggctcctcagcattgtgttaggcgtttatactcttctctgttcaacttgcaatagccacttctcttttcagtacattttgtaggacatctgaataaaggtggttgacaagcattttcaagcagaattttcaaggcagcatccaggaatacttggtaactaacctcagaggtttaaaaaagtaaaaaataaaaatatgtggttgaattcttacagtgagtaggaaattaatcttagactgcctgcatcaaattgagcctctttattgatatgaagtgagttttccctaaatgataacctattgagagatctgctcactatgaaatggacagattctgcttactgaattaccttctgctatttatccttgtgcttctttttttccttcctttttttccttatctttatcatccaaaaacattttgtaagaatttatttatgcaaattaacacaaacttttaatatggatatcaagatttcaaagatgttgtgtaaatatgtatatatacataatatagacatatacatacatgtaactaataggaagcacttatttggcatttactacaggtat

SEQ ID NO: 56754 - DNA, 1127 bp, Homo sapiens
aagtagatatggtaggtatattattatctctcttttacagttaagaagaacctgagtcctagagaggttaggcaacttgctgaaggtcacacagcttataagtggcatatttaatcaacctaggcaggcagtctgactcaaaagtctgtgcttttgatcagtacactgtactgcttctcagtataagtataataagcaaaagacagataataaaaatcattataacaataattaatataataagtaaatattactgaatatttcctctgcatcaggcactgtggcaagcattgtacattcgttgtctcatttaatcttcccaataatttgatgatgttgattccattttatcccacttcaaatatttagaaacagacttagtttctaaacctgccccagtgttatatagctggtaaacagcagagccatttattgttggggtaaaccctggagggcttcaggatatctgaaggccaccataaatcactgtgagagtagcagaaggcaatggaagttagggatggcaggtggatcagctggttagagcatggagttagtgaatccacttcttgtcaattagttctgccctattccaagaatacagccatcaacagttagtcccagagttggtggcattgttggggaaagagattgcaatagactggtgcagatcagttacctgaagctcctgccttatctgtggcctggtgatgctgctgtgtgcccagaagccagtcatatggatgtcttgacctgtccagcacacacctcagtagtaggagatatgggtctttggaatgctttatgtgtgatgaggatgaaacagttaagtgctactttctcatcctcggccttatgacattagttagttgtgtaagattttgcagggaggtattccctcctctaccctttcgtcacaagcccctctcattcctctgaaaaggttccatactccagtccctaccctcaaagaaagattttactaagcaaaagtatctatggctctctctgttctccttgctttagctagcacagctaaactgggatctcaccagtctgacagggcaacctccaagattcacaacccaggaaaagtactgctttgcgtaagtttaatcaagaccaga

SEQ ID NO: 56755 - DNA, 1034 bp, Homo sapiens
gaccatggaaccttgggtcctgtgcatctctgtgaaccaccaagggtacatagggccttatttcctgtgtcgctttcacccttgcacaggaggatttatctgctgggtatgagacaggtctttgtgacattttaaaaaaatcataggactatactgtttcaaaggaggcccaaaggaggtttgaatagcaaaattcaaacagtacattgatggtacataaaaggaatactgggtatactatgtagtatgtttttgttctatatactaaaacctgtttacctgtttgcacataagtaaggctatcttcatattgactagatgataaagctcaagtgtaaaggaaaccttaatttgggactaaggaaacagggaaattaagtttttaatatatccaattaaaatttttaataaaaatgtttaacagtcttatatttgaattaattataagattttttctgttgcattaaatcattttatatcttatgctaaacttgaccgactaaaagaaaacaacttttatgcaattaaactatttgttttttaaacagacccttttgtgtttgctgaatcggcagaaatgttctactaatttttttctgtggttgactaattagcaaatggattgctgggctttggcgtatgcatgcacatatttacgtaccaaatattgctatgttgtgtaagtgtggattcattttgtatgtgtgctctgtatttttcactacatgtttgctgactgtgattttaatggacatttgaatgcatgtgatttcagtgggtgtgcactttacatacatttcaaatacgttggatcctaccactatgtactttggagttatctcctttctcattttctccaagaatttagttgtaagcagtatgttactgaacattcagattcccagtaatggcttgaaggaagcatttcttgtatacaatgaacccgaatcaacttctgtgaataactcatttgcatttttaaaatacagaaaatataaaaactacaatactaaattagtcagctacaacctatt

SEQ ID NO: 56756 - DNA, 1038 bp, Homo sapiens
tggactcatagggccagaaggactttttggtaaaattcctttttcatatgattcacatgtatgccttcattattccaaagaatgtcagacagattttcaggaatataaattgctatttctgttaagcagcctcctcaaagcagccagaaaggtcttttaagtcaaatgtatttcagatccaagagagcaagaacaatggtatactaggtcatatggtcttttggccctgccatttaaatataatatctgtacaaggaagtaactgcaggagtagtctgtatattcctgttggttggctggtgggaaggtagctaaccttttgtttctttctttttcagtacactgctttaataaatggtaacagtgctttaataagtcccctggccatcatcttacttatgatctctagatgaagaccactgtgtgaaactggtatcctaggaggttggagtgagcatgtatgagtgagtgtgtgtgtgtgtgtgtgtgtgtgtgtgtgtgtgttgcttgatttataaaccactgaagcccgatgaagtactagggtgaaaatcacctacgtttccagaggaaaaaaatgtcaccatcaattccaagagggacttgtaaacctgaaactaacagccaatggtttaatttttttaaggtagattttttttttaacatttctaggcttactatattctatctggaaaaatataaatttatgggcaaaaagaaaagctgagagtcgtagttttcatgggagagccaaacaaaaaatacccattattgaaaggcagtctttcagggattcttgaaaagaaaggtaacctttcttattcatagtgcagttacctcttgagaaactgcagattagggaaacctgtagatattttattctatctcaggtagggaaagacaagccttcaaaggcttttaatgacagggtatctgtattacttacggattggaaggcccatcatgtattcaatatcaaggatcacaaagccaggagtggtggctcacgcctgtaatcccagcactttgtgaggccga

SEQ ID NO: 56757 - DNA, 1023 bp, Homo sapiens
tcaaatgaagactggaacatatcaccctaaccgcatgggactaggatggggtgagcactggggcaggagcagtggtgtgtgatggaggggtggaggaatctttctccactccaagatgggatcagaaatgtaggaggaagccaaaaagagcaagctcaccactcttggcatattttttccaccttgacattgatagctagacctcactcctggttgggaaattttctaagctaccaagaataggaaaaaaatcaaccataactaaagccctttgagatattcttccttgtcttcatgaacaggacaatattaaaacattacagaaagtctggaaaacaaagggaaaaaaaagctgatagccctgcccttcaaatatacaactcattgcatttttagtaatgccccctttcagtttttaatctatttgcatatataatatattagctagctaaaattggaacataaacaatatatatcttgcttattcatcttacaacttaatacagaaattttctgttactttattactttttataattatttttaacaactgcttaatatttctcagatagagttttaagtattattaccctacaaataggtgaaagtaatgatgaatagcatttagtatagccagtcctggatagacacagaaagaaaatgatacatttttgtttttctcctccttcaaattctgccaaatgccactcatcagcaatataatagtgaaataaagtccatattcaggtatttgatttggagttgctggagatttttggtagatttaattcttcacatgattaacccactgttattagcaaggcttggaccctttgaccacaaaaaaactttttagaagtacagtagctgggggatgattggatgggtgagtggatggatggatgggaggcagagcaaaagggagagaatgaatttgtcattgatcaaagcactgtgcatggcttaggagaaccgtggaccaagcaggcccgtatagatgatccaccctgtctgatggtgatt

SEQ ID NO: 56758 - DNA, 1609 bp, Homo sapiens
tggaacatttgcaatgacttccaaagataatattcttctaatttaagactttggtttggtttttataagccaagttgtctttattataattctcctgtgaattggtcttctttgggaaggaattttctagcactggaggacaggtttccatatagttataggttaaaatacccttcctccaccctcacctttccagcttaattgcttctgtcagcggccacatatatggttgtcaacagtttacagacagtgatttaaccctcagttttagaaacatatagaggtgatgtcttgacaaaaaagagcaagcagtataaagatgtacatgtagccctacctacttccatgatttttgtctctgcccagcaagagtcagtgttatctttaaaaacaaattgcttctggtatatgtgcgataacatgtatgtgtgagattgtgcacatgtacatgtgcagtggagtgggcatcaatgtattttactgattgaagaacacagaataatttctattctcatttgttttggaaacttggaacaggaagagggaacttggcttcatcaatgaagatgattggctcccgataatggctcccttctggtgccagatttaaggcaggaaaaagcaaacagctgttcaaaatgactttcacctagtaaacacaggagagaaggcagctaacacttactggatgccttctgtgtgcccagctttagtctaattgctttacacatgttaactcatttaaacctgatggcaatcctgtgagataaatgtggttctccccagtttacagatgaagaaacaactgaggctttgagaagtgaactgactctcccagagtcagacagctaacaagaggcagaggagttggaatttaacttaggtctgtctcattataaaaccatccagtttccagggtaccatggaaacttgtgtcactgtgagtcagatactctcattctgtcagggtgtgaaatgccccttaaaatactgttatgtgaaatcatagctggtggctttatgcactatcctcactgactctgctaaccttgtttgaataaattaaaaaatatttatgaacatgtaccatgcccctagcaaagttctaaatgccgttgggggaaaaaagaagggtaaaatatggtccctgcccttggatgggtaactctcatttggcaatcagaaaagcagtacatgcagcagctgatggccatgatgatatttaataaatttgtgacttgggtgacaacagaaactgaataactgtatgacatcattcaagcacaaaatccagaagctgagaagggggagattagtatatgctagggtgaagggaatctagaaggacagtttaaatgtggctgcatggaaggctggaaggaagacttgagagaaacagctggactgagcagtgattgtagaaacataaagtgtcatcattacagatttaagaagagtaacatctgcctggcactttacagtttccagagcactttattttcttatttctattttctctcacttccattattattgttattaatcatcatcacccctgctttacctatgaggaacaccaatcaagtaccatcccttacacatattgtgc

SEQ ID NO: 56759 - DNA, 1353 bp, Homo sapiens
cagtgtacccaatccactctgcctcatctccccaccatggacctggaatgttgtcaacctacttgtgtgagataagaaaactctcattaagaaatccattcatcacgcctgtaatcccagccctttgggaggctgaggcaggcagatcacttgaggccagtagttcaagcccagcctgggcgatatggtgaaatctgtttctactaaaaatacagaaattaactgggtgtggtggcacacgcctgtaatcccccagctactctagaggcttaggcatgagaattggttgaacccaggaggcggaggttgcagtgagctgagatcacaccactgcactccagcctgggcaacagggtgagactctgtctcaaaaagaaaaaaaaaaaagaggaaagaaggaaagaaggaaggcaggccagccattcaaattgattcgaacatcagattctttgaacttgcacatgtgatgtggtttgactcccttataaatacatcgaatttggtggcttaaagctttagagtggatcatgaagaatctcacaggggtcaaatgagactctggccccaaattatggatctgtacttggggtacattttctttcctggcccctacaaaggtgagcagaagacacatttcctttggtgtcagaagtggcttcatctttgtggtcctgcagggtaaagtgtgacacaagagaagacttaggtccagaagatgctatacataaagtggggaaagcaccttgcccctaatgaaggcccctgagacatgcactcttttctgcccttcacatgatgaagtctcactttgacatttattaaatgggcccggtagaaccagtcctctcctaaggctgttgtaaggaccagatgaggtcttgtgtgtgctgtacaaatgggaatgacaccatcataaccaggaagattgagttggagttggaaatctagggagcatggcaaatgtggaccttgagccaacttttattactgtggcaccaaatcatttatgaataacttatatataagtgatgaaactctatagtactaaaaggaacttggttccagtcacttgccctcatgcccttactccattttggtctataaaaaaagtcagtgctcatgttgattcccacactttctctctgcttgcctgcacctattccagttacctaccttttgactccctttttttagctttcagatggtaactgacttgagaccagtacatccctgcacataagcagacagtccatgcttatctgaattcctggtgtaagcccagggtagtgcaaagagcatggacattgaagaactgcacttgcgtaagctgtaactttgaacttattttcctaa

SEQ ID NO: 56760 - DNA, 1119 bp, Homo sapiens
ttctccctaaaaaccttgaagatatggaatacttcctgcctacatcttcaactcagagaccgccaggggatttcagtgtttattgcttttttctctgggtttggaacagttccgaccaggtactatttgaaaaatgtagaagtatttttttgcttattatcaaaaggagaatgtagttttcttgcaacaaaatgagaacttgatatctttcttgcctcgagggtgtgtgttgggagacgggggtggtgttcagccttctcttcctccacctctgtatcctggtagccagaattgaagttccaagccacaccaaggagggtggctgcctttcatgaaaggcagacatgtagtaattacctttttgcctatctgccgccgtccccttgtgctgagggggttcccttgccgctctgtctgttgtctgcacactgcatttgtttgtctggaatgcagaactccttgcacttgacaatcactacagtctttctgctttttctcttaaacagcttttttaaagcacccagagacccttaaaaaaaaaaaaagaatgcaaatagaaattgcgctggaagctgaactgaacattgttgcgagtcatgagatcccagccacactgggacaaactattttttattttgggtaatattttttctttggcatttattacacctctgttaaacacagctcatgtgacacagtgttactcataggcaatcagaaaaaagctgaaagttgagccattagtagggcagggcaacttattgttaatagcagccattaaagctgaaaggaaaaattacccatctgcccccgccagacctgtctgtctgagatcgagattgggcctccaggccggaaggggggctgggcaaacatgagggaaggagaatggaatgtagaaaccgagatctttgtaagggaagatagagctgaattcaagtgtgggccctaccccaagaataggggggaaaaaaatcctgccccaagaattccagctgtcctttgtctgttcatcctttctcaggaaagcacctgatagcttttatccaaagatctgctgcaaaatccattttagctacagacaggaaatgcaaaagaaagattcctgtagcaacaaca

SEQ ID NO: 56761 - DNA, 1039 bp, Homo sapiens
accgaaagagaaaagcaaatttggcttctaagatgaccatatgtctgttaccccagaaagcatgagcccctgcaaagttctctgctgaagtggggagagttggagcctcctgtctgttctgcaaaggatttgcagggtgcttagcatgctggccccagtgtcctcatggaaatacggatggcttgctaggggctgtcccatacaaccagagtggggttcaatgaagtgccatcaacaaggtgcctacgaagggccatgctaatgtctggccagtgaaacaggggaacttccagagcagatatcacatgggttggagagatgttgctttacacagtgagcaggaaagccagacacctcttcagagaaatacagtaagaaccacagtaaataaggcccagcctcagggaggcagatatttaaaggaaaattaagacggctcctcatctatctctctgtcacccgttgatgcatttagccagcatcttgtggtgctaaatgctttttgatgatgatggttcatgatgaccactgtatctccccacaggggtgggcgcctccgatgtgagagttcttagtggggggctccatctccagtgcacagaaagaaggaatggtccagagaccccctgctctccccaaattcccgattttaccagcatgtaaaagcaagtggaggcaacaaccaccacaaaaaagcccgtctgaaaatcagagcctaatcactcccatctgctccagtgctgcttcctctcgctgcctgccaggatgtttgccgcagatgctaagtagcacattattttcgataagttgcaatcatttacttgaaatctacttctcctttaaaatgtccccctggaaacttgaatcggcagtcgagaagccttgttcaggatggaatttgaatgctcgcactcaagttcaagaaaagttaaacccatttgacctccaggtgttgatgaattgtaaatttcagccccttagactctgttgagaagagaggaagaggcaccagggaagacgtctgggagaacagagccat

SEQ ID NO: 56762 - DNA, 1194 bp, Homo sapiens
ttttgaaatggacctggggcacccataaatagacccagtgtccttcagctggagaattctgcttccactaaagtgaacagaggtgatttctcctctaagtagggtgcattgggatctctcttccaatcctctgtacctgacaaattgagcaggctggttagagtaaaaacctgattttattagtatagtgtaaggaaacatcccactacaagatatagatcaatatatgcagaaaggcaaattacaggtactcagcctaaagtaatttgttagaacttggtctcacaggtttacagtttagtccaccttagaattcccttggtcaagatagagtcttctcttctactccctcatcacagaggctcttggctggtttccatatacagccactcctcaccacctaccactgtattctcagtctaaactcctcaagggcacccgataccctcactaggtgatgtctttccctgttccctcatcccggacttcctgggccttcttttgcctctgctgatagccgtggtagtacccaagagaggcccctctaatgaccaaggtctctttgatctgttctaaaacctcctctttttgccaggagttccccacagtgactactcaggtttttctgtgacttgcctctggttattaaatctgcctttttctaattttctctgtaatactctacatgagatcactgtgcaatactctacatgaaaacactctgccttctagatttttatcttatttttagaaataatttgtattagcttagattggttaagctgtctaaagcaaacaaaacaaaaccctctgaaaaaccccaaaataacatggcttaaacaaaatacaagtttattttttcccttctttcttatagcccaaagatgactggtgggctggtctccagggtgtgagaactcccatctggcttctttccctagagtggcttccagtgcccagcccagctcatgggccgggggatgggggagctgcagaagggatggagtgatttagagtactgcaccttgttgccctactctaggctactggtaaccctggctggaatttgctgtttggcatcagtgacatcatttcctctgtctgtccttggtctgcacacctctgtctatggctgtcacctggcagaggtttgcatttcaatcttattgggaaggaatcctggtctagcaggga

SEQ ID NO: 56763 - DNA, 1058 bp, Homo sapiens
aaaagcaagaaaggcaaaagtgctaagtgagctaatttaaagatgaaggccacacaacttcaaggagggccaaccagcccctgcattgagcctgcaactccctcaactatccacaggccttcattgtcaggaagcaataaagtgattctcactttaaattagttcaattagcactttttttttaaggcagaaaatgcttttattaaaaaaaagtgattttctcctttttggcaacctgtatatgaaaaagaattctgtgggcttttgttttaccatttagcagctgttcttgcttaagaagtgccacttttctccttttgagggatgtcaagctgttgggggttaatttcagtcagttctgtgccctcttccccagatgccttttaaaaatgttacatgcatttacatggggatagaatggaaagaacatgataacttatttttaacttatggctgcagaagctctgcataattgtgaggagccaatttgtatagaagagagagattgggttttgtagtggtcagacctgaattaataccttagctctgttacataccagccaagtgacctttgagctcagttcttcatcggtaaatacgaataatcatatctgcctcagtagtagtgaaaaatgaataacttgaattgattgccaagagggaggggtcaggcccagtgcctggaacctggtaggaagaaagaccaagttgtagcagctgccacgtgttgggcgctgtgctgagtgctgtctttgtgtggtctcatctcttccctactctcaccctgtgaagtcagtatcaccctcttcactttcacggaagaagctgatcgaaatcacccagctgatattcaattgaccgaggattcaaaaccaagatggggctgggcgcggtggctcatgcctgtaatcccagcactttgggaggctgaggcaggcagatcatgaggtcgggagttagagaccagcctggccaatatgatgaaaccccatctctactaaaaatacaaaaattagctgggtgttgtggcacgtgcctgtaatcccagctactcaaga

SEQ ID NO: 56764 - DNA, 1040 bp, Homo sapiens
acaggggaggggatggtttagcaatgacatatttagaatccagttgaatagtttatgtgctctatcatggtggcagaagtaccagtgaccagcccatagcctccatcttgtggtcccctggccaaccctagaattttagaggcatagaagagagatcctaggtctagagactacaatccaaatagactaagttgggaagaataaaggttccctttcttggcttgaagttgccaaggggaagcagttctattgacaacttgcagtaaggtatggcttcacataacataaacaatatgcaccctttattgcttgctctgttcttcatgctactaaccagactctgttgatgttatttttattttagtttttatttggggggggttgctttgcatgtcattcttcctcttggctgttagttgcggggtttgagccttttcctttctgtgattcaggtgcctcactctttcctttccaggttcttccagttcttttaacatgtcaaactctggagatttgttcatgagcgtgcagtcactcaatggggattcttaccaaggggcccaggttggagccaacgtgcaatcacaggtagggacccagccaatatgtcaccaggtgaatgccttagagtccaagagccctcagttgtattggacttcctgcttctgtccagagagagagagaaaaacagatcagaaccaaaaccttaccaacgaccgaaccaaaatcaagacaaccattgtcatggggaatctcgtccacactttgtgaatgcatttggctctggcttttcagttgtacttggaaggcaggagaagaacagtaagcacagggcaaggtgaccgagacacatcaggcaggtggaaccagcatattctttattcaccaaagggaaaaggaggaggtgttcaggatgttacctcaatttccaggtctccctctcatgtgttggtttctcctgctcaatatttaccatataaagaggcaattaacaagcaagcaaatatattactatcggacgttttcattttaagctttaa

SEQ ID NO: 56765 - DNA, 1592 bp, Homo sapiens
cgcatcccggctgaccctgtgccccagttggggcaggggcaggagggagggtttctctcccaacgctgaagcggtcagactggaggtcgaagcaatcagcaaacacaataagagtctccttctcttctcttctttgggatgctatttcagccaatctggacacttctttatactctcttcccttttttttctgggtagaagccacccttccctgcctccagctgtcagcctggttttcgtcatcttccctgcccctgtgcctctgtcctagactcccggggtccccgccctctctcatatcactgaaggatattttcaacaattagaggaatttaaagaggaaaaaaattacaaagaaaataataaaagtgtttgtacgttttcatgctggtggtttgaggagccaaatttacctcactcgaatccctcactccctatgttaacaggcaatccttctctgtttctcttattactctcactacctcttagcaggaatactccacattgccctattcattccaggcctccctgcttcctcttgctcttcctccctggggacagtactgattggaacactttcctcctcttccttcctagccccagctattcactggggactgtcatagctgggattctaaaggtgccacatttttcagtttcatctccactaggttggttcccgggcaggaagtcaggcagcagggaaggacacgggaacagcaggtggagaattcctacagtctttcttaccctgctagcaatagctctcagtttcagaggcacagtctttggagaccattcagcactgagaaagcaatatttagaacctattgcaaaactgggcctgagttaggcatggtgatgaatgcatcagcaaggaatagaaagttcttatcgtgaaacccttcaacctcaactatgccttcatagacacacacgttcatgcacatgtaggcacatgtaccatctcacatcttcactttcccgagatgccatatacaattacctacattaataactgtagcactatgccttttgagcccgagagagggaattagtgactctaagtgaaggtcactgacacagagaagcagtatgtgtctggggcttccaggacctgcaggcccactagcgtgcacttaccagaatggcatacacaggacctgatcatgaggaagaccaggtttccagtgtaaactactcttgttcccaccacctctggagcactcagggagccccatacagtacttacaatgtctttaatggacttgattctgtttaattttttgttttatattaggcacactgtattaattttccaaaatgttataccacactatgttcttggtcctgacctattgctctggaggaaagagttgtataagaacgtggctcatgtgaacttttgctagcttcatttgaggacctgagaatcatggggaaagggaaggtaatgttttcattgaaatcatcacagtgatttttattccctgggaacacagcgtgtactaaaaatacatgagaaaatagcatgtatatgaaagctattctcaaaagtcacctgagctcaccatcttcatagccaaccctac

SEQ ID NO: 56766 - DNA, 1063 bp, Homo sapiens
ctgtaccactgtgacctctgctgcttccttctctggaattcctccagcccatgaccttctctgggcttttcctttgtctcaattggagtcaagctcaaatcctgaagcaggccattgttggtgcagagggcagggcttcttccctgggcaccactccccacaaagcctcccttccttctgccttggagttccaggccttgaataactggtgctgcttcagtattagcagaaacattcctttctgccctccccttgagatttgcacctgatgtttctctcctattgttcctcaaatccttttcagcagagcctgcaaggtttaaaatgttctaacctgctcctttccctggttccatcccttctctgtcttgcatagggctcactctctgctgttgggcacagacatttgttttcctaacatacttctctaaattatatttttaattttttttcaatatctctggatctgtccaaagcttccactgttcagctttaattccttgagttgagtaatgcttcataggcggagtcttcccaggagcacacacccaggctcagccattacatggctgtagtgtgtttccgccctcccaggagccctcccttagagcccatttcctatgctacaccttcagaacacatgacaggtctgtttctctatacatataactgctatgttggaattcactaataatccttcaagtattttcctctgatcttcttgattttcccctctcaaatgtgtccaccttttctgttcgcacctagtgaagtcttctgaatcaccagtgagaacatttccaattgctgccataactggtcccctatctgctgctttgggtgctttctggatcctttggtattgaggaacacattggttgctcactagatcctaaaagcaagaccacacatacttgaatcccagctctgctactgccaggttcttcctgatgccacttctgacaacagatgagaagttttcttccaattccccaaaaccaactaggtgtcctacaatccaactcaattctgacaccaactacccggaattagcttcagactc

SEQ ID NO: 56767 - DNA, 1059 bp, Homo sapiens
tgatgacattatttgtctgattattttcaaggaatggcagcatctttgaggatcttggagtcagagaaattcagacaccaaaaagtcgaagagacttaagagatcctttctacctttttgtctgactcttaattctcctatttcatctccttgaaatgtgtcattgatcatctgtttggaacccactaacaatggagagcttaattcaacatgacagaggggaggaaccagacacataaataggccattttaataaaatgtgattaatgctataagagaactgtggagtggcaactatgggagtggtcatgaggagtggcctggcctggaagtctacggaatgaaataaggcttccaagggaaaatgacattgtgctggctcttgaaaggaagaagggagtttggcagataaggggaatagtgagggagtgagtggggatcattcagaagtgggcaaaaatatcaaatatttagcagttatgtgaatcatgtgacaggtgtctcagtgtagctggagcatgggccatggatgcagggatattgacagataaagcacagcccaaactggaaactaccccatgctgaggagtttggattttatcctgaagttgaaagggagtcatttaagggttttaagggattgacaggatcaaatctgcatttaaaatgaactggaataagaatggaatctgggagaccccgaggaagctagtgcaaggcctgacaaagagggatcaaggaagaaggagagacagcagtaaaagttaaagattttatgagaatgtgggtgtggtatggatagagagtgggagaagtagagggtgatgcccaggtttctagcttgggtactttggtacctgaaaaattatgcggggggaagcagagcaagttctatgccatcactggcaaactccaggtgtaaagtgagtcttcttgtattgatctgaaaatgactacaaccctttaaccttctcagggatggtcttagtctctcctccataattataaatagcaatgaacattattttgtgaatgtactaagttgcaaataaatattct

SEQ ID NO: 56768 - DNA, 1008 bp, Homo sapiens
gtgacaaggatttagttttacagtgttggattacggaccaaatacaacatgacttggataatttccactttgctggctccttagctacaagtaatttattttaaccttcttccataatgccaattacagctgttagcacatacttcaaagccagtattcaaagtacaaagctatagttaagatttccgaagttcctgtgctgatgtgctgggcctggggggctttaaaccaaggttggaatgggtagagatgaaaggaagtagggcttttcctgaatattctttcgttagtgtggatgttgggagaggggagtttaggaaggtggctggaatcagcccaaaggagggagtggccagaggggagttgtagatgtggttcgtggggacatccccttcataaacataaaagttgtgacttactagaaagactttcactaaacagggaggggtagagaacagaatgaaagggaaagatgaagatagagaacagccctaatgagagaattaattgataagacgtgccttgctgaacatgtcaagagagacaagcagtgcaactccagactgtcctgtcttgtataggtatctgatcagtcacctaacctagggtctgggaagcaagagaaggaagtatgtcaccagtctagtaggagcctctggggtgttggtgttcagggcttctgcctgggatgaagtggggctgcctgtgattgctgtgctccatctgatgccaagtggaagccatccgccactatctgctagttatgccctcattactcagataattctaataattattgggtgcttagtatgagtaaagacaacatgctggctactgtagaaaacagaaactgctagttttgcttaaagagagatgctggaccctagaaatcttgtggatgtggagaccctgaacatctgtgttctctcttcgttcaagccctgagagactaaaaaaagagaaaagggatgggatctacagaatgagaggtaataaaaaaaaagatat

SEQ ID NO: 56769 - DNA, 1037 bp, Homo sapiens
agcccccagaagaaggacaaaaaggcaagcagaatccattttctttctctccagctcccagggtttgctattggtgacttttgtcctgggagcttgtctgcacatttggcagcagaactgttgaatatcatatccggagcttccagcataacttccatcgggaccagccagcagctgtccatccattccttgcataacccctttccaagttttcttctgaactgtgttgtattttcaaacaagtctcagccttagctagaaaagatcccactgtgcccccagtggaggctgatttccagaactgttgacatccctcttgttttttacttggcctagctggatcaaaaagtgataatggaatcccagtttttaaggaaactgagtattcctgtattgtattatttctctcaccattgctgaaattttattctcttaaaactagttctagtccattttggagagatgaaatatgtgtctgaatttaatgtttgtaaactggtatttaatgaaactagagatttcaggtaacacatgagcaactggaatgtactttacctagttgcatgtggaattttctaatttagagttaaacagactcttataaacagttggttcattaattaaatcactcattcattcatttaatcatcaaacattcgtattaaattcctgtatgtgtcaggtatgtaaaaatgaataaaacaaatcactcatgtactaaaggtctagcagaaactgtttagacatgtaaattaagcagatgctttgaaaaaagaataacattattttaagaaaggcatggccacagggatagaaaaccaggttatctaaattccttggttctgtattactatgtgctattcatcatcttcaaggcacttattacaatttgaaatatatatatatatatatatatttggtttattgtctgtctatgtcactagaccataagctctatgaaggaagacacttcttgttttggttttgttttataatccctacatctccataatcttgcatagtatttagtgaatgca

SEQ ID NO: 56770 - DNA, 1069 bp, Homo sapiens
ttctttcctctccattcttcctgccccatatttccctccccatcaattttgaacacatccgaatctccgatttgattatttgaagaacaataataagaggaggttattctcttttctatagctgtccatgatggctaactgaatatttccttatactcttaatgccaccaaagccactaaagaatgtcactccattgaaagttccaggcacctagaacttacctagctgaatggctgatgttttcttgctctcaaaaaatatttcccaaatcatgcagacttggccattgccataatagcacaccagccacagcccgacagtgttttctctgctatgcttattctagttgaaagtctatgaggttcatttaaatattgaaaagccatgggaatgactatgtcacacagttgaaaaattggtcccatatttctctaagacaaatatttcagaactgagagcactaggttttctgggcccaagataaaatcctgtatttatcattgctgtgagttcagcaatgtgaaaagccggcctgtagtatggtcaaccaatgaggcaaaggctggcttttcttcaggcaggctatctgtacccatcatttcatcttacagtggcttcctctgaactgtaaactcctgagatgctggaaacctaagtaaaacagaattagaaagtcatgtcatttctgtaactcaatgacatcacatattacattcaaagaatcagacacaaatatgttttgaatgatttgtttccttatatttttgaagttctgcaatttcaatcaatcaagcatagtgcctggtattaagaagacttctacctagaaaaaggattgtgattgattcatgatgcctgtctgaggatgggcttggtggctctcctgacctaaattagccacccctgcctggggtaattgaaaactgcatgtgtggacaggtaataagggcaatgaaatatgcaacaaattagtctggattaagcaaaatcaccttctttttttttttttttttttttttttttgagacgggatctcgctctgtcactcaggctagagtgcaggggcat

SEQ ID NO: 56771 - DNA, 1156 bp, Homo sapiens
tgggcagtgtcttgaactctgagtaatcagagggaccttcagtgacccctcaccaacatgagtgggtaggttaagttactaggttgctcttataggtgtttaagaaatggtgaataagcctattgtgtaaagttttaaattagcatcagctttcaagggtgtcaggttgattattgtagagattgcctttaacacttgatataaaatccaagcatttttcagacctcaacccagaatagtagatacctgaaattaagattcctattggtgagaaacaagatctgtatatttccctatccctatccccaaatgccagtgggtcattttccccatgcctagctccattcacagctaatatgtggattgaggctttattccaaaacatttaggttctatattcttccctagccctgattagcagtgctcatctttgaagatcattgtgacttttcagactattgtagtgatggctcaacctgaccccttctcctcctttcaggatttggcagagagaacggccgtgtgacaatcgaatattattcacagctgaagactgtgtgtgtggagatgggtgatgtggaatctgctttttgaaaacctgcagtgaaacctattgacatggccacgctgtggaatgatgtgaattggccctgtttacagaggcagtacaactgaatgttattttacatccagaattttggcgttcagtataagagaatggttcatgttactctttctctctccatcagcttcctcactgaaaatgtgcattaagtgccttgtagatactaatcaagaaagctgtgattctcctcaaagcgtatttttgtgaaatcttttaagagccagtaacatacttctagagaacaggaaaagagactaggataatacatcttccacacatttggcccactgataatgttaattctctggcgtatttcaaagaacttgttcctggctgatccaagtgcagtggtatttacaactaattgatcacaaccagtttgtagatttctttgttccttctccattcccactgcttcacttgcctagtcttgaagaaaaaaaacaaaaaacaaaaaaaaaccttgttcctttataggttcctggtagaatcagtagagatgatttcagctcattgacatttttttaagct

SEQ ID NO: 56772 - DNA, 1047 bp, Homo sapiens
cagctaaaggaatcaaacctgttaccttggaacttggaggcaaatctccactcatcatcttctcagactgtgatatgaacaatgctgtaaagggggcgctgatggccaacttcctcacacaaggccaggtatgtacctgtccctggaagaggtgtaaaaggaatctctaccccctcatccaacagtgtgttttaaagctttttgttttacaatactttcagacttacagaaaagttgcacaaatagtacaaagaattcccatgtacctttgaaccagatttctcaaatattaacattttaacagattcactttatcatcttctttatctgcctgtacatacgtaggcatattaagtttttctgaaccttgagagtaaattgtagacataaggcccctaacctctaaatataaagttcctaaaaacaagtgcattcttttacataagcacggtacacttagtaaaattaaaaaattaacattgatatagtactgttactgaatctatagcccttactcaatctatagcccttattcaaattttgccacttgtttgactaatgtcctcatagtaaaatagaacaaaaatggttttttttccggtctaggatccagtcaaggatgatgcattgcctttagttgtcttgtctttaatctcctttagctgagaacagttcttcagttattcttgtctttcaggacgttgacattttgggagaacaggccattcattttgtagaatgttccttagtttgggtctgtctgatgttttctgttagattcatattatgaatttttggcaaaaataccacaaacatgatgtcatatcctactcagtggtgatttaactttgatcacttgctttaaggtaagtcctcactgtaaagttactgttttttactttgtggttaataagatcttgtaggaggtattttgagactatcctgttcctcatcaaactttcatgcagtaaatacttctatcaccactgacgattcttgctgaaaacaatttttattatggggttgcaaatggtgattttccaattc

SEQ ID NO: 56773 - DNA, 1024 bp, Homo sapiens
catgtgtttgaaggataggcagggttctctatgtggagagaatacgtggaagccagtggaagactgcctggaacaaatagaagaatggagacagggtgagcctggtgtattgggagaagtggggaggctgcgttgactggagtacaagtcagactggtacagatgttggtgaaatcttggggagcacagacctgcatcctcctttactcctgttttccccataggtgaacacatccagctcccaggtggatcgtttggttataccagaagagaaccacttggggtatgtgtgggaataggagcatggaactacccctttcagattgcctcttggaagtcggctccagcattagcctgtggtaagaatgaattatccctccatttgagagccattcgttcattctctcgttcgttctctccccattctctacctttcacctctctataaacacacactttaaatcggaaggggcctgctctgggatattcaaagcctcagaggacatggctcgttcctgccctgtcttgcccctcaaggagcttatagttaaggttgtacacaatcatgtctagatattctcaggttttatttatttaattttgtatatgaaaagaaatttaattttttcttattaaattgaattagatttgtgctacttataagttctcttcctttctggacaagaattttaaggtaggagttagcacttaggagtttgacttcatttacgaagcagaagataaactcctttcttcatttgggtcttaagagaaatgataagcaaggctttgataagcttcttatcaaagaggagctttggctgattgacataaaatagttttcttacagtatttaaagagaagaatctttgaggaaagaagactaattttatcttagaaaaaattgtaatgttagaaagcattactgttaggacattatattgaaatgcagcttttgtcctgttgccattgcatgttcttgttttagcctatttctctttgagatacagctgtgaaagaggaa

SEQ ID NO: 56774 - DNA, 1046 bp, Homo sapiens
gagatgaacccagtacctctgttggaaatgcagaaatcaccgtcttctgcattgatcacgctgggagatgcagatcggagctgctcctattcggccatcttgattctggactctgatagttaaactttttatagtcttaaagatcagaagtaccagatgttcattatagaaagaaaattcagaagagaatacatcaaaataagaatcatggatagctgagtggtaggtctgtggtgactttttgtcataagtatgttacgtcagaaactgtgacgggtctgagagtttccctgctttcaagagtgtgtgtgtatatgtgtatatattacatacatatacatataaaacacatataatatacatatacataattatacacatataagctatgttatacacatagaataatatataatctatataatatacatatattctatattatagttgtaaattacacaattatgtgtaatatatgtatattttatacatatatatattctagcaagagacatgaggctttttggatcacagagaaggatggtttattacagcaaaatgcagcagccatagcaataccttagcactaatttctgtttatttattattattttttttttgtgatggagtctcactctgtcacccaggctggagtgcaatggcacaatcttggctcactgcaacctccgcctcctgggttcaagcgattctcctgcctcagactcctgaatagctgggattacaggcacatgacaccacgcctggctattttttgtatttttagtagagacagagtttccccatgttggccaggctcgtctcaaactcctgaccttaggtgatccgcctgccttggccttccaaagtgctgggattacaggcatgagccactgcatccggcctagtttttttgttttcaaagcaccggtcaccacggtgagtgaggggatgggatgagaaccaggtgagatccctgtgcatgcaggaagttgcaccaaaggagaagaaccctaaacttctgagattcatttaaatagaaattactg

SEQ ID NO: 56775 - DNA, 1522 bp, Homo sapiens
gaggtgggcagatcatgaggtcaggagatcgagaccatcctggctaacatgatgaaaccctgtctctactaaatatacagaaaattagccgggtgtggtggcgggcacctgtagtcccagctactcgggaggctgaggcaggagaatgacgtgaacctgggaggcagagcttgcagtgagccaagattgctccactgcactccagcctgggtgacagagcgagactccatctcaaaaaaaaaaaaaagtgataatcatcctattgcaggtcataatggttcctttaatctatatgagtatgagttccctttgcctgagagctacataaaacacatcttctgtatatttgatattaaaacccaatccttactgtgctttcttcacagaacattcagaagattctcggccttgccccttcacgagccgccaccaagcaggcaggtggatttcttggcccaccacctccttctgggaagttctcttgaactcaagaactctttattttctatcattctttctagacacacacacatcagactggcaactgttttgtagcaagagccataggtagccttactacttgggcctctttctagttttgaattatttctaagccttttgggtatgattagagtgaaaatggcagccagcaaacttgatagtgcttttggtcctagatgatttttatcaaataagtggattgattagttaagttcaggtaatgtttatgtaatgaaaaacaaatagcatccttcttgtttcatttacataagtattttctgtgggaccgactctcaaggcactgtgtatgccctgcaagttggctgtctatgagcatttagagatttagaagaaaaatttagtttgtttaacccttgtaactgtttgttttgttgttgtttttttttcaagccaaatacatgacataagatcaataaagaggccaaatttttagctgttttatgtacaaggagagatctgtttcattttgttttgccgtatttctagatataagttttagcatgggccaggaaggactaaaataaaagtttttaaggtactgtactttttgccatacttgactcatatactcaaaatacagagttgtcttggtgtaggaattggaaagcaagagtggaaaggaacgtaataactcgttggagtttaaaaatgagggtcttggcaagtaacactgatgtctgaaaaaaaattaaatataaataaataaataaaaatgagggtcctcagctgttctcttcatatcctattacagtctctcagattcttgtgggggcactcttagatctcccttggagacaaggttatagttatatgttgttaatctcgcagagcttccttttagtcacaatagccttcattttctgccatgccccttcataagggagaaggatgtttgtaccatgatcctccccgcataatctatggaattaggagtcctgtgtggagtcttatcaataaatatgcacattcatcaaatgtctacttaaatgtgagtattcta

SEQ ID NO: 56776 - DNA, 1130 bp, Homo sapiens
gggaaatctgtctgagaaaaatggaagacctaggtttcacctgtgagactataggaatttaaacagattagtttagaatttcacgaaaggataaaattgcatgcagtaaatgcagaatgtttgtgttaaaatacaaatacctgtgtaatgtaacaccgatacatttaatttagtgttcccaaaacgggtctgtggcaagagccacaaggaaaggaaagtatagagtaaaggaaagtatagagttgcctggatttccatgtactttggctgtggctactgaagtgtctcatttttaacacttttttgttgctgctattgctatttgagatattcccgtctagagcagtggcttaccctcagtagtcatttaaatattttgagttagtaaatgaaattcaacagactaccagttcagtttcttgtttcttcaaaatattattttttattttttcaatcatcttctttaaatcacggtaaacctataaagggcatccaacatttttacattggtttttaatctctaaaatgataaggactcatctatttgacccttcagaataactgagcaagaatcccttgtgtattttgtctaggctatattactgtatttgttaactagacaaatatgtttatcagcagctaattctgtatgtcttactgtttcaaattttatctttaaagcaatttcccttaatgcctagcttagtgctaaatacattgtaggtgctcaggaaatattaattaaataaagaaattgcaaactagtgacatcatttggtctttttactgctttgtgtaatgggttttttagaggtgagctttaaggagctatttttattataaaagtaatgcaggccaggtacggtggctcatgcctgtaattccagcactttgggaggctgagacaggcggatcacgaagtcaagagatcgagaccatcctggccaacatggtgataccccgtctctactaaaaatacaaaaaattagctgggcatgatgatgtgcccctgtattccctgctactcgggaggttgaggcaggaggatcgcttgaacctgggaggcggaggttgcagtgagccaagatcgcaccactgcactccagcctggcgacagagcgagactctgt

SEQ ID NO: 56777 - DNA, 1065 bp, Homo sapiens
gcaatgagccgagattgtgccactgcactccagcctgaccgacacggcaagactccgtctcaaaaaaaataaatattaaacatttctcatttttaatttctaatacagtaaatattaataactataagctacagaaacacaaagtttttagggtcctaaataatttgtcagtatataaaggggtcttgataccaaaagaattgagaatgactaatttaggaaaagattgatgagaataatctaggctcttctttacatcaccgtacatcaggttcatgtgtatttttagcatgtcaccctctctttgtttttcagagatcagagacttaaagctctatttctgtcccagattcttctttggaagtaagaaagttgtcagtcttccaaagataacaattctttttttttttttttcttttagatttgatggtagagtggtggcaaagcttccttttacccctctttcttacatccaaggactgtctcatcgaaatctgctgggagatgacaccacagactgttccttcattttcctgtatattctctgtactatgtcgattcgacaggtgagtgatcacatctaccatttaatatgtatatttttccttgctgtcataccaattagcttttacttttataatactagaaatgtttacccattgttcctgagttctttcagttgctcattttagaatttcagtgtatcttccaaaagccattttaaatggctgtaggtctagatgactgatccttagggatgagaagtagtgataaaaccaaacatggattccacatcccattcttagagctctcaggctccttctttattacaactgcctaaagctgcaaaagtagagagtgggtttggtcttcccagtaccatttcttcattatataccagcaccatttagcggctcaggagcacaagtaagtttaacaatgtggtaattttaggttattcacagttgagataaagtttaggttatagaatttacatttggccaacttggtgatttgacattcgtagtgaaaaagagtgagaactaaggagtaaaagggttatga

SEQ ID NO: 56778 - DNA, 1626 bp, Homo sapiens
tcttcgcgctgacgttcgctccttgaggccagcggcccacaactaactcatttcgcggttccagcttcacgtccatgccctggcacctacacccagtcgttcagtacctttgcggaagtcagtcttcttacttcacggcaaacccaagctaaactaatattacgaccacagaagttgggctgaggtagaagtcaagactatcccaataactggattctggccgagaaaaaggcgcgcgccagcaccccagtcagtaaaatctaccgggcaaagttcgccgccgccactatcctcctctggctctgaaatagttccaattctcgcgagattcggcctgactaccagcccttcagctccagtgagttgcgggttggtttcctctagactctcgtggccacaccgttctccgatacgagcctttccggtgctatgccccggaagcggaagtgcgatcttcgggctgtcagagttggtctgttactcggtggtggcggagtctacggaagccgttttcgcttcacttttcctggctgtagagcgctttccccctggcgggtgagagtgcagagacgaaggtgcgagatgagcactatgttcgcggacactctcctcatcgtttttatctctgtgtgcacggctctgctcgcagagggtgagagcgggtatttctcagacgtttgatcagtccccgggaggaagggccccggggtcccctgtgccaccaggggaaagatcgcgagccttacttgcttgagaggctcatctactccacttcagggaatctctgggcaactcgtgaacaggagcaggaggggagtatggagtcgattgccgagttttctttggtctcaggtagatttcacttgggtatttgtggagacaccttcacatcatgttactgttgttttggctgaagagtcagttgtattagcctttgaaaaaagttaactatgggtaaatacaaagcgaaaagttggaattcctccttctccaacagtaaccactttgtttgttgtgatcattccagtcatttctctattaacatgttgcttttaatgttttaggcataacctgggtcctggtttacaggacagacaagtacaagagactgaaggcagaagtggaaaaacagagtaaaaaatgtgagtatggcaacacattagaaataatttcaacacgtcaagctcattaagtccatgttcacaataaatattttaagagcaccagctgatacaaagatgaacctgacttgaagcctatttagaaatagaagacttttatgcaaaatgtgtaataccaactagagggaagtgaggggcgtagcagatacatgttatgtgctgtggtggttctaaagaagaggttcaatctggcgcagtggcttactcctgttaatcccagcactttggaaggctgaggcaggactgaacttaggggtttgacaccagcctgggcaacatagggagacctcgtccctacagaaaaaattagctgggtatggtggtacacacctatagtcccagctatttgggagactgaggcatgaggatcccttgagcccaggagattgaggctacagtgggccacgatggtgtcactacactgcctcctgggcaatagtgagac

SEQ ID NO: 56779 - DNA, 1049 bp, Homo sapiens
atatgtattatatatatattttatatatatatacttttatttttgagacagggtcttgctatgtcactcaggcaggggtgcagtagtgcagtagtgcaatgtcagctcactgcaacctctgcctcctgggctcaagcgatcctcccgtctcagtgtcgcaagtggctgggactacatttgagtgccgtcacacggggctgatttttgtattttttatagagacagcgttttgccatgttgcccagctgacttcgaacccctagactctagcaatctgtccacctcagcctcccagagtgcagagattacagatgttagccactgtacccagcctgtatcttttcttttttgttgtttgtttcaagttttaatcaaagcttgtacataagattactttatttttgcatcttctcaattgtttcttcctagtatttgcccttttcctttcctacttggcgagatttggctttccattcaaggatctttttgctgtctttgtccagttttagcctagtgatagccacctttctggggtgaatgcctgtgtggacagttgtgccattagtcttttcccgctgcacccattcaatgtagatgacatatttcttcctgtaaacctggactactttaccaatttgctgacctttatagtgccctcgtacaacctgaacttcatcatcctttcggatgggcatggattgcacattgtacttctgtctcagctctttggaaacaggggaagacataatcttcctgtgaatgtgggaaggtgcattgaaatgccttttgctatttttgatttggttggaagtcacaaagggattgaacttcattttggccgctctgtcacccagactgaagtgtagtggtgtgatcatagctcacggtaacctcaaactcctggccccaagcaatcctcctgcctcagactcctgagtagctaggactacaggcatgcaccaccatgcttggtaattttttttttttttttgtacagacagggtttcactatgttgcccaggctggttttgaactcctggcctcaagtg

SEQ ID NO: 56780 - DNA, 2675 bp, Homo sapiens
agccaccgtgcccggccttatttttctacacagccaaatgcacacagaccatcttactgaactgtcttcacttacatttttgctcagtggtcttctttttgtaatggcctttagtctttttaaggctcagctctgttaatactttcttgagggagctttgttacccatttccttaatgagaattattttttctgtcttctgcttccatagacttaccatatctttcttgtcttatgcttatttgttgactgcttcttcccgtagagtatgtgttctgtgagagaatactttttcttacttaacctgtttaagtgcttgggattgaggggaaataaggatttaagaaaccatgaaagaaggtctctgtccttagcagtttactgtttataaatttcttccactgtgtttattaccaagtcactttatcattaaagcatttgattatctattccctttgaagtcaggcatgtgtcttccctactggtagatgacaatggaagatgaggttaggggaacttttgacttagtggtaggactgggattaggatctagggttttattttttatttatttttgggacagagccttgctctgtcacccaggctggagtgcaggggtgcgaactcggctcactacaactcctgcgattctcctgcctcagcctcccaagtagctgggattacaggtgcccaccacaatgtccggctaatttttgtatttttagtggagacggggtttcactgtgttggccaggctggtctcatcttctgacctcatgatccgcctcagcctcccaaagtgctgagattacaggcatgagcctctgtgcccggccggttttttttcttaaaatctgtacctgttttgaactttctccacaagcagtggcctcttcgtgtaaatatttttagggaggttggcctgtgtgtgaccattataggataagagaggagatgctgtcccctctgaggtgtggactgccacctcagtgcagcttggccgtgagtcagcatctgcttttggaatgcttcagaatgtgctctggacccgtgtcggcgcccactgctctgttctggaaccttggtcgccatccccatccagccagatcacgtattccacaccttcctgtcaggtgttcccaggactgtggggctggtttggtccttttgctgcttttctcagagatggcattgtgtgttttccgtcacctcaaactgctgccatgatctggcccttcggaccttcttccctttcccccttactctagctagtccagccagacccactcttggcatggcaggctttcccccagccaaggatgtccgcatttgctgtctgctctgcctgaatctctcctgcttgttcactgagccatgcctagcacgatgtctggtagaatgaagaagaaaccctgggtcctgctgcctccagtagttcctatcctgctgcctttcctcaggctgtatttcttctttgttccttgagtgtctttgaagtatggtttctgatgctcactctgtttgtggtcacctaccagttcactacatagcatttgctttcatgtcatttctttgtcaaatcttgcttttatgaggttctgtgatggagacagattgtctttgggaatttcactgctgaagacctgaccttttttgctagtgggctctgtgatggtgctgttggaactacttaaggtctctaaatcttagacttgtatttcagtattttaaaatcaataaaaaggggttgagagtatacttttatatgtgagtgtgtatgcatgtctgtatgctttcgtgtccattaaaccatttcagtcattaagctgatttgtcatgaaagcattcgatcttttcatcatatatataaaatatataagtataacccatatataattatgacatacaaaataggaataaaaaatgagaaaaaggaaacatttagaaacataatttctttaatggtataaaatcttttgatactaaaatattttttatttgtgactgaagattgaaagacgttttatttttaaaaatcttgtttaatacttggtgagtcttggatgaccttggtggtgttagttttggtggtcattcaagactgaaggttttgttctaagtttagtcttctgaatttttatttaatgattatcatatttgaaaaagttacctctaaaaagatccaagtagaggaaagtcatcattttgtagtacttactaaatcatgatattcccatcctccagttatgctatggcttttccttaaaacgagctagaaaattttcatcctgtagtcccagctacttgggagactcaagtgggaggattgcctgagccttgggaggttgaggctggagtgagccttagtcccaccattgcaatccaacctgggcaacagagcaagaccctatatcagaaaaaacaaaaaaagtgcaattagtagacaatttaatagaataacctgaaaaatataaagaaccatataaagccctccagcattaggctttcaggcctcataagccataatttgattggatgagggggcagtggttctaaatgtatgcctgagaattttgaacaatgacagaaggtgacaactctgaaaaattcagtttgctttgccaactcgctattggcaatactctttccataacatgggtttctttctttcttttt

SEQ ID NO: 56781 - DNA, 1412 bp, Homo sapiens
actgcactccagcctggatgacagagcaagacttcgtctcaaaaaaaaaagaaagaaaaaatcagagagtgactttaacttaaacttttaactttaaattcgtattgtcaagctcttaaagaactgtcacctattttgtttaactcaatgctttttttttgattgaggtaagatatgctttttttattagtcaatggctacatttttctctacctccttttgtagagaaagtaaacatttgagagcagaaggaatagaatattgagtgatacatagtgtttgaacaagagaggtagtgaatactcttcaggaaggaaatgcaagctgagcgagccctccttgtctgactacagagggatgacagaagctgaagtgggcatcagattggccatttgatttctggaggaaggggtcaggagacatccattgttaaggtggaaaagcttgtgttttagacctgtcttctgggaagaactcagtcctagcctgccatgaggctcttcttgctgggtcttggtggagtttaaggtgtttttttggtgtgatagaattgaagctttataatgtgtccacttcaagttaagatagagaatccctggtttgttcagaagatgcttccttgttgaggtaagcccaggaagcttgatggagtggagaacgtgcgtgggttttggagtcagccaggcttgtgttaacatccctatttggccacttttaatctgtttcttctgaacctattcctacatctgtgaaaaggagatgatgtctggtttggagaggtgttagggttaaacgataaaatgtatgcagaggtatatacatagcaatgcttctgcagtgggccggtcacttgccggtaccgtgattcatgttctgtgcagatgtgctgtcagaacaggctggttggccagccttcccccaccccggcccccgccccagacagagtcctgctgtgctgcccaggctggagtgtggcgcgatctcggcccactgcagcctctgccgggttcaagcaattctcctgcctcagcctcccaagtagctgggactacaggcgtgtgccaccatgcccggctacttgttgtatttttagtagaggcggggtttcaccatgttggccaggctggtcttgaattcccgacctcaagttatcccccggcattggcctcccaaagtgctgggagtacaggcgtgagccactgtgcccggcctggtcagcctttaaaaatgtttttaaatagttattcattgattttaattgacaaatgaaaatatatttatggtgtgcccattaatgttttaatgtatgtatacattgtggaatggttaaatcaggctaattagcatatctgttacctcacttagtcatttttttgtggtgagaacaattgaaatctactctcttggcaatt

SEQ ID NO: 56782 - DNA, 1489 bp, Homo sapiens
ctgccaaactgaattaagtagtactccctttactggtttcctgtagcagtcattctcttgtgtcatggttagctgtttacacctctagattccaggatcctgcagtgtcagttatccctcttgtgtccccagtctcgtgcacagggagggcttcagtctgattgttgaaagtatgctaaataccaagtaaatgctacagtcataaagtgttgtcgcaggtggagaggagtcagaaagtgttaatgactatgctaaagcttttcttgctaaagtcaccagtaatcacctagtctctaaatcccgttggagctgtagattctttaccttgacttttctgtaacacttgacagtgcccttgtcctctgggaaacttttcttggtttcactgctcttggctggttggctttcttcactctcaccattcttctcagtcatctctgggcccttttctgcctatggctgtgtcatgcctcagaatccccttcttgattccctgttttttccccctccatgttctgtattctccatttgtcagtgcttcgcagattgggtatttcctgccttgagtcctttcctgggcttctttctcatttattcagctgtcactgggcatttccacatcatgttcttcaccaatgattatccagaatgagacccctaacaatacctgcctcctgttcctagccacagacctgctgctctacctgtattttctctccacacagatgtacaagacagaaaccttacagtcatctctgtcactcctgcacttccacattctcccacatccatcctgtctcctggtgcagtcaatcttgctttctgaatttctcttgaaataatttctcctcccaatccacatccatatttcttgcctgggtaactctccactgactgatttcccagctgccaatctggaccacctccaaaacattttccacattgctgctggagtgatcttttaaaaatgcaactccgatgttgcctgtccgtcgggtacattcttcaatagctcttctttgccttcagtcttgctgtcatcctgttctcccagctaagccacaggaggcttagtccctccagccttgcttcctgtcactccctctttgccttatcggtcctccccaaccctgagttgtcagcacttccagttcccagctcttgagagctcacctccacactagtgcacgtgtgttgatgctgctgcttctgatgtgcctcttttgtgtggtcacttttactcatccttcaaagacctcttgagctgtcacttcccctaggaagtgttctgtcagttgactgcaatctgaattgaggtttgcatcctgtgtttttctttctctgacaccaccccatactgttctcttctcagtagactgagtttcaggtcactgtctttatctctgtccattgtgcctagaatattgtagctgctcaaacatacttgagtgaatgtattcaagtcctttttttttttaaaccatgattg

SEQ ID NO: 56783 - DNA, 1067 bp, Homo sapiens
tcagaatggcgattattaaaaagtcaggagacagtggatgctgacgagactgtggagaaatgggaatgcttatacactgttggtaggaatgtaaattagtgcttatggtttttaaaaggcttccagagcaggggacccatatatttagtcccatagaacacatcccttaacctgcctcttagcatttcatctatccttccttatataagttctttcttctggagttgggacaggaggtgtcttgttatttgggtagaaaggagaaagaatgggtgggtatgtggacaaacggtgcagggaaatagatagcatgggaagtgttgccacagctctatggaaactacttggatattatgattaatggatagtcaaacatctctcaaataaatatcaaagagtgatcttcccttaaaggttattgttcccaagtttatccctctcttggtgccctggctctggtttcttttcttctaagttgcccctttgattacttgtcatgtgaatatcaaggcctgatccttcctctgtgtgagctccaaggggccgccttccagtggagctttgtagaatcatatgtgtcatagagaacaggttttaatgctgggctgctgttaggctttagcgctagtgctgagaggccccacaaagagctgaacctactgatgaggcctctcccaaatctaatcagagatgggggaaaatttgggtgctgggaagagcagatcatctcagtgattttaatgcccacctttatttgcaaagtgaaaggagaaatatatttccctattgcatttcctacccttcacttgtcaggcatatttgatatttttttttttgttttcatttaaaaaaaattccaaaaacaccatgtcaaatatgtcaaatatttattttttaaaaagtaggccaagtattaatgtctttctgctaaatctagtgggttctctctcacccacccccgctccaaccaggtgtttgcagaaaggatctttttttttttttccggaaaggatctttatccagaaaggaattttaaacctcagagttaagttcttcttcacctcagt

SEQ ID NO: 56784 - DNA, 1410 bp, Homo sapiens
aataaataaataaataaagtgagtgtgtcttttggatctcttcagattagaaaaaaatctgtatttgacttttcctatgtttgttctgattttgttcagtcctttacgctgaagcagctcccccactcttcccacttaactcctatcttacttcaccatatcttttctagtccatgaatactaccttccatgctttattctggtcctctaaatctttcctttatacttctgtttttcctgccaatccccaactcgtacagaaccctactgtaggagaacataactgagaagaatttaactgggtttgaataattaaataaattcccatacgaaggtataataaataattttctagatactttgtacacatgacactgaaaagagagggacatattctgtaaagtagctcactgggggaaaattaccattgctacattttcagccttaaattgtaaggagtgcagatggttagccagcctatgtttctcccacccaccttcgttttaaactatcctaccctggaaagatggatgcttataaaataaatgaaaaagactttacctttagaatgacatagattgtgattgacaggtccaggtagctcttgtgtatgtgaaggggagttatataatgtattaggctttcttaattcattccacaaacacctattcctagttcttgtctgaatctccatttattttgcagcaaagatgtccccaaataaggtgcttatatatagcaacagattctacttccttacattttgtttcaggacagctcacacagtttttttaacacatttcaatgggcccagaatccatcgtggtaggaagtaaaactgtttttacatatatattcggtcacttcccagttttttcttttcttttttttttttttttttcttgcaagctccttctgtctgggctgactgagacccacataacatctcagccagctgagttggacattcccgggtttctgttggtgtctgaatatgtgcagagcagtagaatatgtgctacttgaatcttgctgtgcgtgagctgctggaagtcgctgtgtctgactagtgtgtagaagctggggctacctgtgatggggaacatgaatattcgaggagcacaggtggatgtggggtggggacgtggggtgtgcatcgtcacagagccagcctggccctctggagagttggaaccctgtttccttgtcctggccaatgtgaaaccttgggaatagttgcagagtagagaaatcaaaatacacaatctattctctgcttggcctttttacgccctggtgcagattgactaacctgtggtttttgatcatctctggtccagcggttgggaatctgtgctgtctatagcatctgagtgttgtgagaataaaatgtgaaaataggtatgaaaa

SEQ ID NO: 56785 - DNA, 3008 bp, Homo sapiens
taatttattcagcaaacattacgtgcctgttgtatccccagctcctggtattttgggtattaggtgattttttttttttttgtcattaaaatttcctccccccacccccaccccacaagtaacttgtaatgagcttcagaggcatttagctttaaaacaaaaatcttcctccctctttttaaccacactacccttggttcttagtttaaaaatttagttgacattcctgtgtgtttttatcttgcaattggccggagggttatttattaggaaaagagattttgaatgatttcagtaagtgaactaggagttgtgatacacgattatattaaattgcttatggttagttttccaggaggtgatttaattgttcaccttcctaagtcttcagtcttaggcttatccagtgggagctggaaagctttaataggcaagtttattggaacacacttccagagtcaaatgtcactcttggcagctgcagatgtcaactgggacaagtattcagagcctgagaattaaggatatgtgttaaatatggccctcataggcggccccagggtttttttttttttttttttacttttgcgaacatgttgacagagatgaggctcagaaggcaggtatacatgtgccttgtcttcattctctgcagagagaatgtttttaggggcttgggaaagtatttcaactcgaagaaaggacttatagttactagaatcttcacatctgctttctcgagtgaccttgagtcaaccacagtcttgtggggtagatggtattattcacccctcttttgttacatattaacatgacaaaactaagactcagagaggaagtgccttccccaagcacatgcagctagccagtggcacatccagtacttgaacccttttctctttgaatcatgctttgtactaagctgatcacggtccactgtagcagtaggtgacttatggtactaagtaccatctgatacattaatttattcagcaaacattgagtgtctgttgtatctctagtacctggcattgcaaagatgagtaaggcagtagacagataactgacataacccatgacagtgcagttgcgtaagtggcatgatctggagtgcagagtactgtggggacacccatgagggagccacaattgcctggggtagggagttggaggaggcagatgacaggaggtaatgactgagctggagctggagggatgagcaggagttaggcagattgcaaagggggtgcgggcatgtgctgggtggcatttccagacaaaatcggagggcttggaacagcagtgtgtgctcacacctggtacgtagcaggagtgagaggcaggaacagcagtttgaggcttgacagccctgtgtgcgaagcgaagcatttgaatgatgtctcattaccactgtataccacatgtccttcccctgcagctttggctgacatctgtcattctaccctactcctgttggccttactttctcccttttacccctctcaacgtttgctttaggctgtcagtgtttactgcaccccataaaaggttagatcctcccaccaggcctgatctgactactaggagagactgtctgtatctgctggagggattgagagaattggtacagaaggagttttgtggatcatgacatctagaattagcactctgagaaagagggagtaagcatggtattaggattggaaaaaggtttttttcctttcagaccattacaaaaactcatgagttcaggatgtatcagttgtgtgaataaggtggatgtttgaagaccccactagcatgtgttgagtttacagccactgtgcaagatgcatcttaaagattgatagtctgtgcacttttatcccgaggtgtgaggtactggacctctgtcataggggagagagtagaggctcagagaggttaagtaacctgcctgaagttgctccaccagtaagatatggaaccaaggattcacatgtgggctggccaacctcttcatgccctgtgcctcctatgtgtgtaggtgggtctgtcactactgccctgggtgtcctgcagaatggctgtggttcccagtccacccccttgggagccttgcctacattagctcgatttgctgacaggtgaacaaacaagcaaccagctgctctgataggcctgggaacttgtccccggagagaatgcccaagtccaggaaggttatgccaggtcatgaagcagaagtgtctggacatgtcacacagtctgctgagccagcagtgcccacttcatagccctttctgtagggcccctgtgttgactccctgcatggtactcgtcccttagcccaggagaggccccatgggaggagggagagttgcagcaacttctggaccctgagccataggaacttccccttcccaatctctgagaagatgttcacagtgacctggccagggtcactgcaagaaagaaaatggaatgctgatggggcaagggtgacagggaagccaggcattccagctgtgttcaaagcagtgacaatgactgtgggagcgggtcctgttttatatattcatcattctgaggccttcagggactattttgttagctacataagtgttgaaagggctgcgtaaaccagaaatcaaattctgtagattggcatctgctggataaatcttctgctgggattgctacaacatgttgaataaccgtgtgttttgaagaatgaaaaagataagacagttcactgagttgcaacgtttatgacacagggaatggaggactgtaattaaatctacataaaaaggccatgttttccaagtgtactttgaacttggggcaggtgttctgagtgggtgggtgcatcatctcatttccccctgcggaggaggctgctggcaacctgggaatggaggttaacaccatttgttacccctgaagtttctggatgtctagaggaggacccccttcctgcgccccgcccctccatgcaccagtccagagctgtggtctccttcctg

SEQ ID NO: 56786 - DNA, 1050 bp, Homo sapiens
caggcattttagggggacacaggcatgccaaccttagcagcaacttttcatataatttgtatcctaaaaacagtaaaactcggccgggcgcggtggctcacgcctgtaatcccagcactttgggaggccgaggcgggcggatcacgaggtccggacatcgagaccatcccggctaaaacggtgaaaccccgtctctactaaaaatacaaaaaattagccgggcgtagtggcgggcgcctgtagtcccagctacttgggaagctgaggcaggagaatggcgtgaacccaggaggcggagcttgcagtgagccgagatcccgccaccgcactccagcctgggcgacagagcgagactccgtctcaaaaaaaaaaaaaaaaaaaaaacaaaaaaaaacaacagtaaaactcaatagctctggtttattgactgtttattacatgcctgctaagataggcattccctacctggccattttacagatgaaggaactcaggttaaaggaggttaacaaccttgtccaaggtcagacagcacatctggattcagacatcagcttgtgtgacttaagcttatttttctcttcaccatgccagtcctgcctctagcaaaatacacgcagatttcatgataccacttttaatttcagcaaattatgttatcattttcaattaactgataattagctggcagtccttggaaggtagaaggagttctgatggaagccctcatcgttttttattctttcatgacttccacttgaaggtccttgcttactgaaatggaagccataagtcctctcgtcacccttggtagaagggtgctaaatcatccttgctaaatacttgacggaaaccatcagtcatctcgtttggctctcatcaatctctttgttcatatgcacaggctcttaatctctgttttccctttctttagagtaccgtagtctcagatgataaacttctctgaagctaatttcttcactgctgccctggagtgtctcttcatgctgcattctaaacaagtgaagagcaaagttgctcttggtaggg

SEQ ID NO: 56787 - DNA, 1053 bp, Homo sapiens
agatgtttgggaagtatttcaagcactgctttgtgtccttaaggaacagtgagtgaatggcccgttgcaggctgagtctgatgtcagtttttgacttccgtatagtagtacatcaggtggcagctggctgcaacccagcctccactgactttagagccagccaagtgagttctagtttcagcccacaggtcttatgttgttgccgagggacctttacaagacacttaaacccttagtttcctcttgtaaatgagaattttaaaaagttcccgacacagagagagaggccatcaataaatgttggataccttccctttcacttccctgtttatggtttttgaaatttggaaaagaagcttgtcagatctgtgtgtagaaataataaataataggacttccctgtgtagaaaagaaaaactttattttttagggattttgttaggcatttgcctacttagagatcgttctgatggtcttgttctcaactgtccccagccagatggggaacataggaaacctattatgtgcgagccaatgggtccagagaaaagagatagacagctattgtgatgtctatcagaggacactgtcttctcccgtgccaggtgccaggtgtgctgaagatctactttgcagattgaccccataaggatttatgcacttgagggctcatctctggagacacatggaaaattagcaaggcaaaagtttggagtaaagatgtctgcacagagtgggcagcttgtgtgttggagaacaagccatgttggccatttgttgtgaatggcgtgaggaaaaatgcttcagaaacatagacttttctggatctgcaagcaccagcatttttggtgttcttttttacttcagttttagatttgcagcagtattattgtttcctgattttgttaagcagatcttcagtatttcatcagcagtatgggttaagttggcattagaagctatgctgggaacctaatcctcacccgtttgtctgggaaaatgtgtttccgtgttgcacagtgagtgaactttttgatggcagtgtgtttgtaa

SEQ ID NO: 56788 - DNA, 1456 bp, Homo sapiens
aggaaccatttcaagtgacgtggaaggaggttatcaaggtaggattagaaacatgtatttattatgctgcttactatccagtcttcagttatatatgtgttattattttacagaaggcttcattggacaaaaattccttgttagtcttttttttcgagaaggagttttgctctgttgccccggctggggtgcagtggcacgatcttggctcattgcaacctccgccgtccaggttcaagccattctcctgcctcagcctcccaagtagctgggattacaggcatgtgccaccatgcttggctaatttttgtatttttagtagaggagtttcaccatgttggccaggctggtcttgacctcctgacctcaagtgatctgccagcgttgcccctcccaaagtgctgggattacaggggtgagccacctcgcctggcccctgttagtgtttagtatggtttctttttgtgtagggggagtgaattttttgtgtgtgcgtgtgcgtttgcttattgtacccatttctcatggtatggaaaaaaacaggatttcatactcttaacaggataccctgcacaaggtgggaaaatatacctcgtgttttaaagaaaaatagtttaacaaatggctttcatctgggttgtactccagacttgctgctgcttcatgcttttccaattgtgccacaggcctgatcccttagcatgtgtgcagctgtgggctagagggttgaaagcaggtcctgtgtctctttcctggtgaactccacagggacacagctgcaggtcttttgtaacgctctgtatatgcacaggaagtcccttacaacccactctgttagatctcatttcctcttcggttatttgccctctgtggtctctgggtgtcagcctggcctgccttttcagggttcaaggagctgctggattggtgccctcttgtggtctgcctttgatgtggttgggatcttgggagctgaaggcaaagaaaggacaagtgagctaccgaggagtaaggaagacatgaagttgagaagataacagagggaagttaaaaaaaaaaatctttggttgaggaaattgtttctgaatataacatgataaaatcagtttaggttaatcagtttaactgcatcaataaagaatttctttgcaaaacactacttaaaaagacagttaactagaaagaatttgtgaggcaaatgagaaatggccagtttccttaatatataaagagcttttataaatcaataagaaataaaagaccaataaatcaacagagaagtgaggacaggatatcaacaaaccagttccagaagaacagaagccttttaggcatatacatagtcttttttttttttctctttttgccggctgctctagccagtttacttattttttatttttatttctttgagacagggtcttgctcttgtcacacaggctggagtacagtggtg

SEQ ID NO: 56789 - DNA, 1044 bp, Homo sapiens
tgtgtgcccagctaaaattcaaggactgatggcttgagtccaggagttcgaggctgcagtgagctaagatgttacgacttcaaaaaagacttctgataaattttgacatttctatttaacagacatttgggagacacacccccaccccccagtccaggtgcctgagaataaaaacttagtcacactattggtccttgtgctccaaaagctcttcagttatttgattgacccatggctgctttttggtactgaagaaccttattagtaatttagtgagtttttaatttagatcctgtatgtggtggcatgggtgggtggtggtgattgtattgtagctaggagctcctagtcagcaatgcatgggctctggggccatgcatgacttcaagaatagatggcctagggcaacccacttgggtccccttccatgctgtggaagctttgttctttcgttcttcacaataaatcttgctgctgaaaaaagaaaagaatagatggctttgcagatattccagggaagcatttgagtgacacctctctattgtgccacttaatcagttggattggaagttgagccagcaggtttgaaccttgttcttagttttaaaccagggcaaattactggtgctttggttttctaatgcctgtaaattagagcttctgagccatgtggggagcaacccctacccgcaaaggagtgatgtaatgtctgggggctgcaatggttttttcctttgagatggataccatataagctagtggtgatacttactttatgatagtgacagggaaagctactgccaagagtaattgatgtgacccacacatagtcccagagccaaggagctagatgggatcttcctgcctgaggaggccaagcgtctggccttcaagcattcttctctgctgtgatgttgtttcccgtcctgaaaagcagggaggaaatgatcaatcagtgtgcctcaacctggagccgattggctgtggttgctaagttttcttccctctgagcagccctccctgtgattctgaagcagctcattc

SEQ ID NO: 56790 - DNA, 1116 bp, Homo sapiens
acttttttgtttttgttctttggaattctaggaggaattctatctactaataaaggctgcagactttatcttcctacaaccttaggacgtaagaaacgtcctaagatagatgcctgggaggaaaaggaaattgagggcctacaggtgtttaaaaacctatagtttataattgcttagagcctttgatttccccccccacccatccatctgtagcacccagagagccttggttttgtaacattttcacttttgaatctagtttatcatatgaaagttttactgttctgtgatattttggggcatgggaggatctgtggtcccaaagtccagagtagttttaaatgtttttctgtgttaatatgcaaaagtatcatgaaggcgaaataaattgtttgcaaataattgagtcaaaatattattgttcctccaaagatccttacttagtcgtgtgtcacagcttgtataacaggacgtattttgcagagctgtttagtttgcactgacttgtgcaacaggaatggccagttttccttacgctcagggcaatcaaacacaactttataagaattgtaactttaaaagatttcatatttttgttgttgttgttgttaaaatcgttgatgaaataaattcaatagtaaaacttctaagatttgagtcatcaaacctctaaatatgctgtttttctgttctgttctgttctgttcttttctcttttttctttttttttgatgcagtctcactctgttgcccaggttggagtacatggcacgatctcagctgactgcaacctttgtgtcttgggttcaggcgattttcctggctcagcctcccgagtagctgggactacaggcatgtgccaccatgcctggctaatttttgtatttttagtagaggcagggtttcaccatgttggccaggctagtctcaaactgacttcaggtgatccacccaccttggcctcttaaactgtgggattataggtgtgagctaccctgcctggcctaaatatgctgtttttcctttctatttattcggttgaccagtttctttcttcttcttttttttttttttttttttttttgagatggggtctcactgtgttgcccaggctgg

SEQ ID NO: 56791 - DNA, 1464 bp, Homo sapiens
tctgctttattgataaggaagagcagctctagggagctcaggattgacctgtggccactttgttggtttggggtagagccagaccagacagacgtcgggattctgtacttcctcacaaatgctttctcgtctgtatcctctttcccaaaacttttctttattttccctccttcccttccccttctgtcctttcctccctcctttcaattgcctcaggactggcggggaggggatggagttgttgagagaaaactgtgagtttctgtttttaaagttcagagtgttaggttccataaatgccaggccatgagagcattcctggagacgccttcagagaaaaaaagaaatcacatctgtttttgtctgcctttattcttcattcaacagcaggtttttttaattccaaggagaaggatgtctgccgtgtatttctgtttcatggtgaaagctcagaagtggtcaaaggagacctttgtcccggccgtgatcacccttggctctttggtggtggtccgagggctctgtaagaccatattagccaagtctttagcccccgcttgaagtctgtgggggcaaggaacccagaacccagcccagccagatgttctggcccttgttctctgtcccttgctagcccctgcctggcttggcccattatctgctctgtgctttgcaggaaggaggagacagttactgtctatcccgcagacgtggtgctctttgaagggatcctggccttctactcccaggaggtacgagacctgttccagatgaagctttttgtggatacagatgcggacacccggctctcacgcagaggtgcgttctaaaagcctcaggtggccctgttggtggccaccttgagggcgggggagctgggagcctgtgacaggaccccacccgcctgagtctgaagcccatgccttccctgaggcagctgtgtgtcgcatggtccagcccggctgcgtcagtccagccccaggatatcctgctgcccagacacttggtaacatttgagaagggattagtcacttactgtttgggataacgaaaggcttgtgaggtcacagagactaaataagacactgacatctggttttgcctggaaaagtttgattaaatgcttagttccttgcaatttgtttataagacatcaaaatgaagatgctctgatttggggaactaactgtaggacccccgaggataggatcccctgtgcctgaagtactgggcagctcatcctgttagcctgcttctctagccctttattttccagcaggctttatggaggcattatcactctttccagtcagctcaggagggaagtcagctgtgccctccgcaggccctactaagtgtgggcctgcctgtgctaagtccctgtgcttgtgtgctgaaggcacagcagtgccccttggtagaggagcccagcctgtgaactgagctctacagggtattcagcag

SEQ ID NO: 56792 - DNA, 1151 bp, Homo sapiens
ggacccagcaagggcagtgggtggaggcgactgaatagaggaatgaaaggtgagaaggtttgagtctccgttgtgtgacagaggcagggagacacaggaaatgacgaggttagctcctagtcacaggacacattattgacagtttcagatattataagctgtatcccagggccctctgacttcaaagtctgggtaattttctcttttcggttcatgaaacagatctgtagtttatcccatttagcaccgtaattgtaagaactattcatgagaccagtagaacctacagaaacaagtcctgagctttgcccttctaagtagtaatagatacatatgctattaagtcagtgggagctacatcttgctcccaggtggggtgagggacagttagttttgtgtgatggaaaaaagaatggaatgggaggagacttttagttctagcagagcccttcccagctagctttgtgactaggctcttgcgacaccccggcttgggtttctttatggataatacaggggagacaggcctgcttttagtgtcacgactctggctgggtaagagttgcatggtcattttggatagataattgaaccctgagcctgacaacccctcatgcttctgccccagggcctggcttgtcaccttaatccacaaactccggccctgctttggttgatctgctcagtgtccatgtcagcttgtcaaattagagaggcagtgtgatacacagggacagataaattttagagtccagcgaattgggctgagatcctggttttaccacttactagatgtgtggcaaattgtgcaaattggcaaattgtgttttaacttttttgtatctcattttcctattagaatgtggtcttatgattggtacttctgggatagttgtgaagatgagaggtagtgcaggtaaaatgcctggtggtgcattagtcaataaatatctatgtggcagatcagaaatctgcttctgctgaaggggtcggtgctgttcgttttctgaattttctgacaagactggttagatcctccaaggggatctgctccggtcatgtcctcaggagctagtgatgcccggactgatgccatcactagtccagcagtggtactcagtctcagggatgcagtgctgccgagggaggcc

SEQ ID NO: 56793 - DNA, 1563 bp, Homo sapiens
tactatagagtagcacatttcctcatcagatttttaaagtgattgacttcaccattgaggaattatctttattttgggtccctctaagtttctttcttggcttttggctaaccagaaagagcaagtctgggtttggaagggctgacgtggaagcccagcagggaatgtgggcagacttgtagcttcctgccctgtaccctgtcctctgaaaaggcctgtcctggcccagcaaatgtgctggggtcagagcagtgatggaggggctggttttgagcccctggggtttccaggttgtgccaagaccttgtttggactcagtccttggcgcggccctgtttcctgactctgcctgaggagaagggcctttcagtgcagggaactggctggccctctgttgtccttggctcagggaggcacagtctgcctgaggtgatagttctatcggaggttcttggggagcagaggtgggcaaggccttatgatgttgcatgttcccagtgtctgggcaacattctgacccattccccatttgcttttccagcgtggaagctgtagtgggactattccctatcttccttgctttttttccttcctcacgtatgttgtcctatgtgcttgtgtcctgctctcccttcccgcgtggcaacctgcctttccagctgccctgcgggactcctttttccctttgctgcccccgctcagctgggtctgacctgcttacctgaattcgaggttcccgcgctcccacggtgttgagctgctctgtcagggaggcactgccctcccaacgcgtcctcaggttctgttgtggtcgtaatcatcatagaacacatgcttattgaacatgtgctaaggtgccagctatggtgctgaagagttttatgcacatctctgtattcctgaatagtaactgtatgaggaaggtaccattattgtccctgttttatagttaaggaacttaagattcaaagaggttaaagtcacttgtcgaagttcacagaggtaggagttattggggttaggattcaggtccagggcagttttccccccagagcccatagaggtagaacaagaagcagcttttgggctacagagcagcttcactgtgatttacctcctcctcctactttctgcacgaccagtttcctctctccagtgacaaaacagctgaagccaccagatctacagaaggaagggggctgaaggcccaggctgagggcagttaggaggactacgtgacagggtgtggacgtgcactgtgtgtgcgtgcgtgcgtttgtgtgcatgtgtgtttgtgtgtgtgcacgtgtgtgtgtgtgtgtgctgggagaaggacaaagcttcctccagtgctaaagccttcagcaattgtatgaaaagcatgtgttgcaaaacaatccagcatcaggcgtttgcagggctttaagtaaaagctgcccaagcacgggtgtgtttgttttttccctagctctgatacccttttgatctggtttccttttttctttgggctttatctggagacgtgtgaagaattggaggccgcgctggctgtgtgttttggcg

SEQ ID NO: 56794 - DNA, 2176 bp, Homo sapiens
tctactaaaaatacaaaaaattagccaggcgtggtggcaggtgcctgtagtctcagctactcgggaggctgaggcaggagaatcgcttgaaccccagaggcagaggttgtagtgagctgagatcgcgccactgcactccagcctgggtgacagagtgatgagactctgtctcaaaaacaaacaaacaaaaaattagtccattgaggtggtgtgtgcctgtagtcccagctacttgggaagttgaggtgggaggatcacttgctcaagcccaggaggttgaggctgtagtgagctatgactgtgctactgcactacaacctgtgtgacagagcaagacaccttgtattaaaagaaaaaaaaattttttaaagaaaaaaaaaaaagaatggtaaaagcccctggataaaactgaccgggggaagaaggtagaagacagaagatggtgagtttgttgtcaatttgggcttcatctcagccccagcccaccattctctaggccatggttttcttatctttcactgagtgatttttttttttttttttttttttttttggcaaacctctgtgcatgaggtaggtggaaatggttaaccatggctgggtcctcagcctggcctgggctccatgctgcagagggggcatgggtgggagctgggagcagtgagctgatgcctgatcagtgggtcgctggacttctgaacgcaggtaagtgcatgcaaggaggcagcgtgcagcccagccctctcggggcccagattgcttcttgttaacagtgagctctccaggagtgccctgcttttttaaaaaattcacactgaaattttgtttggagcaaatgttgcttgaaacaagaaggctgttggcctccatggacagccttttgtttcaaagagcattgtgtcattgccaagtttgaccattgtaagatgtcagaatgtaacttgtcttttccgaagccgctgctgatctgctcttggtcaagcctctcaggattccagcttgagaatcatctagagtaattgtggagcctgtgggagctaggtccaccccatgaagggcgggtgtgtgctggctcctacaccgttttttgattcttgttttcccttctcttacagtattaagggacatcagcgagagaggcagggatcttgagcagattttatctcagtacattacgttcgtcaagcctgcctttgaggaattctgcttgccagtgagttgtgttcttggtttgtttttgttgaatgtagaatttaaaatttgatgatataaacgaaggtgtgcaagtttgtggagctcccctgcctgaatctcactcctctctctgagtgatcctctgtcctgaagtcctaagagagggcagcccttggtccttgtgtcctctgtgttctccaggagccctgtcctgctgttctttctttgggtagccctgtagggtcctgccagtccttaggcaggtcatttaattcccagctagttctaggtttcttgcttggtggggtcatggtgtgagaccgtttactgagggtgtatcatatccaaggagagtcctcagccatttggatctctgaagggtctgcaatgggtgacgtatggatgcactgggtgctgtgccccgagatgttcccctctgagcctctcctgccatcaccactgagccctgctttgagcttgtctttagctcccatttggagactgtcatgccttactggaataagcttccttcccttcacccttgcagactcaccagtccttcctgtggcagctaggaattctctagtgaggtggctttcagagaaggaagaacacagagagttggccctcagcccaggaaagacaggaaggggcatgttgagggaaggctaccagagacaagaggtgtggtgtgctggggctgcagaaggagaagtatttaactcaggagaatcctactgagtcaatgagtcttctccagcttggccaaaccatggtctggctcctgaattatttatagttaagctctgagaccgggaggaagggaaggaagagcttgggacttaacctggtcttggttgagatacactgggaaggctggaatctctgaagacattgaagatttagagtaaggctgggtattggaatttccctatttattctaacaataaacttcattctttttcttctgggaaaatatctc

SEQ ID NO: 56795 - DNA, 1903 bp, Homo sapiens
tgcagtcattaaattcaagacatttaccattgatatgacctcttttaacctggagatgttccctatcttttgttttttaagacatttttgaggcgtacaggcccattgtttggtagaatggtcctcaatttgggtttgtcttttattttcttatgattggtttcatgagcttatacagtctgaaggaattatcccaggagagatgtggcgtggtcctctttgtgtatcacatcagaaagcatttgatgtgtattccatttttggtgatgttaaattgacctcttggttgaggtatataatttatttctaatgctaataaaagatagctctctgcattatattttttggagggaaagagggccttccatagggatgctctgtcttaggatggaaaactggaaggttccctggtggaaaggtctcatagctaattgacgtgtcagaaccatggctggttaccacgtctgcagactttggcccgagtgcttcatccagtggtgactgatcatctcctgataagaagcccattcattaagggcttactctgtggtaggcattgtctatcttactccttagagccctcctgtgaaggaggaggatcatattagctcaggcagagccactgggaagttggatgacttgcctgcaagtggcagagccacttccctggaagtctttctactgtggttcctgcatgcccttcccccagacagactcccacactcacccctgcacccatgcctgcacccgtaacgctctgctggtctctgccccacagtggccatcaacctcatcgtgcagcacatccaggacatcctgaatggagggccctccaaacggcagaccaatggctgtctcaacggctacaccccttcacgcaagaggcaggcatcggagtccagcagcaggccgcattgacccgtctccatcggaccccagcccctatctccaagagacagaggaggggtcaggaggcactgctcatctgtacatactgtttcctatgacattactgtatttaagaaaacaccatggagatgaaatgcctttgattttttttttctttttgtactttggaacgacaaaatgaaacagaacttgaccctgagcttaaataacaaaactgtgccaactactactggtgatgcctaattatgaatccaacgtgtaaccagttataaatacatatatatataaaaaaggatctatttttgtgtaaatgtacaaatactgtaaagctgtttgccataagtattttgcaggagggtctgtacttgagtgttttaggactggagctggaatttcaccaaggggaaattgcctgttgtgtcccagggtggggaggctcgggcatctgtgagagacagggagggtggctaaggtccagttgcttttgagtgccccgtggaacttgatgggaatggggttggaaaaccttgattgcctcctctgtcacatgccactcttggagctggagcttagtgatatgtcaatgagagatactcttgtcttttttttttttcttttcttttttttttttgagttgaaattaggtaaaatctcaactcaaaaatcaaactcagggaagaggcccactgaggagaacaagtcttctgcattttcttcctgccctgctcccaccttctcgcctctggctgcttggatagcttggtgactccttcctcaccctcctgcttctctgtctctccaagaagccagagctgcctctttccttccctggaagagattttatgggatcgcttcctgatagaagatgggaaggagagggcagaactttgcctgctgtcatatctgaagaatcactggttctttctgcatcccaggggcgtaactgatctgactccttgggctttttcctgtattgtggaatatagagtggacc

SEQ ID NO: 56796 - DNA, 1473 bp, Homo sapiens
agcccaagtgagcctgaaggagttctgattatagagtcccgagcctcagtttctgactgcagaagagccagagatgttcatttcattgttgaccaccctagtgcttggtggactgtgcccttagctatcccactgtggctgccattgccagaaacattttggagaaccttttcttcccattgctctcagagcctgttcgagccattcaggtaaattggtctccattattacctggtcacaccagattttcccccagactcagcaccatccagtctgattccccgtttctgggctcagtttgactctaaatctgttttgctattttaaaaagtcaaacctggtccccagcagagcttgccacccggagactttcaggagaccgtgcaggctctgaagggagctcccagtcacagcagccgcctacttggagcaagggaaggctcccaagatgcctcctttgaaagccggtgctcaccaagatcagttcaggatcaatcattatccttgtagtcatgccttgatcagttctgagatgaagcagggaatgcaggcctgggttagtatcctgaggacacagggcccctggccttgatggcactgggctgtgctcaggtgaagcccacccgtgtctgggagagccttggcttttcagtgggcagcatgctcaactttacttgaagctcccaggtgccaaaccatttagtgccttggctgtttatcccactgccttggaagatggactcctctcatctctgagcctttacctagctgcttcctcatctacctgtggtgttgggaccaagcctccaatatctctgaatagcccactcctagcttggaaacagctataagggctgccctgccccttgtcaaatgatcaccaattcttggtggcttggctggggacaatgaacagtgtctgctggggtctgtgacacactgtttctggaacaaggaagggatggaaggctctacccctccgtggcagcccagcatttggccaactctgtatctgaacttgagctttctatggaacaaacaatggtcttagttttttaagagcctctgggtctctgattccatggagagtcaggagtagaattagtggaccagaaaccatgacatttgccatctaggtactctgctgttcagggtggaggcacagatgagcagagtggggtgatgttggttgtatgtgcatagaagtcccctggctccagagccatccagtggtgcttggttctctcttcctgcccaggtattgtgtgtggaccaagtgtttaggaaacaagcatagaagcattatgtcacaggaaggcctggcctctcactccttcacactaatgagccttctactgacccaagtttctttttctcgggcagcctgggaccactatgagcagagagatgggagtctgtgtaagaaggatgcaagtatcctttgatttggagtggacagagcaggtccttgca

SEQ ID NO: 56797 - DNA, 1028 bp, Homo sapiens
atttagcaaccttgacctgcactggccctcacagctgttggagggaagtagcctcttgcagggaaatattttcccctgccctggaatctcctatgtgcctgttaaagattccagggccaagaactcggcaggctgaggagcagctaggtaggtgggttatgcggttcaggactgcttctggaagggactgcctgtacttctgtaccaccgttgccctttacactttgctcagggcggggtgggggaagcattcaaacaaaacaaggaagggaactgtctggcaaagcataagtggatgcatccagagctcagtcccctttaatcttttgtctctgggcgttctgctgccttcctcataccggggactggcattccaggtcagcttggctgtggtcttagaggcagggagtgcctacccagtcctgcctcaggagcagggtgagtagctaaatacagacttaggcttttttttccccccttttaagatgcttgctcctctcccttttctttttaccaccctacctttattgttagtggttacaaagtgaccacatattatgtactttgctgtaaataaagacagacaaaaaggctctcgccttctgtgtgatgcttggcccagagcagcgaccgaatcctggctgtgtggcccaagtggctcaggaagggccatgctgtgcatgtgtggtgtagatgtcactgggcctgctgtcacgaagcctcatgatcctggggtgtatgtggggcagaccccaggcctcacctgggctcagatactggttcaggttagtggacttgcagttcttgtcaagtgggaagcccgggccagggtttctgggagcctttggttcttaggacaacctggcgctatgttcccctgattccatccagtttacctggcctctgccccattgccttccttaggctggtgacccagccccttccttgctcaaacaaacccttttaaagtaaacttttttgagggagatgggtggaagatgaggaaagtttacattataacaacacaa

SEQ ID NO: 56798 - DNA, 1068 bp, Homo sapiens
cacccatgccccgcccctgctcctgggcccggccctgaccagtgctacttctcagctttgttcctttgcttagcctctcactccttttgagagctgactccttacatccttcaacactcagctccagtgctgctctgcttagggattcttcgccctcaacccaggctggcttacgtggccctcttagggttcccatagacgccatcattgcccagagctgcaacatgttcagatgatcggcttgtgctggtccctctgtactgtcaggtctctgaggcaaggaactctgtatgtttgcattcctggtggatacacagtaagtgcttaatcggtgtacgttggatgaagaaatgcaggtaggaccctctaaagcaggtgcctctataatatatgcacaacattctgggattagggattgaagagaaggactttgcaaatttttcttcaagttttcatgatattcaacagatgtctctgctccggccatattctggccggtcagagggccctgggaacaagctcaaaagtgagaaaggcttcctggatgtgatgagaggcaatggtgaatagtggcctataggcctgggggctgggagacctgcattctcatcgaactcatcctttacctgggtctcaagagacttcaggaggggataaactagttcagcggttctcaaagtgcagtctccatatctcaaagtgctgtctccagatcagcagcatcagcactgactcagaacttgttggaaatgcaaattctcagaccccaccctagaccttctggatccgaaactctacaggtggggcctggcaatctgtgttttaacaagttgtctaggtaacgctgatacacacacacattaaagtctgaaaaccatgggactagcccagtgctcctgaaactgtaatgtgtataagaattattcagggaacctatttaaatgaagatccttggaccctaccccagaaattctagtttggaaagtcagacgaaagcccaggaatctgcaccttgaacagatttgccctgggagattcagaagcaggtctacagatggtattttcatc

SEQ ID NO: 56799 - DNA, 1008 bp, Homo sapiens
gcttgggcaaaggcctgacgagaacagcacagcatgtgcacagaacttagttctgtctacacatccacagtctttccaatattctgagtgtcctataattacttttccttattttttcccttccttcctttcttgaataagagttctgaactcattacctccattgaggacctaggaactactagtttgaagtatcttcatggggaaattggctatccagccagaacatccccgtttctgaagaaaacctgtgggatgtgtcatttcaaactcagaagggcactcaaatgagcccctggcaagctgaaccttaaggataaggcctattccactccagccacactgagcctctacagctcttgatgagatcaggctcgatccagcctcaggtcctttgcagggctcatttcctcttcctggtaagtgccttctctaggtatctgcatgactcttcatctaagtctgtgtttcatctgctaccttctcttaccaccctattttaagctcctcaacaaactgcattcttatttcctgccttattttccttcacagcacttacactaacacgacatatagtttatgtactaatattcttcatcactccctaactcccaattagaatgctagctcctgaaggttttgtttgctttgttcactcctgtgtcctctgcacctagagcagtgcctgtcacataagtgttacgtaggtgtgccctacataggtgtgccctacataggtgtgccctacataggtgtatgtgtatatgtaggtgtgccttacatatttgttgaataaataataaatgaatatttatgagggctgaataatggaaatgaagagaggtaattgggcccattcttcgcgtctacttggttgtggaccacaagagaaattactgggaaactcctcagcttggttttcaagcccctgctccgtcgactctaagacccactctcctctttcctagaggcctcatgtccctctaccagacttaggtcataggcatc

SEQ ID NO: 56800 - DNA, 1079 bp, Homo sapiens
tggccagatggcttttgctgctgcccctgatgacatgtctctgtccccaaatatcccacattgtattgaagtgatctgctctaattctgtcccagaattagagcagggacaccatttcatgagtcttgttgtcgcctgcacccaggacagtaccaagcacatggcaggtggtgaagaaatcattcgaactgatggctcatgagccatatctctgaggtggcttttattactgactttgattgggactgcattcccttcaaaggggttagttttacccatgaaaggaccgagttaatagcctgtgaccttggagagctctcattccattgtccttggagtggcctcctcctttggttcctgacacctacttcccctgttttgtttttttcagcctagtcttcctgttgagtaagggttcagtttcagtgaggcattgctctgcctgtccggaacctgagaaggttcatgtgtcagtgtgtggacagatgattgtgatgaccaggcttagaaaatgttgtatgtttgtttgtgtttacgtgctcagaagccctaaaaagtgttgcatgggggattggacttttcatttcttagttttcacatggacatcttttgacctgtactggagttcagggccagaaagtagacactgggaagaagattacagggctctgggaggacaggagcagcattgtataactgacctgggtaggaacctcaggacctcacttttattttgaaagagctatttctgcaagaggcaattattggcttcctgtttggctttcgatcctcccctgcctctgctgttcaactttataattgctgccaggagggcgaagagccccagtgtggctcagggacagtgggagctgagtctcgaggagtctgtgcagcgctgccagccacagggctctgtaccactgagggaaagctgctctttaacccccaccgcggttatgttaacagagttcccttttccctggagagagctccctcctactgagtccaagggatactggtgacatctggagtgcagggccaccccataacacagggacataggcaccatcggtaccctc

SEQ ID NO: 56801 - DNA, 1040 bp, Homo sapiens
ggttagagactcctcaagcaccagatcctgagtcccctggaaggaagttggactctccatgtaatagagacaaaaagggaggtggtcttccacagtcgtaggtaaacccttctgctcaaagtctggagaaagacttaattccaagctccctcctggactggtggtgattggggtggaggcagccaatatatatgcagtctctgtctagggcagaattgaacttggagatggattgtcagtgattgcagctgccaaaagctggggaagtggtaggaaatgaaagaggaactgcaagcacttttcaaagcccttggacatgcatacatttcaatcttcacaaccctgtaaagcaggagtgattttctccattgttcaggtgaggatactgacattcagaaagtttaacattatatgtcacccagtaagagagagaaagacccagccttcagcctcaaaatcttttattccttctaccataacagaatcaggtgagatctcttggattccttccagatcacaaatatctgagtcttaggtcctactgtgcctaagttggttgacaggggaagataccatgaaacatcttggtttccatgtgttagcgttaggatgcacacataagctctgaactgagaccacctgggtgcattcccagctccaatacttggttatgtcaccttggacaagatatgtaatattcctttgcctcagtttcctcatctataaaatgggactaatattggtactcaatattgtagcctacataatgcaataattatcatgtattattgtgtatattacaccccatatgatgtggcccctcattgtctgtcatcctcatcttctccatcatcactccttcccagcctcacgtgccctcttaccactccctgagcaccccagcatgctctcacttttagacctttgcccagaatgcccctcccccagatggccaactccctcacctccatcaaatttttgctcagttatcgtcttctcagtgaggcctacctggaccattccctggcactcccagtctc

SEQ ID NO: 56802 - DNA, 1026 bp, Homo sapiens
agaaagagcacaggtctgggagtcagggaaccggggcttaggcctgtatctcccacttaaatagttgttctatcttgggcaatccacctcacttgtttgtcagttttttcaacttgattaataatacttattttaattaataagtattcagggtttctcaatagcagtactattgacattttggcctggttagttctttgttggagtggcagcagagggctgtcctctgtattgtaggatgttagcagcatacctagcctctacccactaaatgccagtagtaccttccagctgtgacaaccaaaagtgttcccagacatagccaggtgtcctctgaagggcagaattgtccccagttgagaaccactgcattaactcataggattagcaggatacattaaataactgtgtgaaaatataagacatcatggttgtcttcctccttctctggcattccagtcttctctgattgtctatacttacgtagaagcagaaagaagaaacagcatattctatccacatccctatgtggtccagcaagtgacttgttacgtccatgctttcacatcatgcgattcaggtaagtttgtccttttctaatgggcttgatatttactgtgtgtgaagagccacagaggtgagtagcagtgcctgttttcatggatgacacattctcatgggaggaatatttaagcacagaaatgactaagaccagaaaggcatgctcaggtgtcagagaggaagcacttcacagaggaggtgatgtttgggtttcagtagacagagataggctggtatagcctgaaggggcttgaatcagagggagcagtgacccagggtagaaagcacataggattagatgagaaggtagcaagagataagaccttgtgatcagtctacggaggcttggaatgccaaatgtgttcattgtccctaatttagcagtgacatggcatggccatagctgtgttgaagagggtcatgtggcaatggattagagtaaggagaggccagcacaaggtggct

SEQ ID NO: 56803 - DNA, 1547 bp, Homo sapiens
gaggaattgttctcagagttttggactttgaaaacaaaagaatgtgctttcaagatgtcattgctgttatactttatagtttatacattcctgcccactggtcttgctttttttcactttttcttctgaggcagttataagccgtgttgatacagctgtttagagaaaattcctatggaagtagttctagctggaagtcatctggggaaaattaacctctgtaggtggactgaactttttcagggaacgtgtagggacctcacaattgacctaattaatgtgtttgcatagtaacatacctgttttcattgtacatttaattagcttctttaaaaataattcttcaggtgaaagatgttaaaggcttctcatcctgccctgctgagcagagccaaagagcttgatagttttaggacaaataaaaggaagcagtactttacgctgtaggtagtaaatgtgtgaaaatcattactcctagaaacagtatgtgttgaaattatcaatagattctagacacgaacctttagagagcatcatggatgacagatataaattgagttattaaagggacattagagagcattttctaatcgttttaagttatcgttacgaatggatcccccatattctccggtgagccttgtgacaccacaatcaggaacagaatgttaggtggatgaatgctggtctgacctactgaggtattattaaattcatatgctccagtcaaaatttttaagccagtttaacctttttacctatttatgctccagtctttttaggtcagtttaaccttatacttattattattattattattattattactactttaatgttctggtgtctttcaaatggccacttcttcagaactctctcaaatgatttggaaaagctagggggtactcagcccaaccataagatgggaaacctgagctgcagtcctgcctctgccactagctagttgcttgactaggggcaacactgcacttctgcttcatttttctgcaaagaaagggagttggattaaatgccttccaaggccccattggcagcaaaatactgtggatcagtaaataaatattatatgcacactcattcagggagtccctagaataaaagaatagtggggtcgggggtgggatgggggactgctttgccttattttccaaaaaggataaagtagagcatttctcccttctgacaggagaaactgaatgttgtagggacagtgcagaaaaacccctgacagcatggggaaaccccccaaactttcttttctctgaacctgaggagggaggtagtggggagaacatacggtgggagttaggcaggtctgggctcagtcactcactgactctcagtctcccgttggtaaaatggaggtaagtacatgtaacctttggggtgatgaggatgaaatgagacaagtggcatgaagttatctcacttagttcctcgtataaagtaagggctcaataaataataatgtttagagaaaggagatgggagttccaaaacacggcaattataatggtaagcacctc

SEQ ID NO: 56804 - DNA, 1172 bp, Homo sapiens
cccagaattatggaaaaccattttgtaaacttcaagtcacttcctctccatagtacagatcaatggtagaccagtgatcagggaggatacaaatcatacccccaaaaaaggcttctttgttgtattttgcctcaagtgttttcttagagaacctcaacaaaccacactattttctagtaatcagccacttatcccaccatttgcagtaaggaaaactgaggcacgccttgatggcttattcagcatcagcagcctcacaaaagacagaagtctcctttggattagctttatcatctttcccttaagcagagatgatggtgcctttctcgctgctctggctcagttaagaagtcaagtctgatttattggtcatcctaactatcgtttcctgaaggcccgaagccctgtaatgctgttgtctggcttcccagatttatgaccatggtttctggcccccaacaatatctggagttcggtttacatattcacttccaccatccaatccaaatcctcccaggcagcaatcaagctggggctgattcctcatccatttgtgggctcactttttctggcaagtcagccttcattctccaggacgcttagaagccgcatgttggcggtggattgtgctacgggaaagagtgaatgtgtagcctgcacatttgaagccttgctggggtagagagcaacgctactgctcctggaatgtccaggccactgttagaaaggccatcttattccttagaagagtctagccctgctgcaggcttcagaaacgtgtgctctaagctcgttcctgctcatttgaagcagtcttctgaaaaggtctgcagaaacctgcctttaccctctccctcatcctgcgtggcctttgtcacatccttcctccaaggttcctctggtggtggtagtagggaggctgccacctggctttgcatgtgggaaagcccagcctcttccctccaacctcacagcaggacagccaaacttggattttttcatgaggaagcaactcttatgagctctctggttcagctctctggttaaaagaccatactgtgctgtttctggggcagcacagacctggttgatcgtgtccacaggaagaacagcctttgggattcattagtctggttaagaccagccctgcagcctcctctgccagctataga

SEQ ID NO: 56805 - DNA, 1317 bp, Homo sapiens
tgagagataacctctatgatacacagtcacctccagtccagatgtgtgtgtgtcttcgcacaatgatgacatgacacaatgaaagacatctcaagcttagggtatccagacccgaactctcgatccccactatagctcccactctaaatctgcacctttgccattcttcatcttagtaaacaacacctccactctttgagttgctcaagcgaaaccatctgtatgtcaccctagatacttccccacacatccagcccatcattaaatcctactgatcccatctccagaatatgtgtgtaatccagccaccactctctctgtctactgctaccatctcaggacatgtcaccattaactgtcacctgttcttgtagagactttctaactgaacctgtcaccaccattcttgtccccctccagtctgcctcccacatagcagccagagtgatgtattaaaaatgtagatgttattagtttcttgcttaaaccttttaataacttaccattgcaattggaataaaatgggaaaatctcttgcatgggaggccgaggcaggtggatcacttgagcccaggagttcaagaccagcctgaccaatatggtgaaaccccatctctactaaaaattccaaaaagtagctgggcatggtggcacacgcctgtaaacccatttactctggtggctgaggcacgagaattgcttgagcctgggaggtggaggttgcagtgaaccaagattgcacactccagcctggctgacagagcgagagtctgtttcaaaaaaaaaaaaagaaagaaaatctctttctgttctctgattttctgttcttaagccttgtcagccttcttccagtctttcaaaagaaccaactttatcccaactcagaacgtttccatatgccgctctccatctgaaatgtgcttcctccctgcactgctctagctacttcctgcccctcattccggtctcagccgctatctcctctgagaggctatccctgatctcacagttgaaattgggatcctcctgttcttttccttcaagatgcgctgttcttatactggttaccattactaagaatataattagtgagaatataattgtttacttaatttctgacttgtccattacagtgtaaatttcatgaaagcagatgtcatgtccatcttgtttatgaacagtgcatggcccatagcagatgttcaagaaacatttgatacaaaataaacgaataaactatttttctgacctcaaatagtctgtcctcttcaacaaataatgtctcttcaaagttagcttttcatgttaaacctaagc

SEQ ID NO: 56806 - DNA, 2559 bp, Homo sapiens
agaaaacctgggcaataccatcctagatataggaatgagcaaagatttcatgacaaagacaccaaaagcaattgcaacaaaagcaaaaattgacaagtgggatctaattaaacttaagagcttctgcacagcaaaagaaactatcaacaaagcaaatcgtcaacctacagaatgggagaaaacttttgcaacctatgcatttaacaaaggtctaacatccagcaactataaggaacttaaagaaatttacaagaaaaaaaacaaacacccctattaaaaagtgggaaaggacatgaacaggcactacaaaagaagacatacatgtggccaagaaacatatgaaaaaaagttgaatatcactgatcattagagaaatgcaaatcaaaaccacaccagtcagaatgactattattaaaaagtcaataaacaacagatggggacgttgagagaacgaggaggaaggagagaaaatggcatccatggattacagtacctatagccaagctgcagcgcagcagggctacagtgcttacaacacccagcccactcaaggatatgcacagaccacccaggcatatgggcaacaaagctatggaacctatggacagcccattgatgtcagctatacccaggctcagaccactgcaatctatgggcagaccgcctatgcaacttcttatggacagcctcccactggttatactactccaactgccccccaggcatacagccagcctgtccaggggtatggcactggtgcttatgataccaccactgctacagtcaccaccacccaggcctcctatgcagctcaatctgcatatggcactcagcctgcttatccagcttatgggcagcagccagtagccactgcacctacaagactgcagaatggaaacaagcccactgagactagtcaacctcaatctagcacagggggttacaaccagcccagcctaggatatggacagagtaactgcagttatccccaggtacctgggagctactccatgcagccagtcaccgcacctccatcctaccctcctaccagctattcctctacacagccaactagttatgatcagagcagttactctcagcagaacacctatgggaaaccgagcagctatggacagcagagtagctatggtcaacaaagcagctatgggcagctgcctcccactagttacccaccccaaacttgatcctacagccaagctccaagtcagtatagctaacagagcagcagctacgggcagcagagttcattctgacaggaccaccccagtagcatgggtgtttatgggcaggagtctggaggattttccggactaggagagaaccggagcatgagtggccctgataactggggcaggggaagagggggatttgatcgtggaggcatgagcagaggtgggcggggaggaggatgcggtggaatgggcagcgctggagagcaagttggcttcaataagcctggtggacccatggatgaaggaccagatcttgatctaggcccacctgtagatccagatgaagactctgacaacagtgcaatttatgtacaaggattaaatgacaatgtgactctagatgatctggtagacttctttaagcagtgtggggttgttaagatgaacaagagaactgagcaacccatgatccacacctacctggacaaggaaacaagaaagcccaaaggtgatgccacagtgtcctgtgaagactcacctactgccaaagctgccgtggaatggtttgatgggaaagattttcaagggagcaaacttaaagtctctcttgctcggaagaggcctccagtgaacagtatgcagggtggtatgccaccccatgagggcagagggatgccaccaccactctgcggaggtccaggaggcccaggaagtcctgggggacccatgggtcacatgggaggccgtggaggagatagaggaggcctccctccaagaggaccccagggttcccgagggaacacctctggaggaggaaacgtccagcaccaagctggagacaggcagtgtcccaatccgggttgtggaaaccagaacttcgcctggagaacagagagcaacaagtgtaaggctccaaagcctgaaggcttcctcccgccacccttcccacccccgggtggtgatcatggcagaggtggccctggtggcatgtggggaggaagaggtggcctcatggatcatggtggtcccggtggaatgttcagaggtggctgtggtagagacagaagtggcttctgtggtggctgggcatggaccgaggtggctttggtggaggaagacaaggtggccctggggggcccccggacctttgatgtaaccaatgggaggaagaagaggaggacgtgaaggacctggaaaaacggataaaggcgagcactgtcaggagcgcagagatcagccctactagatgcagagaacccgcagagctgcattgactaccagatttattttttaaaccagaaaatgttttaaatttataattccatatttataatgttggccacaacattatgattattctttctct

SEQ ID NO: 56807 - DNA, 1099 bp, Homo sapiens
gggaaggttaaacattaaaatgggtagaattttcctgttcctatgggcatgagctactctgtagctcaattctaaagcctttgcagtataaagtagtgcttcaaaaccggactatgcctcagcatcacctggaaagcttgttaaaaatgtggaatcttgggtctcaccctaggacactctgactcacagggactggtgtgaggagcagaagtgtttttaaggacttcttcaggtggtttggaggcagccactggttaatggatatctatccatgacagagcaactttgcataagcagcgcaaagcacagccattgcatggtgttgtggaatgacactggctctggatcagaggactgcgtccaaatgctagtgcgatcaattcttgcagcgtgaacttggcaaaatcaatggacactggggaaaactggagagcttgaagaggttaaacttttcaaccaatttaggtcgtacagggcatgagaccactccccaaaggacagaagagaaccgaatggggtgaactagaattgggaggaggcaagagttttgtttgggagtttggaaaaggtggagattggggatcttcgtggtactgtgagattttaggaagacaggtacagggagtttctgctgtatgttttacaatgtaattgacttcactaaagacctacacaatttcttaatgttgttgggtttggatttgtatttattttggatgtgacactatgctgagactgacctataggcagcccaattttactaagattataaatgtaaaaatgctacccttgcaggactgttgtgaggattttagaaaccctattttaaaacgtcttttaaatactagatgctcaaaaagtggtagccattattggaaaattagtaattatgaagtacctactatatactatatgttgtgttaggcactgaggatacagaaggcgaataaggagcacacagtccaagtgagtccattaacttttaattcaagaaaggaaaggaaatatttaatttaattttaaagtaagtatgtgttccagaaagttctgtgtatgatttacatattgccaggtaactgactgcataagctttgagtag

SEQ ID NO: 56808 - DNA, 1056 bp, Homo sapiens
cttattttacccacttcagctatataagtccatctgtgtttcaaagagtgacttatgtctcctgccttgcttccaaattaaattgtactcatattgctgaatcccattgtaattctgggatccctggaattacaatggagcaagaagttcttactattacattcaaaatcaccaaaattgcttttttttcccccttgggtcctccttgctttgagaaaccccatgaatccagcctcccttttctgctgacccttatattgcctgcattggatatcaaactgaattacattgagtttccatcttttcttcatttaccttttgcttttccctctccttgttagataacatttttgtgcacttttaatttcctaagctccttaccacctcagggacatgattaaaaacttccagaagaggaaaggagaaaaagctatgctaagttgcatttatgaatgttggcctgtaatattggtcatgagcttttgctcttctagtctgccacaattctctctgcagctcctgaggaagtgatgggagtagacagattcacagtgaacaagagatttgggagaccaagtgggcataaaactacgtcttggcctctatttggaaatctgaatgatggaattattatgtttgttaaaagttataccaaaaagccaagggttaattcatttaggttctctctgttttccagcaaatggaactctgatttaaacagctggggatgaaattcctcaagatgattattcctgaaagtgtggatgcgctggatgcgcagggaacatcaggaaaaggccacggggctctgaacagccccggtccagacagcagcctgtacatccatcccaggacacagcccagcccctccccacaccatacaaggtatcagaaaagtctaggacctatcatttcatcagagacatgatcagaaaagaaactgcttctgccccatttcttgttttggagattactccatctgtccatcaaaagaaacctgtaaatatgaaagaacaaaggttatttcctggagaaaagacaatttattcaacacca

SEQ ID NO: 56809 - DNA, 1028 bp, Homo sapiens
gggatttacatgtgtgagccatagcacctggctaaaagttgttttcttttaagaggagaaactcattataatccaaatagttgtcttcagttaatagactaagcttttcagaaaggttatttatggcataactcttctggttgatctgatgttttgtcaacaggggaatggtttttaaggaaagaaatgaaattgagaatcctatagattaaagtcacttgtttttgctgtgatacagcactgaagagtattagtcttggcatctgaacagcagaattcttgtctctgctcatgatttcatttgtccattcattttattcatttagttacttgacaaaactaatttgatggggtctataatgcacgagtatggtcaggtgacattggattttcaattctctgagccctattttcttcatctgtacttcaaaaataataacagttgtcccatgaagttataaacattaaatgaattctgcgtgcaaaccaatttaaatagtacaataatgtcttgatataagtggattttccttggtataattgaaacaccctgcctgatgctggctcccctattaataatggtagcctgggacgagttctgtcactctattttcacaggcttcctcaaccttttcttatatacttggctctcatgaaagtgaagagaaatcaagtacctaatttattttgtgcttatttcctatatatctgttgtttatgtggcttttgagagagccaaggttcttttcacgcaaggattttggttccaataatatcagatcttaaaactttttgtcctattttaaacaaagtttcagcatagtttgtctctttttaaaaagtcatttttgctcatgcctgtaatcccagcactttgggaggctgagatgggcgggtcacctgaggtcagaagttcgagaccagcctggccaacatggtgaaaccttgcctctactaaaaataaaaaattagccaggcttggtggtgggcacctgtaatcccaactacttgggaggctgaggcaggag

SEQ ID NO: 56810 - DNA, 1071 bp, Homo sapiens
cttttattttctatccatgtcacctctcctagcaatatgggtgaaccttcagaaccacttccttattggggtactctaacacataggtcttttgttctcgttttgtagtgaaagtaccgggagccccagataacctgggtgctctggtagcccagtgggtgatattagttcacaggatagattagtgtttatggttgtagtgttatttctgccgctgccctctccttgccttaaacatttgggaatcctggtaatctttatcttcattgccatgcccttaaaatgaacctaaaattttatctggcaatcaaaagattgcttagcagtaataacctgttttattatatgtattgctatttatttatatgtcttctctgaatctccaaatttattttttcccagtttataacagtacctcagatgctttctttttgttagagattttaaaatacaaatacttttagttgaattaaattagattctgatagtgagatttttatttcttttaaaggtactgcatcagtaattctctggccactctctttggaatccagctcacagaggctcatgtaccactacaagattatgaggccagcaatagtgtgacacccaaaatggttgtattggatgcagggcgttaccaggtaaggaactgacttttaagagctgctggtctctttagctgttctactcaatgtgattctggccaacagaaacaaaagatcagcctttgtttggttctttccctccccttaaacattattttgaagtacttcatggaatgtcaaacagttcctaatccagttgtgtcttgtgtaaaattcttttttctctggtatatttcctaccaatttaacaaagttttaagaaagttaaaactggtatttaatctttatgtaaaacatttccaaagatttattccaaaaattaaatatctgaatgtaagtaatataaatattctaaacatctacctcaaaaatatttaagacctgatttaggatttgattaaaagctatctaatttctctaccaccttccttccctccctgccgtttacttattagtaggcctc

SEQ ID NO: 56811 - DNA, 1015 bp, Homo sapiens
cgcccatcctagtgggcacttaagcttaattggggaaactgctttgattggttgtgccttcccttctctggtctccttgagatgatcgtagacacagggatgattcccacccaaacccacgtattcattcagtgagttaaacacgaattgatttaaagtgaacacacacaagggagcttgcttgcagatggtctgagttcttgtgtcctggtaattcctctccaggccagaataattggcatgtctcctcaacccacatggggttcctggttgttcctgcatcccgatacctcagccctggccctgcccagcccatttgggctctggttttctggtggggctgtcctgctgccctcccacagcctccttctgtttgtcgagcatttcttctactcttgagagctcaggcagcgttagggctgcttaggtctcatggaccagtggctggtctcacccaactgcagtttactattgctatcttttctggatgatcagaaaaataattccataaatctattgtctacttgcgattttttaaaaaatgtatatttttatatatattgttaaatcctttgcttcattccaaatgctttcagtaataataaaattgtgggtggaaattcttatttcttttttaatgtggattttgtttgcagtaagataaagcttgggtctcatggatcatctctactcaccatagcactcttctgcttcctaggggaggtgagacaaggtaacagatttgagaatcctggggtccctctgcttgtggccgcagtagggtcaggcagtgcctctagtggttgctgggaataggacagattcctgcctgctggtggaggtatattccaggagtctgcagtgtcaggacaccaggaggcctgggtgtcggtccacgtgcttgaaggaagatggtggagatgctctagccagttctgcttcctatgatgccccttctgagaaaggggcggggcagtcctcttgttctgtcacagagaactgtgacgcttcctcc

SEQ ID NO: 56812 - DNA, 1240 bp, Homo sapiens
tcttctacttgcagcaccccttggggtatatcacccccattttgtgctgatgaaacaatgacctgtccaagccataaaatgtgcattgcagccccaggacctgcctcccagtcctgtggttttccagtctgggagctcagggccgggcttcctgtggcatgactagagccaagtgtggcctggagcccctgtcacggggccagttcctcctgggctggtaaagccagcctgttcctgtaaccccctcagctcatgcgtggaacaagtctgtggcacctttactctcagcccagcctttcagcccagtgtcctctgcagctggtgggtggggaggaggtctggaggctgctcttcctgtaatgcacatgaggcccagctcccttgagggtccacctgagagcaaatccttcccctctgtcccctgctgccctgcaggaaccgggaagcctatgaggagccaccagagcagctaagagaactttccagagagagggaggaggaggatgactacaggcaagaagagcagaggagcactgggcgtgaatccccggaccacctcgaccagtgacaggccagcagcagagggcggcggaggaagggttaggggttcattctcccgcttcctggcctcccttctcctttctaagccctgttctcctgtccctccatcccagacattgatggggacatttcttccccagtgtcagctgtggggaacatggctggcctggtaagggggtccctgtgctgatcctgctgacctcactgtcctgtgaagtaacccctcctggctgtgacacctggtgcgggcctggccctcactcaagaccaggctgcagcctccacttccctcgtagttggcaggagctcctggaagcacagcgctgagcatggggcgctcccactcagaactctccagggaggcgatgccagccttggggggtgggggctgtcctgctcacctgtgtgcccagcacctggaggggcaccaggtggagggtttgcactccacacatctttcttgaatgaatgaaagaataagtgagtatgcttgggccctgcattggcctggcctccagctcccactccctttccaacctcacttcccgtagctgccagtatgttccaaaccctcctgggaaggccacctcccactcctgctgcacaggccctggggagcttttgcccacacactttccatctctgcctgtcaatatcgtacctgtccctccaggcccat

SEQ ID NO: 56813 - DNA, 1060 bp, Homo sapiens
accacatacatcacacactacacacacactacacacaccacacacccaccacacaccagacacatcacacactcaccgtaccacacacactacacacaccacacacatcacacactcaccacacacactacacacaccacatacacacataccacacatatgccacacacaccacataccatacacacactactctcacagagcacagcacacacacgctgcacatcactgacacaccacacaccacacacactgacacaccacacacactgacacaccacacacaccacataacacacagacacacacacacacatacaccccacacacctctctcatggcagaaatccagagatcagagtttttgatttccaaaggcttctttcatatgagtctaagctaagagatttggtttctgaagatcataaaagtaataatatcttctgattagaaagcattttcatgtaatacataatgtgcattatgtttcctgagcacttactacatatcaggcattctgttgtgggcttatatttattattagtacctcattttatgcttgcaagtaccctgtgaggcaggtactattatttctgattttagatgaggaaatggaggttgaatgaagctgagttacttgctaaagacaaattaataagtggcagagccaggtgtcaaacccagggtgcctgactgaattctgagcacttcacattgtgggccctgcctggtttaagcgtcctgcagccctggaggtggacatggggctccggcctgaagaagctcagtggcagaggttgtgcttcccaaggagtccagacctcccattcctggctgtctccactccactgtagtgcctctcttcaccctgactcttcttcccctgcagcctcaggtcagcctgtctccctgaagaatatctccacagacacatcgggttactacatctgtacctccagcaatgaggaggggacgcagttctgcaacatcacggtggccgtcagatctcgtaagagcagcctgcggggggagggctgacaaacgccacaggataactggt

SEQ ID NO: 56814 - DNA, 1048 bp, Homo sapiens
agttctagacctgaaacaggatttttgttcctgttttataatttcttaattttgtgaccttgagcagttcacttaacttctttaagcctccagttaactccatgaattggagattgaaatattgaggattgctggaaggatgaaaggacatcacatttgaggatgtgtactgagcagcacatccggagaaggaaaatcttgagatgcaatcttgcaggaaagtgacggtggggcggagagaggacaactcccctggttttgcccctagcaccaagtggcaagaggcaaagctggtatgattgacagggccagatctgtgacctgaagcttggacttgttactgaggattacgtctagtggttgctgggcagcccctgaaatgtctgaacagagcagtgacaggatcgtatttacaatttagagcgtctcttagggatggcgtgtaaccacctggtggcagcagggatcaggcaaggctggctctgcagcaaaattagaggaggtaggtctccagctcctctcaaaatagcagttataacaaagcatcttggatggcaggacatatacatatgcccaagcacaaagctcttgctttcaagatgaagaaattcataggatgatagattgaggggaaaggtcttccatgagatattctggtccgttctcttcgattcaggaggatcaggtgttttcactcctgctttccgaaggaagcctacagctcaaagaagttaaatggcttgctcaagtggcggcagatgtagaggaagagtctagacagtctgcctccgtcccaccccaacagcacacacattcaccaccccccataccacacacactacacatgcaacacacaccacacatcacacaccacacacattacacccaccacacaccacacatcacacactgcacaccacacatactacacacgccacacacaccacacacagtacacaccacacacaccacatgcagcacacacactacacacaccacacacaccacacaccacacacacaccacacacattacacactcaccacac

SEQ ID NO: 56815 - DNA, 1506 bp, Homo sapiens
caattgtggaataaagcctttgcttccgattcaaggcattcctgggaaaaggctgaatggtttggatgcgtggagagggatgctcccgtacctctgaaaagctcaagagataaagcttggctcagcaagcccatcctaggggtcctctgggaagtggtgttcaccttctcttgttccccggggacctgcttgttggctgctggtaagagtggtccttaagccgcagactccccctccccacactgctccagtcccagggtctggtgcaggatagatgaggcccggccttgaactttggacctcttatgtttaggaaccatccaagggaaagtgacaatcagggagggcctctaatttccctcatgctcgccccacacctggccagccctcactatggcagcaggagatgttgggcacacccaacaatagcctggctctttccaagaggaaatactgtggctgctgggctagaggggagtggtgtgtgtggaagggtttctctcagcagctgccgggtggggccgagatcagaatgcactcctgatgctcagcgaccgtgcacctggattatagaatgggcagcactgtttattgagcgagcaagccatccaaggggatgtgaaaagaaagacgcagaggagacaggcttgccacctagggattccaggagcaaccctctccactgtgtgtcctccccttctcacctccaaggacacgacctgaagtctcaagcatgcttcatgctgcttcttgcctctgagcctttgcacatgctgttcactctgcctggagtaccatcacctctttctccgaccaccactcccacctccaccactggccttgtttactgtcatgcttccttcacgtcacagctgatcttgggtttggggctgttttaggccttatctgccccagcagccttgcctcctgtctggtcattgttcagctacttgtcttttgcccccactagattccttgacccacccactgtgtcctccaagtgcccagcattgtcagacacacagtaggcacccagtgaggtttgtagaatgaacccagctccacaatggtatcttgacaatgctgagtgaaaggcacaggcttaagcttcccagaaatccagggaatcgggttggggttgtgagatgagggtggctgccgttctgggtaacctccagtctatgggcttccctctccttacctctgcgccctctgcctgctcgagtcccctcagtcctcatccttcaccctgcacataactttactgctgcctgtgggtccgcccatcatcccgtgcttatggcaactgcttccgcccatcatcccgtgcttatggcaactgcacgttatctgcaaagcacaggaggaggatggtgctgaacccagaaagaacattactaagaagttaagagtggaaggcttcagagatcacttagttcaggggtaggcaaactaggaccaaatccagcccacagactgtttttacatttctaacatactatttaa

SEQ ID NO: 56816 - DNA, 1808 bp, Homo sapiens
aaatacggcccctcaaggagattattgtgacaggtcctagcaggtcttctagcctggcggaggtccagggagggaggcttaggatatctttgatgggaggagggttagtgggcagagggtcctgggcagagccagtcagcatcagaaaagagcagaattgggaaggaccggtatccatggactgatccacagcccgagacacctttgcatctcccatcttgtttctccctcgcttgtcagctaagcttcctgaaagagctgtctgcctcaacctggtctgttgcctgtggttgggtagattgcaccctgcacaaggatatgtgcttcattagccaagccatgtatcccagcacaggctgtagagccccttattctaatgttgcacaaagcgcactgcacgcacaggtgtcagacttgacatcgggtctccacattctctgtccatcatggtctcgcttctatacctaatgctctacagaaatcaacagcaacctcttttttcgctcaattcagtacacttcattcagccatcttatttcatctctcattagcatttcacaccagcagccactttccaaccttggagtcttcttgtcttgactttctggaagtcttgtcttggcttttcctcttagctctctgacctctccttgacccttcaaatgaagtaacttggtgacttgccatttctctacttatttatcccgggtggcttcatctagcccatgtctcagtgaacatcgacatgtcattggctcccaaaccttcatccccagttgcactaaactgacctgtctggctcttactgactcctccacctagatggatctcccaccgacactccagataccccacacgtaaagagaacacattgtttattcataaaacattcccttcctttgtgtttcctctcttggaaatgacatcaccaaatatccaagccaaaaaactcttaccctggaagtctgccgttcccttactctgtccatcggatcttctcctggcttcatggtctcattggtgcccccactttcatactcctcaaattcatttcattctttccatctgcattgccacaaccttatctgaggacccatcattttttacctgaattgttaaactggtttcttaaccagtcccttttctccttccaagtcactttccatcctgtgttgagagctgacttcctaaatacatggctctctagcacttcagggtaaatgcaaactgtttagtcccatatacacgatgtctgagacctggcattgtagaatctccggacttcaggctctggagccacaatgcccggtttgaacctcagcgctgtcgtttacttaaacatcatgtgaacttgggggaggcctttaacttcttggtgccttggcttcctcatttgtaaaatgagtgtaatcatatacctactttaggggtgttgtgaagattccatgagataatacataccaagtgcataggctagtacctagcacatagcatacactcaataaatagcagctatgatctttattgctacctgcccaagctcaccctctcaccagtccctcactcacacacttacctccattcatactgaatgactggggttgatatgttgcttcccacatctaattctttctctgtggttcttcttttgcctgaaatgcccaacacctttatcctactccaacacttactctcccaatacccccagccctttgcctggctaattcttagttgtttttaggattcaaggcaactgtcacctctcctaggaagcctcccctgacttaccactctggaagtgatatttt

SEQ ID NO: 56817 - DNA, 1098 bp, Homo sapiens
tttaccacatacaaatgttccataaatacttgttaaatgagagaatacatcatcatcacaaccaaaacgatggcaggtaatgtttattgagagttttctatgcgccagggagtaataaaaatacttacacatggtatctccattaattttcccaataaatcaaggaaataagtattagagctcctattttattgatgagaaaactgacgctcagacaagttgacacagctggtaagaagtagggctgaggttcagggccaggcaattcatcatgctgtggggtggagtcaggtggaccaaggcccatgtgtttgtcctcatcgcagtcttggaggagaagctggttgccagggccaaggtggccaagatggctctagctgtggctggaggtgcaagaacagccctggacattccctcagtggtcctgtgggcagtgagtgggtatgtctgtccgtgtcgcttacttttcccttccactgcctactttctttccagtcagggtgaccgtcgatgccatctctgtggaaactccgcaggacgttcttcgggcttcgcagggaaagagtgtcaccctgccctgcacctaccacacttccacctccagtcgagagggacttattcaatgggataagctcctcctcactcatacggtaaggatactttacaagttcaggcaacatgggaatgattatcacctgaccaggacctcttagaaggcaagcactatgaagtctttccataaatggtagaataaacactagcacccaggctggagtgggtggggagggagcagtgaatgttgggctcatggagggccagagtatgtcacctttattttgaaaatgtcacctgcccctaaaatatctttctggtggccaatctcaaatgacctaaattgtatcatgcgagtcagtcactccttttgattagcatagcccttgctctgaggccaaattttatgggttttttttcctgtttggattcttttgggaagtgtggaggagttttgttttttttttctatttctatttttaaatagataatataatctcatggtttgaaaatcaaaacctcataaaaagtgtgcattgagaaggc

SEQ ID NO: 56818 - DNA, 1649 bp, Homo sapiens
tgagtagctgggactacaggcatgcaccaccacagtcgctaattttttgtatttttagtagaggcagggttttaccatgttggccaggctggtcttgaactcctgacctcaggtgatccatccacctcggcctcccaaagtgctgggattacaggcacgagccactgcgccctgccagcaaatgttttctgatagacgaaggtggtggaaagacaccagtcacatggagggtcatttgataagtcttggccactttggaatcaccttctggagcagcatcagtgacttgggaagccaacatttgaacaaattttcaggggcttctggcactggcatcaccatgaggaaaatatgcaaatgccaaagaggggaaacctgtttttttgacatcttcctgtctctcattcccaatatccaatactcccggatattataaactcaccccaggagctcacatggccctcactgtacagtgcccattccaggagggtggctgactttcaccttatgaaatactgcttaatgaagtatgaacaacccgaatgcttccctgtttcccaggagcgatttgcattttgaaagagaagtgtgttaatccagctggaatttgcctggatagtggagtcttcccagctgggcggggggacggtcttcagcaggacattttccttctttatgctgcagcctcatcatgggaacattcagtaagaacttgctcacccttctaccaccaaatctaccagcccacttgcacctttagccacatcctgttacagtgggtagacagcccggcatctcttctaaggcctgtcctcccataacaccgtacccccagccccatttgccctacaaggacatcatttctgtccccattctctcttggctcattctcatcatcaacaaacagtgtaaaagtattattttttaaatcatcatacacatattttgggaaaaagggcgtaaactcctcttgaccctatagcctcctttagctgctacagtctccctgctctcttccctttccagcaaacactgtctgcttcctcttgtcccatcagctcttgaactcactcctttcaggctccatccccaccaccccactgcatccactaatgccaaggccacctccatgtggccacatccaatgaccatctctctgccctcaggtccctggttgaacatgtcagcagcatttgagtagctgacctcctttgctttcaagaaacttttcctgctcttggttctcttcctgtctccctagccagattttcctacttctcccttactgattcctcctaatttcctccatcatgaagcactggagtgtcccagggttcagtcccacatgtctttcctgtcttcatgcacttccttagtgatcctcaacatcctctgaccttaactgatggagagccggtgactcccaaagttgtgtctccattccgtgcctctgtggcactccagacttacataactgcctcattgccacctccaccagggtgtctaaggagcatctcaaactttgcaagtcctcaaacaaactcctgatctgccccctgaaacttcctccttccttaactgttgtcatttcagtaaacgacaactccattcttccagttgctgaggccaaatccttctgtctattcctg

SEQ ID NO: 56819 - DNA, 1091 bp, Homo sapiens
tctaaaattgatctattctttagttataatcattagcaattactattcttttttgacagctcacccatggtgatggtgagtgctgcctcttgtgattaacttctaccaaggatgcacctccacaacagagtatgagacaaggaagcagaagtggctcaatatgaaaaatatatgtaatagtaactatcatttattgattatgagttaggaactattctaaacaaagtacccatttcatgtcacttaattctcacacggcccgtttctcaaaggaaaactgtgtggcacagaggtcttaagtaaactgctcatggttatatgtatagtaaagaaaggaaccagagttccaacaggggcattctagttctagaatctgtgcattcaaattctatgccatgctgcctcctgaaatggccatggagaagttgtgcgatacagagcggtacacgctccgggattaaagtatcgaagggatgtttctgaaccagaagaaagggagagttgggagacagaatgaacgagtggtaggagtggttgatgggagtatattgccctccttggaaggggatgttcagagaatctgaatacagccaattcggccattccatttggcagagtctcgcctctcacaaggatgtgaggctcctgagaactgtgaggtgctagagaatagtgggtgttgtttctatgcagttgccagccctagttcttttcctacataaaggtcacactgagttctcttctataagcaaatactgtacttagcatttggttaagaggatctaagtgtatgtgtgaagctagtctatgtccattaatttgccagggtaagaagatgactttgtgggcatctatcttatctccctgagtagagcagggggctggttttatatgctaggcacatattaaatacttgttggttgactgaagaaagcagaagagtttctgtgacaagattgaggggtgtgatgtggtcaaggaacaaaataggaaataggttctgttgacagccaaggaaaacaccatcctcctgtccctgcaggcaaaaattagcacttttccctgactgttgggcagcagccctataccct

SEQ ID NO: 56820 - DNA, 1100 bp, Homo sapiens
ttaggacaatgcatgtgctatcatgcaagagattgttatgattccttccttgcaggtaaaggcgcttgcacttctaacctgtatacccctggaggttaacacattgatacattattagttagtaacaccttacagtaaattagcttatccgatggatgctcttcttgagcatcagaagagctcagccttgacaaggagagtaggggagagaggatggaagaaagaaaatgtctagagcatgacgggcacagggcaaagggagtgactggatgggagagccacagctactgggaggagggtgggctctgggcaactggagacctgatattcaatgccaacctatacaaggaagcggaaagtgaggtagctggaagactctaaaaatgagcttcacttctcaacttcctaatcccagcttagatgtcctacctggtgctttggtctcattcactgagtacggatgcaaagacccccaggagagaaaatgagggatgcagtgctaataaggataaagcctgtggaaaaaagtaaaagaaactggatttattccagatggaggtgaaaaagctggtgattgcaaacatcagaagcctctaaagctacaatggcgaattattaaaaagtccagccagatgtcttcattgccagtaatgtcagaacaagaggatattgactgaatgggtggaaaggatttaggctagctatgaaggattcccaagatggctgttggcataaagttcttaaacacggaataacttctcgtctcaaattatggaaaatgtaagtgtgcctcagggcacaggatgagctttttaagatgcttctcaggtttacaaagaacattgaaagagtgctccacattttccacatttgtgcaagttttcttttttttctttttttttttttttttggagacggagtctcgctctgtcgcccaggctgtggtgtgatctcggctcactgcaacctccacctcctgggttaaagcaattctcctccctcagtctcctgagtttttgtaactacaggtgcatgctgccacacctggctaatttttgtagtttagtagagacagggtttcaccttgttactcaggctgg

SEQ ID NO: 56821 - DNA, 2110 bp, Homo sapiens
ataagcgccaggcccagcccacatttctggctgcactggccatgtatggtgtgatttgagttgcttgtaagaggatcttggtgggggcaggcaatctggctgaaagggtggatagcaggatttgtcctcaactacttggatgagacaaggatgctgtttttacttgtcctgtatttggacaagtttatttggattgacagtgggaggctaaaggatatcatatggggaatcatacacccccaagaaacctccctggtgccatagctacacactggtttgtgttagtttctggaacatgcctcgccttctgccaccccctgacctctgcatgatgcccttccctcacatctcttctcctattttctcaaggttcactcctgcttatatttcaatctcagctcaaaaggcccttcctcagggcaccctctctgttatatcctcccatcatatgcatgacactcgttactatggtggttttacatttatttctatgattatttatttattaccatctgacttccctggaacagtgaacgccgtgagagcagcaactgcatctgtccctgccccacgttgtatccccagagtctggcatagtgcccaggacacaggcacccagcagccgtttgctggataggtgttagtgaatgggtgccgacccttctgaacctcccctagcagcaggctgactggcttcaccatttcctatcctgcctttcctgcttttcttcctcctccaggctgcccctgcttgtctccaacctctgtgttcctaatctcacttgcttctctcaaaatgttcctgtctcacattcctttcctgggtttgatagataaggggcactagctagttagggagatggattactccacaggttaaagtgacttagagaaagtcacttagtgtgtcttccctgcctctcagacatcacctgcattttagcaggagcttctgtgccttctgtcaatggtggaagtttcagtattgcaagagctggtggaggacatagtggacttggggggaagttcagttgcccctcaagccaccccgggttggcagcactcaggttttgccctccatcgtcttctctctgcctgctctgtggggcttgtctctgttcccagatcaccctgtcccctttctgcctggggcaccaaccgtcaagcttggaacccgcctccttcctgaggtgtttccctctcctctcctacccagtgacctttggactgcttcctcattttctgccctggtgagtcagggatgccataaacaccaggcatgggcagaacatggcgacagacagacgcttcccattagggccgtcacaaagttcactgggagaggagcataaaacgtatatctgttggctagagctcacgccctgcacgtgtccaccaatgtatctccatctgcatttggggaacaggtgacacttgccgtgagcaaagctggctttccaactgtgccctggcccttcccctcctctcgggtcccctcccaggctaaggtcttgctccatctggtgtctgctgcactttcagactcttccttgctggcagcaccttccctataacctacaaacccacctccatttctccttcttcaatcccaaaggggctaaagaaatctgctcaggatcctctgtgcccctctggtctcagctttctcatcttccagtgttaggtgagctcctgacaaaataggctgccctcactgtctctactttttcacctcctagttggctttattgttaaaagagggctgtatgtttgttgcagagcatttgggaaataaaagtacacatagaagaaatctcagattgccccacgatctcagaatccacaggtaactgttattaatactgtattttggtgtattttcttctagaaatattctctctctctctctgtctgtgattgtgtaggactgggacactgttgtatgcacagttttgcatcctgctttattcccttatatatgcagtccaacaccgtgaattgaatccctcgggttctacctcctcaataagccttcccattaaatctcttttcctggttttaactcagctcctcccctacacacctcactcccttaacacttccactttaa

SEQ ID NO: 56822 - DNA, 1040 bp, Homo sapiens
tggatgaaccctaagttatcaccaaaaaagccgccatgcgctgccccctccacaaggctgttagagaaaatgctccaatgtgtgcacaaaatcaaggcacttccattccaggattttttttcagccaccagacttcatgaaagatttgatgtgctgcaatgtgccgctgcatgaaaagggatgcataaagaggcaagctccaggagacaaaagtcactgaacagctctgctcagagccagtgaaacctttgaagacccaatctctcacacacacacacacacttacttacacaccccaccttcctagaatgagaggaagcttccttgtttttctaagttaaatgagaaaaactcaggagaactttaacctgggaaaggtgtaaaagctttcttctctctagaaaaaaatgttttttctccccccatataaaaaagtttcagaaaacccacaggtgcttgatccatgaagagtttttgaagggaaccaagtttgcaagttgctgacattttgaggctgattgtgccattttagaacccttccctggcatctttgttagaggcacaatcccagcaggaagatttttcctaaatgtggtgccctacacttgtctgctctgaagtgccatgttcgtgtggatcacacaggtgtgggttggtccctggggtctgccctatcacgatggcctatctgagcccagtgtcacatgtctaagctctgtgcagtggcctagcctaagatatgtggtttaggggcttagcctcagatgtgcacttctgatgagaccctggacctcaagagggtagtatttgggccagagccggggtggtgtcagcccgcaaatgcaactgcaagataagcggcccgcccaccatctgctctgtggccctgggtcctgttgccattccaatcctaaattagcctggctccccgctggggcctgggccccacctgctggcacctgagcacaagtcagaagccagtgcttgtaggaagagctcatgcacctggaatgaatcacattgcctccctgtcagagacg

SEQ ID NO: 56823 - DNA, 2739 bp, Homo sapiens
atctcttgcgcactgtggggtggaggctgtagaagaggagagaagtagagaaacagatcacattgtgtcttgaagtgtttcagcaaatatgggcaacacccttcttttactagcttggaaccctacctctgagtgcatttccctttttattatttatttcctgtcagttataagagaggcctacccctttgtgagcagtctaggactttgtacacttgttaagtagggagaaggcaggggaggtggctggtttaaggggaacttgagggaagtagggaagactcctcttgggacctttggagtaggtgacacatgagcccagccccagctcacctgccaatccagctgaggagctcacctgccaatccagctgaggctgggcagaggtgggtgagaagagggaaaattgcagggacctccagttgggccaggccagaagctgctgtagctttaaccagacagctcagacctgtctggaggctgccagtgacaggttaggtttagggcagagaagaagcaagaccatggtggggaagatgtggcctgtgttgtggacactctgtgcaggtgagtaggccccttttctctccagtgcccaggggtgggtgagacatggggacctagggctgaaggagaggctctgtcagagccttcccaggaagggcctccagcaacacagctgcgttcctgctgggccagaattacacattccggaccagtgcccagaatcagaatggtttttatttacatattagtaaataacattctagcccactgctgaaatgaagaattcaaagtactctcaagaccatattttcttatcccaaattagattataggatcagacacaggatttgacaatgtggacaaagtatttgaaatcggagttgtcctagaaaatccaggatgtgtggatctagatatgttcattatctagtatattaacgtttgtgttaaaaccagagaaagagacaggaaactgaggcagaagagacaatgcaacttatcccgtatcattcacagagcaagagaagattcaaaccctaaaaacaaacaacaaactagatgggtcttttccaaaggccaaagctccttgccacttctgggaccctggtcattgaaaattctgggactctgagcatttccctctgggagggaaacctcccagaacaaaatcagacattcatgagtatatggttgaatccacatcaagtgcttaatagcacagtgttctgtggggacctatggagtgtctaagggttagaatgaaagtcttggcattaaggtaccaaccattttgctgggcattggaaggaaatagaatggagagaaggaagttgagagacgcagggtttggcaaagtttaggaatatctttggtttagtgtatttggccatcaccttgcaattcagacactgttgagggcttccaggatccagctgcaacggggaggagaagagctataccaggaaactcaggagcaccaagcctggggaagtggaaaccaggagactggtttagagctcactttttagcatacacaggaaagccccgggccacggggcctacagctcattctggttctcccaggccctagacatgcttttctctcaacacctggccttggggctctcgagggaagggcagcctgctgctggggaagggctggatcacacggtttggaggaagatctgggtaagatcattctctcaggctggctcaagttcatctgactgaaggcagaaagcccctcatcatccaccaagatggactggttggctcattcctttatccaaacaactctttactgagcacatagtttgtgcaggtgccatagaagtgaggagtctggaatgattagtcataagtgggcctatctcagccatcagattcaggcagggaggatgctccagggcctgagagagggaggctgaaggaaatacccatccttccctggctgggccagtgattctcccatcttctcctggtaagccagaagctcctccatgcctgcaccaccccaacccccaacacatatccccacacttgtagactggctgcgacccatgcatgaataaaaataagaaattttggcttagaaaaacgatcttaaaacaagatgctcacccagcttggagggaaaagtggccgtaactctgaattgcctggagcaggacattttgcttcttcctatgagaaggcaagtgacccctggggaactcacccagcagaacgagtcttgggcatgttttcagacacactgatgaagtgtcttctacctccgccccatccctcccaccacagcctgcccagcacagaatcacgtgcccaccaacttttcttcctccatatcttacattaagaggaagaaggggccagagcagtggggcaggagaagccaggcttggtggtcgacttgaggtatataaacagagtttaccaaatagtgaaatagccattgccactgcaggtgagcaaggaagaccttcaaaggtcgaccaaaagcaaccaggcggccctccccaccatgcctcatgagaggataccacctcttcctttgcgcaggtaagggagacccagttaggagcagggacattaggaaaggcttcctggaggaggtggagcttgacttgggttccagaggacttactgggcttttctcttctttctcttcccatctgacctttccgaggaattgattctgctaagacctgggcagggaagcactgcactgatgaa

SEQ ID NO: 56824 - DNA, 1028 bp, Homo sapiens
tataaaaggaggaagaggaaatactgctgtcatatcattaatgaacatgttgacccaggatgtgaggagtcctcctagatttgaccttgatttgtctctctgagagaaatacccttgtctattgttctctttgacctctagctctgccctcctagctgtcttgcttgtccattatcctccatagccacgttgaagacatgtcttccttgaaggctgtatagcttttgcagactgtgtcctgtttatgaaaatttggtggctctgggactgttttaaggtttatgccatgcaaaagcttttggaagttcctggtttctttgaaaatacgaccctttcaaaaactcaataggtttatgatctatgtagattagacaaatccatgtgttactaaccacactcaaagttctttcctagatatagttttcaatcctgattcattcatttgcctttttgtctccgtttaatgatagttatcttgggaggttatctgaaactgtaaatttgggtgtggagtccaagatgcatgttgtaatttgtagtgtaattgttagaaagttttgcagtggagtgtatagctaacaagctcatgaagggtggataaaataataaaatataatcaatctaaaaggagaaaagaaagtagagaaaaagaatacagaaaaagaacaactgtctccacaagaaactataggttaaaaaaaaaagaaagaaaaagaataataagaaaatagtaggatggtagatttaagctcaaatatataaataactacattaaatgtaaatagactaaatactccaattaaaagacaaagatggtcaaactcaatttttttaaaaaggctacatgctgtttacaagagacacaccttaaaaataacgatataggtttgtcatggtagctcatgcctgtaattctagcacttttggaggctgaggtaggatgattgcttgaggccccgagtttcagacaagactaggcaatatagtgaggccctgtctctacaaacttttttttttttttttttttt

SEQ ID NO: 56825 - DNA, 1069 bp, Homo sapiens
gctgcagtgagctatgaccatgccactgcattccagcctgggtgtgaaagtgaggccctgtctcaaaaaataaaataaggatatacaaaagttaacaaagaataaaaaatttatactacactgtttcagttactactgctcataacttcaaattttagtggcataaaataccattttattatgttcataatcaggagcctggatgaggcacagtggggttagcctgtctttgctccatgatgtccaaggtctcagctagagagatttgaagactggagatgccttaaggctgagggtgactcacagaggcatcttcacgtttggcagtttatgttgaaatttacctgggcttttggccggaatacctaagatagtccctctatgtgggttactttgggctttctctaagcatggtagctaaattccaagagttgcatccaagagaataagatagatgtgtattaattttcatgagctagcctcaggagttacatagcaccacttctgctgtactctgctgacacaaatgtccatgaagtttcaaggggaggcaacataaacttcatcactccatcagagaagtaccaaggtgatattgtaaagtaagcaaaagcaagccagtgaagcagattttaaagtaatcattactagatacaaagagacaaaaagagacacttcataatgatcaaaggttcaattcaccaaaaagataaaataattttcaatttctatgtttaataacacagcctcaaaatatataaggcaaaaaactgacagaactgaatgaaaaattaaaagccacaatctccctcaactgtatgtatattttttaaaactatctcagcaactgataaaataaaaaaaatcaaaagaatcatttttaataagaatatcaaaaattatcaagaatatttggataaaacaataaataaaattaacctaatgagcatttatagaacatgcacccaacaagtacaggatacacattcttaccatgtacacatggagcatttgtcaaaatagatcatatactgggccatacatatatcaaccaatgtttagtgattga

SEQ ID NO: 56826 - DNA, 1018 bp, Homo sapiens
ccaaagactctagggaagactccttccttgtctcttgctcgtttctgttggctacgggcgtttcttgcattgtggcagcataattccaatctctgccactccttcaaaaggccgtctgctctgtcttctcttctcttataaggacacttgccactggctttagagtccatcctaatttagggttatctcatctcaaaagctttaacttaattactcctgcaatgatcctttttccaaaaaagattacattcccaggttttggaagacataccattttggagggcaccgttcaactcactacagccctatatccagcccctaggaaacagaattttactctttcctgtggaactagaacagagccttgcaaaacttcacccagtgatccaaacagccactagcagccagccaaaattagcagggatgtaccctgcttgctgtcctggcagggagtcttaacatttcaagtctcatctgtaaatctcatcctagggtgaattaagaatctgagaaaggggtgtagaaaatggatggggtatcaaatcttcatttttgcctgagttaggcactaacttcaaacaccttaaattcaaacctagccactatgagtcactctctggaagaaaatgggcggttagagattcatccatctcacagctaggcaaatttccctaagtgattcatgagttgacactgaaatttaaaaccccctgtcagtgggggagcttggtggggacttctcccttacctatagtctccgtcaggccttcccagtcacctaaacaaatacagcctaagaagtaagtgcacagccgggcgcggtggctcacgcctgtaaccccagccctttgggaggccgaggtaggcggatcacaaggtcaggagatcgagaccatcctggctaacacggtgaaaccccgtctctactaaaaatagaaaaattagcctggtgtggtggtgggcgcctgtaatcccagctgctcaggaggctgagacaggtgaatggcatgaatcggga

SEQ ID NO: 56827 - DNA, 1013 bp, Homo sapiens
cagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagagagaagaggactatggccgggaggggggatcagctgaggctgaggagggcgagggcactgggagcatgctcggggccagagtgcacgccctgacggtggaagaggaggacgacagcgccagccacctgagtggctcctccctggggaaggccacccaggcctccaagcccctcaccctcatagacgaggaggaggaggagaaactgtacgagcagtggaagaaggggcagggcctcctctcagacaaggtcccccaggatggaggtggctggcgctcagcctcctctggccagggtggggaggagctcgaggacgaggacgtggagaggatcatccaggagtggcagagccgaaacgagaggtaccaagcagaagggtaccggaggtggggaagggaggaggagaaggaggaggagagcgacgctggctcctcggtggggaggcggcggcgcaccctgagcgagagcagcgcctgggagagcgtgagcagccacgacatctgggtcctgaagcagcagctggagctgaaccgcccggaccacggcaggaggcgccgcgcagactcgatgtcctcggagagcacctgggacgcatggaacgagaggctgctggagattgagaaggaggcttcccggaggtaccacgccaagagcaagagagaggaggcggcagacaggagctcagaagcagggagcagggtgcgggaggatgatgaggacagcgtgggctctgaggccagttccttctacaacttctgcagcaggaacaaggacaagctcactgccctggaaagatggaagatcaagagaatccaatttgga

SEQ ID NO: 56828 - DNA, 1050 bp, Homo sapiens
gttacaagttttccaaatcccagtcagaggaacaggacacctcctcctaccacgaggcaaatggcaactctgtaagaagcacttcacggttctcatcttcctccaccagggagggcagagagatgcacaagttctccaggtccacgtacaacgagacctcaagttcccgagaggagagcccagagccctacttcttccgccggaccccagagtcctcagaaagggaagagtccccagaaccacagcgcccaaattgggccaggtccagggactgggaagatgtggaagagtcatccaagtcagacttctctgaatttggagccaagaggaagttcacccagagctttatgaggtctgaagaagagggagagaaagagaggacagaaaacagagaagaagggaggtttgcatctggacggcggtcccagtatcggagaagcactgacagggaggaagaggaagaaatggacgatgaagccatcattgctgcttggagacgccggcaagaagaaaccaggaccaagctgcagaaaaggagggaggactgagctggggaaaatctgagaacactgaaagaaaccactcacgttagcatagggctcagggcacacgttgccaccactcatcgcaggatgaggatacagagaggatcttccagaggggcagagccaaaatgagaggtaccaagcataagggcagcagaggtggagtagggaggaggcaaggagggggagaaccatcaatacgaatacgaggtccgaatgcggaccaactgataccattttctgttgctcagcgccctctaagctttggtgtttcacttaatgtatttggcagtgttcatcacaggctagagaggtgagcttggaaaagcactgtagtttgtcagagactccagtttacatccagaaaggccatgaacataggacacgcttctgtctgtagaggcttcatatgagacccagaaagtctatcctatggcaagtctgacctctcctggcaatgctcagttctgatttttttttttttaatgttttgagtctccattaa

SEQ ID NO: 56829 - DNA, 1051 bp, Homo sapiens
agttaatttagagtccacagtctaagatagaagcacatcagcttcttgaagaattttcctagtgcagagtctatgcaacttagtataaaatggtaagagaaaattagtaactatgcaaatgcaagcagtgacatatagatgcttttgggaatgatagtaaaatccaccagattgttaaggcttattcagagtaaaaaccattgcaaagaattttacagactataaaatctttgcagtgagacttataaagaatagctatgcagcggagagactgtactgtccccagtgtaggtcacgggttcagatactatggtcacactctccttggtcagcagtgttatctttgaatacaaaagacaagaaggtacatattatgtagtcagctgtgaccatcaaaggccaaacagctttttcttccagctggagccatctgcctgactacacaatacccaggacccagggcagtctggtggcaggataccccaccccactacttagcccgagtcacctctgagagagcagacagggatttcttacagctttacacactgcctttgttggttgtttccaaggtgacaaagtgttctaccctttgctgtaaataaagacaggagcagagggatctaaccctttcctcctcctctatcagcctctgtcacgttcagttgcatgcttcttgtaaggctgtatacagtgaaagccccgtttcccagattcacacctgccttgggtttttttgtttgttttatgtgcatgtggaactttgctgtcggtcacagagccttgtggctggcattcaaggccctctggtttttactcctacctcactccaaaatgttttctcatcaggagaggaataaattcaaatactgttgaagattgtattatgtatttccaattagtcactgaatctctctgtgattatgttttcccaggccactgacatcaggtttggcatataacatgctttggccagatgtgctgtcagtggaagtaacatgtgccatgtctgacaaaggttttaagagtcattctcacagttctgccatta

SEQ ID NO: 56830 - DNA, 1061 bp, Homo sapiens
atgtttagtaattcagacctttaataacagccactcacagcccaacgccgtgtttatattttacattcgccccatgtgcttttgtggttcgatatgattttttttttccttggcaatccgcagggctctgagatcaaacccaggccgtgctgggaagagaggggggaagctgggccttggcttctctagcagttgcctaggcctcatgttctctgctgcttgatttatttactaataaccaaaatgactacctccaccaacttccacacactttcccctcctctgcgggcaaaacaaactctcttggggctttactagcattaaaacaggtcctagctaagtatcaactctgtgatggtttgttttctcttaaaaagactttcttatactttgcagtagtattgggcctagggggaaaaatctgtcctgtattttattttcagagcctatgaaatctattttggtttaatccaaatcactttgttttggggatgggtaccccggttgctccccacccccatgttaaatactttaaggctttgtaaaggtctgtagtatttgtaaaactgacactttttttttcctctaggagttgtggagtagctaaatattagaaattccaattaacaacagtttcataatttcttggtgtggtgctacctttctgacatcttcattctaatttaaaatggagctgacgttaattttgtgctatcattgtcatagacttgcttattttaattgtagcactactgaaaacaaaaaaatggggttatgttttctttgagtatttgtgtcatgattaaatgagtgaaaagagaagaataaacataggcattgcgtttaccctgatcttggaacttattctcctcccagcacacccgcccctcctctttaagttgtcagaattgatgttatgttttatctagacttaggacagttggcttgtgagaggcagattaacttttactgtttagaggaaacagtaattttgatttttggtctttcctgtggtaaaattttcttttaacatttttattttgtgtaggggtgtgtgtgag

SEQ ID NO: 56831 - DNA, 3175 bp, Homo sapiens
gctcttctcaagccaccaaagatgtttaatagacccttgaatatcttaggcaggtggttctgaaataacagaagtggaaatttgaatgttatctttaagtattttctattaaaaattgaaatatttgacctgcttcttgaatctgtattgcttcatcttgaatttatttgtgttttttaagttggtcactcattttcatgaatgtttcctttgtacttggaagactgtaatattatgtagtagtgattgccttgttgttatcggttatttttgttttgttttttaattttgaaaccccatagttgtaatctttgcatattagtctttcaagcaccattaaaaataatgttgtgtgactcattaatttgcctttatataattgtgttaattacacagtttttgtgattagtaaagacttgctatgaagcctgattttaagcaggaatgtgtttttcctaatgaaagtgattgcatttgaatttagaactattcaggtaatttgcgtttagggaacagaccaagtcacaaacaaaacatgcccccttttggttatccatgttcttgtttctgatccctccttaaatgctaaatgcctgagcaaatgtacttactatttcttgggcgttagagttgaaagttgttgatttgattcagtgacatatctgctttgaatttctgtaccctttctgcatgaattttttccttttcctttttttggggtaactttgagtcaccattttgcttacttcttactgtgttgcttaaaggatgtaaatatccttttgagtggttgaaagggataataattaaggttcacagagaatagcagtttccttatgcatctttcgctggacatttttgtgcattattgacatttcataagtaaagagaattgaataactgtagattttaattcttcttaggaataaattggtttgttttgtaccgaagtatttctgtgttctaaacaggtgatgagctcttataaactgtttcagcagtaataacaatggaaacaaaaatagcctgagtagagctattgcctgacttacttgatccgtttacagtatgtttagaatttggaatatgagaattgtcttgagtttcagaagttctgatttgaagatgctccttgcatacagtgcatgtggttatggggttctgtgtgtttttactatggggtgtgaattttttgagcattggtatctttgtatactcagtgactaatagagctcttttgtttttgggttttatttatttatttatttatttccaattaagcaagcactcaagatttcagtgttgcctacatttgctgacaggactagtaattgagcaaaagaagaatcagcaaacctctagatttatcagattatcttttattcatttattttctcttatttttaattttttttaagagatggggtcttgctatgttgcctaggctagtctaaaactcctgggcttaagcagtcctactgtggcctccccaagtgctgggactacaggcatgagctaccacacctggcccagatttcttttaaactgctggaactcctggacatttatccggagaggatacattatactaacttttttttaacagccaatgttcacattccacaaagctaagtgtttgtagtagctttactaagtcttcaatattgaaagtcatagcaagtgcagtttatcacattatttatttcataattctttgtaactttatgctttttatgttggaatatagaaatggtatatgaaattaaatcaataataataattattatggcaggtttccccccctctgttgaactttctctttgcaatagaagatataaacaggaatggctggaaaatgaacaatatgctgtgtgttaaacgactcatttgtgcttaaacatatgattaccttaatggagttgcactgataccttaaagggaatatatttttatatggaaaagtgacttaggtgttttcttgttttagtacacttattttagtggtctgcttaatgaaaaatacagccttttttggctgattcatactgcagcaagcaatattataattaatgttttaaagtagttaccatcctagtctataaaaggtatctgctatgtacctggtcctatgcctgtagtctttgggaataacaaggaaatatgactgctgcggaggagttggtatgtttacttaagcaggaaaaattgaaaaacagtgtatataattacatattaaaatatgtaacagataatgaagattggagaatagatcagagtgtgtccaagtttgaaagagccagagcatcctagaatatattatagctggaaggtaatttagatataatctttgctaaaggttttgcttcacagatgaggaaatattttcacaatggtttagtgacttgctcacagtcacttaactattcagtaacagataagaacacaagacttctaactttctcccacctcccagtctctcctcctgccccattgctgtcagtcagagaaggctttatgtagaaggcgagacttttaaaccgagctttaaagggcaaaaagaatttagaggaatgggaatacagagaaggccattgaaggggagattgtgttcaacattgtgatgtataggtaaagaatgaggaagcatttgttctatctgcaggaaagctgttggaggattttgaaatagggactgatgtgataaaaatggtgtgttaggagtaatgtggtgtgcaggatggtttgaaataggaagggagagattagatccatagaaaccagtgtatagaggtatttggtttattaactaattactgtaggtgctactagagatacaaacataatttaaaaattacttgacctcaagagacttccagtctaatttatgaaatagataagtcgtgataaaggtgttgaggatattgtccaattacattacatggaataaggacgtttgggagaaattcttacctggcctttacagtagaaactatttgtttttagtcttatggacactgaattgtctaattgacttagtttccttttcaaatcaaactacagtttgatttggtcaaatttaggtcagattattaacctgagaagcacatgcataggcaattacgtttgcatttcttagcctgattagtagatcaattttttgtccatgcatttgttt

SEQ ID NO: 56832 - DNA, 1064 bp, Homo sapiens
actatacccattttatagtcgagtaaaataaaacttagattaagtgactttctcaaggtcctgtgtttttataagcattaagtgtgggtaatagcaagacttccagcttagttgttatttaggctgtgtattaaggcactttggggctctattgtggagagctctgaatcctttgtgttggtgtaagagtttggattttatttgctaggcagtaggaagtcactgaattttttttttttaatttttttttgttatggacagtgccatgatcagagcccttaaagtttagcagctaattagatgcaaagagattatcaaggttttgagtttaggttatccagaaaagagcattaccataagcagatgtagggatgttgggaaaaggagccatttggggagtaagtcagtgaattcactttgacatgtcatttgagacatgtttgggtgggtcttattgggttgtagattccttgtgaaaattgaaaattttttagtgaattaaatgtttgataaacattaatactagggttgaaatttatgctcatgccactgtgcgtgtggactgagtattgaatctgaacgttgtaaattctagatatctcattttggctttggcactgtcttctaaggttatttccttcaacaatacgatggtgataataccagtgttagagggatgctgtggggagtatcaaattgatagcagaagcatttttaaagtaactctgtaatagtttttcttacatgagcacaggagtaaaatcaggaattttattacttgtgctgctgtagagaagcagaagctttagcagccgatggattctgtggggcacctgactgtaggttgttcattttttggtgcagccagcatcttaggaggaatggacactcctaatactcttctgaaaactttatacagtggaggtgttgcattgtagcaaatacaacttaccttgatttcagggcattctgttatctagcccctacccttgcctatgcattattatctttactacttccttaaatagcatgactcaacaattccatcaaggaagttcccttat

SEQ ID NO: 56833 - DNA, 1003 bp, Homo sapiens
catgacttgaaaacttttgtccttatttatcttaagggacctgtctgtccatttctttatctccacaaatagccatctgtcaaatctgagctcctgtcatactttctctgaaattagcacttaatttgtgttcagttacccaattcagcacttcattatacacagtcctattttcttctctaattgattatgtaagtaaatcttgtcctaagagccttgagtgcaggaacatactggtagggacagagtaggcctagacatttaacaaataatgaatgcttggttgatggacttagtggttctcaatctttgtcaccatggggtgacccatggaactttttcaacataagaaggcccaacttctaatacagtagaggtctgaaaatccatactttaaaaaagctctacaggtgatttgataacattaaatgattacttgttgcacttcaagattatttattgcttagcataccttgaataatggttttcagttaatgcaccagaaaggccctatactggaaagacagactgagaattaggagacttggatccttattctgcttttagcattaacgataatagctttctgatcctgaataaatcactaaatttttccaacccataggattcttattgataaaattatgggctgagctaggtgaatagttttcatactttttttttcctttttaaactggaattattcagaaacatcttttgggtgaagaccagtaaatataacatatatttttatcagttcggctttcatctgggtacctgaatatttattaaaaatatagaacatggtaagcttggtcctgtcctagtaggagagctaaattgtatgcagtaggtagtactgaagatgggatttagactttaaacttgaaacatcctattagaatgcgaatgaacaaaggtagtaagcttatcaataattgtggtactcagtgtgaataaaaactagattatgatgaaccaatatggccagtctttctgcatt

SEQ ID NO: 56834 - DNA, 1202 bp, Homo sapiens
agttggttgtatgcaaactgctgatcctggtaacccatacattctcaacattttgggtttttgttaagaattgtattttagggtaggtttggtggcttatgcttgtaatcccagcactttgggaggctgaggtgggaggattgcttgagaccatgagtttgaaactggcctgggcaacatagcgagaccttctctctgcaaaaaaatttaaaataatagccaagcatgttggtacttgcctatagtcctaactattctggatgccgaagcaggaggacctcttgagcccagcagttccaggctgtgatggactgtgattgtgccactgttctccagccaggatgacagagcaataccatgtctgttaaaacaaatatatatgaaactgaagctaattacacatgttaaccttgggataattttcatctggagcagcatttatatttttttgtgacccagttggtgaaatagaaaattaggatttaccctgtttacatgttattttgataaaaacataatttaaactatttcagtgttgtcaaatgagttgtgacttaaaattaatatgcaagcaaattatgcaaaaaggtggatttgtttaccactttttaccaaccacttcctttctcccataccaagctgttactaaactagggctgtagctttcagttgaggaaacatgacggttgattattgtttctaataatagctattattagaagtcagctatttcatggcattggtttccagtcattcacacctcatttaatcatgccctgcatcaccttgttgagttgttaatgctgtttatttctcaatttttcttttacactacattgctaagtccccccatcttcctcttcatagtgctttccctaccctctgagtacttgcttcttcatgctctggccaaggagagtggtgttttggcagactgttttatacatgtacacttatatgccaatcatcattagttagaaaggaattggtgaaaatgctcttatgttatgagagacatgttcaacatcacaatagtctgagaagatgaattaacaatttatgagtgttgctggaaagtatgatttcaggcgattagactataggggcaaagccattgccggcttatgctgttggaatcacatcttagtagttacataatgccatcaggaccagtacgagactggtttggtgattgagcccat

SEQ ID NO: 56835 - DNA, 1335 bp, Homo sapiens
ctgggatttgttcctatgtattgcagacagatgtccacgcttaggtgtgcatgctcctgtcatgcatgtacacataatttttaaaaaaggagtcatagtgcatatcctattatatacttgctgtttttcccccattgctctctattctttagttcactcatttaaataagataaacattttaatgaaatcatattctttgcagtaacttggatggagccagaagccataatcctaagtgaattaatgcaggaacagaaaaccaaagactggtttggtctgttctgctgagacctagtggaggaggctagtccaaaatagtagtctcccataaactttctttaacagaatatacacacttaaaaattttgtacatgtcgtcaggttgcttttagtaccactctatattttttatctacagtatttaatagtgtcagtttctcctgcactgttaactattagtcttttaaatttttcctaggttgatgaaaaacacttcattgctttaattttaatgtttttactctaatttggacatctttttttttttagacagacgattgctctgtctcccaggctggagtgcagtggtgtgatctcggctccctgcagcctccacctcccaggttcaagcaattctctgcctcagcctcctgaggagctgggattacaggcgcctgccaccatgcctggccaatttttgtatttttagtagagatggagtttcaccatcttggccaggcaggtgttgaactcctgacctcatgatccacctgccttggcctcccaaagtgctgggattacagacatgagccaccgcgcccggccgacatcttcttattaaatttttattaaattaaatcttactaaattttattaaatataaaatcttttatcattagttttcaaatgtacaacaatgatttatttttcctgttttggccgtttcagaatacttgtagttttcctgaaaatttatgacttcttaaatattctctttcgacgtgtgcctgccccacctccttccccgcagctaattcctatacctctttggagaagtagcttagggatgcaggtggagcttggatcagtctacctgttagtcacatgctttacttgcatcccactattagctgttcatttatagaaaggggatggttgcagagtctgggcagggatgggtcagctgtggcactgtggtcctggagagtcataccctactcttggacaaaaatgtttctcttagcagagaactggagtgagcatattttttttactctgctttctctaaaggcaattttaatttttaagtcaaatatatgggaggtagggataaa

SEQ ID NO: 56836 - DNA, 1400 bp, Homo sapiens
tatttagttttggggatggaaaggcttttttttttttctttaagctatgaataggactttatggaaaggcttttttgacatgacacacaactcaaatgccataaaaggaaaagatggatagatttaactatataaaatatttatggttctgccttctgaaagactctacaaataaaattaacataatatatggtagaaaagtattagcctgtatggaacatagagggataatttttcttactatatcaagttctcttagacattagtagtacataacaaataccccagtagtcgaagtgtatgaatagtcaattcatgtagaataagggctgtgaagatatgaaccctgactagaagcctctgctgtaaagacagaaccttctttaagtccgatataaaacaaaaggatgaagaattacaaaatgtatgctttggtagggcagtgaagaaattaaaatattagaaaaaagagtaagagttgaatactggccattgttttagaggtaattgaggaagcgtattttatatactcgtgggtaattttactactttaaaggtggaaaaaatatttaaaataatgaaataaatagagaagggattcctgctgttcctgatttaacacacaggacaacagataaatgattatgagcttatacttagcctaagtttgtgtggaaactgttagtttcttccaagataagtgtttcctagataactgaaaatctactattgttttaattcactttttcttgtgcttctgcataaacatatttaatatatgcctttggtgtcccaatgaagttcaccttttacagttggtttgaagcccttccctagaggtttgccaacgttatttctatgtggaaatccattcagaacccagcttctgaaacctttgctttggggacaccttgttctgtaatgaaattatctgaaaaggccgggcgcggtggctcatgcctgtaatcccagcacattgggaggcctaggtgggcggattacctgaggttgggagttcgagactagcctgaccaacatggagagaccccgtctctgctaaaaatacaaaattagcctgatgtggtggtgcgtgcctgtaatcccagctactcgggaggctgaggcgggagaatcacttgaacccgggaggcggaggttgccgtgagccaagatcgcaccattgcactccagcctgggcaacaagagtgaaacgccatctaaaaataaataaataaataaataaatagtctgaaaaagttctcacccaggagataactctcctctcctattttacacatctccctttgatttgccagtgtaaagcaataaccttagcagaatgatgtcttctgtcataatctatttgtcttcataagggcatgactcaaagaggtctgtag

SEQ ID NO: 56837 - DNA, 1077 bp, Homo sapiens
cttgaattaagtttcaggattgacagccttcattataacatgtcccatgtaattagcatcatgaccactatcacaaacatactgataaatatagtacaggacccagatttcagcacctgttacatagagccatttgtttttttcccctcttatccgtagctgccctccacaaatatggataatggaccgagagtagactgtgctgtgtctgcccatactctgaatcatattgccaatctcctactcatcctgcctcttgagaatcctgagcacaggacacctgagatagcaaaaggtccttcctgtagtaaaaggcttacagagtcaaatggctggagcggtgtgagaatatggactcaggaactttggaattgggagtacattttagattagaagatagcatgtaaaggaagaaggagagaatttttgtgggtcaggcatctgggcatggctcaggtgggtcctcacaaggttgcaattaagatattggtcagagctacagcctcatctgaaggttcaactggggaagcatatgctgccaagctcactcacacagttgttgactggactcagttccttactggtggtcgaaccgaggaccctggtttcttcctggcagttggccagaggctgttctccattccttgccatgtggacttctctggcttgcttcagagcaagcacatgagaagagccagatagtgttccagctggaaaggagtattagcaagacagagtcacagcttttgtaacctaattgcagaagtgacatctcatccctttttcagtattctgtttattagaagcaagtcacttggtccaccccacactcaaggggaaggggctacacaagggtacaaatagcaggagttcatgaatcattggatggccatcttacaaatccacctatcacctacctactgaaagccttcagtaagctttaagagcatacaggagccctgacacccaaaaattagagaactgctgatctaaatgtatgttacattggtggaacatgtatgggagatataataccttccttaaaaagttcttctctaggataagatcttgggcctt

SEQ ID NO: 56838 - DNA, 1098 bp, Homo sapiens
ataataggtaacatttaatatacagtgcttattatgtgccaattgctattccaagtgctttgtattttccatgtattaactcctttaattttcataacaactttattatgtaggtattataattatccccattttacagatgaggaaactgaggtacagaaagagaaaataacttgtctaggatcacatgatgagaaagtagaagaactaggatttaaacccatgttgtctcatttcggagttttggcttttattatgagaaaagttaaactctggattgcaccggagataagtacctggggtgagaaaaccttttcaattaattcttcttactgaaacacatatattattttcttaaaatctgaagcagtggatcctatccatttttttctgcctctgtaagaatgtttggcatcctttatcttctcatctccaagctttccctagtaaccagccctcttaaacttcagcattctcgaacttctcccttctgttttctctagataccagccttttgcttccccttatctccagacttctttgtaaactcctctaaactccctgcctctgctatataactttcattccctcctcatcccattgaaatctgggttctaaagagagatttatgaggaaacttgctaggcagtgtagggttatgccttctttttgtttttctaatagtgcttgacaggtcaaggtgtagaagtaggagtggagatggcagccctccaggattggggtctttgttaggatgtggaacagaaggacaggggagcaagggagtggaaagtcttgacaggaatgtcattcatggaccctgtggtctcagtagaatttagaaggaagtgaagacgggagtgaattgatggtctaggggaaaatggaagagcaggaggtcaggtgaattgcagaaaagctctttaatgggagtaaaagagccagaggtctgggagtattgaggtagtattgggagagtttaaagttttagaggaggaactgtcctgagtgatacatttcaagatctggtggtcattggtgtgaatgactgaagtgacagtcgtgagagttcatgctgactcacctacagtgaggatg

SEQ ID NO: 56839 - DNA, 2771 bp, Homo sapiens
atgactagtttatagcttttgatcttatgtgtaatgacactgggaagaaaacatgtatccctctaaggtagcatttctgttatttctatgcccaaagactgtgctgaccgccattttgccagaagctttgaacactgttgactgattgatgtgtacatctaattcagatttacataatctaattggacccttgggttcttaaaaaatggccttcttttatcaccatatgtgttcattacaatgcatattttaaaatgagatggcccaaagagcatgctatgatgaatttactgttgaaatacttgtgaaacttggataaacctaattatcaagggacagtttcacttaagagggcaaaagtttcacttcaaagaaaagcctactgctcttgcttttaatggtttgaattatgtttttatctttcatcagcccaagagtttgtacttcagggtcagaaacaaaacttggagcctctgtgaatcctgtaatcatttactaactctcttgtagaacaagatgtcattttttcctactattctgtttcattctttatttttctgcccccccccccccaaacacacaggagagtggaacttgggattataattggttaatgggttttttgggtttttttggtcttactctgtcacccgggctggagtgcagtggtgctatcttggctcactgcaacctgtgcctctcaggctcaggcgatcttcccacctcagcctcctgaatagctgggaccacaggtgcctgccaccacgcctggttaattttttgtatttttggtagagacagggtttcaccatgttgcccaggctggtctcaaattcttgagctcaagtgatccgccggccttgacctcccaaagtgctgggattataagcctgagccaccacgtccagccagaattttttattttttaagaaagaaagtttatcttaggtcctccttcccccataccccattttaatttggtgccaggtttgcctgtctctgtggagaaaagaatagaaatgttggctgagggaaagtttttatgtctcctctaatacgtatttcatttttttctatttgctccttgcttttctaatacaggtaggataaagaggcaacttcaggaatacccagactttagctccatctaggaatttttattggtttgttttttgactagagtgtagaatggaagctcttttggctgggttgggtccttgggcaaaatatttcagactcctgtattatatggtgaattaaattgcttcactggcactttttcttttttaaagcctgttcacactttatacagtttttgaagaggaaaactttggatagtgctctttcaaaccaggcaaatgcctcggtttcttttaaaaaatctttgtaaaataataatattagtctgacttaaaggttatgatggaatacatataaaacatttgggagtctcaattctatttaatgtaggttcgatcaatgttactaatgtgctttagctgcaatatattaatatttgtttcttagcatcctgaggctagccacttgcctcttgttcaccttactagtacaactaaactagtgtctggccctgaaggtgggcagaaaatattcattaaattgaattttgatgtagggataattctgtttctttgtgtcttgcctaagtttaattcatgtcatagtcatgtttcacatgtatcttaattcttactgcataaaatgttcatgcaaaaggcagtattaattttactcattgttaacaatcagcaagtactattcagagtctgactcataaccatagagtatcttgatgctataatcagaaacatttattatccctggctttagcagttgaacttacaggataatgtttagttctcattatcagagaaaaaggtgattcaggtaatttcttcatttgttcgtttctctatccctctaccccagtgtcttgaaaaaatatttagctagaatgctcaaaaatggtgtgttagcattcattttcttccattaggtgatttttgttgactatcattaatagcaatatgtaagacttactattcatttgcctatttattcattctacaacatttattgtttttctactgccaggaacaatttgaagtgctggatatatttagtgggaattggttttcttaggcagattatcatctgtttgtgaagctttttcacagtgtacgtgcctggccccaaatctaggagattcttgtttggtatatttggtgtggtgtaagttcaggcatctgtatttttacagagcttttcaaatgactctaatgcacgtttgcttttgagtaccataggaataaaacaagtctcattcaataggtactcaaaataggtaaatgcagtaaagtttcatagatgctgtaagagaaactgttggtatagtgtgggcacaaagcaagaagtcctactaggtacctcaggaaaggtttcctaagaatagaaatgcctagctgaatcttgttctcctaagtgttttagagtaggtggaacccatgaatctatagattagcctaagtaaattccagtatgcagggcaatgtgaacaaaaagagagaggtgtgaaacagcttacagcattttggaaattgcaagtagttggcatgattgaattactagatgaggatggttaaaaataagatagtttttatggtgctgaaaacaagcatacattaaagaatatgaagaaaggagaataagagtagacttgaactttagaaagatgacagtgatggtatgaa

SEQ ID NO: 56840 - DNA, 1035 bp, Homo sapiens
gagaagagagagggaaaagggagaagtatcaggttgtgaaggcattgcctgagtgtcagaaatgaactctacttctggctattctagttccttgagacaataaatttcttcttttttttttttttttgctgagtttgtgttgggttttctgttctttgagattgatagggtcctaactggtatagaaatgataataattgttgttgaagcaggagactagatgatggagataacataactttttagatgaagaattgttgaggatattcacaccaaataactttgaatttcaacttgagaataactgaggttaagtgagtaactgaaagtcatgcagctgagagtagaattcagatctcagaatcttcagcttagtgagtttataccatatcatctcacttacgccacccgaaaagttacgaaatgatagtctttggatgtgttgcctttgaataagggagagtaatttatttatttattttttccccttggtggttgtatttggaaaactttgggatgtagcagtacaatgactttcctgctctgaagagcctgagtgaatgcctattgatatattagagtctgggtgcactggttataactacacaaatctttattttgaggcagtcataattttgagttgcttcagggagagagatacttataaagcagtaaaaacctgtccgaatgtgactgtaccttttcactgtctggatgtgcttgtggaaaatgtctccctaggacctttaattttgttcctaaatttacaacagagccacttcttgatgctatctattgctcaaggtactgttggcgataagattgttattaagttgggtaggtgagctgtagactgtgtcctgcagggaaccatttattgttttgtacaagaataggtagtggtgaggaatcaggtctcattttgggcatcaaatggtctctcactttaaaatctgacattggcactactttttctttgatttaaacagaaagaccagcagatgttcatgtgagcatgaggataacttaaaaaca

SEQ ID NO: 56841 - DNA, 1032 bp, Homo sapiens
ttcttcctcctcagcctcctgagtagctgggactacaggtgcgtgccatcatgcctggataattttttttttttaatttattttctgtagagacagggtctcactatgtttccaggctagaggtagatgtttttaacttccattttacaaaagaggagtcttgagatttaggtaaaataatttgcccaaggttccaaagctaagctgtgattgtcatgtgtgtcaccgctgagatgtaaacataggcaagctgattctcatgcccccactttaaacaatatgttatagctccagatgaatgaatatgctcttacctctagttatattgtgactccagaagtgactgcgggtaacattttgcttcattttctactgtttcttatagcttgtgagcatctccatattttggagggagtgactgaaagacacaagaattagcaactttcttcatatttcttccccttctgaatgtgccacactgtatgcgatccttagcaattgtttgacaaccagttattatcaaacttgatcctttatttccttcatagcacttacaaattgcaaaaaaattataattgcattaatttgttttgctttcttctttactaataatatccagcacatacctaatggccaggtctatttgtctatcagtcagtgagattatatagatatatgtgtgtgtctgtatacacatgtgtacacaggaggacctgtgtaagctgttaatcagaggttggcaaatcttttctttgaagggtcagatagtaaatatttcaggctttgtaggccaagaggcaaaatcatggatactatgtagatacttatataacaagagagagaacaaattaccatgtactttaaattcagaaaattcaaaatataaacgaatagaatagtaattgagttaaaaactcttgcaatacaggtctactaatgagaagaatagaattatttggggaggacaacattttgcctaattggggtccaagtttagtgtttcttatcaaaacttttgcaaatgttcttctg

SEQ ID NO: 56842 - DNA, 1049 bp, Homo sapiens
tcagtgtactttgttcagcgaattgcgggaaacacaagatgaatcagaaaccgtatctgccctcaaagggactaagttcttaaacagtttaagttataaatatagttgcttgcttctgtgtacatacgtaccctcttagtttcacagagggagctagaagttgtttataatttaattgaggagatcaaacatatgaagaaaaatcattcaatgtagaatgtggtgagtcacaaagcccctggggatggattttgtacttgaggtgggttgaagaaagatgcttagagtggcagtaacaagggagctgggccctcaataaagaaggtaggattttgacaggtgggttaaggatggagggtggggttgcatttaagaaagaaaaaaacagtgtgaagcaaggtctggtagaggcagaaaaagctggccatgtttggagcaaaagtagttcaatttggctagaatataggagagaaaagtacataaattggggccagtttatgtagagtcttaaatatcaggctaaggtgtttggacttaattcagtagacagtggggagccactgaagtgttttgagtaatatgatctgagccatacttttggaagattaatctggttgcattgtcagtaatgaatgagaaaatgaaagtgttttccattgttggaacacttttttgttttctttataaacataactaaaacaaatgtaagcttagtgtagctatcaaataacactaaaaacctttattaatgaaaatgtaagaaaagatatgtttttgtatatccagctattttaaaaaacatgtcggccgagtgtggtggctcatgcctgtaatcccagcactttgggaggccgaggcgagtggatcacctgaggtcaggagtttgagatcagcctgaccaatatgatgaaaccctgtttctactaaaaatgcaaaaattagccgggcgtggtagcatatgcctgtaatcccagctactcagggggttgagacagaattgcttgaacccgggaggcagaggttgcagtgcgccaagatcgggccattgc

SEQ ID NO: 56843 - DNA, 1024 bp, Homo sapiens
atcttgactcactgcaagctccgcctcccaggttcatgccattctcctgcttcagcctccctagtagctgggactacaggtgcctgccaccaggcctggctaatttttggtatttttagtagagatgggttttactgtgttagccaggatggtcttgatctcctgacctcatgatctgcctgcctcgagcctcccaaagtgctgggattacaggtgtgagccaccgtgcccggcctactgtgtcttttttaaaatcttgggctttgaaataccagtgtggtaaactgctaatctgtgtttaccctgcaggtggcgctggtggttttgtggtgttcttcagcgtgactcaagtaaaattcccttcagctgggaaatcacttagatattggttctgcttgtagaatgttatctttcatgtaatctgttgaatatcagacattttcttactattatttcaagaaatacatgtagcaggaaaaaatctactaacaaattattaggatataattatattttataccttatttatctactttattattcattacaatttctgggaaaattaaatttatttcagcagttcattactttccaactcccttaaaattccaaaacttcatcaaaaaactggcagtagaactaattttttcaaattaattctctttgaagtctttcattttcctttctgtttgtgtgtctgactccccctttctttctctcagtctgtcaagttcaagagcagctcagatgccatgaattaagtggagcacaaaagggggaaaggagacccttttgaagaacaaaggcctcccattaggctgccatgttcttttttgaccaaaagtgcaccctacatggtttctattgttgtccacatgccctgcacataaggtaaatacagcagatcctcattacctcacgttttcctcctcttcctcctatgccacacacaaccagtgaagctttgggtctttgatgtctttaggcattcttatacagttgctttatctccttttaaaaacct

SEQ ID NO: 56844 - DNA, 1511 bp, Homo sapiens
tttggtgtcatggagatggctttactgtaggtttgttgtgttgcattacttttcattgggattgaactgagaaataacaaacaagctttaagtgggaaattaaaaaaaagaagtaacctatgtagatccaaacttaaaatgtgagaaattattgaaatttcattttctacaaacttgaaattagcctgctaattgtaaagttgttttaataatgctgacaaatgtcagttacgtttgcaaaggagtgtatggttctaggtatttgcctactgttaaccgttgagaaaaacattgtcaggttagcaagtctattgaaatagagacctccttagtttacagcaaagaataaatagctgatgactggagattgggactaaggttttatttatttatattctttgaaagaaatcggacagttaataagtggtttgtggtagagttgaaggatgtctgagagatggaaagagagtgacaaaggaggagaaggaatagtatttcttttttagtattgttttgaaattaaaactctgttattttaatatggtaaagagcaagagttgggttgggcgcggtgactcacgcctataatcccagcactttgggaggccgtggtgggcagatcacctgagattaggagtttgagaccagcctggccaacatggcgaaaccttgtctctactaaaaatacaaaaattagccaggtgtggtggcacatgcctataaatcccagctatttgggaggctgagacaggagaagcacttgaacctgggtgacagaggttgcagtgagccgagatcccgccactgcactccaacctggacaacagtgtgagtctctgtctcaaaaaaaaaaaaaaaagagtaagagtcgaacttaggacaacgtatgttttcttttttttctgacgttgagctaatggtgggcaatttgtgacttaacatttagtgaccaccttgaactctccctgagtttgtgggtctgcccttttaggattatagaggtgattcagtggtgttaaaaacaacattaaagggattaaagaagtaattcctttgtaggaacagtagtaacattttattttgaaaatttcatgaggaaatttttagtattcctatttttttccccatatgttcttcaaataaatatacatagcacattcaacatttttggtcctaagaatttcttatattaaaatctgactagcatagctgaagttaaaaaaaaaaggcctgttaactacttgaggaaatgttttgactctttatggaccctgaatattgcttttcaggaagtattccttgttttgtttttttgggtacagcagtctgcaagaagcctttggtttatgtacttggcagcaaaataaaaggcaaagagcttcttgctgtgtgttatgtaggaaattaccattcctgttgtctgtgtaggatgttctaaagatgtagccaggaatctcagaggagagagagaagagacagagagagagagacagacagagagtcagacttgt

SEQ ID NO: 56845 - DNA, 1116 bp, Homo sapiens
aatattaatacaataatagtcattagacaaatagtaaattttaaaaagaataaaaattaaaaagaacacctaactgggaaagtgggagagaagccatttaaaacaataaactgaaactcttttcctgagtttccttagaagccatttggacaattaatggagagattttaaacattaaatgtatttgtgactaaaacttgccttttcaacaagacacccgaactgccaagacttcacaggggtctcattgtagagaattaaaattcaatgatggttgaaagagaaaaggcataataagattggtcagacttctatatttattcaaagattgagcatgaaaagatttggagctttacagtatttcaaggaagtaggatgtgtaaaaagttgagatgggtggcttattttctgacatgagtagattttgatttaaaacattcaagctgtgccctggggagagggatgtgtaaggagggaaggaatctgatgaaatgaggacctcagagagtttctgtggaaggcttagaactggaagtggtgaattagtgaaccatcaagaaagagaatatttttatagacatttataaatttttatttccacaaacattggaaataatgtaggaataggcaaacaatggtcctcaggtcaaattcgtgttttctgtttttgtatggcccttgagctaagaatgatttctacatttttttgtgggggaaaataaaaagcataatatttcatgacattataattatatgaaattgaaacatcaatattcataaacttttattgggatataaccatacccatttgtttatgcattgtctctgtaatatctatagctgcttttatgctgcaacagcagagttgaatagttgtggcagagaccatgtgtcccataaacactaaaatgtttactttctgactttttacacgacaggtttgctgtccacagaaataaaagaatgtccgcagtatgttagaatgaacagtatacagttttttgtaagactaggaatacttgccattaataaattcattttctgtattcttatatttgcttatcaggaataaatgctttttttggtgaatggttttcattctgaaaaatgtcaaaa

SEQ ID NO: 56846 - DNA, 1054 bp, Homo sapiens
tcatatccgggcagcactgatgcaaggggtggtctcccaggtcctgaggcatctctgcccctgtggctctacagggtacagcccctcggctgtctttacaggctgtcgttgagtgcatgtggcttttccaggtacacagaacaagccgtcagtagatctaccattctggggtctggaggacggtggccctcttgtcacagctccagtaggcactgcctctgtggcgactgtgtgtgggggctccaaccccactcccctctacactgccctcgtagaggttttgcatgaggcctctgctcctgcagcagagtcctgcctggagtttccatacatcctctgaaatctaggcaggagctcccaagcctcaactcttgccctctgtgcacccgcaggcttaccaccacgtggaagctgccaaggcttacaacttgccccatctggagcagcagcctgagacgtatctgggccccttttagccacaaagaattttctttctcttggcctcaggccagtaccttttatgccttgcctattatgtctggcagaagtgtggcagttgttgggaaagtaactgggagctctcataggcttctgtatgaaaagctaggataaccacgttatgagtagtgtatggacaagaacttgaacttgtggtctttcccctctcatcagcttcatattgcttaagatagaaaaataagggatttcaaaatgtaagagtgaaagaaattagagtttgacaaagatataaaagccatagtttaaaataaatgtgttttattttcttcctgaataattgagcctgaaccaggagcatactgttcatgtttaatctctatgtgaaaaaacaagggtagtaattgtagagcaaactcttgatttattctgaatgaccaccagttactaactaaaaatacgattttccccaactaggttttcttattccttataatagttgaagagtaataaggttgagattttctttttgtgtgtttctttgctcacattaagaaggttactctatgcagaactttttgactacttttattagtta

SEQ ID NO: 56847 - DNA, 1098 bp, Homo sapiens
tttcattctacgacccagcaattatatctatcccaatggcctcagttactactcgctgatgccgcatgccatcctctggtgtcccacatgtcagtgaatagcatcaccttttttattccagttttccaagttaaagacttaggagtaattcctaataccccctctccctcacttcccaaattcttactgtactaaggcctgtctatttgacatcctttaataattttcaaatccatattctctgctgtcttagtctgagtaggattatctcccccttgcagcacaatagtagccctccatatccttgttaaatttgttctgtacactgaagctagggtactgtatcctatgaaaacacaaatccagtcatgtcattctcctccatagcattatttcctgctactcttaggataaagactaacattccccaggcctacttctccacctcccctcttatttttcaaaccctctgcacttgagccactgagacttttgttcagattctcacaggtaccatgctctgaccttttacttctctgcttagtcaatttccatttcattcttcacgtctcaacacaaagactgtttctatagaaaaagtgattattgatatatggtcttgtaagattctgttcttttgcttatagcatttatcataatttgttattatgtatctctgagactgaaaactcccaagagggatgggaccttgtctgctttactcactgctgtatctccagcacctggcacatggtagggatttcatagataatggttaaatgacttgagtttgtcctttctctagatctagggtatttgtcatttgtccataaattttgcttcaggaaattttagggctcagcataatctgattaggcttcaacgatgaagataatgttacatttatcattcgacacagtttaggaactaaaggtcaggtaaaatcagctaattcctgagctgtggaattgaatctgttcagattgtctgggaactttatttttacctgtcctgacaagtcttctaaaaaaagatacgttgacttagctcacttttcagcaagcgtttcagtgcttacaatacgccagacattttgca

SEQ ID NO: 56848 - DNA, 1049 bp, Homo sapiens
gaggaaaagaaatcattatatgaaaaagacgcctacacatgcatgtttattgcagcccaattcacagttgcaaagatatggaaccaacctgagtgtccattgactaatgagtggataaagaaaatgtgatatgtatacaccgtggaatactactcagccataaaaaggaacaaaataatgtcttttgcagcaacttggttggagctgcaggccattattctaagtgaagtaactcaggaatggaaaaccaaatactatatgttctcacttataagtgggaactaagctatgaatatgcaagtgcatacagtgatataatagacataggagacagacgtgggaagagagtgccagataaaaaaactacataatggttacaacatcactattcagatgacaggtgcattaaaatctcagaattcaccactatataatccatccatgtaaccaaagctattgaaattttaaaagacattttagccgttatttttgtggagccatgaacatgattcagaggctaaattgtaataaaagatttctcttaatgttctactaagttggttgcttggtgttatcataaccagtgtaaagtgaatgggccatagaaggccttcttctataccagggagaatagggaacctcttaagggtcgttgtaaattttttgttgtaattgcaggatgagtgactttgaacatgaaaaaagtaagagtctgtgaatagatgtgttatggagctgctgtttttaattcagaaagggagggtgtatagtaactgctttaatatgtaaaaatctttaaaatttttatttggtctaaaaagcattacaagtagaaaacttttttttttttagtttctgtacagttaagtcgtgagttggacaaagaatttttactgaaggaaatagattattggtggagactcaaagtagtaagggcagcattttggagttcatccattgagcctttttgcattcaggtaaaatgagagctaaactcaggccaaatggagagatggtcagaaagaatccagttttatgttacttctaag

SEQ ID NO: 56849 - DNA, 1075 bp, Homo sapiens
ggagttcgagaccagcctgaccaacatgagcaaactccgtctctactaaaaatacaaaattagctgggcatggtggcaggtgcctgtaatcccagcttctcgggaagctgaggcaggagaatcacttgaacctgggaggcggaggttatggtgagccgatatcgcaccattgcactccagcctggacaacaagagtgaaacgccatctcaaaaaaaaaaaaaaaaaaaaagaattatggaaagaaaagaaatatggaaggagttgtgattggatatactgaggttaaaggataaaatgaaaagtgtatcttgtagtatatatgaaggcagtgtggttagttactaggaagaactgcatccttgtatgttttttaaaaaaatcttacaagtagtgttgttaaaatgtatgactcaaacttcatactcatctttacatacatatttaatatgttgaaaaaattattcttctaaaaggaataaatggttaggtttgctgccctgtgtgggaagacatcagtgattggagattgattgtgattagtaatacattatgaatggtagtggattgaatgttctacgtgcaaggaccctcctgtccttgagtgattataaacaaacacttgattttcgcttggtgctttacatgtgtaggaatgacagacacactgaactactgtttatctctgcatatcttttagacggtgagatattagccaacagactcaattcaggagaccagagttttttttttttcattttattttgctgctgttcctcacctagttccaaagagtgggataaagcattgcattttctatttcatatttgcctcctctgaagtttgacactgtaagtcagtggttcagggtcttctaggggtttgttaaaacccagattgttgggcccccacctccagaggttctgatacagtaggtgtgaggtaggggccaaaaaagtgcatttctaataagtttccaggtgatgctatgatactgatccgggtactgccctttaagagtagctactgtgcactgttcacaatagcaaagccatggtattaaccaaggtgcccatt

SEQ ID NO: 56850 - DNA, 1046 bp, Homo sapiens
atgggtttaccacttactagcttgtgactttaggcaatttccccaatctttttgagacttaatttattcaattacaaaatgaggataatatatttcaggttattgtgagtattaaaggagatgatatatgtggcatgttaagcaaaatgccagctacacagtaactattcagtaaaatgttttttcttacagatgttaatcaaaatagtaaattttatctgccctacctttgctataaattatattaaaagttatgatagtaagtagttatagacacatacccatttctaatacattcttttatttggtaatttaaaaaaattatacttcattaaaccttttatcaagagaaaattatcatataaatgagaatactgaggccccatgagagaaaggtaaatctgtaaaggatggtttgtctccacggctcatactcttgagtcagtatattgcttagaggatgtaagactatgtatctttatcatctgccagagaggatacagggacttccctggtttctggtaaaggtataaatcaaaatatgaaaccaaataagaagacagttatgggcaaggatgaacagaaagtacttgcttctaaaaactaggtttttcgcttgcagagagggatcccttttgacttatcattttaaaaatgcttaaccatgggcaatggtaagagtgagaggcactcttaatttgtggtaaatggctgagttggactaatgtagcagttttcctgcctgtatgtcttttgctgtaaactctcctatacctggagatgcttatgttaatctctaaactgtacatacctctttatgtgaaactgagctgtggggcttccatgttcacccctgttgtatttaacacacttcatagtactcttactgaggctagccaagtagacttctgtagtatctcttaagaagggaaagggcagcattgtattctgtctgaattgtcagccagtctcctttttgttacttctctgtcccctgtttggactccatctttctttcttgttcagcactggttcctatgccagtg

SEQ ID NO: 56851 - DNA, 1024 bp, Homo sapiens
gttaaaatattggtttggaaggtctaatgtagaggtgaattgaaaatatattcttccctttaccccctatttctagagttgaggaattgggggctatgaaaaaaatctataaatttgtgggggatgactttatttttaaaaattgtaatagcagctttgctggcattagaattaacaagtttaaaaacttggtatgtgaaactaggaaaatacaaataaaagaaaggaggtaaaccagaactcatgactgaataagctcatgttttaaatgattcctaaaagatggggttttaagtacatttcttttaatcaaccatttgcaatcttttatttcctacccaccccacctcagtctaaatctaatgaagaatcgggggattcgcagcagccaagccagccttcccagcagccttcagtgcaggcagccattccccagacccagcttatgctagctggaggacagataactggggtaagtgttcactgagagaattataacaaactttttctgtgtcagaactgccattggccaatagctgattagaattgttcaccatagctggtagtaacatggctatgcctggcactattgtgtctttaaggaacttcctacactgtaggtagtaagttgctctgaaaaaggaattatctttgtcgtaagttttcaggatatcttttattagaattgtggatgctctggataaattaaaaaccttattaaacccctgtttcaggtgttgcttcatcatgcaatggagtaattatcatatggttgagatcattacactgaaaatggcagttatccatttggcattaagacatcactgcagggtagaagttaaagaatggattagtacctgcaaaagaaaaacatttttctttaagttactgtgtaatgatctaaaataaagcatgtggcttcatatcctagctctgcaacttaccgtatggcctaattacttcatttccctctacctgttttccttctgttaaatggagatactaataatacctatctcacatt

SEQ ID NO: 56852 - DNA, 1049 bp, Homo sapiens
ttctttctttctttttttcccagttaagtgtgttttgtcagtggacaactgttttaagaactgttgcaaaattgttcacaaaatcccatgagtagagatgtatgtatatatatattatgtaaaaattaaaaatatatctatactttatatacacacatatcccttgaagggtattgagtttttgaatggtttggttttgagccttatgtttctaatgcacaaattgtgtttgattcttttagaggaggttgtggcactaagtgactgtacatatacttcagaaaattatggttccatcttgtttgatcaatcagaacttgtcaccaaaagaaaagtagaacacatttactactttaagtgtgtttgaaataagttgcattatgaaaacaactttaaatatgctctaaatacatttcctactttactatttgggtcttgtttttggtgactagtgtctacaatagtaagagggagttgggattctaggttcctttggctggagcttctgttaaacctgggcattagggttcatttgcatgtaaagagaacggctatcaccacctgtttcatagagataatgtgttggaaaggagatgtaaagttgcagagactcagtgctttcaataacagaaaagattgtgttagggaggggcctgtagggagacttggaaaagaaacaaatggagctcatattctttagtcatatctttggacttaatggaaatgatggaatatggcagggattcatgctaatgggaagcagctgggccttatcagttctttccttggttatatccagcatccttgttcctcattcatctgactaatcacttgctgtttggttgtgtgtaaatgtattttcatatcttgtcagtggtgattcttttttttttttcttgcttactagttaattacttttttgcccaaaccctagggccctggacaagcttgaatgattaagtccatagtggggaccaccattttaatttaaatgttctgctagtaatggtagtttgatcactgatgaacattttagctgtctgctaagc

SEQ ID NO: 56853 - DNA, 1021 bp, Homo sapiens
tcccagcactttgggaggccgaggcgggcggatcactaggtcaggagttcgagaccatactggctaacacggtgaaaccccatctctactaaaaatacaaaaaattagccaggtgtggtggcaggtgcctgtaatcccagctacgcgggaggttgaggcaggagaatagcgtgaacccaggaggtggagcttgcagtgagccgagatcgcgccactaaaaaaaaaaaaaattaagaagcatacacaatagtaccaaggaggaaaataaataaaatctttaatctcaagaagaggaaaaaggtataagtagatatatcagtaaaatatatgaagagttattatgagtctaattgttagacagctgtctttatccgtctcagaaaagactcagaaatggacttaacttgtagcaagagtttgactaaccatttaaaaagaactaattaactgtaagagtagagaataaatatcagactagtctttatacaatctttatcaagataatgttttgattttggccactttctcatcaccaaataaatgtttttagtgcctaagctgtgagaccctatattaacattagtctaaataagataacgttcatgaaaacactttgaaaattataaaacagtaggccaatgtaaggtgctattgttgttagggattaaatttttatatggatagctatttttggttttaaaaaattgaatactttagaacatgtggaaaagggcaaaaaaattgaatactgatttttcagttgagttagataagctgttgtcaaatgtcataagtcattataggccctttattgatggaaattcagacataacacgatcaatttttatttaagagaaagatcaatcaaatatttaaaaactgttttctcacttgatttttaaaacccatattggtctttacatgataaaaaacagaagtatatttgttctgagggaattttaaagaaacattgaaaattaggcttatcataacaatatatgtcagtccacaaaaatagtca

SEQ ID NO: 56854 - DNA, 1109 bp, Homo sapiens
cttacattgattcccctccttggctgggtccaaatacagttggctctctgtattcatggattccacatctgtggattcaactagtccaaaatatttgggacgggggacgaaaaaggatggtcatgtctgtactgaacatgtatagacttttttcttgccattatttcctaaacaatacaacaatttacatagcatttacattatattaagtattataagtaacgtagagatgatttagagtatatgggaggatacacgtatgttatatacaaatatacattttataatttggaggacttgagcatcagtggattttggtatccaagggaggtcccgaaaccaatcccctgtgcatactgagggacaactgtatttgctttacatgtccaaagaggcttctaagatacaatatgttcctcagccatgttgttttttggttttaaactgcacctttttgttagccttttcctgcatttttaatgtatggtttaatgttagtctagaagctttatgatttctttcagaacacaggcctctgaaatcataattatatcactaaattgtgaagactttaaaagattgtatggaggattttgttatttgaagaatatctggtggtagacctcagtacttcatatgtaagattgagagagtaaagattacggggtgtattatattagctaaaaggggaaaagtttagaaggcttatttaaaaacagttttttgtagtgggggcagtagctctaatctgtaatcccagcactttgggagactgaggtgggaggattgcttgagcccaggagatggagaccagcctgatctctggtgggaccctgtctctccaaaaagtaaataaataaaaaatttaactgggtgtggtgacgcatgcctgtagtccaagctatcaggaggctgaggtgggaggattgcttgagcccgggaggtcgaggctgcagtgagccatgattgctccattgcactccagcctgggtgacagagcaagacactgtctctaaaaagtaaaaattaataaaaattaaaaataaaaataactttttggaagagagagggtgatggagacaggcatgcaagcacaggcacgcatactc

SEQ ID NO: 56855 - DNA, 1041 bp, Homo sapiens
aaaactttctgtgatgatggggtgttctgtacattggacatgggatgtccaatacaatagccactgtctacttatggctattgagcacttggaagggctagtgatgctgaagaactgaatttttaatttattgggttttaattaatttaaatagccacttgtggctggtggctatatgggaaggcagaggatatcaatcacttgaagttcaggtattctgggtgcctcattttgtcttacatttcaatatttctcatctgttaaactttttatcagaagttgctcaccaaaaagaaaatggggttttaaaaatatgttacttttttaacccaactaccacctaataaaaaatgtagtattcaatgtgctaataaaaaatgtagtgttcaaaagatggatttaggggtaggggggaatcaaaagactgggataatcccagttcaaacaagtgttgccaggatagttgagagttggctgtctcatagtaggattagttgtatagtactttggaccagaaatgatgttgcctttctgccctgtcactaaactaattgaaatgaatgggtgaatcatttaaactccgtgagcctctgtttcctgtatataaagcaactatcttacgcttttttcccagtttgatcaagagagattcagcaagaagaaaagctctgtatacatttcaaaggttataggcttatagagaaagacatcttttgtaatatattcagggcatcattgttctattgctataaggttactaagtttccattgcccatgaaggtttgactaaatgggtcaaacctctctactgtgaatttctatttctatgatggttacaaaagtagtcttttagaatacctgttttttgtaactaactttgaaatccaaactaggagtgaaaatagatttttttttcactgcgtccagaaatacttgatagggaaaagaagaaaagagatgatttctaatttttaaagtgatttttgggaagtttgattagttcgtaaatatcttgggttatctagagagttatacataata

SEQ ID NO: 56856 - DNA, 1413 bp, Homo sapiens
tagttgaaattttggtatctccatgattacataaggtggcaagaagagattcaaaatgggaaagtatgtgggacagtattgaacattgtaacgatcaggcctaaaagagtcctcacagtaacactgtgactggcttagggatggagtttatgtgggaccccgtaagtggaataattactgactccttgtctaaagcagttattggagcaacaccccagagtgaaggctttaagcactggtgagataactctgtctttcctctcctcttctcctgctctgtattgtgtgtagggtgatgttgggctcgctatggggaaactatatggaaatgacttcagccaaactaccatctctcgatttgaagccttgaacctcagctttaagaacatgtgcaagttgaagccacttttagagaagtggctaaatgatgcaggtaagtgactgtataagacatttctttgtcattcattggaattttacatggggattgttatataaattggggtttatatttcttactctatttttgttgttacagaaccttgaagcttactaatcctgggaggatcattataaattatggtgatataaatcagaaagctgattcatttaaatattctagtaattacagtataaataattagccgtaatttttagcctgaaatactcttgtatttgagccaggattaggaacacacacacacacacacacacagttgaaggaataggataagtaaggcttttgtatttagataagcttgaagtagaagcttattgtttcttccttgatgaattatcatagaacttgttcttgcaatagttctgcttttgttatttcaaatgaccacacatttcattcagaaaagttggactactagctttgtcttacgtttttttgtgctgagagttccttttggaagattggaattttgagtcacaggatcatagactatgaaagctgtaggagtcatgtagatcccttaaactatggttcttattgtagatatgaacaaaaattaggcctttggaaaagacaaacctgaaacacgcatccttggacagttttattcagtagctatgggtgaggcctaggcatctgtttcccaagtccacagataagaaccactggtttactgtttccatcttattttacgtgtagcagaaacaaactcagatgtgtatgacatgcccaaggttattaaactgtgaaattatagaaccctgtgatttaacttcagagaatttataaatatttcatttgtttcttttctttttaccctagattataccaataaaatgagaggccatttacaagataaatattaaacgttcagtaatttctaagaaactttcttccttttatccccagaacttataaacaaacagaactggagacatagagctgagtttaag

SEQ ID NO: 56857 - DNA, 1077 bp, Homo sapiens
atcctagcagaaagaatgccaataagggcagcagaaatatccatggtagtaaatatatatatattggggggatgggtggtgggtagggggagacatggtctcactctgttgtccaggctggagtgcagtggcaccatctcaggtcactgcagcctccacctcccaggttcaagtgattctcctgcctcagcctcccaagtaactgggaccacaggcgcacgccactgtgcccagctaatttttgtatttttggtagagatggggtttcaccatttagccaggctggtcttgaactcctgacctcaagtgatcctcccgcctcagcctcccaaagtgctgggattacaggtgtgaaccaccatgcccggccaataagcaatattgtaatgtaggttatgtgaaaaccttttcatacttggatgtagcttattttgtcagttttgttgttaatatgcatattatgcacatgaatcactgtgctcagctaattttatttctgtattttcttcattcttacagagaacctctcatctgattcgtccctctccagcccaagtgccctgaattctccaggaattgagggcttgagccgtaggaggaagaaacgcaccagcatagagaccaacatccgtgtggccttagagaagagtttcttggaggtcagtgaggattttacttttctgtacatgggattgtctgtgtagtacttaacattagtacttagtagaaactgtaggtggtaaaagatgacatgtcagcctctgctcttatggatgattataaataggtgaagtaagtaagttactaacataggagacagaaccagagttctgcagggttcaggagagactagaatcacatccatgcaagcactcagtatgagagaggtggcagcttaccataggatacataggaattaattccacagactagaaaaggtggggggaaagtactttaagcagaggaaatgcatgagcgtttccccctcagagtgggggagaaacactggagtgagggaaaccatagggtgtatgaggagacactctagtagattggttggttaaattgtagtgtctg

SEQ ID NO: 56858 - DNA, 5322 bp, Homo sapiens
tgagaatctaatgccgccactgatctaacaggaggcaggcctcaggctgtaatgcccaccactcacctcctgttgttaatgctttaatcacttcagctagtttgtcctttgaacagaggtagtttaaaatcagcagtcttcattaaagacaaaattattggatttatcaaatatgtctaggtaaatgaaataaactggtgatttcaagacacgaacatgactctaattcattagacagttattagctgtcttctacccctgcttgtgcccattaaattagacatttcagtcttttaggctcttcaaaattaaaaataaactacaattggtatcaatatagcactgtgtttgaggaaaaaaattcagtgaagggctatactttttcctggtgggttgtaggaaaatgatagacttttgatgtgttatttggcttctccaggatgatgttaatgttttcattcctgcctgttttggggggtttttgtctgtagctcttgcttctggtggctctcttccaataacatcacttgatgcaactgggaacctggtatttgccaatgcgggaggagcccccaacatcgtgactgcccctctgttcctgaaccctcagaacctctctctgctcaccagcaaccctgttagcttggtctctgccgccgcagcatctgcagggaactctgcacctgtagccagccttcacgccacctccacctctgctgagtccatccagaactctctcttcacagtggcctctgccagcggggctgcgtccaccaccaccaccgcctccaaggcacagtgagctgggcagagctgggctgccagaagcctttttcactctgcagtgtgattggactgccagccaggttaataaactgaaaaatgtgattggcttcctctcgccgtgttgtgagggcaaaggagagaagggagaaaaaaaaaaaaaaaccacacacacccatacacacataccagaaaaagaaagaaaggatggagacggaacatttgcctaattttgtaataaaacactgtcttttcaggattgcttcatggattggagaactttctaaccaaaaattaaaaaaaaaaaaaaaaaaagaaacaaaaaaatcaaaaacaaacaaaaataagtgaaaggactacttatcatttccagcagtcatgatgacaagttaaggtgggttaccaattccaatataggaaggggatttcttgtttgtctaaatttctttttttcttaaaaaaaaaaaatcatttttatgggtctgttgtacaggccattaagtcataacaaggtgtttataatcgtatcaattgtgttgggggttcctttcttaactggtacaatttaggcaggcctgtattactgtattattattgttgttgttgttattgttttatatatatagtttggacatgtttattatctcttgctcctggatcctatttcagtgagctcccacactgtggggagggagggttttggggtaaggggagacttctgttcttaactgtggggaatgttcttgctggtttccttatccttgatgactcttacagaggtgctagaaaattattttcttttgccacttatgcaagaggcttggtgcagaagctgaaggcagtgtgtgcaaacactcccattccacacacgccccttcccctccccacatcaggtggtgcctttggagcacttttgtgtaggaaggaattcctgctgaactgtagctctcactcacccccaaatcattgaatgaccctgaggcccagttcctgtggtgcaacagtgctgctttctgctactttcaatgggaacagctgtacatgttgcagggcaggatttggttcccaagagcaaagactactgcagacacctgacttggtggttctcctgatttcttatctcctgaaaaatgctcctgctgttggtgtgtttgtttgtttgttccattttgtggaagtttttcatccaaactttaactaacttggcaaagaaaaaaaactgacttactgaaattgggaaacttttcccttcttttattttctaaaggaattctactagactattttccattgataatatatacaaaagaggtgtgatgagaagggtataaggttaccaccttttcctctagagagccacagacttcctttccactggatggtttataaattcctctaaccctgagattcttcttggttctctgactaaaggaggcacttattagccgggctgggatctgtagaacctttgaagaaggactttgagcaggaactttgcacacaccttaagtgtctccttggtttgttcatgatgctcctgctaggtaggtctaaatggcaatacacatctctttattcaatgtagaaagtaattagctctgtaattattttcagggtgtttgtagactatataaatgagcccattgaaaaggaagagtttgtgaaagtggatgaagaggaataagggtaacttggagattaaattcctttttttgtcagtgtactgttgttatgccatctgtaccaaaaaattttccaaaagactggatcactgcagtgcagctcatctaagttccccttcttattggagttaaaggttcccatttggtggctgtgggtgcttgcttaaatctctggtggtcccaagactgcactttttctccctttcgagctggggatgtagagagaacttacaggtgatttttattctgattgcttttgtttgtgtccacaagggagcttggattctgtgtacttgtctctttcccattgtccagtaaggcagtaaatacagacacaatgtgtacttttgtgtgtgattcaagtgggagacagtctgttaaaaggtcagaaacattttagtcccctttaaaatatttcttttagtttatttctatcgtgttttatttcacagatatttaattaccacccctaaatttcctcctcttacccttcaccttccctaaaatccttccaaaatcagtgaactgcaagcagggaaactaacaaatgtccattcaccctttttgtgtggtgtgtttttttatgttttgttttgttttttaactaagcttgaaccaaagtcaatttttagcaagctgctgtactaatggactagttgataacgtgcagttcagacacatcgaggagatagatgctactgacaatttctttttcatttgtctttattaattttatatgaaagttgctgcttgtttttaatcttttatgttggtaaattgtgatatcctctgggcagacattaacttgatgtttaactagtttattaggttggtgtgtaaatagaatgacaatgtcaattactaatttctctcctctccattcactttttctctgttgtagttaaatttaatcttctatcctgacttgacatctctacctttagtctgtggaaatgattttagggctatcagtaatgctgtagctgcccataataatgagtccctcccttgggagtggtgaaacttagaaggaaggattcagggagggaaatgctggtacccagtatactggattagaagttatagcattaatttctcaaaattgctaccaaaggaagtgtggagtcccaagggactcaagctcagtgaggtaagacaaagggcaaggaaaggctgtttgggtggtttttttttccccacatatggtttagaaaatgatccctttcccaaacaaaactcaccaacagactttaatattagaaaagatactaagctttaaatgtcaatacagtggtcttttattccctgccctgtctatattttctactcaatttgggataaggggattttatgtgaagcacttgatgagggtagaccagcataaaaaatctgtttaaaagaagaaataatctttaggaaaagataaatctttagataaaaataaatttttttctctttttttacttatttaaaaataagttgtgaaatgaaaggtacatttacacatgtacacacgaaacactaatatagctttttggtggttgtttagtttaaaatcaactccctatccatcatccctagatattctacttatcgtattgcttcatgaacaccttagtcattttttactttacgtatatatttttttatcatctcaagaaatgcattttgaattgaatgaactatcttctaagctaagatactcaaatttaacttttagccaccttatatgggagagcctggaaactaaaggggaccagggaccatttgaccaaaagaggtgtttggtggagtttctgcatttcaaagaagaaaggccagataggtcatcacaattcattgtattattctttttttttccccttaatgtttatgcaaattttattttatatttctgaatttggttagcacatactaagccaaagactattctaaatgcatttatagtgaatactatgtatgcccatggtaatgggtcctccctaaggagtggtgaatgtaattgtgtgaatcctgcttatcacaagtggtgcaatttggtcataaactttatttataccctgtatacatctgaataacagagcagaaagacctaaaaaagggcttctcacaggaacaatattactatgttgttctaagaaaaaataagttgagtgctgtattagtttaagtgtttctaaagttctataggcagcattttagaattaagaattgtgtatatccattaactgatataattcacatgtccttttatttgttatcagaaagatcaatactatcccaatttattcaacttgttacccaagaaatggaaccaaaggaatccaactttcattttgtgtagaatcatacctacttatacttaatgctagcactgtaagaaataagtcttttttgtttaaaaaagggaagataagattaaagattcttagtgagatcatcttgccaatttgttgtacatctctcattcattgttgggggaaaaaaaagcacaactatacctctttaatgttattttcttccattatccctcatttatttggaaagataagggaaaccttgtctgtattatccagaagcacagatatttgcttgacacaatatttaaattcagcccaatctttaacattaaaaaattttctttttaacttgctggaaaagttggatacattggcaaatatagggaattcatgtcttttttttttttttttttctggtcttgctctgttgcctaggctagagtgcaacggcatgatctcggctcactgcaacctctgcctcccgggttcaagcaattctcctgcttcagcctcccaagtagctgggattacaggcgcccaccaccgcacccggctaa

SEQ ID NO: 56859 - DNA, 3588 bp, Homo sapiens
acaggtatgagccactgtgcccatcctcatgtcaatttttaaagtgataaatcctgatattatacattgcaattagtgtagaataaacgcttggcttatagaactctctgttcttagtctaaagctgttcccaaaccaggtcatcctcacgaaacattcttgaccaagaaaaaagataaggtcattgagataggaagacagaggaaaagcctcttgctgttgtttcttcccaagaaaggagaagccctgccagggagaagtcagtagtattgctgactcactgtatcactgagtgtagggtgtggtagcaaggaggaggcaggggattcacgctgacaggtggctctggcctggctcttggggggccttctgaagaccagtctgcagtttgaggaagggccccaacaattcatttggagagcttggccaaatactttctcattaaatcagcacctaaacttgatgaacttaaagtttgtttattagagttgaaaacattaaaagatgactgatactaatgggagaaaaatactaaagacccaaaatttaaaattttccaaaatggacaagaattgatgggttaatttgctcataactgatatgagtttgcttttatgtgtgtgtggaaagcatttaatgtgtgatgctgttcatagtcctggctatttgatgtcattttcagttttacaacattttgaggatgacactttataaaatggtaaatctttctcagcgtttacaaacttggcttttgagaagggaaaaatcctctttgctatttctgtaagaagaataactgagatcagctattatataggtttgcatggatggtgtccacaatacaaatgtaaacttggacaggaataggataaataaattgctttcatcataaaggccaatcatccatttcttagtccaaggagattaaatataaataggacacccctgagatttccagtaaggtatttgaaaggattccactgggagggcagggaatatattttttctcagagcatccagtttgtacccagttttctatatggtttgtgaactgtagcttttaaaaaaaaattttgtagttttcttctaaccttattcattaagtagttccttgttttggcccttctactcttggccttagctaaaagcagtaaatgtgagtgaattttatgttgattatgtcacctggatctcctttccttcccttctttttctcattgaatggtggtaccttaatttgggtaacagctagcttctggcaccttcataaaatacctcagaatagcttagcattgttgcaaaactggttttaaactaaaaaccaaataaataagtgaaaaaattttataaatagtggaaataattctagctgtagcatttagttgaactaatgtttattatgatcgataaacaagattgatgctgtatgtatttgggatcctgtttataggttacaatttatagggttagggagggttgggtgggggaagaggagatgttgattatgttagaaggaaaacattgctcgtgtgtgtgtttgttttttcttatatctgtcttgccaaaggaaacttgattttccctgtgattggctttggcctctgtggtctggtctgcagcagtgtgtggtggcatgcaggtaacatatggggtgtccagtaggttcagggaccctgagggtgcatttacatcccttcctatggttgcccatgccccccagaccctgccaacctctcctaatgattcattacctctgtacatagcaaaagcataggcaaaggatgaatgcgtgaatgcctggatgtgcagttgagaaacagaggcagacatagacatgcaccaattaatttggagccaagaggtgagtgattgatgtatcttaaatctaggaaagttaaagtgaaacaggttctttgtgttgccctctgtcaagttactgaatgttgtgctaataacacaacactttaaaaccttacttacttttctcataccaaggctagttctttctagaccaaaaacacaaacaggataaaaagcaaaccaagaagttgaaagctaacctgcccacctcacccctgtgatacaaagtgtgaaccttaaggattagttggtgggattgaggagagaattattcttggtgggaacatgaatgagaaatgatgctggcttaggaaaaatcacaagccctttctgcccatactctgggacaaactttcttggctccctgagttcggatatagactgtatctctagaaaggctatttttttaaataaatgatcccacagaacttaagtgggatttggtttagataccaaagacactgctaatgtcattgcttatccttaagttttcaaaacaggcagagggaataggagcaaaaagccaaaatttggaaaagctttactttatctctttccttcccttttccccttttcccagtcccctgctttttgaaggaagtcttcttggttatcctggctttggaaaagagatttattttgttttgctctgctggctctttaaagatggatagttgctcaatctagcagtgatgttcttggaattgctgagaaatttggggagggcaaaagataggggtagaattttttcattatttccctttatctaatacttttaaatagaaccaacacagcctatatgagttcagacaatatttagatgtggtatctccatctgtctcctgtaaaagataagaattttcaagaacaggattacgtggaaaaccaaaagatcttcccttactctcctataaatgttttgttccaaatgtttttatatatgggctctagggagtcaggtagttcattgtttcggtgtactattgataggacacagaaagggagagagggtaaagaaatgtatcactctctgaatattgcatcaaaaatgattaggttgcagaacttcatgaaagctttactaataatcttattgttctgacattatgtaaaggtggtattaatattgtatgacttgtcaaagtgctagataggtttataagtaggtaatagggatgttgaagattagagcacttgaaacagaagttctgggaaaacaaggtgtgtgtaatggaacaccactttgagcacagaaacaaaggtcccttggacctggtagggaagatgtgatttatgattgtttctgtgtccctgtatctgcccaccctgcacagggctccaccacccagggccaccttctggtttaaacccaggacactgtcaaaaagttaagaccccaaaactaatttactgtaaaaaacattgaggactgctgcaaagttttcccttgttttctttgtgtacttgttcatcattgtataagttagccacagcttcacaagagcagcttaaggcttctttcataaattggcagtggcattgagttctcaaacattatatcccaaagtctgcaggcagacagctggatacagcgctgtgtataaatgagacgtccaaacacttgagtttcttaagattgggatctctttcaaatgaaaaaggacagagccaagtagagaaaagactttgtgctcccacccagccttaatgagtctcatggtctaaaag

SEQ ID NO: 56860 - DNA, 3671 bp, Homo sapiens
ctgtagttgtaggcagtcggggatgccatgtccttggttccattcctgcgtgagtctgcagaaggcacacactttgtaagagtagagtggactagtgccagcctgaataggtttaaaactgcaaacagttggagaacatggaacaggttggtgcaggaagcctaagattttgcaatcatattataacattggcttttgacaacataaatgttgtatcttccctaaggtcaggtcggggaaagaaagacttccagcttcttacctctgcgtgcatgggcacgtgtgcattgctcagtccgcaggaggtctcactccgcaggaaacgctctcctcccgcataagtctgtacttccatcccctcatctgtggtagtagtgaaggctaggtgagtaagcgtgggctgttctacccaccagaagtccaggagctgttgtatacctcatttctaactcgtgaccgagtgacttgctttaactttctcgaaatcctacagagttgccaagtctgccctccctcctcagtcatgttaaactctggcctatagcatcatgggacctgtagcctagggtgggaccccctaaagcctctgaatgtcgctgcttaaaagctactgcaaactgagggcaaattgcaatcttctattcctttttgttgcaaggggtcttcacaggtctcttaacatctgctttccctgccaccctgcctttaggggctggccagctatccacacccctaacccaccctgtgtttctgacagctggccacacgtcaacttctgtacttgccttttccttggtggggtagaggccaaccccttctcctctgaggcctcagggttctgtttcttttcaggactttgggtagaagggaagacaccaaaggctcctttaagctgactgctgcatacacatttcactttttttcctttgacatgaccaaaaatatccaaatatttaagtttattattattattattattatttgacaatcttatatccaatgggctctctagaagctgcatccccagccctttcaccttttctttgaatgtagttcccaaccttcaattcccacccctaatgctgacaaaaagcttagccaggtcatgatactgctgctataagccaggggagggtggtttctttgttttgttttgttttgttttgtttttcaaatttccagccaaaaccaaagatttcttaatgattgtataaactcaaaacaaacaaaagaaccaaagaaaagggaagtcttcagcatcagtccagtctgtggtgtcctggcacttagaagagtgaggccagggaaggtggggcggggggaccctctgactggatcagaaagggcaggcaagctgcttaccaccttccagggtccagcacaggtgcatgcccctagctttggccctcacaaacttgtgagcatgccctgaaacaaattggcatttcagattttccaaaacaaaagtcaaaaaaccccatcaccaccatcatccaccctacaccaaccagggtcactatggggacttagcacagggcctagggagggtgggagctgctgctggactggcccgaggactccacagagtgggggacgttgaagacactggcgcacgattggctgctctgctgggtgctttaacctctggggctgggcgaatgcacgccacggtgcccttctgagcctttttttcttttcctgtactggaactgcttggaagtggctgtcctgtttgtgagaaaacatgcagaaagattatcaagcttttcatttctctttattgtagttttctttcctttttgcagcaccactgtgcaactatgcattgtacttcacaaccttttgtgctaggtagatgcctgtgactttttaacttggggggtggggggattgcaaatgaaggaactttttacatggatctttttaatctcagttggttgggggaggggggtacttggttcttgggtcacacaagctctatcccaaagcaaaatccaaatgttaataatattagcctgatgcagataccaaagataatttctttcctgcagaaccttagactcgtgtattaagtacgattacccagcacttgcattagtctaacctcagtaattccaaagcttagatgtatattttggtatatttctgggatattaaaaaaaaaatgtcgtttaacttcttgtttgtttcagtgtaatgctcttaaagtcatagcatgaaaataattgaactgtcctattcttagtagtttgaaataatagtatttttgtatgttttgggtgtgtctatgtatgtattaacataacagttttcactgcctaggtgttcataataaaaaagaaaatgaaaaaagttctgagtgtacataatattcaataataatctcccaccaggtgtcaatttagattgcatattcctcattactgttcccaactgggattttgttttcttttaaagagacagtgatcgtgtttttctaaagatgttttctttctctctttcaatatcttaactcactttttttttcttccttttttgtcttaattattaattcaggggtgtttgtccactgttgtcaaaggaggggcacaaggggaattggcccccggcctcctagaactttttgttttatgtactttaaaatgtgagtttgagttcttctttgtggaaacttaagatgtggtgtaaatgattctttccaaaattgtccagcagcttgaatgaggcagtgacaattctgaggtggtttattgggagtccttctacatttctcttagataactctgcactctgggtggctattgtgtagccttactgccccagagtgcctgttagccaaatatttcccctctgataggaatattttctaagaatcagctgataacttgcgtgctggaccttgttatctgtgcccctgggagacacacgttttcttggttttgaaaacctgaaacacaggcaactttacattttggggaattagctgatgcctcctgaagcctgaggaggtggcggggaatatgagcggtgctgtctctctcaaaagtgccctttagatgattccccctcctagggctgcctgcaggggctgtaggcttgggaaagattgtgtaggtgacagtgaatcagaatgaagtggtagattttgtgtagatgcatttgtctgctgtaattttttatatatatattaaacttactgtaactgtacagttcatttctgttgtaaaacatcattaaaccatcttccaagtgttttcacattgttggagtttctttgaaattgctgtgttggtattctggatgcttcacatacagattctcagacttcgcataattcagcttccaaattgttttttccaagtgctctcaggaaccccagaatcaccataagcaccctggttcctgccccactccacccttcctcctgcactccaggaggagctatggccactgcatttctccctcccagaccctcagtgtggtttcgtgggaccctgagtagcagtagtctccctcaggcccaagtactttgtgtgatcaaacacgcaggcccatgattgatcctgcaagggagctcttcaaagctccatctcactgtgtatttgactgcagaactgggaccgaactcaactttttccaaatgtattgtttaaactgcactgcccctctag

SEQ ID NO: 56861 - DNA, 1037 bp, Homo sapiens
tctgcccacaccatgaccagccccacgaagaaatccagggtctgcaaggcaccaagtgaaaaacccacgctctggtcagctccccagttacagatgaggaaagggccttttcaagagaaaggctaacatggccttcattcacacttggaaagaaggacctctgcctgagtgtaagcccctttgtcaccagtagcatcgccttccctgggacactctgatgtgcacacatttgtacggcttgtcatggaggtgcctagcaccaggctctccctcctaccctgtccatctcagccagacactgccacctcctcctcagcccactcaaggcacacacttggctggtccttgctttgctcctggataccaagccccaggcaccacccgagcttgagaccttccaagaccaaggcccctctgaacatccatcaagtgggggaccccgtgccctcctcccaaagcccagtggtacccaccttcactctcaggaacaaggcagtgagaatgacaccatagatgaagaggattccatccagcaggtagcagagtttgggatccagcaggccaaagctctgtgcctctgtgccaagagataaagctggtcagccaggcccaaggtgacgagaacacatccccattaccccagggtggcactaggactgactgaccaaataaatcatgacacggagactatatccaatccccatgcctcagcctgatcacaaccctctccctccctcccacctcaaccagctcctggaaaacctattggcaccaacggcagatgtggccgctgtggggccaaagaacctggggcaatgggaggggaggtggaaacaaggcgagcagatgaggctgttctctgtgcacagagctcctgccactgcagcagaagcccagccatgttagccccggtgtgaaccaagaactctggaagcctcgggaagatgttcacgtctggatgaatggtactcctggcctgaggtgtgtggctctgaggcctacccacagggagacaataggtcaaatgatggtcaaat

SEQ ID NO: 56862 - DNA, 1078 bp, Homo sapiens
ggtgaaaccccgtctctactaaaaaatacaaaaaaattagccgggcgtggtggcaggcacctgtggtcccagctgctcaggaggctgaggcaggagaatggtgtgaacccaggaggtggagcttgcagtaagcggagattacgccactacactccagcctggacaacagagtgggactccgtctcaaaaaaaataaaaagagataatgggtgtgtacaaagtgcctggcacacagtgggagctcagtagtgtgtagactttctgagaactcctcacttcacaaaatgataatgatgtaacacatgcatgaagcatacagtttagagagctctttgcacttgcatgatctggcttaatcctcagaacaaccttgcacaatacgggcagaattattaccaattctattttgcagataatgacgttgcagctccaataggtcacatggctagagattttctgagtgcatctgatgcaaagtcccttctcaatctaccttatcccagtgcctctggggttcctgtcatatagagagcttcccacctctttcaggagtttcttctttggtaggcacttctggcctctgcttgaatatctctggtgacaggaagctcagcacccagcaatcactggtggagagctctaattttcagagttaaaaaaaaaactttgaacctagttctgccttcagaagcacaaatcacacagatcctccaatttctatagggcagcctttcaaacctcacccccgtccagcttgtttccactttgataggaagcacggcaggtaagaatgaatcctacgaaggcgacaactgcaatccaagtcctggtgttgctactgtgtaatcactgagtaatcacagcgacctcccagggtgtgtgacactcaaatgggaagggcttggtacctggtaagcgctcagtttgtaggcactgatggaatcaatatgaatcacagtagctcatgatccaggtaggagtggccagctttctactcgccaaccttccttcctttgagtccccaactttgagccctgagtcctgctgctgccagctccacccccaggctcaggcacaa

SEQ ID NO: 56863 - DNA, 1575 bp, Homo sapiens
tctcaactatttttgtcttttaagccttcagatactcttaaatgagataacaacagcagccacggcagtggcctgcttcttgctacatcctagtagcgtttatcagtgtgtcagaatcatacttggagaggagggttattgctaaaatgaggattcctaggccccaccctcaacctattgaaaccgaaactcaggagtctgcattttaacaaacccaagtggttatttagtatattctagtggttgaaatgaactgaaaatcttaatttagatcagaaattttatctagtccttccctagaatgaattaatttttaagatttgttaacccagtttaacaaaataattcttctctgttcccctttctaggtgaagcagactgtggtgaatttagcaacacttatgaagtttcttaaagtggctcatacacacttaaaaggcttaatgtttctctggaaagcgtcccagaatattagccagttttctgtcacatgctggtttgtttgcttgcttgtttacttgcttgtttaccaatagagttgacctgttattggatttcctggaagatgtggtagctacttttttcctattttgaagccattttcgtagagaaatatccttcactataatcaaataagttttgtcccatcaattccaaagatgtttccagtggtgctcttgaagaggaatgagtaccagttttaaattgcccattggcatttgaaggtagttgagtatgtgttctttattcctagaagccactgtgcttggtagagtgcatcactcaccacagctgcctcctgagctgcctgagcctggtgcaaaaggattggcccccattatggtgcttctgaataaatcttgccaagatagacaaacaatgatgaaactcagatggagcttcctactcacgttgatttatgtctcacaatcctgggtattgttaattcaacatagggtgaaactatttctgataaagaacttttgaaaaactttttatactctaaagtgatactcagaacaaaagaaagtcataaaactcctgaatttaatttccccacctaagtcgaaacagtattatcaaaacacatgtgcacacagattattttttggctccaaaactggattgcaaaagaaagaggagaagaatattttgtgtgttcctggtattcttttataagtaaagtttacccaggcatggaccagcttcagccagggacaaaatcccctcccaaaccactctccacagctttttaaaaatacttctactcttaacaattacctaaggcttcctcaactgccccaaatctcttaatagcttctagtgctgctacaatctaagtcaggtcaccagagggaagagaacatggcattaaaagaatcacatcttcagaagagaagacactaatattattacccatatacatgatttcagaagatgacataagattcctcttaaagaggaaatgtcaggaatcaagccactgaatccttaaagagaaaagttgaatatgagtcattgtgtctgaaaactgcaaagtgaacttaactgagatccagcaaacaggttctgttt

SEQ ID NO: 56864 - DNA, 1541 bp, Homo sapiens
ccccaggttccctgaagaggccaagatgcaccccaggacaccatttattctcatgtaccatttgtcaccaagacacacagagtaagtcagtgatgctggaaatggccagttcgtttctgccttgttacaggaggcctacataaccacttggtttgaataagattttttacatgtccagtcccggagacattaggtttttgtcttttgtcaccatggtggcagcatttcttacacagacttcgaactccccctgcacttcccctcctcacgtctagtctgaaaatgggaggatttgggcagcagtttgtctgagaaagtccatcctgcctttccctggctcttgtggtctacaaaaacaaaggatgcttccctccagcagcgagcttactcccttgtacacacacacacacacacacacacacacacacacacacacactcttccatggccctccttttgtgctaaaagtggtgtctctgagctttcttatttgggtgctccctccaaagtaaataactttagtcattctaagatgctgtccccttggagcaagggaggggcagatctcctcacctcccagccacttccagcagggaagttaagttaatggggcaaagttttgagaagaaggctttgacaggccggacatggtggctcacgcctgtaatcccagcactttgggaggccgaggcagttgatcacttgaggtcagaagttcgagaccagtctagccaacgtggtgaaaccccatctctactaaaaatacaaaattagccgggtgtggtggtgtgcacctgtaatctcagttacttgggaggctgaggcaggagaattgcttgaacctgggaggcagaagttgcagtgagccaagatcacaccactgcactccagactgggtgacagaatgagactccatctcaaaaaaaaaaaaaaaggcttcgtttagggatttgaaggaactgctggggccatggactttccgatctgcgaacagctgttctggaggaaaagacaggtacccctttactgtgggttgctataattcaagctcatctccataccagcctaaacaccaaatgctgatttcacataaagatataaaaggattcacctctattcaagatgccagatttccccatgatgctgggggaaagccgaggagtgcgaggccccaccctgatgagttccccactgggaggggctcctagacttgacacgttttaccctcacacttgccacataaggaagtcagagaatggaacaacgagagagaggcttggggacagtgtgtgattaattgagctgttcttggcaaagatgctggctgattggtttgtccatctgtctaacttcttgcccacatcacagatcagtctctctgtcccctgctatttatgcttgggtcctgctgacagtgtgctttacctcagtttcaaaggcgccaatcactggtggagcaggaagataaattccagttaaaaatagagctgtataggaatcaaaagctcctcccttacttccctgtcccaaaactagccttg

SEQ ID NO: 56865 - DNA, 1031 bp, Homo sapiens
tacaggtgcacatcaccatgcctggctaattttaaaattttttgtagagatagtgtctcactatgttgcccagtctggtcttgaactcctgggctcacgtgatcctccagcctcagcctcccaaagtgctgggattataggggtgagcccagccccatacagactcttgaggtatcccgttacccatcaacccccaccactaaatgtcaaatacatgagcttgtgcttgatgtggtccttatgttagttcttttccctcaggcagggctgtgagatccttatcgtttactgcaatttgatcactggctgattattggggccaattatgcaggtgacacataggctacccctatgagcctcaaagtcatgcaaattttggataagaagtggagttagataaaaggtagcaatagacaatgaattctgcacttacctgaagcttctcaatcagaggcgagctcttgaccttgaatttaggagggtggctcgcattgggtggtgatttctatggagcaaatcaaccaaaacaaccagataagtaaggtgaggaaagtggggttctggttggaacccaaaagccacaggcagaaggagaagagaagttggtgttgccactttctcattagttcagtagcccacatacttcattagggcctgggcgacgtgaactttccccctccctccctcatcccaccacagcaagatcttcaaatcagaattagagaagtcagcgccgacatccttaacacagaaggtctctcccaggaagagtgacttcattgttgttatgaaggaaaactatatctgagcaagatcttcacctcatgaccttcaacactgtgaatcaacaatttgggggatttcaaagacaaagggcaaaaattaccatcctgtttgtcacacacacaacaagaaaccagaccaggatgacagaggtatgactggaattcctccctggacccagtgatattttggaaaatcccatcgatggcatgatttataaattatgattttccaaaatgttgaatatt

SEQ ID NO: 56866 - DNA, 1041 bp, Homo sapiens
agggcacatgtagctgtgtcctccacagcaaccccacacgttcagctgtgttctcattgcacaatcaagaaagtagctaagggatctgccctgagattcacaccgggtctgattctccctcagcctccaggtatcaggttccctcttaatagacggcagagtggtggacacagtaggccactgagctccaggacgaaggcagtgggacacaccatagtatgagccaccacttggggtatcaaggtacaggtgtgacccgatcaaaatgaaaggcagccaaatgggagagtcacccaaaggtaacgaaagcctcagggagtcttgagtttggttggggaggaggcaggtggtcccagatgcccgaaggcgtccatggggagaacgtgcgtgagagtccgatcctctttaaggccatctagggtgcttctcctgccctctgcattcccaaatcaccacagagctgcgtcctgcagaccctgtggcagtgccgaaccaggagacagagcctctttgagacttcacagagaagggatggagtgtgaggggcagacggtgcaatgggaagtacatgggttttccataccgacagatctgactttaaatactggatctttcacttaatagcagtgtgaccttcaggccttcagcaagtccaacagcctttccgaatctcagattctttgtctgtccaaaccttttggcctgacttccaaagtcttttctatctggtccctgtgtactctctcctgccccatactcacaccctctccctcccagctccccttggccaccttcccacctcctaccagccagactctgctgtcctggagaactcctatgtatactttaggacttgcagacttgaaagcattgcacacgtttagaagggtgttagtgttttcattgtgatcttaataaagaaggtatcatacagacaagactgagtcatggtaagagttcagtatataaaatacgaaagttaaatagcatactagcccaaaccatgtcaaaaagcagcatatgaagctgggtgcagtggtg

SEQ ID NO: 56867 - DNA, 1205 bp, Homo sapiens
catctcagcctcccaagtagctgggaccacaggcatgcaccagcacccccagctaatttttcttactttcagtagagatggagtctcgctacgttgcccaggctgatcttgaactcctgagctcaagcgatcctcctgcctcagcctcccaaagtgctggattacatgtgtgagccaccatgcccggcaagaatttttttttaagtgtcagaataaaattactaaattagacaccgaactgattaatgttttacagtgcaataaaatcatgagtttttgtttttgttttttactgaatggaaagcatttgcatcttcacaaaataaaagtctgcaggtcaccatgtgatttcacaatcccacatggctctaatctataataaatagcaaacaatgattcgttctcctggaaaattaaacggtccttgcgtggacttgtgaagcagtgcaccagactgacattgaaagtgcatacagtcctcctcttggcctttttttatgagtttttggataactttccttaacactttcttctaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgc

SEQ ID NO: 56868 - DNA, 1050 bp, Homo sapiens
caggcctcagttactgagccgtgccgaggctcggtcactcacacacacccagaagcttgccagaactccaagtcagcgagaagttggcaagagcagaagacacacttcctctttgtgtccttttgtcccctcagcctcagcgacagcctttctccaacaagttggcacgaggcaggagcctggcacctttgtttctgcatgtcgagctgatttatgaagggactgtacggaacaggacatgtgacagaggcacacactggccctggcactgccttctgcatgtgaacgagccaggccacctacctccggcttggggactgctggctcgctctggacctcactgctggtctccagctgggcagggccggtctgggggctgcagcctggctcgagcactgccccctcctgttgtttttccttgcctttttcctgcttggggacatctccgcccttcactcctccagggggactgtggggggtctccttcactgcagctccctcctccagcttctttgtttcttggctgtcatgttcaggtcccacctcttcattttgcaccctctcccccttcacctctgtagccttttccatctctgcttcctctccagctggcttttcctccctggggctcccacacctattttctgcctctgggccagaggtctggggcgattccgggacctcctcttgggccgggtgctggccgtccacctcctctgaactccgcctggccttttcaccgttcttggcttcctctgtggccctgtcctcctcctgcttctctgtcctgctgggtgacctcctcagaggaggcttttcagcaggtcccagggttctcactccctctcccgctgctccctcactggacaaaggggatcctggggccttgctcttggatggcaacacttcatccccatcctcttccttagcaccgttctgctgagatgactccaccgccctgaaatctccaagttctccacagtctgactgtgaccttcggaatcgcctggagggagggcgcctttttattgagcccctcgtccgcaccta

SEQ ID NO: 56869 - DNA, 1033 bp, Homo sapiens
agccacttcactctggcctgggtgacagagactccgtctaaaaataaataaaataaatacataaatacataaatacataaataaaaatttatcaagtgtttctcaaacactcattatgtatccagtattgtgtagggcactcagctatgccagagactaacttacccaaacaaagacattcgaaatatttggatatcaaatctgagactttgctgtattaacaataagtgccgacttcctaattgcctgattcaattgctttccaagtcattccccttggtttctcaacatttgatttgaaattcttttctccctgagctgatgaaatacatccttctcttgagaatcccctacctttgtaactttgtagtgttaacattgttctttctttcttctccctcctggttaactggcaggtcaacagactcagttcttggccctatttcttctcagttcttttggggacacactccctgcattcccacctcaatcatccctcagacacattaactgtccttgccagagatccctctgtctctcctccttttcccctttcccacccaccgctcctccttgaccctcctcagccccgagcatgaccagcgctttgtgggagctcaatcaataatggaattgtgaccaggcacagtgcctcacacctgtgatcccagtattttaggaggccgaggcatgaggatcgctggagcccaggagctggagaccagcctgggcaacatggcacaaccccatctctatgatgataccagtgctagcctttcttttctatctctacaatcacaactcattcctaacagaattcctggtttccagactcaccctacacatcagtgacaaatgcctcttcctataaataccataggttgtctgctctcctatcccaaaccctttgatactgcccactggaaaatggagttcatgctcctccatgggctgggctttgccacatgcctaaccttcactgtctccatgctccccaatagtggggccggggctccagccagcctgcaccctc

SEQ ID NO: 56870 - DNA, 1088 bp, Homo sapiens
cctgccctctcctcgtggtgactctggatcgtctaggccctcccggattctgactcaggaactagggttctggcgttcttcacctttgggaggtggcggaaagttgcaggtttttcatttgtagggcctttgttgatttgtttcctgttaagccagggttttgttgtaagttccctttcccatgctctcattcagttttaagtctccgtaataaaagagtctcatttccgtggtctgcaaaacgccaataaaaaaatattgttacttctaggttagaatgcaaagagcttggaataccagtgagatggcctggcttaaaagaatttggtcaaatccatcataattccagacgtagccaccataatttgacaagacatagagcattaaaaagcataattttcctaaaggaaaaaaaaagctcctttttcttaccaaatattgtgactcaagcttaaggtaaacctcgggctcaatttatgggaattggatgacttgttttatggacatctgaagtggtatctgccacaggacttttctgtgttgttgttcaaagcaaagtacttgttgctgtctccgaatttagttaaataatagttataaagagggccagctgctaagaaaccacgtagatttttttcattccctttgttttcaaaatgtcagttatgatttagcatcacagtatctgaataccagagtttactcagtaatttctttcttcatggaaaagttcttaatataatccttggatcagggaaactaggtgaagttctgttggatcaccaactgttccacttaaacagtgattccaggggctgtaaagcataaatgtaaaagtctccctaccctccaggggttgacagatgatgacacactttgtgtaagacacaatccattctgtattttgtcttagaaaaaaaggttaaaagtgtgtttgttggtggtggtatttgtgtttaatcaaacaagtagaaaatagcctaaaattaaggtttatcagaaatatgcttcagacagaattgttatgcatgagaggtcagacattgctatggaggacaaagcagttagggtgatcttaattaaaatca

SEQ ID NO: 56871 - DNA, 1518 bp, Homo sapiens
tcttcactaagagactattcttattttatacactgatcaagtcagtgtgatatcacaaaaaaagaacttcagaattgtttaaattctgtttctgttctctatgatctggataccttcaataagttactttccttttttgggctagagtattttcatctataaaatgaacgtgaactagatgagttttcaagcctatagtagaacaattaattagaggtgaaatagaggctactactggaggcaagctgcaatcagcagtggccacagctggcctgatctgcatggagtagacagtaagaatgttaaaagcatttacaaaagttcaaaaataatcatggctggagacatctggctaggagcaaatagtccgacatacctgagtggccccagagggcacactaagttacattatgttcctaatgtccacacaagttctgagctaccaaataaaggttaaatggaatactgtagttctttcttttgcagttttattttgatataatttctcatttacagaaagtttcagatagaacacaaagaataccatctatccttcacccaggtttttcttttcttttctttttccttttcttttcttttcttttcttttttgagacggagttttgctctcgttgcccaggctggagtgcaatgccgcgatctcagctcattgcaacctccgcctccagggttcaagcaattctcctgtctcagcctcccaagtagctgggattacaggtgcatgctaccaacgcccagctaatttttgtatttttagtagagacagggtttcatcatattggttaggctggtctctaactcctgacctcaggtaatccgcctgcctcagcctcccaaaatgctgggattaaaggcgtgagccaccgtgcctggcccacccaggtttttcagatgttaacattttattacatttgcttaaatctttctctccccttcctccccctcccaccttgtatatgtgtttctgtaccacatggaagcagtaaaaatgccgttcctttatttataaataatttaacatgtatttcctgaagactaaggacatcatgttatataaccacagtgtaattatcaaaattaggaaatgaatattgaaacagtaacagtactgttatctaatatatagagtttatttggatgatgcccgttgatccaataatgtccattagagcagaagaaaatccagaatcatgtgattcacttagccatcatgtctctttcatcacctttagtctgcagcatttcctgagtcattttctttaaagttttacattaatatttttaatgtatattatataagccagttacatagtagattgcccctcattcaagtgtgtctgatgatttaggctatccatatttggcaggaacaccacggaagtaatgttctgttcttctcagtacctgatctaaggagaaaggtgctgcttatttgttccactgctggtgatgttgactttgatccttggttaaggtgttgtctgccatgtttctcca

SEQ ID NO: 56872 - DNA, 1279 bp, Homo sapiens
tgtgcgccatgaggctcagctaattttttttatttttggtagagatggggtttcaccatgttgcccaggctggtcttgaactcctgagctcaagcgatccacccacctcagcctcccaaagtgctgggattataggcgtgagccactgcacctggcacagctgcattttagagcttccaaatgcttagtgcgtatttcatttgtttccaaagtacattttaaaccattaaaatcacaataaaaaatagcacacacacttgtgggtggttatatgaataattcgtggactttggacaccaatgtcctgttaactcaggctgccagtgcagtcttcagaataaagtagatttttgtaatttctctgccgacatgtaaacttatacaagtgtgttattgattaagaagctgagtagagcactgccctggtattttgaaaagttcaggttcatgcatgtgcactaataatgtattttacaagtgaacatacctatacctacagtcaatcaaatgccaggcaaggtgtggctcgtctgcttcaggcatggtcttattgtataatagcatcgtaagtgaagtcccaacatctcatttgtatgctgggtagtaattacatgtttcaaatcacctgggggccttttaaaaatcctgatacccaggccataccccttaccaattaaatcagaattcctggaggtaggggtgggacccaggcattagtattcttttaagagttagactgtttagagcagttatggtttacagcaaaatagagcagaaggtacagatttcccatctgtctcctccatggcctctcctattattggtatcccccaccagagtgatacattgttacagttggtgaacctacagtaacacatcattatcacccaaagaccattatatttacgttagggttccttctttctgttgtacgttgtatgggtttcaacagatgtacaatgacatatatctattattataatatcatatagagtaatttagtatttttcagtagtttcagtaggcatcagtatttttaaatttttaaaaattttttgctgtattttggaggagaggaatatattcttattgccatcgaccgtaggcgtattctttccaatctcttgttctgtccttctagtaataattgtattggcttttctggtttcagttaaattttggttcacatatcttcaaacatactataaacctgataagatttgagagcccagaaagataagtttaaggtacagtggtctttttcctgaagagcaatttt

SEQ ID NO: 56873 - DNA, 1373 bp, Homo sapiens
aagtgattagttcagtgactggcctgattcaggaccctttgagcatttctcatttgagaaacagaaagatctttgttggtacaaaaaaggttaaggatagatatgtggccagctggacatcgatcatgagcggaaggaattgactccgagagggatttggtaatcttgtgtgttagtaaaagtacatggattttttttttttacagtctcactctgtcacacaggctggagtgtagtggcacaatcacagttcactgcagcctcaacctcccaggcccaggcagtcctcctatctcagccccctgagtagctgagatcacaggtttgagccactatgcccagctaatatttttttgtcaagacgagggctggtcttgaaactccagggctcaagccatcctcctgcctcagcctcccaaaatgctgggattacaggcatgagccaccttgtctggccagatttttttttttttttttttttttttggtaatcaaatatttcaaaaggtgagtctcctttggggtgattctctcacacagaaagatgattcttggaggaaacatatctaagcatcctccaaggtagtgtcagcattcaaagttgatcctgaattatctctgcagacactttttgtgttgggcattatgctgaagccatttgttgtagagcaagttgatttttatggctgagcttatctgaatttagtttgatatattgtattctttatttattcattcattgattcactgattcattcatttttcctgacattcaaacaaatgtttcttgaacacattgtgaaagggccaggcatttgtcaggtaatgagggtataatggtaaacaaggtagacacagccctttgccctcttgggggtgcagacagccggtcatttaagtggggtgtgaggagagcatttacaaggaaaggacaggatgtcggggagcacagggtggggagtgtggggcagacgctaggaggaagtcccttgagattaaggcctgaagcataactttagacaaagagtgcagaagagtgtgttcctgactaatgaaaagcttagtttattaatacttagggcttgttgaatggaggatacttttgcagccttcccctactttgtgccatccagccaagagaggtccacaatagcagccctgattcgcgggaggaaagagcccacttcagctgcagggtggccctgttcccaggagagatttgagtctgaccccacagtggcagcaaggcagctctgtgcctgtgttatctccaccagcacacgtcattgagtcagctttactttatccagcctgattgtagaagtcatagtagacactgtgagggaatcgtgtggaattttcactggagcattc

SEQ ID NO: 56874 - DNA, 1224 bp, Homo sapiens
gtatgagagtttgaatttacttggagtaagatcatctcggcatgtagttgggagacattatttactctattgtttcagtaattcagaatattgaaataggtcagtcatgtcaggaaatagactcttaggtgaaccattcttgaatttgcctttttctttgtgattgtgatggatattgttttgttttctatctttgcttttttttttctttctgaaatgttctggttgtccatccaaattgtaagaatattacattttgaatatcctttgattattgtaaaaatgacccctagtcagatgattccacagactttttgattacttgtcaaatgactttgcgggcttttttcatttgaattgatttcctattttaagggtcagtgtcacttcattgctaaatgatacctttgagcaacatggtacattttagaaaccttattctccagagtactctaagagaagggttgtttggattttatttgtttatattcttgccctttaaactctagcataactcagcaggattcggtactccttatagaaccgttccccagagagaaagtaagctcagctctcatttccatgttgaagtttgtatgcaagtttacatggagctcagaatccaaagttggcaggatatgaaaatgtttgtatatcatttaatctattttatttcatttcatttctgtgtttttattcccaaagcaattggttttattcaggaatcaacagacttttttaaatccatctataagtttttgaaccaaagctttactacatttcacagccatttttgccactatgccataattataaatccttggcctcaaagaaacctatttaatatcttattcagattgagattctagtcttcagtgacatggaatgtagattagaacaatagtttctgtatatctcaatggtctttacatttgcatttttagccattttaactagcccctaaaaactctcttttatgactctgtggatgagctatctgaattcaacaataattttactatgtattcccataatactcctagtcatttaaaaaaaggcaggggaatggacaaagcaaatcattcccaattgtttaagaaaccagtgaactcatcccttgcttggactgcatagaatacagcctgagagggaaacctgtgatttagtttctctctttacccacacaggagaacacttctgacaagatgccattcgtgctcaccg

SEQ ID NO: 56875 - DNA, 1016 bp, Homo sapiens
atttggttagtctttttgctcaaaattctgtgactgtaaacttggacacttggtctaattccatctttaaataatgtctcgggatgacaagtcttgcagctaggcctcgaggaagggatctggtttaagaaaatccttgaagaaggctgggtgcggtggctcacgcctgtaatcccagcactttgggggggccggggctggtgaatcacctgaggtcaggagttcgagaccagcctgggcaacatggtgaaaccccgtctctactaaaaatacaaaaattagctgggcgtcgtggtgggtgtctgtaatcccagctactcgggaggctgaggcaggagaattgcttgaacccaggaggcggaggttgcaacactgcactccagcctgagtgacaagattgagactcggtctcaaaaaaaaaaaaaagaaagaaagaaaagaaaatccttgagaaactttatttatagacttttagagactgtggctttccagtactcatcaccatggagaaaactagtcaaaatcacacagagtgaataagggttgcaagccagtgctgcttcctggaataagctggtccactagtctagtcttgtgctttgtccttcattttgaactcaagtgccctggggctgcttttctgcgtacccacaatagcaaggaactcttttgtttgcatctcctctgaaagaaatgcttgttttgaggtttggaccgcaaataataatctattgttccctgtaataataatccaccctctttcgcagaaaaaaaaatctgcttgatgcagtatggctatcagtttatttaaaagaatagccaaaagtgcccattatgtcctgagaataaacatttgcaagatggttgggaggaatgggggagtactcttgttctccttggctgagagtcagttaagtcttcaaggagaaaaaattctgaaaatgaccatcagtcctggctgacaatactcttccttattctgcccgtctgttacattctaagaattattgcaacac

SEQ ID NO: 56876 - DNA, 1028 bp, Homo sapiens
cgccaaaagaaatcttcgtggcaaatggtacacaagggaagctgacctgcaagttcaagtctactagtacgactggcgggttgacctcagtctcctggagcttccagccagagggggccgacactactgtgtcggtaagaatgcttgacttctcttggctagtcctgcctcacaggtttctttactgctgtataattggtgatccatttttctgatggttcatttccaaaatgagtgtattttttatctgttatagacttcaaggcccttcttttgcttcaggataaaataagttcagcatctcttaaatgcgtctggtttccttgtctttgatcagttcctctccaccatcaaatcccattctgaaattgatcttaattgaccacactgactctaatcaggatttatcctgcatcttttcatcttttattgccccatatttattgatatttgttttatgtattatcaaattttatatatatatgtatgcatcttctgatttgattatctttttttaatttagcgtatagtccatctgatttagcaatattgatttgggagcttactatgtagtgggttatgtagggccttcaaaaatgtctaaaacagaatccttgctctcacctagagatgattaggaggaaggctgatatatagatgactttggagtaagataaaggatgtaacagaaatacagcaccagagcattgaaaaaaggttatttagtaactagtggagtgctggttattaaacatgaactgactatcttggttctggtctgtaaaatggagacgataaaacctcccacacaagggtgttaggaggataaagtaagattattcaagataagtgctcaggagagtgtctagctcttgagttactaaaatacaccatttgttgttactgttgctctcccagcatgtggaatgcccttcatatattggcacatattttagtactgttgcatgtttcaggttgtcagtgtttagcaaggacagtctgtcatctatctttaagaatgcccaatt

SEQ ID NO: 56877 - DNA, 5583 bp, Homo sapiens
caccaaaaatacaaaaaccagtcaggcgtggccgcacgtgcctgcaatcccaggcagtcggcagcccgaggcaggagaatcacaggagcccgaggcagggaggttgcagcgagccaagatcacggcagtacagtccagcctcagcaacagagggagaccgaaaaaaggaggagagagagggggagagggagagggagagagatgttgcatttctttccgtatgaagtctttaaaagaacctttcatagcatgcacattacagagtttaggaattctgcctttgagaatagttcatgtgttccttttttctaattgcagtttttccactactcccaagggcaagtgtaccttgggaattatccaccatttaaagacagaatcagctgggctggagaccttgacaagaaagatgcatcaatcaacatagaaaatatgcagtttatacacaatggcacctatatctgtgatgtcaaaaaccctcctgacatcgttgtccagcctggacacattaggctctatgtcgtagaaaaaggtacttccttgagtattttggcagtaataatgcagtctcctttatctcatgtttggttggaaaacatgagttgcatttcatggtgggtttggagggaggatttttgccatacagttgtgctccctgttgccacgaacctgtggctctaccaaacacacttggagctgggaaacttgttgctcattctgacccagagtggctgatttctccatttttattcctaccgtctggtgcctattggtctaatttcaggagtatgaatttttcagtgttaattagaagaaagaccaaattcattatgtttggatgtgatgggcagtgggaaagaaggagattcatactgttttatattctccaggagaaagctttcaacaacagcacagttatttcttccttttgattttgagaacaaacaggaaatgcaggttctggtgtctcatttttgagacaaagtctgttttgttggagagtagatccaggtaaattcacacctccggtttttctttagagcactgagagggattgtaggtgtagaaatgcttagttccatagttcattctttctcatctaatattcacatgtcatgaattacatagtaataggatagatagtaggatctcatagtttggataataaaagagggtacggtaactgctaaatgaagatacttgctcgttaatttaataaaattccatgttttctctctgtagcaatgtaccttaaaactattttgttctttctctctagagaatttgcctgtgtttccagtttgggtagtggtgggcatagttactgctgtggtcctaggtctcactctgctcatcagcatgattctggctgtcctctatagaaggaaaaactctaaacgggattacactgggtaagaaacactgtttttttagggcaggggtggagggagggaatcagggtttatagaaacttctgtatttaatgaaaaaaggattttaaagaattaactactattttctttcatgtcagaatcaggcagtctccttaggaggtgttctaacatgggcaagtggaaatcagtgggcctgctattaaatgtggaatatgattctaatctctgttccagtttccttcttaggtttggtgagatgagctgctcagcagtctgtgctctgtgtttcaataccatccactatgcaattagtattcttaagacatcacttacccaatttaagagtttaatttcaatttcttgctaataaactcacaaggtggttctttccagttaggaaatataaaaccctaattaagaagttgtgagctggaattagtggcatgtgcctgtaagtcccagctacttaggctgtggcaggaggattgcttgagccgaggcgtttgaatctagcctaggcaacatagcaagatcctgtctctttaaaaaaaaaaaaaaagaaagaaagaaagaagaagaaaaagcagtggttttaataaactacctcccccagcccagtgtgatgatggtgcagggcttttcctttttgtagttcccctaccccactccaagcttaagtagctttattgctttgatcattcttagctagattcacccaaaatgggataataagaattgatgacaaaatatatcagcaataaagaaaaatagactttctttttgtttatggcttctcagatggaacacgtttaagcatagggtgtgtatctaattaaaggaccttctcttttccccactccagctggaaagctaacccatataagctatgtagaactcatgtggtaagactgggagcagaggctggattcaagttgatatagcatgagcagtgttgcagatgcacagatctaactttagccatcctgaagggactctgatgtgaaaggattgcatgtcctgaactctcttgctggtggatggtgggaacctctatctatgggctctgctgatctagagtttttaggagtgctgtgttttaacaagtttgagtgttcaaattcagatattacttgcttggaatgcttctattctgctgactgtatctgccccccttgcatggtgagtgttttatgattaaatatagttggactattggtttcaacatgagactaatccagggtggtgacatgccggtctttgtagttcttgcttcggggttaatgaggggcaggaaagagttccttagactcctgcatggcatcatgaatgctgctgttcttcttaccttggtttttttcctcctcctctaccttttctaccttggtgtgctgggatcagatcctgcttatcttccacttcttaagaaaagctgacatagaagacacattgggactataacagggctgggtctcctcttccactcccactagacacatggtaactaatcacattgcccattactgttaatattcctgtgtatgtattcagcccctctcccttgttgatgactaaccagctagctctgagctaacccaacagctattatgatttgtccatgaatatgtcacatgtttgtattggaaacatgttgagcatactatctggatgaaattggattgtgaagttacatagagtttttatgcacatctgaatatttgtgctcttcatgtaaaatgccattgtgtatgtgtgtgtgtgcattagttttcttttttcatatatgtattatgttatcaatatttaagatcctgactgattatgtattagaataattaaaccattttggttcagagcatgtagcctcccatttcacagaaggaacagtttgcagaatgcatggtatgctttggtcttagtaatgacactttaaatgtgattctccccaaactcctaagttttaaaagtatatatcaaaaggctttaagctgtactgatgacacatctcattggaaaatccctacgctgtaccccagctttcttacttcctggcattcactttccctgattcatttatgagatagtgcttgttgttaaagactactgtcaccgtgaaaaggttcagcctgtgtgacctggcattccctaatttctcattcatgacttcctgagtttttggggggatttgattgtggtattggtagggaataaaaatatggagagaacaagataagccaagacttgcctggatatatatctgtaatttaaaacatacattcagaagaggtttgcctttgattataacaaaagtgaattgccattaagctaataaaaggtaccatagagcttgttcccttaaacctttatcccaaaggagggttgatggcagggggaaaagacaaacagcaaaaggataaatgtgtattgtaactagaattccaatatgatttttgtaaactgggttgaagaggttgtaccatatttgtttctgtgcctcccccagtgatgagttcattgacttagaagaatgagtgagtgtcaggtatagaaaatagtttaaaaacatgtgatcattttgacacccattgttatgttgtcttttgtttttatatatctgttgcttcatcttgccgtcagttgcatttctatatttttgtttctatttatttattattattattttttacatttgttcttcaaattgccaattcatcagctgcagtacatcagagagtttgtcaccagttaagcaggctcctcggaagtccccctccgacactgagggtcttgtaaagagtctgccttctggatctcaccaggtaatggctgattgcgattctgcccactgcactgttccctacagcttggtgctctgtcacttccttgggtgtggaaaagaatactgagctatgagagacagagacagagacagacagacagagacaaagagagagtgggagtgaggaattaaagggctggcctaggaagaccacaggaaaatatgtggtgaagaatctgcttgagtaaagatttccatgaaaccaccaataacataaattgtttactaaccatgtagcttccttgcctcaagcagaattaggaaatggctttgtcagtaaaagattctttaattgcccaaggaaatgaatctaatgaaggagattctttctgtattgaggtactctaagataagaaattagcaaggaaaagttggtattcttagtattgataataaaaccaaaattattttctgtggattctttagaaaaaatggaaagtaagcatttatctgaataattaataggcttgatgaacaaggaatggttttggtttctacttgtagaaagtacagaagagaaacaggttttatttggaagttagcatataatctagctttgtgtgttttggctgtagtattttaattataactgtggcttggcaaaaattccatagcttagttcagtttgatttttctggggtagaaagcatgctaaagaatttggccagttatagctttgtcctaaaaaggtgttagctggtgggaatggatttaagaggaaataaagagagtaacagtgttttgtgggaaaagtacccatagtcttattccatagttgttatatgtggtgaggaaactaaggcattgtgatgttaaattactaaaagcacacacccagttagtgacagaactggggctagaacccaggtgtctagatagcatgttctctaccacagcatcaggctcattacttgttcctgttctatctgtctgtctctctctcacattacataatatatgtcagatacctcagtctactaatttgggttgtgaacaggaatatggttgtaaatgaagacatgaaagttacatacacataggcatagcatctaaaaaagcattggaacatttttattccgcccttgaagcactatggaagttgcttttttgctgaaaacaaaccagaaaaaagaaaaagaaactgtggttttcaagacagtggaacacaaattatgcagcactgtcatccccaaaagaaaggaaacagacaatgtgagccgtgttattgccccagtgtactgccttgaagcagtttccacactgcagtgtaggtggggaaaatggaaactgggcccagctgtctcactcaattgagaaggcggaaatcagaatttggggaggtcaaggaggcta

SEQ ID NO: 56878 - DNA, 1470 bp, Homo sapiens
aacagtggaataaatactaaaaaaaaaggtgttctgtcagtagtcaatgagcacatggtaaaaatagatgttctttcttagtgattcgtgctaggcttttggggatgactcctctaacacctgaaggactagaatcaaattaaatagggctacaggctacagagactgtgaaaggtgtactacaggacacaacataatgactcctgagcagttaatttgtagttagaagcaggtctctttgcttttctagaatcctttcttcctggaccttctcccccaaccttcaccagttatggtttttttattggaataaataattaattttggtacaagtaaacttcagaggtaattttatctctagttgtaactaaaataataggcctatattaagcaatgtgtttcttgaaacattttcaatagctaaggcctattcatgcagaaagtagctgaaaacatactcagaccaatttttcactttattgttgtaattctttgtgtaaaagcaaagataaataaataaatgaaatggagggtggggagggtgagtaccaagagatagagtaaaacagctaggttaatgtaggttttgttgttgttttccttctttattatacccaaaagtgaatgtcttaacaatggtaggttcatttcaaagttgatcgtggttctgtggatcctcttgaagtcctgagcagcctcatttgccctcaaaatcgaggtgctgaggcatgttccatagagactcagggctccttccacctctaaatagcactcagaatcaaacttcatagaggtgttctagattgagctagatctgtcagcagaccccaatctcaacctacatctgcagtttctctgcatcctttctttcatccatcccttcatccagcacctgtgttctgccaagttctaggaagttaacaaagtccctgacttaagaccttattatattctaagggggaagaggaatgaggataacatcaggcagtggtaaacagtttgaagaataccaagtccatcagcaggaagggatttcttcagtgttttcccatttactttcatgagatagttgtattcttttgacatgaaagacagtactgtctcacatgaaagacctcattgatattttaacatttacagactaaaagataattctgtgttctttttcctctttactttctctgttctcattcttttctactcacataatatatcaattatctactgctacgtaacaaaccccccaaaatatagtggcttaaaacacgcactatttatttggctccccattctgtggattggtcgagcagattctggtctggatgagctcagctgatctctgctggctcacttgtgcatctgcagttggctagaaggttgactggtagctggacagtctacagtggtctcacttacagtctaaccattggcaggctgttggccaggcagacagaggacagctgggccatg

SEQ ID NO: 56879 - DNA, 2979 bp, Homo sapiens
ccaccatgcccggcgaatttttttgtatttttagtagagacggggtttcaccgtgttagcaaggatggtctcgatctcctgacctcatgatccgcccgcctcggcctcccaaagtgctgggattacaggcgtgagccaccacacccggccgaaaacagtctttttaacttccttttgttttttggtggggttagcatttaacttgtagctttctgagatgaatatagagggtctgtatgattattaaccatgtgatctgttaatatttcctatgacagccattatagactaaagataaacacacagagtttgactatttaatttacttgaccagttacctcagtgcattttaaagtatgtttgtgtaacaagacgttcataataataactaacatgtattaagtactgtctgtgagacactgcctaagttataggtatcatcttatttaattttcataacaacaaaaaacaaaaatgtagatattattagtagtaccattttagagatgaagaaacttgtgcttagaaatttacaaatgtgcccagggccacgtgaccagtgctcttctctaaggttcaacaaagacgatatcataattcagactgcagatctgccaacattcaaatggctctagtcctcgagtgttattttctaactccgcttttagatgcaccattgtatagcccttacaactgggcctgtcccttctgtagatgtgggagtagctgaactccacagaaccccaggttacacactaaggacacaggttgttagggctcctggatgagggtaagtgtgtttattttaaaccacgtgcttttggctattgagcttatgatttcaaaggtgaaagcttaagcacgttattagacttctcaaggagagttcccctagattgggagaaaagttgacattgggtaatattaaatctttcttttaaaaccagggctattttgttgttgtttacaattttaagagtctagactgaaagagtcatgaaatgcagccacctatctgacctcttcccccaacagttagggaattcgctctgcccccaggccacccaaccttcccttgctctcctgaatgggaccctgacaattccctggaattgtaacctcttccttactgctgaggctgagaagaggatcttttctactttactccatttagggtttttctttatatctgtgtagattgtggctttttgttttttctttttaattttattttaaaacaggaagaacagttatctgatattaaaaatcaaggaagcaatatttgtattggtcacaatacgctcagactaaaagaattatgctgtaagtagttgtattgaagaatatttgaagtgcttttaaactatttgtttaaaactatacctatttgtataacgtgaccagatcaaattgattgtatctttgggtggcaccaaatatgttggtttcttgcatggattgattattctgaagctcatgatttctgtgggtctcaggtgcgtggaagttcccatcttagtccttaagactcttaccccaattgtaagagctgaggaattctgtgatagctattaagataagagatattcctaagaaggaatatattattacagaaattttcaaacatcaaaaaggtttgaaagaataatgtaacaaagccccatgtacttgctttaactattgtcaacgtatgtccaatcttgtttcaaagtcagtcctggatgtatcatccataagaagtcttcctgaagacattcaagagggaagtctttgctttggaaccctgatgtgatcacgttaatcattgcttctatgcctgtagctgaaggaaccgccagcgttttcagtcctctaatccttctgcttcccttttccagggcccagtcatatatgcacagttagaccactccggcggacatcacagtgacaagattaacaagtcagagtctgtggtgtatgcggatatccgaaagaattaagagaatacctagaacatatcctcagcaagaaacaaaaccaaactggactctcgtgcagaaaatgtagcccattaccacatgtagccttggagacccaggcaaggacaagtacacgtgtactcacagagggagagaaagatgtgtacaaaggatatgtataaatattctatttagtcatcctgatatgaggagccagtgttgcatgatgaaaagatggtatgattctacatatgtacccattgtcttgctgtttttgtactttcttttcaggtcatttacaattgggagatttcagaaacattcctttcaccatcatttagaaatggtttgccttaatggagacaatagcagatcctgtagtatttccagtagacatggccttttaatctaagggcttaagactgattagtcttagcatttactgtagttggaggatggagatgctatgatggaagcatacccagggtggcctttagcacagtatcagtaccatttatttgtctgccgcttttaaaaaatacccattggctatgccacttgaaaacaatttgagaagtttttttgaagtttttctcactaaaatatggggcaattgttagccttacatgttgtgtagacttactttaagtttgcacccttgaaatgtgtcatatcaatttctggattcataatagcaagattagcaaaggataaatgccgaaggtcacttcattctggacacagttggatcaatactgattaagtagaaaatccaagctttgcttgagaacttttgtaacgtggagagtaaaaagtatcggttttattctttgctgatgtcctttctgcttgaaataacagtcaccatacagctaaaggagaggagtttctttccttctaagtaggcagaaatggtatcattatgttgccgctctccaatctcccagagctcgctctctagagaatcaccttctttcgcttttttttttttttttgaggtagagtctcactatgttgccca

SEQ ID NO: 56880 - DNA, 1746 bp, Homo sapiens
aggtttggtcaccacacatgtctgaagctgggcagcgtctgctctgtgttctgtgtggaatggagaaaaaaacgcctgccctgctgccttccatgttcataggcccagcccaagagagtgacacacagtgctggccctgagacatttccacaaagtggtcaactctgccttgcatcctaaaactttttgggcatctattttgaaaactataggagcctttggaaggcctcttatgtttggaggggaagggtgttgagattgtcaccatccttcaagctgagactcctggtgagcctttgccaccatgaaaaccacatagctgaccagggctgtgcttgaggtacagaggacacacattgtagacaggcctgtgtcatgtttccttacagtcgttttttacagagaaaaggggcattgttttttcactgctttctcaacagttcctgtgaataaatgaaacatttcggagctccctgagagcaagagccttcacttcttcttgcggtgccgggaccatgtgttggtgaagctggtgctgtgggggccactcactcgaatgacacctggaggcctgttcctcccttaccactcccttccccagcccgacttcttggcctcctgcccaaccagacacctcaaactctgtcagtgccctggcattctggcagagaatcctcaccagttctcaccaaccttccccccaggcaagggcagctgccagcatggtgctctgccaggacaggtttccctgaaggaagctgctcacactgagatgagcctctcagggcaggacctcttcccaagccctgcacacccacccctgcagcccttttggctccccttttccctgtgcctcagcactcctttcctggttgcagataacgaactaaggttgcctaaagggcagatctgccctctccatgtcttcgtcctggcaaacagggtcgtcttaaaattatgcgctaattctgtatgggagcactcaaaaggcattacttagagattgaaatttcaaactatctctagtttttcaatggaaatatatcagctagggaaaaaccatcaagctcattattattttttgatcttcagttgtatttttgtgaatattttaatacatctttttcaatttctgaattgtgttgtgtgctcattttgaccagaatagaaaaagagatatgcctttcactcatatcattccagctacacctgccttcttttcttcaaaaatgccgtccgtgtgcctgcttctgggcctttgcacatgctgttccctgggcctgaagcatgccttctgccaatattcctgtggtttgctctctgacttcctttaagcctctgctcaaatgttacctcctcagggagaccttctgtgatatataaaagagcaagccccccaccccaccgcctcagccttcctggccccctcagttctgctctagttactctatttctctccctctttcccagtacacacttgtctgttctcccgcattagaacatagttaacaagagaccagaaccttgctgttttgttcactgctccgtctgcagtaaagggaacagcacctggcacttagctgctcaatacatgttacgtggatggatgagtaggtggaagcattcatccattcagcaacctacactgagaacaatcctgtgccaagcactgtgctaagcataaggaaacaaaacaagacaaagctcctcaaggagcttgccacagggtggaggtgacaggtgaca

SEQ ID NO: 56881 - DNA, 1017 bp, Homo sapiens
ggatgctcaggtgggggggctgcttcagcccaggaagcggaggctatagtgagccgtgattgtgccactgcactgaagcctgggtgactgagagagaccccatctcaaaaaaaaaaaaaaaaaaaaaaagtgctgggattacaggcatgagccaccgcacccagctaaacttaattaaaattaataacatttaaaatttatatctctagtcacattaccatactgcaagtgttcagtggctacatgtgtgtcttgtgactaccatattgatcagtgcagatacagaacatttccttcattgcagaaagttctattggatgacactggtgcagaccacacaggggttggcaacgttttagatagttgtgtcaggttatatgcacacaagctcagaatcctccatagccttttttttttcatggtggggatgggggtaccccccacagcagtggtctggtggctgacactttctcgtggatagacagcatacactctttactcactcaatataatttatagcctatgatgtcccacacattgcaaagtgctacaatgcatctgagaacaagatagagcttgctgaaggtcttctaagctttgaccttatgccaagttctgggatataaagatgagggctggctgggcgtgatggctcacgcctgtaatcccagcactttgagaagccgaagtgggaggattgcttgagcccaggagtttgagaccaacctgggctacataatgaggcctctatctctagaaagaatttaaaaattagccccagctactcagggatagtgggtggtgggggctgggggcaagggcgggagggtaagatgggaggatcacttgagcctgggaggtcaaggctgcagtaagctataatcattgtgccgctgcacttcagacaaaacgagaccctgtctccaaaaactaaaaataaattagaaataaagataagagcaacagaatccctgccattgatgagctcaaagaggagacagccccaaacagcagcag

SEQ ID NO: 56882 - DNA, 1032 bp, Homo sapiens
agaaaaaaaaggactactggccaggcacggtggctcatgcttgtaatcccagcattttgggaggccgaggcaggtggatcatctgaggtcaggagtttgagaccagcctgaccaacatggtgaaaacctgtctctactaaaaatacaaaaattagctgggcgtggtggcttgcgcctgccatcccagctactctggaggctgaggcaggagaatcgcttgaacccaagagacagaggttgcagtgagccaagatcacgccattgcattccatcctgggcaacaaaagcaaagctccatctcaaaaaaaaaaaaaaaaaagtactactcttatgttcattttgccagtgaggaaattcaggcacaaagagtttaattgcccaagaccccatagcaggtggtaacacaggatactgacagtatccaaacataggccagggtgcatatgtttgctcactccataacactatctcttgaagaagccttttagtcaaaatggattatgcccttctctgaactacaatactactttgttatgcctctcttatagcatatatcaaaggttcccatgtaacatacagctaagtttgtgtatgttggtcttccccacttgattgtgagttttctgggcaggaactaggccctgttcatactgtgtgtgtatttctccacttttatctgcagaggtggtacagaaaaatcatgaagagtacaggctttgggatcagatagtcctgggtttgcatagtaaactgattgcattaatggccccagtacctgtatctgtgccctttgctgtgtaacttggcagagtcctctcattctggactcagccttgtgaatgcttttgtcaatggactatctgcaaacataagacataggaagaggcttgaaaaatgcttttgcattgggcctgctctcttgctcctccagtattgccaggacaaacatgctggatggaagatgagacacatagagccagattgccctagttatcccaactgaggccgccaggttggccaacagtctgttga

SEQ ID NO: 56883 - DNA, 1010 bp, Homo sapiens
cggcttttagacaaaactgtcattttatgggtcagctatagacagacatggcgcttcagctgtcttcagaataatgtcacccggcctcctctcctgtcttctgcagtcttaaaagacctagtccctaactgaggtctggcttttcctcagccctggatgaagtggaggtatgtggaagtaagagtctcagcagaaagattgattgcagagctgaagatgagggcgaccgtcaggaaagaagacagctattgcagaggagtgggaagcctggggctagaagtcagggttcaagtttgtgtatacctctgtgtcagtcccttacatgagcttagaagcttgaaggcttaaatattgcctcaccttctcaacctggatgctctgtctttctagcttactttctttatttgcctcttttctgcagtttctcacgtgatatcctcctttttatcagtcaacaactaccaagtgcctacctcttgaagggggctctggcaaggtgctgtggagtaaacaaagatatgtagaagatggttccaaacggggagcttacaattcagatgaagacaaaatagaagcaattcaaaagataatcaaggatatttgtatgggaaataagccacttaagtgtagacattaagagccacaatagctcagaagaaaaattaccatggctagagtaggcaagcaagctttcatgacaggtaacactgtgcctttaagttcagagtatctccctctttggactcgtgaaacctgactttacatgtaggtgaaaagttgaatataaaatctattaggaaattctagaggagagatttagagaaactgatgaatataatcgaaccctaatttctcttttcatttttgggtactactgagttttctttactcacactccgcattcaggaatccttcttggtttatctttcgggcctcattcgcctgcttgccttttgactcaggtatcctcatttctcattccaaggtgcttccgcgctttgtcagtaccc

SEQ ID NO: 56884 - DNA, 1028 bp, Homo sapiens
taaaatgggtttttgggccttcagtgcctaaagatgatgccgcacaattctcttgcttcttttcactggagactcgtgagcgagagactacagaattgagtagcttctctctctactcgtcttttatccctagcgacttaaggatctggttagagtggcccgaatgcattcttccagggtgagggcagccgcagcacacaccagcctcagtccccagggtggtcgtcatctcgcgagaaagggttggcggggagggtatccaggacgaggagagggaggagtcgccatcgcctccgcctccgcctcctcctgttggaggggggctgagggaggagactgttgctgatctttggatgttctggttagtctaagaaggagagtatgaggcgagctccggcccgggtgcggccgggcttcaggggcccaggcgccgctgctgccaccgccatctaacgctgcgccctggaggcccggcgcgcggatggtgccggtgcggctcgggtgttgaaacgggtgtcccctccccctcctcccctcccccacgcggtggtctcccctcccacccggctcaggcagagccatgtctcggggtggctcctacccacacctgttgtgggacgtgaggaaaaggtccctcgggctggaggacccgtcccggctgcggagtcgatacctgggtgagcgggggccccggggcggaggcgctgaggtcgccgcctagagtgggggagggggcacgctgccgggtctgttggaggtgggacggcgtctcggtgggggcgcccggagactctggggtgttgggtggggccttggttgccgaattccgtgccggtgcctcccccagtcaagccccctgtgcatgctgccagccgccgcccttgctgggtttttctcggagggccgggccgtgggcagaaggtactggcttgtaaaggtgttggggtcgctgatgggttgggactcgggagacttgcggaacctccaggagctgccgcgtttagagcaaaagttagctcttttgctct

SEQ ID NO: 56885 - DNA, 1046 bp, Homo sapiens
gagaaataattcaaattgtattataacattgtatgaaatgtagctagtttagaaagagttttaattgtcacataaatatgagtttcttggattattaccatctttttgtagctggcgctgttctagtataattactcagtattttcagtcttatatttgaaagtaatttttattttttcctttttagaatgtatttaattgctcaaatactgatcattttaaaaatctgtattttaattaagtttagtattttcatattttttcttactttaattggtttataaggaaagtctacaatattgtggtagaaatcaatcaattttggagttgtatggccaactataaagaaaagagtatcttccttagaaatattgattgagtatatttattttgatttcacataggctgaatgtattagaaatatttctagtagaaatccgaaaaaaaagttaaaagaaagccgtattgtttttccgctcattgtcattcttgactgaattaggagttctgagaatggttattctaattactaatgagaaaatattttaaatataatttcacctctgctgtataactatatgtaattggtattatgttatgttttgtaggatattttaattaactgtcgacgtgctgccacgtctgttgctatttgcccaccaataccatattaccttgctgttggttgttctgacagctcagtacgaatatatgatcggcgaatgctgggcacaagagctacaggtaagaagataatattagagaaaatataggactgtcagttcaaagagtaaatctctatgacattttcagttttaaaatttcttgtttgttataaaatttcagaaaatagtatttgtttaatatggattattataaaaaataacatttcaccaagtgtttatgaccctttgggatgatacttttgcagtttaaaaagttgtaacatttgatgtattagtttggcaggactgccataacaaatgaccacaaactgggtatcttaaagcaacagaaatttattctcttaaatttctggaggctca

SEQ ID NO: 56886 - DNA, 1989 bp, Homo sapiens
tgttatcttaatttggggggaacttttggaagatgacttcgtgtgattgtatttataaatcattttccttgattaactcatttcaacaaagcatacgtaatctggaattctagacaatcatgaatttttttggtagaggtgttacctttataccatattcttttttgttttgttacaaaatctgactgcagaggaagaacctctactggaaataaacgtgatggcttttatttgtattgctacattaagtcacatgtaataattcagattaagagttttaaaaaatgtttttctttaaaacattattaattttaaataacttcttgtttcttttttagggaattatgcaggtcgagggactactggaatggttgcccgttttattccttcccatcttaataataagtcctgcagagtgacatctctgtgttacagtgaagatggtcaagagattctcgttagttactcttcagattacatatatctttttgacccgaaagatgatacagcacgagaacttaaaactccttctgcggaagagagaagagaagaggtaggtttactcaaaaccatgtcctttggccgggcgcggtggctcacgcctgtaatcccagcgctttgggaggccgaggtgggtggatcacctgcggttgggagtttgcaaccagcctgaccaacatggagaaaccccgtctttactaaaaacacaaaattagctgagcgtggtggcacatgcctgtaatcccagctactcaggagactgaggcagcagaatcgcttgaacccgggaggcggaggttgtggtgagccgaaatcacgccatcgcactccagcctgggcaacaaaagtgaaactccgtctcagaaaaaacaacaacaacaacaacaacaacaaaaaccccatgtcctttattcaattcagaaaacaattcagtgactcttggggcctaaaggccaaaaaaaaaaattaattttcaaggcacttacagttcagaaaacaaaaaacatgagacatacttgaaagaatagaagctaataaattactatcagttattactaattataattagcaattagttactaattactaatagttactaattactaattatagttagtaattagttactaataatttgtaattataattagtaatgacaaaaatagtatttttgtaatttgtgttataattaatagtaaataattactagcgtctattcttaataatgtattagtaataataaatcactaatttattattggtattctaaatactatttctaaaaccttatccctaacagtgaattattagggataaggctttagaaaaaaatattttaaattatttttaaggagaatatacttgatagcaaaatgtttatcttaactttgtagatgtacagcagcagcaagaaagatcaacagtgctaacacttgcagaaaaggcgattaaaataatagaaaatatgatgataaatttccaagagactaaatgtgtatgtccatggatcaatagaagttttacgtattaccatttactcttcatatatggacagcaatccctttctgtcccaattgtgcctctttcacagttacatactagtgatttataacagtaaccttaggtatattttacaaaataaatataagtgggaaaaagataagttaaagtagttgtatatattgaaaagtaggtgaatgaattactttcacaagactactagaagataatgaatttattatttataaaaggggaaaagtagaaataaggtatctttgacagtacacagctgtagaaaaatgtttgctttaacctgtttaagcttctttcctcaacatgtttttcactttggcttttttattttataatgtcctgtgttattcactttgaactttggcttgtaaaagtcttttgaaattaaccattgatttttattttcagtgaccttttggtattggctcaatgcctattaatacgttttaaaggtta

SEQ ID NO: 56887 - DNA, 1089 bp, Homo sapiens
aggcaagtcataaagggtcgcaatagattctgtttgggaaccgaagagtaaattgtcaataatgagtaaattgtcaataataaataaaaataatgatggttcccattgttaattaggtatgtgggtaatttaactagactatatttatcatcacaatagaaaactaaggctcaagatggttaaaaatatcttccttttgtcagctggaaggtgatacaggtgggattagaaatcacatatacatgatttcaaagttgcattcaggctctttaggttgaagatattagatataggctgtcaacatcagtggatatttatcctcagaatgaatgctttaaaagactgacgcttataccagtgtctttcatattttcatgtagatctaatttgcatactcaagaagtagggagatggaaataaatagacataaagtatgctttaagagttgagagtagatgagttttagacttacatagaatttacccgttcttattttttagttgcgacaaccaccagttaagcgtttgagacttcgtggtgattggtcagatactggacccagagcaaggccggagagtgaacgagaacgagatggtaactatactttggtcagcttttctttgtatatggtattttaaaattaatattttaacttccagtttcttcactattataaattattctgtaatgaacattcttatacatataggtatacttatgcaaatatatcttaggataaattcttagaagtggaatggcgcagtcactggataagtaccttttaattttggtagttgttatcagattagtctccaaaaaagatgtgctaatttacattcccactgaaagtataagaatgcccattaccccatagtacgttgggtattgtcagactttgcagtttttgcctttctattagatattaagagaaatgaaaactcagcccaagggttttatattagcacataaaatgttttctatcaagtgcctttgataagcataagaatcaaccctgggagctttaagatagcacacttgaaaatagaattaatctatgaattataattctatattattatgttttattaa

SEQ ID NO: 56888 - DNA, 1261 bp, Homo sapiens
gtatgtttttgttattgttgtacatctttttttttttttttttttttttttttaaagacagtctcactctgtcacccaggctggagtgcagtgcacaatctcaggtcactgcagcctccccctcctgggttcaagcaattctcctgcctcagcctcccaagtagctgggattacaggttcctgccaccacacccagcaaatttttgtatttttagtagagatggggttccccatgttggtcaggctggtcttgaactcctaacctcaagcagtccatccgcctcggcctcccaaaatgctgggattacaggcatgagccactgcacccggcctattgttgtacgtcataaatctacatgttcaaactaaaacttaatgcagcctcctacccttcctgttccgtaattggctccttcttggtccatttgcttatttgaataacctgtgagtttttcttgattccttccttttcctcaagtcccatgccagctcatcagcaagttcttttgttcctgtatctaaactataacctgggtcttttcatctcaccatcatttcttgtctcctaattaatctgcctgtacctactgttgttccattataatgtattctccatgcaggagccagaatgagtattttaacatgttaaatcagattatataactttgctgtttaaatcccttcagaagttcctaattgcatttggaaatacaactacaaaagaaaaaaaaatcaaactcctcactgtggacgtataagaatttatatggcctgcccttccctgtctctctagcctcatctcattcaattttctcagtacttgatgattgttacactctagatgtactactgatttctttcggttatcagagaatttccgtgccaaattctgccctgccctgccctgccctcccccgccccaccccgcctccaccctgcccccaccccctcccctcccccctccctccctcccttcctcccacttgcttgctttctctctctctctttctctctctcttttctttcttttcttccttcttttcttttctccttccttcctttctttctttttcttctttttagacagagtcttgcactgttgcccaggctggagtgcagtggcgtgatctcggctcactgcaagctctgcctcctgggttcacgccattctcctgcctcagcctcccaagtagctgggactacaggcgcctgccaccatgcccggctaattttttatacttttagtagagacagggtttca

SEQ ID NO: 56889 - DNA, 1052 bp, Homo sapiens
acttaaaaaattttttaaaatgacaattctaacatgaaatatttagctgaagaatatataactcacttttttagagctcttctcaataaattctgagttgtttctaaatgcataagtttttatccttttaattgaattttgttatttgattgaaattaacaaagcagcttaaatttttgtgtataaatcagatgagttaactgattgttttcaatttctgtttctttcctagtatcattttgttctatgttcattttgaaatcttttgcttatggaggactttttatttccatttggtttaattacttaaatattcctagagaaatatatgtatctaattcatcgtagttaaatagaagcatttggttgtatatgtattgtctcataatttaatgaccagtaattttttatcagtaatttgtttatagtattcctctatgagacatgtgttttgtttatatccttcttcttttttaatgtataatcaaattcttattattttctattttattactgtcttttcacctttcttttcctatttgtgtcagaatttttaaggggccctgagatagctttgcttcgtaagcgcctgcaacaactgaggcttaagaaggctgagcagcagaggcagcaagagctagctgcacatacccagcaacagccttccacttctgatcagtcttctcatgagggctcttcacaggaccctcatgcttcaggttattaatgtcaagtgtccttaagcagctgatagaattgttttttaatactgctactgtgtaataaggtgcttcccttttcccattcaaaaagagagctaatgcgcttgcagcttacccctcctttccttgcatatgggtggtattcaacatcacgtgttagggggacagattggcagcagcatctgccagagaggtgaatataaaataatcaattttaaaagttgtaatatatttggagaggggcaaatatttattacttttaaagctgatgacctctttttgaataattagtgaatttagagcctgcattgatctttctattgaaagttt

SEQ ID NO: 56890 - DNA, 1091 bp, Homo sapiens
tgtttgaagataagatttcttggagagtttatagttttcttacggctcttaaattgttaaatgagggcataatgaaatgtataacaaatccaaatggatgaaaaatatttttcacagatttttaggagagtttcccaatatttatttcactgtgagtcacatttttcttgtttttttaaagagtttaatttgttttctaaagaccaatttatctgttctttaaaaacaacatagatggtagtgttgaatccaactgtgaaatggataaatgagaaggcatcttaagaaagtaaagcacgaatagattagggaactgattgaaatgctattgttcccactttcttttttgtgtactaaagatttaactgttctgatgaaaaagtgataagtaaggataagtaaaagctgttattcaaataatgatcatgttttgtcaaaatctagtaagagaaaaatacatgaacaaactggtgatactagaagatggaagatttaaagttgattgaaatggtaccactagcaggattcagacttttaaatgtacaaatgcaagcaatcaaatcctataaaatcaatgtgaatccaggatatattggaaaactcagctatccagctaagggcaatcttaaaatacctactttttgggaaaaatatgccattatgagcagaaactggtgttggccaaaagtattttgttaacatttgctaagaactagagcacaggatattagaaactgggaattattcttattggttggggagagttgcgcttattacctatgtttctcttttactgtagccctactggaacacctattccccagtgtcttgcttaggttactagatccccaggctgattagagagtaaggagaagcttgggcctaaaaatgttgctaattactgtcagaatcaagttaagaattaaaacttactaacttctgatgagtgctctttccattttattatgctgcctgccttaataccagtgtttttcaaacagtagaaaccgcttataaagtaaattcttacatagaaacccagcatattaaaaagataagaacgaagctgttctatttgaagccaaggtaga

SEQ ID NO: 56891 - DNA, 1044 bp, Homo sapiens
acaaaaatagtacagaaacaaagtgactttaccatttgggatgtcaggtttataattcacattattttcaaatagcaattctgtaggacaggatttttcatgagttggaagttaagacagaggaattgatactaagttttgttatcagcttgactcttgtggaatacttttctactgcatttctgtatttgaagtcttgttaattgtcctctcacagaataaaggctagaagagaggttctatgagattctcccccccctttttttttttttttttgagatgaggtctcacccagactcgactcgaactcctgggcttaagggttcctcccaccactgagccccgctgagattctcttaatgtgtgctccaacatcttcaagaggaatgaaaaaagatataagtccttcattgcaatagaaagtagatccaataataaaaaaaaatcctaagtatatttgcttttatgaaattgtgattgtctttgttatttttcaagagaagtttatttttagtattaaatcagtccttgaactggtatcaaggaaaaagatatctcacagaagagttttctttctgcaagcaactggcagaaatgtgacatgtttgattatgtatccatttgtattccctatgtattttaatgtttcccaaactgttgttcatcataaaatgaaaaatatgtaaagctctgtttaattatgtctttgcatatccatgtactctttttttttggcaggtggggaaggtagctttaaatactctattaatttgtgtaggctttcttgattttgtcatttaaaaaagatttcatacattgagatagatgtgtattatagacatcatctataggctcttaaaatgaaattgctgtttccacaattaaacaaattccttgcaagattagtcaggaagagaaacggaaatataccaaaatataacaaagtatattttagaaaatatcaaagcactataaataccaccctcttctccatcaggtgcagactgtgattcctccctaaattatagatctgtgagtttgaaa

SEQ ID NO: 56892 - DNA, 1036 bp, Homo sapiens
cacttcaggtattaaatagattcactcgtaacttgtttagattctattcctttttccccctctataaaccacatatacaaccaaaacaaatacagtggatttcattgctaggtataaaaatgataaagactaattcaaactaacatttatatctcatccatttatagtatgatgaacaactatcctggccactgtgtccacaaagaggattgtgcttcactgtgtctcctcattttaactgcttaaggtccccatcttttggatttgctatctatcagtttaacagctggactatagaagcaaaagtaatttattaaaaacaagaaacaaaatacagcatcgaagggaacaggaaagtagataaacatccaatgctgcaattttataacaacaaaagcaaaataacaccttacttgtttcactgtctccttctggtggttgcactgagctctgtgggacgaaagattcctcctgaccctcagatttgcaatggctcccaattcctctagaacttgatgctatactgctcctatcatcaaaacaagataagtgattccaccaagaagttaatcaatatgatcttttaggatttttatattttacaactagaaaggtagaccaaaaaattcacaagtaaaatgtaggatttataattttaatagcatttgtaaacatcatttcaaacaaatcaagatgactatcataacacactttactcttgaaaaaaaattcaaaaatataaagggactgcttcttcactgtttggatcctttcattatctagtatgtatttctacatgtctctctattgaattttaagtgaactacattgtctcctttcttgtcttcactacagatggttcaccatatccaaaaccttaatggttatacagatttttatcatatgcccttctagactctgttattccaggctactttaaaattagtatttgaacaaaagcctggccagttctttggtcttttgaactgctccctgtggatcacttccagttctgatctgctgttcaaacatggca

SEQ ID NO: 56893 - DNA, 1075 bp, Homo sapiens
aaagcttaaagaggtttcttgctgcaagtcttctcagaggctttattacgctacaggttcttgtgaatctcacaaagaggtatacacaatgtagtatttcccaaattttgtgaccacattgtagagtatcagaacactttggacaacagtgaccttcatcttcttattctgtaattaaattattccattcaaaaataaattgagtgtgaatttattattaaaaacttaagcctgggcccctccccgccccgcctcccggcgcgggtggccgaggcgtagcgctgcgacccccgcacccctgcgaacatggcgctgcgagtggtgcggagcgtgcgggccctgctctgcaccctgcgcgcggtcccgtcacccgccgcgccctgcccgccgaggccctggcagctgggggtgggcgccgtccgtacgctacgcactggacccgctctgctctcggtgcgtaaattcacagagaaacacgaatgggtaacaacagaaaatggcattggaacagtgggaatcagcaattttgcacaggaagcgttgggagatgttgtttattgtagtctccctgaagttgggacaaaattgaacaaacaagatgagtttggtgctttggaaagtgtgaaagctgctagtgaactctattctcctttatcaggagaagtaactgaaattaatgaagctcttgcagaaaatccaggacttgtaaacaaatcttgttatgaagatggttggctgatcaagatgacactgagtaacccttcagaactagatgaacttatgagtgaagaagcatatgagaaatacataaaatctattgaggagtgaaaatggaactcctaaataaactagtatgaaataacgcaagccagcagagttgtcttaaattagtggtggatagaagacttagaatagaaacttttagtattaccgatggggaaaaaaaaactactgttaacactgctaatgaaagaaaatgccctttaactttctaatgattatagataaatataatatgcgtctttttcacaatatcctatgatttttagactaggctctagtgttcagaattcat

SEQ ID NO: 56894 - DNA, 2030 bp, Homo sapiens
gaagctagacataaaaaaaatgtattattccacttaattaaagttcacaagcaggcaaaattaattcatgatatcagaagtcagaataatggtttcctttaaagggacagtaatgatggaaatggggtacttaggagacttcaggaattctggttatactgtttctaaattctggtgctgattatatgggcctgttttgtttgcaaaaattcattgagctttttaccttaggattttcaactttcccgtatatgtgttatatttagtaaaaagtttacaatatcttttttatgtgtaaaaaccgctttcaaactcctctcagtaatgcctgttttcctgaactcttaccattctgatatacataaaagtcttttccatctaataaacataaaaagatcagttttttgtttttatcctattattagtgagactgagcatcttttatatatttgttaactgttatgagatctgtttttcttactgatttgtaacctttttaaagattatggacgtctggtctgttatatgtcaaaatataatattttaaataaattcaaactgacaaaattattaagtaatatgtgttaggagagaagttttattttaatagttaaatcagtttttaagagtcctttgttcttcaatcccagttctgtcaccaaatcatttcttaagagagtaaaatctgcttcattagttctaaattcgtaatatggagtccataaagaagatgctatttgaaggcccttgttttattgcttatatattaatattcttttttttttttttttgagacagagtctcgctctgtcacccaggctggagtgcagtggcgcgatctcggctcactgcaagctccgcctcccgggttcatgccattctcctgcctcagcctcccgagtagctgggactataggcgcccgctgccaaacctggctgattttttgtatttttagtagagatggggtttcattattctttttacctaaagtagtctgtttttggaacatctttaaaccacattttaaataaaatatcaaaatagaagtctatccactgctattatatattacctttagtttcttttcatttctctttatgtgttttcttaatatggagaagaggggaaagaacattggataaaatttgttatatttgtagtaaaattgcacatgaattttgtctgtattatgtttttataaaatagccctttaaaaaccagtttgccgcatgctattgcctttacttttcatccagtaccaaatttctaagtgatctcttaactaaaatactttgttgtagtaactcaactagtctgacttctcactgttgtgtctgcgtttttatgcttttggttgggggtgccttattgagatagtgtgtttatgtatttcctagacttactatattttcataagtttctcattattctttgtgaatatttttatttatttttgtttttttaatatgtaattcatatagacgctctgctgttgcccgtattcaggagttcttcagacggagaaaagaaaggaaagaaatggaagaattggatactttgaacattagaaggccgctagtaaaaatggtttataaaggccatcgcaactccaggacaatggtaccaaatgttcatggcattttttggtgaaattgcagtttcatgctctgagtgtttttccataatgatttatcttcatatattgccaatgggatttcagtattacattattaaatcttcagttatctctttatccaacatggttcttttagccctataatatattgtgaaagatcattattttttacaagaaaactctactaaaaaaatgcagattaaaaaaatttttagtttatacaagtaatcattgcttttgtttttttttttttttccccctctctttctcacatttgctgtctacctgaaaagtttctggtggattttttttttttttttttttagcttgtattagcattctttgttagttttggagagaaggatttggatctataaaatctaagttgattgc

SEQ ID NO: 56895 - DNA, 1020 bp, Homo sapiens
ttcttgttaacccttgcccaaaaatttattttccaagactactctgcctcagtcaaggtaacatcttttcaagggattcaagtggcccatggataataatttaactgtatttcgtcactaaagttatcagttctcctatagggaaaacaaggagccaacaaagtaaatggctctgagaagcaaattgcaagtaaaagctaaattaaattcttaaatgttttaagtagcctcaaaatttgacctttgtttttctgccatttgaaagagttgtgttctttgaccttcctcctttaaatacaagttacagtgattatttggcattgaatagacttaaggcagaaatatagacatcagacgcataaagaatgaagtaattcctcctggtactggctgattgtttacggtttgcctgatcttcaaggaaaaaatacagttactttatgatctttgatacgatttttaacttgccttgtaggttataactcgaaacgaactcatgctggaagaaactagaaacaccattacagttccagcctctttcatgttgaggatgttggcttcacttaatcatatccgagctggtaggaactttaagtatactactaaaaccatttttatatttgaaaatatattattatttaagatctgctttaaaggggtttatatatattttttaatatcacaaaatgagggtagcttaacttctaaactaggatttctgtgaatgcttgatcttggcacagtaacttagttcctcatgaactacatttgtcgtaaaatggtcaaaatgaaaagaccagagtcacgtaaaaactcttatcagctgctgttttcttagagtacataaccttaggatatattatcgtgcatattctttaatggtaggtttgttgaaaatcagtcatagcccaaacagaaataaatgtgacatgctaagaaatgaaacatacctcagtttgctttttgaatatttttttgttttagataaactgtgaggtgcagtgccacagatacataaaa

SEQ ID NO: 56896 - DNA, 1950 bp, Homo sapiens
acttggacaattaaacaattaaaagggacatatagtcccttcagtgtactgttcttggtgctgttgacctaggatccagtgggagcatttaatcctgtgtagataataaataaaatctcaggattcagtcttctcttgctgttgacagtgggactgaactgttttccttatgcttaaccttaatattttccatgttactatgtggaaatgtttctggggcagaaacatcctagttccatctcagtgatggtagtgattttatgctgttgccttcttcacaatacccttatgtaatgtatcttaccttcataaaacttatattcatttattcagtaaaccttcattgaacatcctatactaggctctgaggatataaagataaaaagaagtaactcctgccctccaggaactctcaatctggtctgcaggaagacatgcaaacgactattactgtaattaggatcatcattatgaagttcatataagatattctagaatgtggaggagggagttcataattctgcagatagcctgtttggaaatgtccaggaaaagtttcaccaagggtataatagttgtattgagatgagtaaacctttatagctaaagaattgggcaaaagtatcccaagcagaggaatagcaagtgtaattcctgaaaacttgaacgagcatactgtactcaccagtttgtaagtttatattcacttgagtatttaacctaaataagctccttgagaccagaaatttacatctgttttggtcaccattgtattctcaggttttatcacaatgcctggaacatagtatttaatttaaaaaaatctttttacaaacagaattacacaaatcctcaacaatcgtccacatattttctctcacacagctgcctcctcactcccctttgcagcacctgatgtacctccttagaaacctagactccaaagaacactgtttgacaaccactgcagtagaacataatatatcaagattttaggagtgggtttcttttttcatttttacatgttttagaataacatgcataatcaaagctaataatactgtgttttctttactcttttatttgcctctaaagacatccacacatagtggtgaactgatttttaatgcgttttaaataaaaggcattgaaaaatattaataattgtaattactaaaagtatttctctttgcgattctcttatctgtgtttccagaccggttggagggtgacagatcagaaggctctggtcaagagaatgaaaatgaggatgaggaataataaactctttttggcaagcacttaaatgttctgaaatttgtataagacatttattatatttttttctttacagagctttagtgcaattttaaggttatggtttttggagtttttccctttttttgggataacctaacattggtttggaatgattgtgtgcatgaatttgggagattgtataaaacaaaactagcagaatgtttttaaaactttttgccgtgtatgaggagtgctagaaaatgcaaagtgcaatattttccctaaccttcaaatgtgggagcttggatcaatgttgaagaataattttcatcatagtgaaaatgttggttcaaataaatttctacacttgccatttgcatgtttgttgctttctaattaaagaaactggttgttttaagataccctgaatttgactttttatttaatgccttgctactttgacccacagttttccaatctctcctgtagcatacgatgactatttttctatattttctagatttaacaaccttttccttttttgcttgtgtgggatagaatcacatagaaggacttccttcatttctccttccacggtacagctgacccttgagcaacccaggggttagtggcaccagcccccctcacagttgaagattcatgtgtaactgttgacttcccaaaaatttg

SEQ ID NO: 56897 - DNA, 1029 bp, Homo sapiens
tcttaatatcttctctttacagatgaggaaactgaggctagattagatactttttccaagatttcccaggtaggaagtcagggagtcagcttttggtctaggaatggaactttgaaacccacgcccttaactgcggtttgtctccctccccggggtggtggagcagcagcaggcttgtccccaaggtagtccccaggcctggctcctcagctgacttttttttctgccttctccctcagaagctgccaagaactcgattcttcatgtgaaagctgaagtacacaagtccttggacagttacgcagcaagcttggccaaagccattgaggccgaagccaaaatcaacttatttggggaggaggctttgccaggggtcttggttacagcacggactgtcccggggggcggcttcgggggccgccgaggcagcagaactcttgtgagccagaggctgcagttgcagagcatcgaagaaggagatgttttagctgccgagcagagatgagggcctcagggtgccgtggggctgcagcctgagaggctggcccggggaggagttcccatcaccgcctgtgccgcggccttgggagcatgtcactgtgtacagctggccacacacagggaaggagcagcatctggtatgcagccaccaggacaaggactgaaaataatgtctacagtccacagcttcagcatttccagagaccacatgtgagcttcttttaggtcccagtgatgggaccagaagcatctaaagcaaaaaaaaaaccaaaaaaaaatctagagatgtggctgtggctttttgggaggtggggcatgggaggaccagagacgaagggcttggaaggagacccccacatgcatcatttcctcctcttcacagtgtgctgggagtccagccgtgcactgtgccagatgcctcaggaggagaaccctccccagtgtactgtgaaggatgacacagcacttcttcctaatgacacgcgaccgtcctggtgcctctacatggttgatgcgggcagtgtggga

SEQ ID NO: 56898 - DNA, 1040 bp, Homo sapiens
gtagtccttcaacatcattctggttcttaatgatccctctgaaaattgatgtaaatggatgattctgctgtcagcagcagcagaattgatctggcccaatgcataatccctcaggacctctgtaggtatcttaagactggccacacccccaaatatgagtgggctgtggtgtgatgacttggaaacaggactgttcgagctctgtgtcttgccagtgttgagctcttctctgttaaagagctctgcagagctgtggaacacgatgcagtctatataacttgtctggggagacttgggagaaggtgctgcttttagaaacatccaacccagtcatgggagcccctgacgcaggaaggcagcggttttctctctccgctgacttctctctcttgcctccctccatcccttttctagctactatgctgtcctgtaccccatggtgtaccccatgaagatcacagggaaccgggctgtgatggcacttgtctacatctggcttcactcgctcatcggctgcctgccacccctgtttggttggtcatccgtggagtttgacgagttcaaatggatgtgtgtggctgcttggcaccgggagcctggctacacggccttctggcagatctggtgtgccctcttcccctttctggtcatgctggtgtgctatggcttcatcttccgcgtggccagggtcaaggcacgcaaggtgcactgtggcacagtcgtcatcgtggaggaggatgctcagaggaccgggaggaagaactccagcacctccacctcctcttcaggcagcaggaggaatgcctttcagggtgtggtctactcggccaaccagtgcaaagccctcatcaccatcctggtggtcctcggtgccttcatggtcacctggggcccctacatggttgtcatcgcctctgaggccctctgggggaaaagctccgtctccccgagcctggagacttgggccacatggctgtcctttgccagcgctgtctgccaccccctgatctatggactctggaacaagacagttcgcaaag

SEQ ID NO: 56899 - DNA, 1661 bp, Homo sapiens
gcggctgggccggggcctgagctgccgcggcggccgctcctcggtgagcacccggcgtggggcgcgggcgcgggcccgggcggagagggcggtccggatggagccaggctaaactcattgtgcgaggctgagggctcagggcgcgggccgggaagggtccccgcccccacggcgctccctttctccccgcgcccctctcggaggtcagggctgtcctccgcccgcactgcgccttgctttggagagctggagctctttgtgggaagatgttgggggcgcgcccctcccctgcggcctggggcttctgagaggcccaccccattctgctgggtgcagcccgccccgtttctccggcgccgcccgaagcccctaaacagtccgctggatgggagggcgtaggtgcgtgcccgggactctgccgatgcgggccgcgccccctggggccaagagactccacgtcccgctcagggcaaagggtgtggggagaagcggtcacgcccctcggctggaatccgtgaggaccaggtgagcagccttctcccagccgggactcagggcgctgtctccccgagcctgggcgggcggcgggtggcgcgcccagaagtggcccggcgccgccggatgggcggctctgcccctcagatctgcgggagggagattcggctggttcttggaaaggggagaactcgaccagccctcggcgccttctgggccaagcttaacccccgtgcaacctttggacaaaggcatatgggatgagaacgtctgttgggtaagtggggtgtgtcctgtgcttcccggaggtctgctcaccagtaaccacatagctgcgcattggcatcgctttatatcacatcttggaggctatttttgcttgttattgtactttcatcccttttgcaaagtgctttcatagagcaggtcatttgatccacctcccggtgaagccgtgaggaggtgtgtggttttggagggaaagaacctcagttccttgattgtccaatggagacaccgataacctccggtgagcctgtctcagcgtcctaggggctgggggaggatggccatccttgtggctcctccgtggagccaggcgtggattcagcctggcttcttctcccctagtgacctggacctccagatgagttctggagagctactgcttcggggaataggcggttttcccttataatctattttactgcagccactgggagcaagtgaagagaggcatttttcaggccctcagggcagaaagaggaggtgggagggacctcaggtcatagagacagaggctcttcaactgtaactggaatgcatggcacccatttctgttacttctttcagagcacctctcttccggtcctcctccacacccgtcttattttatacttgtcaggtgcttacaagcactttcatgtacactttttcattcacacaacaaccttgtgaagctctactagcccatttgataggtgaggaaactgaggctcaggagagatgaagcattcttgcccagctaggtaagcagcccagattgaactcagatcttttgccttggtagtgcttttcacgtggtttcctgatggcacacaggtgagttctttaactcagggcttctccctgccctgtagctccactgccataacatcaagaataga

SEQ ID NO: 56900 - DNA, 1054 bp, Homo sapiens
caagacccacatcatgaagtcggcggatgtggagaagtgaggcttcggggcacggggtctgggcgctggccggttgctggcccagggcgggaggcagggcgaactctgtgcagcccctccccttttccctgaggcggaggttcggtccctccggaccggacctttgattgacaacttcgataaataatccagtcacacttccgggccctttggttggggatcgccaggcgctgctttcgtcaactgtcaatccgcctgggtttgagtagagtgtgactgttctggtggactttcccctcaccaaacgtctcctcctgcctcagcctgcaccacctttctttctgggtggctgttgcctgttttcttaggggttaatgacggggatgatttataagtttggtttctgtcacgtcaggtgctgtgcccggcgcttgagataggaaatgtaaaagacaacgtgcgcctcaattcacagtctcgtgagagagacagacaattatattacagcgtgaataaatgtaatgaagatgtatacacggagtgatgtgaggtcttttaggggctcgaaccatctgggaaattgggatgcctgaactgaatctttataaaaccgttgcggggggcggtggataggtacatgccatcaggtcaggcagagtgagttgtgatgcgtttttgatgcctgggctgaatcttgacaaaatttaggggaatcaggggacgcatgtaaagctgggggctcagggagagtgaaagctgtgatgtgtttaaagagctgtgtccgtgtgattggagcgtgaggtaccatagggggtgttgtgagagatgagaggtaggccccaggggaatcaagatactgagggaatttttatgcctggctaaggagttttcaattttatctgacaaccactgggtgtaattttatccaaaggagctgcattatcagatgtacgctctgaaagatttctctggaggccatgttgaggctggattgcaggtccgcagggatgggaaggagaccagttagtaagagaaaagataggttttagaagat

SEQ ID NO: 56901 - DNA, 1748 bp, Homo sapiens
aagtcatttcaggttcatactcagggcagacagggcataaacctactttgtctaaccagaagttctttttgctcatatatttgttcatctataaacttgtgagctacaagctagcaggttctgtctaaatcatgtaatacattaccaaggcccgaaacacattttaatgtttcttgatagtgataatgataacaacaaggccgtctgccgttgccaccaactacacttttaaaaataaatttttccactaatgccgtcttttattttctactgataagtcaacaagcaaaaccccctcacattaggttctgaggaatgccacaacagaaaacaaggacgataaaaatagttgcaaaaaataacccgttactagaaagttctaatgctcagactgtccaagacaatcaatgactcatgaaagaaaaaagtaagatttacctttaacttaagagattctccaagtaaggttcccttataatctgttgtataggtccaatcatatggtttaataacctctttggagtgttcaccctccgtcctcaaataccaaaatgagaaggatcagattcagtgatgcagaatagagattatctgtatttatatatcacatcaaattatattctataataacatatcctattaaatatatacacttgttataattcaccagtacaaggtttttcttacagtttttctgcatttattatttaacttgtcatgtactgatgtagtcttttcaattagtctgtatacagcctgaggacatggtttaaaggtttatacttatttgtatcatctaaggtacttagtacatattaggcacaaagtaaataattgctgatttgactatcaaagaaaaacatgttgtcttaatttcaatgcttctcaaatagggtatttattaagcatatcataagtaaacattttttcttaaaaacaggaacattaagtatagcctactgcctcttcagtaaggaacactgaaaaatcgaaaacgtacatagctcagctcagttgtaattcactttaacaagtattcaagcagtggggtaattaacttccatttttatgtctgagaaaaacgaattctagaatgatacaactctcaagtttaataataccagcccttcattctaacaacacacacgtatcattactgaatattttttcaagtcttttctcttttgtttaacctaattaccttttttgtttaacctaattgaccggattctcacctgctttcttgccactcttcagcacaggccactttaagcattccttggtagttgtttacacatcttaacgcatctgtagcattgaactcaattccaaagccagacccatgctggattcttaaaacgttgtctccaaacatcatttcagggagagatggcatatgtaattcatcggctaatctatacgtaaccaaaagtcgggtgagataattttatatcgctgttggcatttttgtttcttttccatcccaacagaattcttcctacttgctgaatgagttacacagcacatgatttaatcaatatgatatatttgcaaggtctataaaatgctttcatcatccattctttcatcatcatatggcactgtactaagtagtgggctaaataagataaatatacaaatacgtaatataatagcttattatactactataatatatagcacacagatattactataatatatatcatgagggtatgaagaaaagatagcaaagcaattaaagatac

SEQ ID NO: 56902 - DNA, 1004 bp, Homo sapiens
tgttccttactgaagaggcagtaggctatacttaatgttcctgtttttaagaaaaaatgtttacttatgatatgcttaataaataccctatttgagaagcattgaaattaagacaacatgtttttctttgatagtcaaatcagcaattatttactttgtgcctaatatgtactaagtaccttagatgatacaaataagtataaacctttaaaccatgtcctcaggctgtatacagactaattgaaaagactacatcagtacatgacaagttaaataataaatgcagaaaaactgtaagaaaaaccttgtactggtgaattataacaagtgtatatatttaataggatatgttattatagaatataatttgatgtgatatataaatacagataatctctattctgcatcactgaatctgatccttctcattttggtatttgaggacggagggtgaacactccaaagaggttattaaaccatatgattggacctatacaacagattataagggaaccttacttggagaatctcttaagttaaaggtaaatcttacttttttctttcatgagtcattgattgtcttggacagtctgagcattagaactttctagtaacgggttattttttgcaactatttttatcgtccttgttttctgttgtggcattcctcagaacctaatgtgagggggttttgcttgttgacttatcagtagaaaataaaagacggcattagtggaaaaatttatttttaaaagtgtagttggtggcaacggcagacggccttgttgttatcattatcactatcaagaaacattaaaatgtgtttcgggccttggtaatgtattacatgatttagacagaacctgctagcttgtagctcacaagtttatagatgaacaaatatatgagcaaaaagaacttctggttagacaaagtaggtttatgccctgtctgccctgagtatgaacctgaaatgactttaggaagttacttaatttgagtct

SEQ ID NO: 56903 - DNA, 2291 bp, Homo sapiens
ataaaggaagcagtttgtgagaagctaatatttccagaaagaattgatcctaacccagcagactcacaaaaaagtacacaagtggaataaaatgtgatacaacatatactcactatggaatctgactggacaccttggctatttgtaaggggttatttttattatgagaattaattgccttgtttatgtacagattttctgtagccttaaaggaaaaaaaaataaagatcgttacaggcaggtttcactcaactgctgtttgtactgtctgtcttcacattcatattccagatttatattttctggagttaaatttggatgatttctaaattatcacaaagtgggacctcagcagtagtgatgtgtgtgtctcatgagcagtgagcacagtctgcattcatcatgaaacactatcttctaccaggaggaggttaatgtaaatcaccaaatcccaatgccttgtgactttcataggattcctgatcatgcatgttgatgtactggctcttcactttgggctttctgatgtttattcacacctttggagagttgcaacttgccacatacgaaattagtctcatagtgtagtgaacttcaaccccaaaattttaaaaatgtatttccccccagttttaaattgcctttgaaatttaaaaaaaaaaaatttagacttagtaccagaaccaaaaatacctagatttttggagaacttattacatacatagaaacatgaatatggtttaccactgtgtgtgtgtaggatgttagaattatctgtcctccatctttaggtgctttttcttaaatgtggttctacttatactgatatttttaatttccatcttccatgcaacctcagagtgaataaaccccttaaatttggtgctggttcgaaaaagtctaaagggtttattaggggttgtttttcgcaaatattacatcaatccttaaagcaacaagattaattttctgcttaaaatatttgggaagataggtaaggaggagggggttttaaaatataaaagcaagtttttctattttaaggtgcatatttgtaacattacaggggatgaagtaaaatgtaattaattagcacaagacttagggagtacagaaaatacacagaagtaaatttcaaatccatttgattgttttcatagtgaccccttagtcattttatattcttgtctgcctttctagaaaaatggttgtcataaagtggaaagtgattaaaaagcatcaaataagaaattatttcaagtggatttttaaaaatatttttttgaagggcagggggaaaattcaccccttttctgatttgaaatatgttgtacatatttccatttgatggataaatcattaagtaagaatatttgatttaaagtattagccaacctcttcaggtattagcctgaagataaattttaacaaaacatatacacttgggtatccgtcattgctcaaactctatagtgtattgctggagccaataggcagggtatattttattagctaaatttgatatttgtcttctgccttctgtatcacctccaagctataggaaatcaggattttgttggctttaagaaaacacatggtatgttcactgtatattaaatatacctgtatttaatgttttctcttaggacagaaaagtagacacacacacacacacacacacacatgttgtgttcagctttctgttttatattatttgccattgagattagaatagaacaggctctattcatgcaaactatatgaaatgaaaaacttttaagactcttcattaattggagcttctgggcaacatcgtgtgtgtgtgtgtgtgtgtgtgtgtgtgtgtgtgtatacagacattttttttttaacttgttgattcagatgtcttggtccctgaatagtcctagattacttattttgagaattcattgttaaaaattacagggaattaaaataattgccttttttttttttagagggtaagagatgggtagaagagtatgcctctgaaaattttattagtttattcttgtggagaataccaagaaaatgtgtatttgcccattgctaaatatgatatatgccattttgtatttatttgtcccaagtgtctttttgtaagaggagaataaacaataaggaattactgatcaaagttttactatttcatttatttgagtttttcttagagcttaattaaagaagtgtggtttggggtatacttttcttatttgtgctttatgttttgaactcagtcaacactgtagacagtctccaggcaggttata

SEQ ID NO: 56904 - DNA, 1021 bp, Homo sapiens
aaggccttgagtgattaaaaagaaaatcttttcctgtgtaggcacgatcgcaatatggatgaaccacagcctttgttcccgtctgcacaaggcttctcccccgtctttgtgtctccggagccttgcacgtggtaggtgctcggcattcgttgactggatcaagtagggcgagggagcgcggcccgttccggtttgaaactgctctggacgccgaattagtgtttggcagcgcctggtggtcttcaatcccagcccctccggcccgccgcgccccccgggaccaaaacaagcggaggcgagcgcgggcgcgcggggcatgccgggagccccccggtgggcaggtgcctgggcggggcgcgccgcggttggcgcctgggcggctgggcggctgcctagcacccggaagagccgtcaacttagcgagcgcaacaggctgccgctgaggagctggagctggtggggactgggccgcaatggacaagctgaagaaggtgctgagcgggcaggacacggaggaccggagcggcctgtccgaggtgagtgagcccggggccgtcggccccctctcgccgcgctcccgccctgcgtcccctgcccgggcctgggaagcctgcggggactccctggagtttctggacggtagctctgccccttctcctcctcttcttctgcagggctccgcgaagaggtctggcactacacggggcagtggccgcggcgtccttttctgccccgcgccccttcagcccatcctccctgacaagggggcggcgcaggaggaaatccccggactgagctgcgagtgggagggtgggcgactgggctgtcggccccggccccaccggccggggaatgcgctttagggccgggtagggctgggggccccgaggtccaggcggaaggagcctttgctgggtgggtcggggccccagacccggactggggtgttggggtggcggtccctacctcgcgacggggctggtggccgcgccccgagctctgccttggttttctgtccggt

SEQ ID NO: 56905 - DNA, 1145 bp, Homo sapiens
ctgtagttctttcaaagtttatcaagggatggtatctgccagaacagtttcagtatagatgtgactcacctatttttgaaaaaaatgtttgctacagtgtaaagaaaggaggattgtggacattttaaagttctgaagaattggttaactcctatttggtagaaatgaatcttgagactgtaagcttaactcccatccctccctttagcaattttggacttttgaataaatatagttacaaattgccttttggaatttactgtgttgacaagtaattgagcttctgtacatgttaagtataagatatggagaaggatgctggtgtttgtgtttatgtgtgtgtgtgtgtgtatgttttttttttttttaaatgacatgcacatttgagtggtagactgtttatattttgatttttcttccagggcagaaattggtacctatatacacacaccttgctttgcttatagactgattttgaatccagtttcagaggttcagcattcatatgggtccagctgaatggtgatattcccttcaacactcatgtgttctgactgtgtttgcttttctaagggctaacttacagtctgcctgacacacagtgcctggttctttagcattatggagcctgttccttgtatatggtttccttctaagtgacagggctgagctaactggaatttaccaagatacctttggacgtactacattttcactcatagagtagttggtagcatttttttcttcttcttttttattctcttttctcttcttttaaaattaataggagcagagcagaaaatttatcccaattaggtagaagttaaattctgtttagaatttataaaatgttaggagttcaactgtgccaggtatgggtggctcacactgtaatgccaagactttgggaggctgaggtgggaggattgcttgaagccaggagtttgagactagcctggacagtgtagcaagaccgggtctctgcaaaaaaacaaacaaacaaacaaaaaaaaacattaaaaaattagccgggcatggtggcacatacttgtagtcccagcaattctggaggctgaggcagggggattgcttgagcttcctagacttgagcctagaaattcaaggctgcagtgagctatgattga

SEQ ID NO: 56906 - DNA, 1446 bp, Homo sapiens
acctgtgataaggccattatagcatattaataagtgctcaggacccatagtgagctcccttctgctgcctgcttagaatgaagaaaggtcccagttaatatttgatttaatgctgtcagtgcattctgtgattttgaccgatattaaagtgcagcaatcctgactgatttcttagtttctgacagtctatgttatctttttctctgattatgatggctaatcccataatcagactgtcgggtaagtggggacatcccctcttacagatgaggaatttgaaactcaaacaggacaaggaactttcccaggatagtactactaataaatgttgaagctgcagtttgatgctgtgaaggtctgatctttcagtctaggtgctttctactctgcagcttccactctgggtgccctctaaaggagtgcctttggggtgatgacgttccactcatctttgtgtcttttctttcctagggatgctgtgaagaagtgttttgccgtgtgtcttgcataattcatggccagttttatgaagctttggaaggcactatggacagaagctggtggacagttttgtaactatcttcgaaacctctgtcttacagacatgtgccttttatcttgcagcaatgtgttgcttgtgattcgaacatttgagggttacttttggaagcaacaatacattctcgaacctgaatgtcagtagcacaggatgagaagtgggttctgtatcttgtggagtggaatcttcctcatgtacctgtttcctctctggatgttgtcccactgaattcccatgaatacaaacctattcagcaacagcacataagccttgggtgcaagtgattcccaggtggcaaaaggcagccccatcagagatcacgggagcaacagtaagggacagagttttggggtccacttgtccctcagcatggaagccatcaccgtggtcctgcatagagtgagtctgcttctactctggcatctgagaacaagtgactctgctttagacaagcccctggagagcctggccatggagtgaggtagaaaagaagcactttttggtggtatatgctgtttctgaatttgaatctaagcattcttggtgttctgattctgcgcctgactgtggaatgtattttctgacattaggtgcagactctttttctcttgggttttatttcccatccctccctccctctccctgcatatctttctttatgacctcctggcactagatggggaaagaacagagcagcagcagaaaatgctgctgttttttttttggacgagagcccataggagttgaaaaatcctgctgctctcagctatatttttttctccattatttataaatgtttgcttttaaactgattttattttccattctcccctggagttgggccaggggagagtggggtgggaagacagatccctgctgtgcagcca

SEQ ID NO: 56907 - DNA, 1052 bp, Homo sapiens
actgcaggctcagggagcaagaaataaaatcatgaaatgcattccaaataaaattaccttttggctgggtgcagtggctcacacctgtaatctgagcactttgggaggctgaggtgggtggatcgcttgaggtcaggagttcaagaccagcctggccaacatggcaaaaccccatctctacaaaaaatacaacagcaaaaaaatcagccaggctagctggtgtgcgcctataatcccagctacttgggagggaggctgaggcacaagaattgcttgaacccaggaggtggaagttcagtgagccgagatcgcacccctgcactccagcctgagcaacagagtgagactctgtctcaaaaataaataaaaaaaaaaatcactttttgatacttctgttaaaatagataataaggaaccatatcttaaagtgtggaggatctggcttggcttctgtttttgatagctctatgaaagtgacagatttgcatcatgagacttagtggaatgaattgggaaattgaagggcagcccagtggctatggattctattttctatgggactgtctacgccaggctttattttctctttgctcagataacttctgactagagtcgacggtaggattataaatggtttaaaatacgtattctcaaacctcattttcagcatataaatttttaagaatcagtgtttaaaggtacgtgaaaccatttgctagatttttgtcctagttttttttttttaatttaaaaatcttaagttttttttagtaagcttaagatgtccagtagtttatttgcagacagcatttttaaaaagtgaatagatgtttaactgaagttaaatacaaatttatgtctgtgtaactcttggtaagatataacaaaacctagacatctaaattttttggaaatttttattttaaaagtttgttgggaggtaaaattgtgtgactttaccttctggttaatagttttatagttaagaagaaagtccagcgaagtttacttgatctcagttgcactcaagaataggggatttagttccactt

SEQ ID NO: 56908 - DNA, 1028 bp, Homo sapiens
ttctaaagaaatttttttaaagaaggagggtggtagatgtcaaagacacaagagctctttgtaggtgctgactagcttactttgtccccaggttcatcttagagctcaagcagattcaagacatgaggcagagatgctagacttgtgtcaggggcaaaaacttctgataatagctcttggtgacatcaatcgtcagctcctgagtgcactccacgagctctcctgagaagcatcctgggcagcctgagaagacagtgaatggtgggaccacagtttctggaggtaatgctgtgttgtcaagaattttgcagcagtctttcaacaaacaccggcacccaatcacgcagttcttgccaacatgaatgcaagaaccaatctgagctgcgttgaccacacactcttcctcaataaagacatggtccccaatatgtaaaggaaagaattcaacacctttgctgaatttcttgaatggtggccttatgacactacaacttttcacaacacaatggagtccatctcttatgttttccagatcccctcagataatacagtcattcaccacatggtcttgcgattgagaagtatgttctggcttccacacaacactgactggagactgactttgttcccagatgccgtcttgatatactcagacttgttgtagagcagctcacctaactccatggtcaccgcctccttccttcagccccggatcctgtcagagtcagtcagtcagtctttctgagattccggctacttctgccattccaatatttctatctggccatgtcctttctctgctgaaacccttaaatgaggccacaaaggccaggggctgtgctaaaaagcatggtctctgaagctggactacctggtttcaatcctgactctcatttctagcacaggtttctcatctgtaaaaggggaataataatagccccagtctcttagagttgctttaaaaactgattgaggttagtagtaggcttaggacaatatctgggatagagtagacatctgtaaacact

SEQ ID NO: 56909 - DNA, 1024 bp, Homo sapiens
taacaacagcttagtttgtcctattaagtttgacttttgtataatatattttcttaaagaagacaaaactgtggagaaaactgtgcttaatgaagtacaagcaatatgaagaaaatattgaaaaacttgattaaacttgattaatatctttttttattttgggttttttttttttttttttttttttttttttttttttttttgggagacagagtctcattctctcacccaggagggagtgcagtcgtgcaatctcagctcactgcaacctttgcctcctgggtcaagagattctcccacctcagcttcctgagtagctgggactacaggcacacaccaccacacccagctaactcttttttccttttgcatttttagtagagacagggtttccccatgttgcccaggctggtctcaaacttctgacctcaagtgatctgcccacctaagcctcccaaagtgctcggattacaaacatgagacactatgtccagcctgaaaaacttgattaacatcttaggaaggtgatataattcttttgtcatagaattttgtcagagaaaggcagagcaatgggtgtagaacagaaaagttttctaccaagttatcacagaatcaatctcttcagtctctcccagattccagacagctggccaaatattaccaaattaattgtgctaacacactggttttcatcttattgctcccctactcaagaattcccaggggtccctaattatccatgtggaatgctccagttccacagcctggcctttaagtgtcttactttaccataccccgccactccccttctctgcctgggccctgcctctctctgtaatgtgcattatccactccaccccagctttattgtctcctgatcagtgtgcacttctctcctaccacaaacatttgctcacctgtttgttttttcctctactgtttcacctattttattcctacatacccccattaattttcttccttttgcatgtctacattgtcttcgttttctgcaatattt

SEQ ID NO: 56910 - DNA, 1051 bp, Homo sapiens
gccaaagctgtgctaagggccactccgatccggcctttggaggagccctgtcttagagctgctcagagcctttgtgaatgagatgctgaggagcatctggaattccccagcacccctgagtgtggaccttggctggttgctctcaacctggctacagtaaagaaaggaaaaaaaaatgattttaaaagaaaatacccatgatatatgcaacaacacagatggatctcaaaaataattatgtcaagtaaaaaaaaaggcagatttttttaatgagtacatactcatgattacattaaggtaaaactcgagaaaatgcaaattaacctatagtgtcagagagcagatcactggttgctggggggtgtgaggtcagaggaaaggattacaaagggacacaaaactttggaaagttttgggtgtgatggatatgtttactatcttgattatggtaatgctttcatgggggttatatatatcaaacttaccaaactgtatactttaaatatgtgcaatttcttgtatgtcaattataccataatgaaaaagatccctatataaacctcactcccagagattctgattcagttggtccagggtgggatcttggcatgaaaatatttaaaaatctcctgaaatcacagcccaggtgccaagggatgtgcctgtagtctcagctacttgggaggctgatgtggaaggatcacttgagcccaggagttcaagactagcctggacaacacagtgagatcccattgctatgaaaaaaaaaattcaccaaataattaagaatgtgcagccagggttaaggtatagaatcttgcacgccacagtaatgactttgttaatgatctgcaataagattgaaagccagttaacattgcaagaaattcaaatcaaaacttccctgccagccccagtgccttttgagaatatgggccccttataggcaagcagttacaaatgaaacttttatgaactctgatcaagagtctgcaggaccatttctacaatgaagtatatcatacagttccgaaataagtggaagtttacg

SEQ ID NO: 56911 - DNA, 1034 bp, Homo sapiens
ggaccttgaagtgtaaggtctcaagtgctgtgatgggaggatcacagatttcaagaagggaacagtttatacctcttgccaacaacccactttctaaaccatctggccaggtaagttactgctaggttgcaataaacttttggggttcagaagaggtttactttgaatatcaaccttacattaaactagcaagtcccctggttaaaactggagattcctccttcaatgatttattcaacatatatttcttgaaacttttatgttccaggcactgtgctggaaactggataattcacaagtaaaataatacttcgtctctttttttaaggagttcacagtttgaatatagcccttcttcttagttgttctctgggtactgtgcttgagtccttcttagggatattttcttatgttttgaatacttcatggtttgaatttttaatctttattcataaccctaattcatacatcagctcattctgttttctttttagtggagctattaatatataagagttggatatttggcaagatagcataatgaattgtttttaaaagagaaatgacagtgattattcaaaaccttgttaaaatactaaaaagaggaggtaaaagccagggcaatgggagaaaggacaaaatccttggaacgtaaagaatctatgatccttaaagaaagataggaagctgccctcaagatgaggcagagaaggaaagaattatagaagaggaagaagaggcctttggtgttgagtttaaaaagcaaccgggtgggcagaaagaaagaaagaccaaaatgttcagtgtaactcttgttttaaaggactttcacaccatttgttgttaaattgtatgtttagacctcactcattgtggttggtcatgtggatttttaacttcagaacaattatactccaattattttaattttaaagaaaacaaggattaaagtgcatgagctcactttaataggtgaccatatgtgtgattaaatttggaggctggaaatcagacttaaggttctgtggaggact

SEQ ID NO: 56912 - DNA, 1016 bp, Homo sapiens
agggaataaaaaaatataaggatcctagttctagctgaacattcctcctacccttaaccacctcccatacacactgcaagtggagggctgcccagcttctcgattttcaccctgtgtcagtggggtgaggtgcactcttgacgttggacaaggaagaaatcatgggaccgggggaaccaggaaggaagcttgttcatccgtgggaagattaaactttcattctgagcatatgactgcatcacagctttttgtttctgttcttcttgcagttaagatccttctattctacgtaatattttatggctgcctggctggcatcttcatcggaaccatccaagtgatgctgctcaccatcagtgaatttaagcccacatatcaggaccgagtggccccgccaggtaaaatccacatgaatagcttcatttccttcagagatagcatgggtgtcactttttctattgagaaaaaattctttggaaaattactctataatgtagtcttaaagcaaccatgaaaagggaaaagagaaacttctctcggctgcagccagatgtcctacccgcattgcaggcagagctcccacgggttgcagacatcttatttgcccagttctagagtgagggtgaagcgtcctggttcttggccagcctgctacccaccagctatgtgactgtgaacagattgagttctgatgggggcctctgtcttctcatttttcatattctagggtttggttagtgggatcctttccagaccttttcaactctaacagacatttttttacttcttgaggggggctatgactcaggtaaattcttttaaaaaagtcacttgggctcctgttttaaaaggtgaacttatttttagagatgataagaagctgtggaatgggcagctactcacagggagaggagccatgactttaggggtctattgtcccacctgctgttaatttgcagtttgagcttgaacaaagtcactcttacttctcaatatttatacccattgatttaata

SEQ ID NO: 56913 - DNA, 1120 bp, Homo sapiens
ttagctcttaaaaacttgggtgaacaaaaagattatcataagaaatgcaaactgccacacgagtccctgctgtgacttgggtgccatcagtgtagagctatgtgtgtccacaccagtcgtgaaaggcccatggccatcatgcctgatgctgataggacaaggcagtggaatagccacaaacgtgaatttaccatctggctgttgtaaaaatcattgtctggaggacctagagagaaagtgttgcataacttccgggctctcacttacgaatgaccttgaagctgctgctgagggatggcaatgacttgtcccttctctgctttcccttggcaaaggtttagtaacagctgtatttaggtgacaatcttcagatgatctacgtggccctgagcagcctagatcaagggctactgcctgccacaggcttttcctgcgtacctccttgaatgtgggaaggattcacagaggaagatcttcaaaatacggaggtggcaagcattgttgtgtagccctaagtcaaatagttctccactgtaagaaaaactcaaaatatttccagataaatttagagctgagggattggggaagtggaaaaaaaaaatcacgtaagtaaataacataacttaaacctgcttaataatccagtttccagcaactgttttccacaagaggtgggtctgtggaaaggttgaagcaagaattctggagtatgcagagaagctgaaacatgttttacgttgggtatggtgatagggaagcattgtgtcttttcatgtcctcttctgctagaactttgtggtaccattagttgtaattttaattggtgcggatattttgtttttgttctttgttatgccatttaaaagttattcttccatcatgatgtgattttataattcttttttttttttgagacagagttttgctctgtcacctaggctggagtgcagtggcgcaatctcagctcactgcagtctccgcctctcaggttcaagcgattctcctgtctcagcctcccaaatagctgggattataggcatgcaccaccatgcctggctaatttttgtatttttagtagagacaaggtttcaccatgttggccaggctggtctcgaactcc

SEQ ID NO: 56914 - DNA, 1071 bp, Homo sapiens
aatggatcctgtctacctggtcccagaatttgtggatgagttagcattggtggcaattagatttccaaaagctactgcacagccttatgacttggtaaagggtttgtggggggaactctgtttggcttcaacaactcaactacccaggtggtgatttctttatttctaaagacaagggtacaactagtaagtcatctcttgggtacacaggaaacctaatgatttactttaaaatgttcttggagccacagaaaaacagatcttacattgtatgcccattgtatgatgaataagcagaacagagacctgataagtaggaaggaccaggtaacaaatctgtgggagtgatggtgggggaaaaaaaaaagctggatttgtgaagcttcatttaaggattttttgctgcattcacccaagggtcatagaaagtggggtggaaagagcagtagcctgacaggtccacttctaccataaaatctgatggggttattggactggttgctcttaactgttggtcagtgctctcatgctagtaatctgatgaccagctggtctgtcggatgcagtcaagactagtgagaagctggggagatgaagggaacagggatgtatcatccagctttttcccacatacatgcatgagtagatcttatcaaatgtcatgtagaatgcagtgtcttgtttcaggatattacttaacaaatgttatgttttatatctagataagtcaaatatactatatgtacttgctcttcagtttggccttgagcataattaatgtaaaatactaggatttatctatttgtttatgttattcttttataaaagtggcacctttcctttattgtattgagaataagcacaattatgagctatacaaaataccaaggatttgcccctatggaatatgcatttttaaagataggtcaactgaactaaataactccctgcttgcctgaaagtgaatatacagccacaggaagaagaggacggatcagagaagagcctaaatcagagttcacggcatttagcttagacaggaggaatgatttctttaccctgagtgttggt

SEQ ID NO: 56915 - DNA, 1004 bp, Homo sapiens
atgtgtgtgtttatgtgtacatatacgtgtgagtatgtatgaattcatacctctgtgtattttttttaaaattggaaattacttttcaactcggaatgtataggagacacatgatttgtgcatggctacatttaaaagcatttctttgcttcctgtgcccttctcagtcatatgggtaccttcctggaggtttccatgggaaatgattcctatttagagatttgatctagtgatttatcagatgtattaaatgacaggtgcaagcagctgtgcatttgaataacttacaaggttgaaatggctacattctagtttaaatactttaaactcacatgtagattgagaaatgatgaacttgctacattataaacctaaagaaacaaaatcctttccctcaagccttttcccccttgtgctatcaacacttactaaagctaaacatggaggatcttccttatttctcaagagatggggaccaaaggcaggtaaatgtgtctttgaaaagcaagtgggaagccagaagttttttctaaatctaaatcttatgtaaagttgaaatactcattgaaaaccaaatattaaaattttacatacccagattatgatttctgcctcttcaagtggctttgttaattaatgatatatagcttaaggcaaatgatcctatcagaacaaagctgtctctagagctcagggtggttaatgtaaattcaagtttagaagactggagagggaaaaggttagatttgtttcctggaatataacttgaaattgcgtgccagcgattgggtgttctgctgtctttggccctctgggagttaccagtgcaaacagagctcatccttgtccagagtcataactaacaactttaagaagtgggcagtagaaagaggggcatgatgggagaaagcgtctggtctagtgtgaaatatgactcatgagaactccagtcagcaaggtgggatttgtgcagcccttggagaatgtcatggttggagaatttg

SEQ ID NO: 56916 - DNA, 1850 bp, Homo sapiens
tatatataggtttttttttttgagatagagtctctgtcacccagactggagtgcagtggcacgatcttggctcactgcaacctccgcctcccgggttcaagtgattctcctgcctcagcctcctgagtagctggaattacaggtgtgtgtcaccatgcctggctaatttttgtatttttagtagagacggagtttcaccatgttggccaggctggtctcaaactctggatctcaggtgatccacccatcttggcctcccaaagtgttgggattataggcgtgagccaccatgcccggcctcagataaacaataatttttaaatgtaagtgtgtcccacatagcatttgggacatacttatatttttttaaaaaaatgttctttgcttatctaaaattcaaatgtaaccaggcatcttttatttggcagtcctacaataaaatgcagttgtgatggacttttccaaccattgctcctgagtagtgctgtgtagtgtggttcacatacccatctaggaagtctcatgaaggcagcggcttttggatattaaagaatgtaacagagttttagagagtgcaaacccaaggcatacggactttgaattttatctgaccggcactgacatgctgagactttcagattggaaagcatttgtggttactgcatgtatgtcccaaattcttcccgtttagtttaaaagatccaaagaaatatcttggttaggtaggcttgagtctagagaatttggaatggttatacatttactgacaataaggattataaaagaagacctctgtgtccaaggcttacacgtaattagggagggtaaagccacctgcacacaatgctagctagcagggtattttaaaaaactgtgcacgttggggtactagaaacataatgggctttggagtacagcacacctgggttggaattctggttctaccactttctgtgcagccttggcccaggtagttaatctttcagtgcaagcagtgttgtcattcataaaatggaggtgatgcctaccatgaagtgttgctatggaaattaactgatctgtgatattaaagcatagtcactggtacttggggttacctaatctaaatgccagaggagtgatttaacaagggaggcaagaccctttctttttagccaagtggagttagcaaagtatgttttgtatgtggaaagtctacttttgaattgtcttcgtttctgccttcctactaatgtttttctctctgcctggtctaggattaacacagattcctcagatccagaagactgaaatttcctttcgtcctaatgatcccaagagctatgaggcatatgtactgaacatagttaggttcctggaaaagtacaaagattcagcccagagggatgacatgatttttgaagattgtggcggtaagtagactcattgtagatgtctgtggctagttttctttctctttaactcttatttcccacttctattttttgtttaatgatcgagagataatcctgaaataatgaaagattgaactctggccatatttagacactttttttaaaaaaagcaggaagacacaatgaaaaacagtacagcctcaagtatgactgttttctgcattggaaaggtgtcttactttaaaacactcctaggtactattttttactattcagagccaagacagcaattccggttttctttctcttacatccgttgaaaagtacagctacttatttccttatcttcccccaaaaagttctccctatagaagagtgcacagggccttctctcatcagaaagaccttttggtgtgattagctatcactgcactggcattcatgaaggaggatgta

SEQ ID NO: 56917 - DNA, 1121 bp, Homo sapiens
agtggtggttgaaaaggaaaataccagttcctttttaaaaattctgaccaaaaaaaaaacctagttctgaaaattattgacagtccttttgtattctgattataatatccctgttactgagctaagccagtgttgacagtgtgaatgatgctactcacgcagtgtgatccgtctcctttcagtcttctaaatagctgagtaatccattatttaaaagaagggaaatattgccagagactaaatattacgtgctgatcaagtactatgaagctttggtgtggggccatataccagctattccttttggtaaaatatcttttaatatgagtgaagaggtgagagatggttttcctggagatcttgcttaattcagatcatgcattaaatgcagaatagcgtactctcagaataggtaactatgacaaggaagacagtttctttttcttagaactgctaagggaattgctggtacaatataaaagttgtgtttttatttttagatgtgcccagtgaaccgaaagaacgaggagactttaatcatgaacgaggagagcgaaaggtctgcagattcaagcttgaatggctgggaaattgctctggattaaatgatgaaacttatggctacaaagagggcaaaccgtgcattattataaagctcaaccgagttctaggcttcaaacctaaggcaagtaatattttaaatgatagaatttagatgagtcatttacactaagtacttaattgatctgagaagacaatgtaagatagttttaaagtatactcagtgctgactttgaaacgtagccagtagagtaacaccaaaaacttctgtatccaccctgcaattcttgtagttaggacattaatctcattttctaaagttaaaggaattctgagaggcaaagctgcattctgaagtgagtctgtggcccttttcttaatactcctgctcagtatccagataacagtttctataacataaactctttaaaaaagtaaaaatggaaaaatatattttttccctggtggtctagtggttagagaaaaaaaaaagttttttattttttacttcataaagaatggattaaaaaaaaaattttaacccacttgcatgtatagtc

SEQ ID NO: 56918 - DNA, 1017 bp, Homo sapiens
gatggactgctggcagaaattaatgtacctctcaaaaggattttaagcttctttccacatagacaggatataatggaagaaaaacggtgagaaccattatgccaaaatgtatttgatattcatattgctggggaatacttcactgagatcaatcagctatttagcagcaaaagaaattgttgtggcatggccaagagaagactcatcccatactttctgagtaccttgcttttgacattactcatcgtagacactgaatgacatttggaccccacagaggcagtctagtctattgtgattgatttcttcccacatctttagagttacttggttcagtgataaattcagctactctttcttttcagtcctttttttcttttttctttggtctctacttggttatccattgccactgcctaattcatcacctccacccaaatctccaactattttggagttatttttgtcagagatcagagtatcccagcatctcactatcctcaccattggaggatagattctggcaacttcttagtgagcattttctctacatatttttaaagacaaatacattgctggcagaaacgtcccaaagagtcaaatctagacgatcattttcttgcatccaaaacagagtagtagcaaaatagtagttccttcctgatgtggaactaatattttatctgactttgattagactatgtatgtgttacatctcacatcaagactcacttgctgtgctgatctgagtaagcaagtgactgtcttccagcgaagtatgttcatcacacttctgagatagatttgagccatgggtgtagaagaggaggctctggatatttcatgacagcagtaattttcagactgtcctctgggtcccttcagtggattcaccccttcaagaccacccttcctcttagggcagtgacacctctgccttttttacatattggactttcctaagaaaattgcaaagaaacgctccttaaatggcagtctccccgactggagattaaa

SEQ ID NO: 56919 - DNA, 1097 bp, Homo sapiens
taagcaaagcttataatgggctactattaaaagttccatttagtactggtttgcatcacagcttaattgtagtcgttataaacttgggcacttattttcatttcagcaaaatcacaaacatgaccttaaattggttaggggagtcattcattctgctgtcctgatgtcttttgttattttggttgacttactgtgaccagtgtgtacttgtttggactacggagtagttttatttttcagaaacttaagaaatcatttacaatctactgatcataatgggttttatttttagcctcccaagaatgagtccttggagacttacccagtgatgaagtataacccaaatgtccttcccgttcagtgcactggcaaggtaaagacaaatttagggttactggggtggtggaagggtaggcagaggaagaggggagaatgaagaagactgtttaagtgacaggtagaattttaatagaagaaataagaaacattgctttcaagtataagtctcagtgagatgaattgtagctatactaggtaaaactttttaaaagaacagaaagatgtaatcagaataagactgatgtcagtttctccactggcataagaaactcaaatatctgaatttaatacattgggatatttgcttatcagaactgagaggtgaattagcccacagaagtactttctggcccacagcatgtattaaaaatttggggccaacattaaaaaaaaattaatgtcacataaaaattagtggtttgggcttctcttttaaaaatattgaaatatcgcctggtgcagtggctcacgcctgtaatcctagcactttgggaggccgagatgggcagataatgaggtcaagagtttgagaccagcctggccaacatggtgaaaccctgtctctactacacatacaaaaattagctgggcgtggcggcgcgtgcctgtaatcccagctgaggacctgaggcaggagaatcgcttggacctgggaggcggaggttgcagtgagctgagatcacgccattgcactccagcctggggacagagcaagactatctcaaaaaaaaaaaaaaaaaaaaaaaaaaaattgaaag

SEQ ID NO: 56920 - DNA, 2360 bp, Homo sapiens
taacaattagtgcatgtttcctttggatccaaaaactaatggaccgtttagagagaaaggcagaacaaagaaagggagttcccagacagtgctagcaccaagcaaggaagtggagattgatttctcaacaagaaaatgagaggcaagtagtaaactttggagataatatcactagacagattatttactgggccaacagcaaggtgtttctgcctttcaatgttggccttgtttctaggaggcttgaagaatgcttatttggcatttgactcagcttccccatccatttgcacattgagaatagtctcttcttatgaccatttctcaaggctgcaatggaatagactgagtagatgttctttcctctctcagtagtttgcaaactactgtgtagattgagtcttgtttttgagtacacatagtgatgcatgatgtgagccattaaaatttcatttcattctggatttcagcgagatgaagataaggataaagttggaaatgtggagtattttggactgggcaactcccctggttttcctctgcagtattatccgtactatggcaaactcctgcagcccaaatacctgcagcccctgctggccgtacagttcaccaatcttaccatggacactgaaattcgcatagagtgtaaggcgtacggtgagaacattgggtacagtgagaaagaccgttttcagggacgttttgatgtaaaaattgaagttaagagctgatcacaagcacaaatctttcccactagccatttaataagttaaaaaaagatacaaaaacaaaaacctactagtcttgaacaaactgtcatacgtatgggacctacacttaatctatatgctttacactagctttctgcatttaataggttagaatgtaaattaaagtgtagcaatagcaacaaaatatttattctactgtaaatgacaaaagaaaaagaaaaattgagccttgggacgtgcccatttttactgtaaattatgattccgtaactgacttgtagtaagcagtgtttctggcccctaagtattgctgccttgtgtattttatttagtgtacagtactacaggtgcatactctggtcatttttcaagccatgttttattgtatctgttttctactttatgtgagcaaggtttgctgtccaaggtgtaaatattcaacgggaataaaactggcatggtaattttttttttttttttttttttgttttttggctctttcaaaggtaatggcccatcgatgagcatttttaacatactccatagtcttttcctgtggtgttaggtctttatttttatttttttcctgggggctggggtgggggtttgtcatgggggaactgccctttaaattttaagtgacactacagaaaaacacaaaaaggtgatgggttgtgttatgcttgtattgaatgctgtcttgacatctcttgccttgtcctccggtatgttctaaagctgtgtctgagatctggatctgcccatcactttggctagtgacagggctaattaatttgctttatacattttcttttactttccttttttcctttctggaggcatcacatgctggtgctgtgtctttatgaatgttttaaccattttcatggtggaagaattttatatttatgcagttgtacaattttatttttttctgcaagaaaaagtgtaatgtatgaaataaaccaaagtcacttgtttgaaaataaatctttattttgaactttataaaaagcaatgcagtaccccatagactggtgttaaatgttgtctacagtgcaaaatccatgttctaacatatgtaataattgccaggagtacagtgctcttgttgatcttgtattcagtcaggttaaaacaacggacaataaaagaatgaacacattcctcgtgtgtgattcactcttgtctaaatgtcccaacctgtgacttctttactttccacaccactaattatccaagatcttgaagaagtattgaacctgaaacggagaaacacataatttcttagttcagacaaattttggtcttttccacttaacagagtccaagaggttggtcaggacttcagacactggcataccccttcccaaagacactaaaagttaatcaatcaatcagaggcagagaatcgatgaagctccagtttgaagttccatttaaaaaaatcatcttgcagtgctactgctacttcactcagtttagaaaacatgaagtgttggttcctgctattgcttcactagacatatgtgttaaaaaaaaaagttgttagcacttcagtttttaaaaaatgaggttaggtttgtggttcagtaaattaaggttcataccttgctttttggttca

SEQ ID NO: 56921 - DNA, 1016 bp, Homo sapiens
gctaatttttaaatacagctaaataaggacttaggccaatccctgaaccaaaaagcaaggtatgaaccttaatttactgaaccacaaacctaacctcattttttaaaaactgaagtgctaacaacttttttttttaacacatatgtctagtgaagcaatagcaggaaccaacacttcatgttttctaaactgagtgaagtagcagtagcactgcaagatgatttttttaaatggaacttcaaactggagcttcatcgattctctgcctctgattgattgattaacttttagtgtctttgggaaggggtatgccagtgtctgaagtcctgaccaacctcttggactctgttaagtggaaaagaccaaaatttgtctgaactaagaaattatgtgtttctccgtttcaggttcaatacttcttcaagatcttggataattagtggtgtggaaagtaaagaagtcacaggttgggacatttagacaagagtgaatcacacacgaggaatgtgttcattcttttattgtccgttgttttaacctgactgaatacaagatcaacaagagcactgtactcctggcaattattacatatgttagaacatggattttgcactgtagacaacatttaacaccagtctatggggtactgcattgctttttataaagttcaaaataaagatttattttcaaacaagtgactttggtttatttcatacattacactttttcttgcagaaaaaaataaaattgtacaactgcataaatataaaattcttccaccatgaaaatggttaaaacattcataaagacacagcaccagcatgtgatgcctccagaaaggaaaaaaggaaagtaaaagaaaatgtataaagcaaattaattagccctgtcactagccaaagtgatgggcagatccagatctcagacacagctttagaacataccggaggacaaggcaagagatgtcaagacagcattcaatacaagcataacacaacccatcacctttttgtgtt

SEQ ID NO: 56922 - DNA, 1048 bp, Homo sapiens
tttatcctcaaaacatcaggaggcaacccttgaggggaatgggcgttgacataatcaggtttatagtttttaagaggtctctccagttaccatgtggaaaatggactgaagggggtcaggttgggatagatttgttaaataatagtataacaactgaaaatacattgataccatgtactttaatttatgggttgttataaattcataaaatgtgtctaggcattagtttctccatgtggaaaatgatgaggctgaacttgtaattctcaaagcttggactcccctacaaatgagctgaataattgatcctctgagacctggaggcagcagctccaatccttaaccacttcctgtgccggctccaggatgccatgcgagaatgagcattttctaggtgcaccatgaggtgacaaagattgagaggccctcctctaaacccctttcctgcactaacattccatgattctaggttttgaggaaatcaaattctaatccgacaccttggttttaccattgaggaatgtgttgcccaaagaaggaaaatggctcacctaaaattgcatggcttagtgtatagaacattactctcctaactagtaatcctgggtttttctagtttgccatactgtctctgtatcctttgtaagcagtataatgaattattataattatcaaattgcaggtgcttctttttctttcctctatttatgaacagaagtacagtttattcttttttgattaccagttaagaatttattgctgtaagtcatcaagcatcgttttactaaaacttgaagactagaaatggagaaattaattcctaggaaaacaacacatcttatcttattctggcttagctgaaaatattgcaagactagcatttctatttcaaaatcagcccaaaggctgtgagcatacagaagtgatgaatagaaagatgttagctgagctcttaatgacttttacttgatttgaacttgagttcaaaggtaaatcaaaagtttaaagttgaacttgaatcttactatgccatataggctttccttag

SEQ ID NO: 56923 - DNA, 1015 bp, Homo sapiens
tggttgaagtggagggttcctttggtagagtatgggagataaatttggaaatgtaaattagagctagattgtggagactttggaaagctttctgatggcaataatgaacattatggtaacagtgataaaaataataactttaatttactaagcaatatataccaggtactatgccaaattgtttacctgcattacctaaaaactctgttgaatagtttctattatctccattttatatgctaagagagtgaggctcccataggtgaaatgacttggccaggatcaccccaccaatgagtggcagagagctgaaatttgaacccaagtttgtctaagtccaaaaccagtgtttctatacagcaaactaggtcaacgatgacaaaagtgtttcaattcaagtgccagtttttgatttattgataaaactacaaccaaatagaaaaaaaaaatcaccatgatggattactgatgtttgctgtaaatgctggatgggagtttcttggtatgtatgacacacagtggctacttaggctctagaaaactggaagccatcaaaggtttttgaacagggaagtgactcgataaaggttccaaaactttaaccaagcagcagagtttaaggtgagtagataataggagtaatggacgcgtatactctgatcatccagtaacaagtcttaaggacctggtagtctaaaataggaccattcagaaattttcttctccttcaagtgatctatttctactatcaaggtgtaattctttgaagagtatctgtctcctcccctgtcctctatgatccatgagaacagtgaccttgtgtgttttgttcattcctcaattctccagtgggtaggcattcaatatagttttcttaaatccagtaataataaaagcaatgatgatcatagaaagcactcactttgtgcccagactgggttaagtactttcagtacagcaaatgcatatggaatcagactacctgggtttgaattctagctctgccacttactag

SEQ ID NO: 56924 - DNA, 1055 bp, Homo sapiens
cacatctcaccattccctccacctgccagttgccagaaaagtccactgcagcatcccaaaaatgtgaacaattattatgtatcaattaaaaaggccacgtccaccagcatcttctttcattgctgtttattcaagtaaaacctgaaatatgtgcatgtggaaagcgaatggtttgcatggattcttttcttccttctcaaacctgatatttcagaagtctctacattcatcgtaaaaacatcatgataatataagaggccttaagctatcaaattgtaattctttatggcccagttagtatttcatcagcattggttgttttctcagataaaagaatcttggataaggagcaatttcacattccctcctatatcccgtcatagtggggcataagttcattgctagattcaaagggagttacaggttcataggtctttctgtttctcaagtacagtgccagctccacctttcttcagataggctgccttctgaatctgaaaagtaacaagcttaatgacttaagaactgtatttaatataatttatcccactttatataggcacttataaaatcatttgccgaagactctaggattattttagattaatttattttgtataaattggttaattaataactatggaaaatccatataaaataaatagacacaatcattggactaaaagtgaccttacagggggcatttaagaatctccaggcattttgtctcagcactttttgcatcttctctacctattccctgggaaatggttctcaaacagtagcacaattcctggatggctttttaattttttttttaatttttttgagacagagtctcactctgtcacccaggctggaatgtagtggcatgatcacagctcactgcaacctcgacctcccaggctcaagtgatccctcctcagcctccctagcagctaggaccacaggcatgcaccgtcatgccccactaatttttttttgtagagacagggtccccctgtgttgcccaggctgctctagaactcctgggctcaagcaatcgtcccaccttg

SEQ ID NO: 56925 - DNA, 1115 bp, Homo sapiens
tgacacccaggaatgagtgaagacagccagtctgtgaggccagaagcaagatggagtcagctatgctagactcctctcactgtcataatctttgcaaagtcagtttcataagtagttgatcaaatctgaatttggatacataattacttctgcatggattcttattctggtacactctgggggaaaaaatagtgaatcaaggattaatcagaaataaacataggtgcatggtgactaagatgattggacaggccccaatttcttggccgtgattaacgcaggcctctgcacatactgacactcataatttatctttagttttagcttctatcttgaaagaagaagagttgtgatttttagtagtacattgtcaaagagggaacaacttgtacaaatacaaaagcaaacagctttctcttagagatctaaaaatagtgcagtaagactggggctttgaccaggaggtagaaaatggcaagagataaagctggaaacatcagcaggggcctcgtaaagtcatattaagacaactgaacttcatcttgaggccattagggatccaaataaatgttttactcaggggaatagcacaatgatacctgtgttatagaggtcactctggctgcagtatagagaacagatgaaagggccctggggtcaggcagggaaacaagtgggtggagtctagggggacagagactaggtagaagtctattaagtaattcaggagaaaattctggtttcctgaattgctatggcagaagggatagccagaagcagtgagcttcaaaagacatttagtggggtagaacagaaagcctcagagactaattggatgtgaaaggtagcctgtgggaatgaatccagattaatgcctatccccaagcaaacgtgatagtaccatctttatctgtgttaccaaaatctaataatctaaaaatgtctgaaaaccaaagttttttcataagtttaatggtaaaacctaacctgtcttatatcaagttgtgtatcattaaacagttttgtttcagtagcttgacaaaacatttaatgtatatcatttttatttaacctatttagtgtgactcttcacactgctgtaaaaatattaatgt

SEQ ID NO: 56926 - DNA, 1999 bp, Homo sapiens
tacattacctaagaaatggcatattctgatttagtaaatgttctcattaataggataatacagtataatctgtacacatagggcttttcttttttttttctttttttctgagatggagtctcgctctgtcgcctaggctggagcacagtggcgtgatctcggctcactgcaagttctacctcccgggttcacgccattctcctgcctcagcctcccaagtagctgggactacaggcgcctgccaccatgcccggctaatttttttgtattttcagtagagatggggtttcaccatgttagccaggatggtctcaatctcctgacctcgtgatccgcccgcctcagcctcccaaagtgctgggattacaggcgtgagccactgtgcccggccagggcttttcttaagaaatatgtaaccaagaaaatatacttgacttgcaactatagtgaacagagtttattcttttctttataaatgggagtcttgcctcaagatcatatataaagatgtgagttattgcttatagaggtgtatatatttaaaatatataatagtaatagacatgtctaacataagatgaaagattatttattatatgtgatctctcatgtttagagtgaattggtcttttctatgctatggatattcaccagaagattaagtagttctttggggaatagtcttaatatctcaactggaaaagtcatttatgagcatgcacttataaacttaatgctattctagtggattagtccaattccacatatttgtcacatggcattttatatctgtgatgaaacagtaatattatcctcaatcaaagtcacagagcaagttactttcagagctatggattagagcttagagttctcatttccattctcaggcaggtgtgtcctagtttgagaaaatgtgatacacaaaaccaccacctcacaaaatagataaatggtggttacttagatttcaaaaggatgttcttcggggttccttaaaataggcacttctgaaggatctaatatagcctaaggagcccagactattggtaaccaagaggcctagtttctctaccctatcattaacaaagttaatggggtatataaatttgagcatgttagtcattccattcatccattcacttatccactaaatcattaatattttattcaatgaatctttcatgaggattctgtgtgttggatataaaaaggttgtagtccttgtttttaaggagttaagacagaagggtaaacaaacagtacatttttaatggtagaggtaatgcagcctgttagcagaccactaaaacctaaacaagatgtgaaggtgaactgtgatagtaggagtagacttggaaagtaaggaaagaatgctatgctaaagaaatagaatctgtgtgacttggtaacaaattagatggggggcccaaaagggagagagaggagtcttaggatgactcccaagctgttggcctaggtaacttggtgtaagagtggtgccatttatgacgagagggaatttaggaagagggggagttttgggaggaagacaatgaggttagttttgtgcaagctgagtataagagccctgtgggggccaggcacattatagctcatgcctgtaatcccagcactttgggaggccaaggcaggagatctctgaggccaggacttcaagactagcctggttaatacagcaagactttatctctacagagttgtttttttttttttttaaattagctagttgtggtggcatgcacctgtagtccgagctactctggaagctgaggcaggaaggtcacttgagcccaggagttcaaggctgcagtgagcattaggcagttgtatagtccagcctgcaactcagaaaagagaactgggcagtagttaaagagtcgtctaaagatatatgatagtagtgaatgaaattgcccagggagagccagaagataagaggagaatatggagtggaccctaggcagtaggaaggtggaaa

SEQ ID NO: 56927 - DNA, 1046 bp, Homo sapiens
aaatagcaaaatggctttgggggatacactcaggaactctaatgagtagagttatgagtaccatataaattttgaagtccttttcctcctcttttagcttctgtagtttgtattagctgagatgactgcttttggatcaatattcaaatatattctgtaataaattattttactttgatgttgtgtatcgtaaatcctcaaagtcatgaaaatggtttacatgaccctgcatggtctggcctcatctcttactactttcccgtagtctcactcagctcctagcctctaagctgatcttcatatatccctactgtacttctgcctcaaagtctttatatccattttcacttctgcctaaagtattctttcctattcaagagggtgaaaaaaattatttttgagtgttctagacactatgagaggcatttttcttggatcatgtttttcattatacagctttatatagagagctaagaatcttaaaacagtatacttatatttttcccctattattctgtgtgctgttgttctcatacattttacatctatatatgctataaacccaacaatacaatgcatttctttgaacaattatgtttgaaagcaactgaaaatacaaaaattagctagatgtggtggtgggtgcctgtagtcccagctactcaggaggctgaggcgtgagaatagcttgaaccctggaggctgaggttgcagtgagccaagatcgtgccactgtgctccagctgggcaacagagcaaaactctgtctcaaaaaaaaaaaaaaaaaaaaaaaaagaaaagaaaacaacagaaaggaaaaaaaagaaaaataaagcaactaaaaaataaaaatgcattttatgtttatacttgacatgtttactgttgctttgtatagatttatatttttgtctggcatttttttccttctgcctaaagaacttcctttaatatttcttattatataatgcttctgatggtgaattgtatcaggtcttttttgtcttaaaacgtcttccttttttcttcatttttgaaaaatattt

SEQ ID NO: 56928 - DNA, 1003 bp, Homo sapiens
ttaatattgcatataaatcttcttttgtatcaagaatgaggttttattcagagagaggtgtagtgtagtaggtaaaagtattatcaatggggtcagactgcttgagataggatgccagtttgaggaagttgtatgactcctctgagtcttagtagtctcatctgtaagttggagccattaatactacctatgcagtaaggtggttgtgagggctaaatgagatgatgcacgtatagaacctagagtgatgctgttatccattattattcttgatgagttgatgtttaataacactttttcttcaaagagtaatctatgtaaagtttatgttttagagtaaagaagagattacaagtgttaagtgctaagtgtggcttatttatttcccttttgttggttggtttatggttttgttttgttttattttttaatatagttcaatatggatcgggttaatgttgaggaattctatgaagtttataaaggagtagtgaccgaatatcatgtaagtataaaagtaaatgtaaaacatttgtactgttaagtgaaaagtataggatgcagtgttttggactaagctcctgtactaggtcccaaatggccagactgaaaatcaatacagagtcattcatactaaagttctgtgtcaacgacctaggttgttatctgaccttctgagaaatcaggagagagcgagccaaatttcccaaacaggctaattttgtttggtataataatgaagttttctctgtctttcatccatacaacaaaaagtaacctgaggtaacctgatgttaaccagtcagttatttccacattacattcttcaaactgtatacctttcatatctcccaaaattcattgcaaccagcctgcagcttcctaaattcagttctcttcttttttcttccccctctgtagagtcagatgctaggttcagatcttaaatcttctagttatatgaccatcgacaatttatttaccttctttaaaccttgattaa

SEQ ID NO: 56929 - DNA, 1049 bp, Homo sapiens
agtttcgttttttgtactgtcttcatatgatttcaatatcaggataatactagttttataaagtgaattgggaattatcctatgtatacaattttgaattgcactaacattgtactttgaatttttttctatgcaattaaataatatttgaaaatgtgatttttaaagtctgagtaaaaagttagttgtaggaacttattcttctttatctaactttttcctgttttttattatttagaacttaaaatttttttattactaataattctatggtgagcatcttcctatatatcgtgtgaacttgtcctatttattcttagaatttgtaatagatatagattataaatttcttttcatattgattgaagcatagtgtttaatatttagattagattaaatttcatatttagattagggttaatatgtaatcatttttttattatcattaatgagacccttttatggatctgcaagaccaaagctgatttcatacttaattgccttttttaatgtgttgtcatttgcactgatggtgcaaaagcgatggtgaacaaaactgccactgccttagaacgaatcaaggcagtggcaccaaactgtgctagtagttactgtatttttaaccatcatgcatctgcagggggaaaaaaaagccatacttagttaagaatatcttagatgcagtaaaaataattttattactttttgatcctcaaatataggtctttttaatactctgtgtgaagtaatgtgaagtacacataaagctccatataatggttttaaggaaaagcatttgtgagtaatcctattcacaattgtttgcactgtcagctcaattagatgctttttcttttatggaataccatttttacttgaaagaatgactgacagacaaattgtgcttattcagacttgggtatttggcaggcgttgtctttcaaattaagtaagcctatcatatcaaagaaaacaactgacaatagcctttgccaaagataaaatccaagtgaagataaactacaaaggaaaactaaacttagaacctt

SEQ ID NO: 56930 - DNA, 2171 bp, Homo sapiens
caccactatataattcatccgtgtgaccaaaaccacttgtaccccaaaaactattgaaataaaaaaattttaaaaactgagattttcatataatgagaatagcccctgcataataacattcatgaaaatctcctagaaacatggatttggcttctaatgggacatttgcttactccaaccacatagagactggcctcttaagattaggaagcagctcactctatccatagctggcagtaccctgtgctgtagaaacttaattttactttgtgattgtgtggttaacttttctgtattaacctgactttgactttagacttcatatgacctatttacccaatcttacacagttttcagtttccagcctatctactcagtaccgtactttattttgtttttcttagactgtccttgttttaaaactgtgatcttatttcaaccaaggtatagctgttcttagcttcctttgcatgctgagcctgtctttcttcacagtgaggaggaacccctgactactctttcctggaaatcttcattcccataggtcttctctgctgtccctatgatggtatggagcctgtttttattattttctactcacttaattgcatcttgatgaatttcagtacacaaagtcaccatattgtaggtatatctacaaaggtgttgttatactggaccagatgcagtggcttatgcctgtaatcccagcactttgggaggctcaggtgggaagatcacttcaggccaggagtttgataccagtctgggcaacagtgagaccctgtctctacaaataatttttaataattagctgggcatggtggcacatgcctgtagtcctagctgcttgggaggctgaggtagttgaatcacttaagcccaggagttcaagtccagcttgagtaacatagcaaggccccacctctaaaaaaaaatacaaataaaataaagttctattggttactctttttactaccttgtaaggaatgtacagcttgttcttgttaggaaattggtaaggaaaaatgtgaatttcagatttgggtatgtggtgttagtggaggatcagaaatctattggatgaattaaatctgtcttttaaaagctactttctactaatgtgggttttatgatcacctgatggattaatttgagatccattaagacctaagtgccttactggttcccaatttaacaattctgtggaatccaaactcttatttattttgatttgtttttacttttttgagacacggtctcgctctgtcacccaggctggattgcagttgtgccatctcagctcactgcaaccttggcctcctgagccctagtgatcctcccaccttagcctcctgagtatctgggactacaggcacacaccatcatacctggctaattttttttttcatattttttgtagacatgaagttttaccatgttgcccaggatggtctggaatccagactcttgtctgcaattgatttaatataattctacaatatttttccttattgcaaggcagaaaaccatagacatttgtagcttaaaccaatctgagtgcttccattaaaaattacaggaagattatcagtgaagtggtattgcctagtaacatattgctctctaggagacagaaagcttttccacctggtttttatgcctaaggttatttgttatgcatgtttgccaagattagtattaaattccttctgttgactttagtaacacttgtgatttcttttatatgttagcattgaacattaaactctcataatctctagttttttgatttgtctttacactaatcatgttttaaagatacacgtctattttttagttaaaatggctttgaattttatttcactagatttaaattttaaaggaaatcatatccttccaatttgatttaaattggttatggttattaatattaaacatgtctattttaggcaccagttttattagttcgtgtactcttggctacatcacgattaaaacttttctttcagtttctttccaaaataaactgcaagatttccttgttgacattttttcatttttaaaaatcgtttcgttttatttcccaccacccctgtttattatatggattgtgaagcaaagcatacaggtgatagtgaattatcttgtacaacagcctggtcgcttct

SEQ ID NO: 56931 - DNA, 1063 bp, Homo sapiens
tgtattctataccttgatgttgtgttttggttgtaaaaaataattctattttcatggagaatgtttcaaagaaagtttagatattttgtggttgtctgcatttaatttactaggaagcaaattatttattagaatattgaccaatttgtaaatttagcatcagaattggctctggtataagaattaaaatgagactggtaggcgctaggtcttatttatcatgtcctcacttttagaaattgggttattcttactcagagcctctttcagagttttactatccactgtaatggtagctttggtgctgtgtaagccaagagccctggtagatgcatgcaacctcctaaatttgggccgattgaatcagttaagtgctcagctttttcatatttgatttccttcatgcagttcatccactaggatactgtgaaagaggcatgacattttttggtataaagagagctaaacatcgtatatttaactcagttttaacaaaaattccagaagtggtcccagttttgcttagaatgtcaccattttggagttttgtgaatgtgttctgttctatctgaaaaagtaaacagttggatggaattttatcaattgcaccaagtacactgaactacatgttaggaccctgactttgaatgcacagagcttagcatacatttttgaaacataaaattatagacagtgaaaatatcctaaggatctgtaagttttagggactttaaataaaactggtgatttattgatttagaaggaatctcaagagttctgttagtccctacaaaagaatcctaattttgaggaaggattgcatttaatggccctgaagaggtaagtatgtattaagcttaagaaaaatcatttacaaatagtgaaatttagatattattgctgtataacaaactatcctaaaatattttttaaatttaatttaactcttaaaaatattttaacttctattttaggttcaggggtacatgtgcagttttgttatgtaggcaaactcttgactcggggtttagttaacagattatttcgtcaccccattaccaag

SEQ ID NO: 56932 - DNA, 1050 bp, Homo sapiens
gatcacctgaggtcaggagtttgagaccagcctggccagcatggtgaaaccccatctctagtaaaagtacaaaaattagctgggcattgtggcacacgcctgtaattccagcgacttgggaggctaaaacaggagaactgcttgaacccaggaggtggaggttgtagcgagcgccaagatcgtgccactgcactctggcctgggtaactcaatctaaaaaaaaaaaaaaaaaaaaaaagaagaagatagacaatatataacataagtagaaaagtaaacattgcctcctacattaatttttatttacattgatattactcatacttaaaaaatattttaaaagagtggctttgacagaatatttggtgaaaaattattaattaaaatataaattagtataaattgagaggattttatcttaattttattaatgtaagctaaaataataagtgtttaattttataattcttaactattgcctttttgattattttataggaaagaagcattggattttcatgtagatcaccagtcaagaccctttttcaagtaggtccttaatttggggattagtggtatgtaaaggaggatatcctagaaaactatggagttacatttgtaaaatttattacttgagaataatctgtcaaaagggccatagcaacatcttgcaactgcacagaattctaagaattatattctctgtctttttattaagtaagaattcctatattttatcattaaaaatcttaaagtttaatcagttgcaaatagaaagatttgtttacattacaagaaggataacttttaaaatttttggttgattaaaaatggagtgataattatatttgatgttcaatatttttattatgcttttgtgtttgtggggcttttaatttttttaatttttattttttatgtcaacttttactttagattcagggggtacatgtgcaggtttgttacctgggtatattgtgtgatgctgaggtttggggtacaattgatcccattacccaggtactgagcgtaatacccaatagttagttt

SEQ ID NO: 56933 - DNA, 1052 bp, Homo sapiens
atattctaatatattctttttcagatctgcttattccattttgtagcttacagttttctattacctgataatgttttgtagcttgtcttttagtcctttaaccatagtttgcacagatactttacagtttttctctgattatcctagtatctgaagtatttgtgggtctctctcttttctgttgtttctcctggttttccctcatgttggccttttccctgtatgtgtgtatgtgtctgtgtgattatctttctatatgattgccatgtgtgtatgtgtgggtgtattgcatatatgtaaataatatatgtgagatatgcattttcatatgaattatttgaggtacaggatgacattactttcctactaggagggaattaattgtctttgcttctgtctttttcccataggcattagcagtctgtatgattggtagttcaaaaattctaagttttgagactgcttagatgatgtgaacttgtattgccattcaagacctggttgtttctgattcaccttaagcgggggtggtatagcctttgggtccaaattattttaggaaggatcatctcttgggttctgttaccctttcccaatgatgtactgcaaatcaaagttcagattttccagataggcaatgctgtcaagtcaaaaacaactttcattcttacttttcattctttggttgtttttttttttttttcacttttgtcccagtaattatttatgatctagtcaatttatctttaatttttaaaagattttttaaaaatatcaacttttttagtttttggtggaagaattgttctgaataattttgctattgttgccaagcaaaagtcttgatcactgaattttccaccaaattacaggtgcctcatttgagacagttttcctttatccatggggcagatatacactttatgcttgtaaacaaagtatgagaaaaaccaaaaatttagccttgatgtttagaataggtttacttttagaataggtttagaatagaatatttacttaagacaaatatgaatcccatatagattaaagtt

SEQ ID NO: 56934 - DNA, 1245 bp, Homo sapiens
cttgtctcaaaaaaaaaaaaaaaaaaaaaaaaaagactgaaatgggattattcatgttttggataagaaataaacaagtgattatagataaggattattatggtcataaatacgtcctcattattgaaagctgttattgctacaaaaagtcaaattgaagaggctcaagctaagagacttctgtttctttgtgttctttcactggcaacacaattttaacaagtagatctttttggtattgggattttgtgtacacaagaaagcagaaatttgggtgtatgactctttctttagcattttgtaaggactactttgctgaaatgatttggtaataaacaaatctttctattcaggtttttaagagtattaaatttgtaataagaagcttttatgttattaccagattggattaggaaatatggaagttattaaaaattatgatttatatttgtaacaaaaaagaaacagaatataacctatctttgataagacagaattaagaattatttctaccttatgatgagattaactttccttattcataactttttttgtttgtttgttatattgttgtgtctggttctagcatgatgtaaagaatcatcgcacctttttaaagcggaccaaatatgataacctgcacttggaagatttatttataggcaacaaagtgaatgtcttttctcgacaactggtattaattgactatggggatcaatatacagctcgccagctgggcagtaggaaagaaaagtaagaaaacaattatataatctttttacatgctctaactttgggttcaaagtcaatctgaatcaagactgggagtatgtaaccatatgaggatggataggacctggaaaatggttgtcttcattctttttctttttttcaatttaaaaaaaaattgataataccatagttgtgcatgtctcatctgacttaattcatgtttatgtctcctgtggcacttagcacatctccatccacattgcaagcaccttgtctgtattagctgaacgaattaatgaatcacaatttaaaatctatgatctattctttcctttttccactttctccctgttttcaaatgatgatctttgatctagttgaccaggaggtttttgcctagattgtttgtaactaatgctgcctattgtcaagttttgttaacagatatatatatatatatttatatctaatagatgttgaccaacggatcaattgaaaaatgacaatgtgagt

SEQ ID NO: 56935 - DNA, 1030 bp, Homo sapiens
gcttgtttttgtcaggtttgtcaaagatgagatggttgtagatgtgtggtattatttgtgaggtctctattctgctccattggtgtatgtgtctgttttgctacccataccatgctgttttgattactcatgctgttgatttctattataatgtcattcaaggtgaatgtgggttcatggagactcagactaaactttagaagcttgttgaactgtaacctttatcatctacataatttactccagaatgtctttgaagtcaaacagaagcagatacttggcttgaaatagattgactagttactgacccttcaacatgcaaatcatgaaaataagacttctagttagtttaagatatttctccatcatgcattatggaatccatttagtatgatttaaagaagggagcacttttgtatgaacaaaaatattttgctgcctattgtgaagtaatttttcctaaaatacagcattacaaaaatgcaatgtacatttttttcagtgcactgttagaattacaagtctgataagtatgtcctgatttttattgttgtggttgtgttggtttttaaaacctgatttgtcttaatagggggttaaattgaaagaatatagttgctatttctagaaatcgagcaaacactgcagcttatataggctgcttagtccagtgtctctcagaagggagtttccatcccttcttgccacagttaaggagagtgtctaagagcagatctggagtcaagctgcctgggttcacctctgtttataagctgtgtgatcttggcaaatttctttttttttaaaatattaaatgtttatgggtacatagtagatatatatatttatggggttcatgagatagtttgatacaggcatgcaatgtgaaataagcatatcatggtgaatgtgctctgtcccctcaagcatttatccttttgatacatttatccttttgatatccttttgttacaaacaatgcagttacactctttaagttattttaaaatgtacaattaagttattattg

SEQ ID NO: 56936 - DNA, 1485 bp, Homo sapiens
ggaaaatttgtaaggagcttgataaaatgaatccagggttttaaaaaaagaggttctgttacacacacaacacacacacactaaatagacatacattgtggattaaaccttttttaaaaatgtcatgagaaagatattcttgaaatgatttaatagcattttttaaattattgtttttaattgtttaagatactgttatgtaatttgttagatgttagaaagcaagcgaaaggaatttattagatgttagaaagcaatggaagagaattcactgaatgtcacgcatattccataagagtggctgtttgataatttcatcaataaatttaaaaactttaaacttatttggggctgactgggcaaaggataacccccccaccccagattgggtcctcttttatgcaaggaattagagagaaatgaaattgttgacctggcacaagctatcctttcattaaaatgtttcctaaagtcccgatgactggaggggatatattaaaaacaaaaggaggctgctcttcctatggagtaggcattcttttattcctttactttcttaataaacttgctctcacttttctttaaaaaaagaaacttattaacttattctttaaaaaagaatgggaaatctctttttcttaatagttaatatctatcacttattgaatgcctactgtatattcttttcacataaggaaacctcagttttttaaaatacccaagattatacgctagaaagcggtagggcccaaatttgaacctatttagcctagaacctcatgttctttctagcctactacttagggtcacgatgtttaaaattttttttttttttgagttaactctttcttttgcttttatgtagctatagaaatttaacttccttttcaaaaactcagtttctagtggatataggtgatatacatttttttcaggaattcataattcatattttgatacttgactagggctctgcaaaattactatggtttaatgaataactacagggctaaaattgagggtatttgtgaaatggctttgtgaaatggctttgtgaaatggctttttgggcaggatatgttaaatccacattgaacactaggtggcactcttccatcattggacactttcaggaaaagctatcctttatggattttattagttgcttattaattttaatcatattgaagtggcattcgaatgctattcatctagaaatcacagatgtacacagtatcacagattatttctcataaagtcaaagacacacgtttttctttcctaaattagaaaactttagcctaaatgatgaaacaaatggtcatctttgggattaagcttgaaaatgtgggtttttttttttttttgcttttttttggaatctgttactttaccaaaatatcctttgacttatttttaaaaacttaatcaggaaactacaaaataaaaataatgtttgaattacatgaggtaatataggcaaat

SEQ ID NO: 56937 - DNA, 1029 bp, Homo sapiens
ttaagatagagacctactgaatgtgggaacacagaagagaggctaatgactgaaagaacgctaattaaaaacaagattagttgactttactgctttttctctgcaatttttcattcactgagcttcaggttttctttaacatgtgaatatgtataaatccaaaattaaacttatgcatattaatgtcaacattgattccctaaagttactggaacgcatttggaaatgaagtaggaaactccgtcattgtggttcattcttcagggttcagcctagtgtcctgtacaattaagtgcttcacagatgctgccccctaccccactttcttttaaacatttttgttcattgacccagatgtccctttgggtgagttttgagaggacacaagatacacagagttggtgactattcagaattatttgaggtagttcttattcatataatttttaagcaattctttttggtttagccttctgagatatacattttcaaagtttacatctttttttttccagttttacatacacttcagctgcacttactattccatttgcctgaaatgctcctacacgttttttcagatgtatgttcaaatgacacctcatcagagaggacttccttgtccacctttctaaagtaacaactccagttgctctctgtccccctaccagcttcaccttcttttttcactttagcacctgacaaaagctttgcaaatctgccattttaacgatagtgcctgacacttagagaatgttttctatttttaaaggcatttaagattcttaactaattgatagtgtccttggaagtaggtattgtatttacagagaaaagatatcaatatcatcagggagcagaaaggcacaaacatccaaggaagaaagataatcctctgaaaagacagttgagaagaaaggaaggtaactttccactgaatttccctgctagttacttggtagagaccaggagtggacaaacagttttgatcaagggctgttcacctctagagaaaaatctagaattatg

SEQ ID NO: 56938 - DNA, 1048 bp, Homo sapiens
attttaattttaactttttattaccaaaaaagtataaattatgttatcttgagtaatattttttgtcgtttgttaaacatctaaacagaagctcctttttgatatgtgtgtgtgtgtatacaaattgtgtcggtatgtctcctaagaaagtaattactttaaaattcctcttgtcatatggatgacaaaaccaccacagtaacttcattccctttgcttggctaaaattcaggacatacttctgacaatttagagtgtattggtgaggatggtgaaacggagtatttagaagtaaaccacccctaatttttttttttgagacttttagtagacataacaatgccttctgtgagaatgggatataagggacatttctctttctaaatgcatgcgtactaaatacagaagcaattaaaatatcataacttttaaattggaggtactctatgtgtttatatgatatttttaaaattatttcatatgcatacatttctaggttgttcagcagaagtcttggagtgcattttcagtggttaaggtgaaaaaatgactactaaaaatttagaaaccaaaggtaagtggcttttttataattgtttttaaaacatgacatttatgacgatgtgaaggaacgtttgagccagataactagatctcatggacccccttgggaatcatttgttatttcagatccctttatgtttattttttagtgcagtgtttatatttcagtactttagatgtacaagtgaaatttaacatcattagttagaatttattaggtgactactcttaaacatttaatgttaatgcaaagtttttaacagctatattccctatacactagaagattacgatttaaataagaatacacattttaaagatttaagtagatagacaaagcaactagggtgtatcaaagatctctttcatgttgtattagtttgctggggttgctgtaacaaagtaccacaaactgcatggcttgaacaacaaaatgtattctctcagttctggaggctagaagtccaagatgaaaatgtcaaca

SEQ ID NO: 56939 - DNA, 1058 bp, Homo sapiens
accttctttgttctttccctacatttcaccaatcctggtaggcaatacgaatgagcaaaccttagatatgttttaattcattgataattgatcacaggtggaagtaatgatgatgaataatttaaggattgttttgttggttcccttcaaatagtggggaagaataaggattggtgtttttcttgacttaagcgttactcataattatggagctgttaccataggtccttgtcttcccaattgagagaaggtaattattcgtaaatgtgtcctggattgtgcctactgcatatgtaataaaggtttctaggtatgtcacaaggaaaaatcgaattacgaaagttaccaggtgagaaaatgttaagccctggctcttacggcctgtttacctatgcacattagctagaatcatagttattactgagcgggagctctcacgtaatatataatacaactttgatattcataaatgcttgagtaagtagaacagtttaaataaagttaagagtaaattggggtggaaacaagttggttgaacttcttgattttccaacaaggtattttgttcaaaaagagatttctgttaaatacctattaatggttctttgccttttaaatttaactttaatcattttgtaatttgttcttgaatctctgttacttaaaattccaactcaaaaatgttacagcttgcctagaaattttatttgaccataatggaagtatcacacctgttttttatttcctcagcctcagtgggcctgaaccatggctgtagtgcgtgtttttattgttgatggtttttattaatttatagttaatacatgattctgtgttacttcttaaatgccagaatgtcttattgacaagattagacaagttagttaagtttagacaaacttaaaatcagattttaagaatacaggtagctgggtgtgatggctcacatctgtaatccaagcactttgggaggctgaggccagagaattgcttgagcctaggatttcaagaccattctggacaacatgatgaaaccctgtctctacaaaaaaaaaaaa

SEQ ID NO: 56940 - DNA, 1041 bp, Homo sapiens
tggaaactgaggaaccacctaaatctgttgaagttacctccggagtccaatctagaaagcatcatagtcttcagagtccatggaagaaagcagttccatcagagagcccaggagttcttcagctagggaaaatgctcactgaaaaagcaatggaagttaaagctgtaagaatattagttcccaaagctgctataactcatgatatccccaacaaaaatacaaaggttaagtctctgggacatcataaaggagaattccttggtcagtcagagggagttatagaacctaataaggaactctcagaggtaaagaatgtattggaaaagctcaagaattctgaaagaaggttactacaggacaaagaaggtctttcaaaccagctccgtgtacagacagaggtaagaagagccttaatcgataaaatgagtactactctttacgtctggaccttttaaacgtgcatgttagaaaactacatttctttatgggaatgtcattcatcctagcttgtcagttctctaaaatgcttcctcttaaatttctcattctttctcagttctctagggatactttatattgggaacttatactctaaacctcattgaagatggaggtgtgaggtgctttggacaagaccaccaataagttgtaaaagtaggttacaattataaactgccagaccaaagattgaccaagtcaggcatagtaattgaccagcagtccttgttttaaggatccgtaaattccaagtagttttgcttgtgtatacgggatacttggaataaagagaatggcgatataacttactgtgtcttcattgtaaatgaaaaaaatctgtagcccttaagtgtgttgctttaatctttgcatcttagtaaaaattgccttgccccttcccttgtttctctattagaccatgcatcttttggctagatacaagtcttcataagtgagaccatggttagtgtttttatacaaatatatttttaaataactaatttctcattacaaaatgtagtacaaatttatgtgtaaaaattt

SEQ ID NO: 56941 - DNA, 1116 bp, Homo sapiens
actggttaaataaaattttgtgtatccaatcagtagaaaacatgaagctaatttttgaaaaaagggaatgagatagctgtatatgtgctaatatggataagtctctaagataaattattaaatgaaaaactaagatttagaaaagttcgtattcagtatctctttttgtaaataaagtggataaatttatttttaacacatgtatatgttgaaatatacataaatttttttttgagaagtgtaaaaaaactttgttgactgcatataaaaggataggtatgctgggcatgacaaaagactttatataaatctttttatattaatatttttctgggggcaaagaggtaattgagtgaagaagataatttagttttgtttgtctctttaagtttttctgtatttaaaaatatttaataattttttctttcaaattttggtcaatctagagtaagattgagatgtactccaaaagtcattatataggaaagttgaataactcttgcctttgtcattgtctaaatgaatattttaactgaatccctttaatgaactctaagctaataagcatttttaatgctctttagctaaaatttaaaaactgtgaagtaactatactgttaaatctttgttagcttctgaaagtgacagtcacaaagtagtatattcaattttttacactgtattattgtcagcaaatttatatgtaagattttaatctttttcagggtaatggcagatgagttaaccaactcaagagcagctttacagcgtcaaaaccgtgatgcacacggggctatacaagatctcctaagtgaacgggaacagtttcgtcaagaaatgatagctacccagaagtatggcacttgtttacattctgaactcttctgctttctcctgcaaattaagttattgtagttttggtttttttgtttgtttgtttttgttttgggtgtgtctacatttgataacttactgagcatatacttttagtagcattttaaaatagatgctctgggagggaagaggactgaaaaaatagaaggcatgcttttcacattcttaattggggaaataattagttatatctgtagtagaaggattctctggatttaaaag

SEQ ID NO: 56942 - DNA, 1239 bp, Homo sapiens
ctcaagaacaaatagataacctgaatagccctaacctattaaagcaaatataatttatagttaaaaattaaatattttccagtaaaggaaattccaggtctagatggattcactgatgaatgctagtaaacatctaaggaagacataaaaccaaacttataaaaattattctagaaaacagaagagaaggaaacaatttccagctcatttcatgagaccagcattgtcttgatatcagaaccattagccaaaacccaccaactaatatctctaatgaacataaatgcaaaaatccttaacagaatttcagtgaatcaagtccaacaatacagaaaaagttttatacattttgaccaagtaaagtgaatcccaggaattgtagattggtttagcattcaagaatcaattaatgtaactcaccaaaaaagaaaaaccgtatgaatatccccatagttgcacaaattatgtaagtagttcctatactaaaagatgagaacaaagaaaagtactgtttgttaaatgattttcatacaacaacctagtagattaacatatgctttctgtagtctaacttacttgactaagacatccgaatttatggaactctgagagagaaagggatcagagaaagatgttatataatttcagaaatatttgtattacctatttactattattaatttttacattttgctctcttactatgtccggtgttcatgtgtgttctatgcagattattggaggagctcttagtttccttgcaatggggaagagagcaaacttactcccctagtgtacaaccccacagcacagcagagctagcattaacaaatcacaagttggcaaaagcagtaaattctcatcttctgggaaatgttggcattaacaatcaaaaaaagattccatcaacagttgaattctgcagcaccccagctgagaaaatggctgaaacggtaaaatattttcttttgtgatctatggaacttctaacactgtccttttactgaaaggtgacatatcatggaaagcatttggcattaggaattaggaaatgtgggatctaaaccactcatgctattgagtgtgttatcttggagaaaattatttcctcttctgcgctttaatattttctaacactactgttctatttttaaggacaaaaaaagtaattgttttgaaagaggtcctatgttttagctattaagtcactgataatccttttcatgagttcattttgat

SEQ ID NO: 56943 - DNA, 1062 bp, Homo sapiens
tcttctttctctcctttattcctccaaataagagctctttgaacttttgaaaattccctgaagatactatccatcatgaactttgagggaccacgaaataagccactcctactagctttttcttatgttaaaattatcatggctgctatctttataagaaaattcttatgactgaaaatccttatggccaccctttacaataggaactacagttttgaaaaatgggcttagccattttaagtaactgctgaaagatattcttaaaacttaagcgtgatgtatttggtttggatactaggaatgcaggtaatgaggctggcattattatgaaaaattgaagagtaggaaatatattcttgtaggatcccataagcagggcttcaaaatgtagttcttgtttatctaaactaagtaaagcttgtttttctaatcagcaggaaaacagagatccacaacaagcttttcgattatggcttaaaaaaaagcacgaagagcagatgaaagaaagacagacagaagaactaagaaagcaagaggaatgtttattcttccttaaaggaacagaaggccgggaaagggcctttaaacagtaagttaaaggcagggcatttcccccctcctccttcctcatgttcattttaaaagttatatcatcaattaagattggaaaaaaaaaaccctcaaaatgttttctcttacagcacgtacctattcaattttaaattcatgcttttaaaaatgtataattctttaactctattatatatattatatatatggagttatatatatatatgcataccaatttttcttcaagatacttttcaatacttaaattatttcttatggcaccagtgtgatagcctttgataccttatcatttattgtttacttatttctgtgagaaatgggttgaagattggttacagcttctcctacatagccctcagaaaaactgaatttacaaataaatgcaaccaataaaagttgcatttaccagtaaaagaaaggcaggtggactaaggaggaaaatctgtatagaccaaaggagatttgggtaca

SEQ ID NO: 56944 - DNA, 1006 bp, Homo sapiens
atcgaaagtaaaaaatacagttaattcctactttctgtgaacttgggtaaaatcatggggttatgctattaaaataaatgaaaaataaagcaaatcctctaaacacatgaccttttagctaatatttaaaactttaagactgaattagctcttcttggcaatgaatatagagaacaaagtaaagggtcaaagtctgagtcacaggaatactcctaggaaaagtggatgcattaagcatggtcatatactatttatcagagatgaagaaaggaactccaggaaaattaaccagttcctgcatcaaggtaggttatttctctctctctttacatgtgtataatgtgtatatgtatttctgtaaaacatatatatgtatatatgcatatgtatgtgtgtatatatatgtatatacataagttagtgtcaataagtagaaaaaggaataacactaggatataaataggtgactttggagggataatgatcagagttatagcagaagccagttttaaaggtgttaaggaaaagactatgaggaaatgcaggttttatattacagatttcttagttccattttgctttcttatataatggaaaagacaaatggaatacacaatgtttgaagatggaaacagagtcaaaagtgaagatttttctaagatggcttttaaatgggagttttatgcatcctaacagaaaaataagcagaatgagtagaggcagatacccagagtggtaaggttgaaccaatttctcaagactggaagggtgtgagatccaaagcacagtgcgatagaattagagaggtaatagggatgatttattgttttattttctaattcaacaagtattaatgatcacctatcatatcagaggctgttctaggtgctagggatatatatagcaggaataaaataaaagtgctgttatgaatcttacacattccagcggatgattataacaacctcttcttttgaggcttttgggaaaaggggatgactgagct

SEQ ID NO: 56945 - DNA, 2310 bp, Homo sapiens
aagcgtagacatatatttatgaatgtgcatttcttgacttcacagcagccacttgactaataccttgtgttccgggaataacatgatactattcagaggagccagaagtaaagtttatttcatggattatttatgagagctaatttaaggatgactttttttctgattcaaaagtgaacttgattttaaaaaccagtcaagagcaatcaaagcagcacatggtgttgtatacttcattagcaagtgagtttggtgttttataggtcacatatgtctgtatctacttagccagatgcttggcctggtgggaccagggctccacagaggccacaaaatgttgcaagtcatgatggatggaaatatgttctaacagcatctgcctctattcaatttaattcttatttctgtgttactcatgtacattggtctttctacatagttattctatcactggcaatatttgttctggtttagtgttctgtattttaaggtgtacgtatcatttctaattttaagttattttaaaaaaattcatcatatgaatgttcttggttcccattgtgacgattatttatttctgtaaaatttgtttagaagtacgtttttgcattattcatatgcttcccagagaagctcatttagttagaaaataaggcaagttttgaagcctgctaaatgaagagacttaagaaagcttaaggtacgcttgcttgtctttaaatcttcaatatgaaggactattaattccaagattaaaagttcatatataggctaaagatgtaactaggccatttgtatttgtattcccttttatttccaaaataaaatgaaaaatctttttttaataatttcatccctatttatagtttttatattaatttgtttttcttatccaagtaaagatgtcaataggaattgcattagtccaaggcctttttcataaactgagcctcttttcaattatttcaatgggacaggaactaggatagatgtgattcctgcatttttttaccttaaatctgcctttgtttctaaaggtagatcatcttgaatatttgcttaaaattgctagtgatttcattaccaagttacttgaaaaaatgttctatatgcatttaattctgaaatcagtctaccaaggggctgctagtatatgtcagacatgaaaactattttaaagctgactttgttgccttatcttgaaaagaatctagataggtgcttttaactggggtattaacttttttagaatgacacagctgaacagtgttaataatagtgtgtcaagattgcaaagtcgacatactcatttggtttaagcaggaatcctagaagcaaatggatggggataagaataggtcattttctattcaccatcctttactattaagggaaaggaaaagaacactagctaaggaagggaaagggaagtgatatcataaaagtagcaaccttcattttacattctgtctgtttttctttttttgctttgttttgtttgtgctaatttgggaattgtgtactccgaaacaagtagaaaagtgctgtttgagggattttattaaatctttttttaatggaatgtggtacaaattgttcatgttaccaaagcaatatttccctggaatttaattcaaagtttgtggcatacaacctgagccttttcttatataagacaagaatatgttcacatcttggtatgtggccatatttatagaatgctgaactcaatgtgcaagttgtactgtatgcagttttgtaaataagtgaaaataatttgttgtactttttattcaattctgtatagattataaaattatttttattaaataaatattttacagtatattttctctttttaatcaaaattgttttaaatttatcttctatttcagtaggagctttagattatatctttaaatattttaataatttatcctaggacaaatttcatattaagtcttcccctggtctaacttgcctagttaaccttttgttatctttttaattattccattgctttgtgatttttacctttgactcttcccccttatttcagatgttttcccccttttttttggcaccccgttgcactgtttttttttttttttttggttttcatgttggcactgctcttatctctttttaaagcattcttccttaaaaaaaaaaaaagacactctctttgatgttaactgaatttttacaataaaggaaattaaagcaagagcagaaaataccaccttgttctgaaacttcatagcctctttgttccacctcaaattattctgatacccagggaggaatctt

SEQ ID NO: 56946 - DNA, 1039 bp, Homo sapiens
gttgtcttcagaatcatctacatgttactcatcacgatagcaacgtatgtattttggctcatagaagccttaggaaaaattgtaacaggataaattttttggtttctttacaaaccaaaatattcaagtttctagttaaatgaggcaaatgggaggaagcattgtattatatgtgcattatcagtttttctcctgaggaagcatttaggcaagttttgtttattcccatgtttgtatgttcctactgttttcagatgtttgcatgagatttatatcatttagttgcagaatgttttcatttggttggaaaggcaattgacagtagaaagaaggactcttcatgtttaaagataaatgtttacttttatttagaataaatattataagtactccagaagtaattcttatttattcactcttttatttttttttaagttttcaaattgctgcaaacctcagcatggaacgctatgccctagtatttggtgtaaataccttcattgccctggcactgcagacgctgctcactctaattgtggtagatgccagtggccttggattagaaattaccactcaggtaagatctctcctttggcatcgaaggtagtatgtgtgacttgatcagggtgacagaagtatatgtatgcttaatgaaaacaaatccaaacaatagggaacagatgtaaagtaaaagcataccctccttccttcattcaacatcttctcccctatccttagttcttttctcctgggagggtgttgggattgtcaggtcttagaacattcccgagtgtaactcatcagcccaatggggctgtttcagctgagaggtaatattgattccttacagaccaagaccttctgcttcctcatccattatttccctctatacttaaatctatgcttggaatactgtatcccatgtttgagattccctgcttcatctcacaactctttaagtctcctcccttctttatttaaaacacccctcacccaaataccacggtaatgccttgctgctgatgaacaacattatgat

SEQ ID NO: 56947 - DNA, 1777 bp, Homo sapiens
ccaccacctagagagaactgctaatattttggtctacttctttccaatatttctatcttaactgttggatcagtctgtcaattataacgataggaggccttaactgaatagtgatttattagggttgctagtctgttgcttattattattcttgttatgttgtttgccagtttatgggagatgtagattacagactcccattggctgaagcctgcggtctcttttcatcatcttcattttgtaaacagtacatcttttgctgggttgattacatacagctgtgttaatgctatagtgcatttaaagcaaaaatcctatgagaacatatttttcgccagaggggataaatgtatttgttaataagtttatgaagtaagcagttagttttcacaaggaaaaaagtctgttaggtaagtaattgggcctgtaaattgctttctatataattgccttcatcagagtttgagcattgttcccttttgctatgtaggaacccaagccagaccgtctccttgtattgaaagtactatggaatgatttcctgatgtgctactcctctcgccctcttctctgctggtctgtgtggtgggccctctctacctgtggctattttcaagttgtgaactacacacagggcctgtgggagaaagtgatgccttctcgctatgctgctatctataatggtggcgtggaggccgtttcaaccttactgggtaagcaatgcaggataatagagggtcgtggtgggggagggattcctctggtagttaagccagccataatcagatttattcacccctcccaaatttgaaatagcctcaaaaaatgattattttgagctagattttacaatttaggaggacaacttagaagtactcaagtggagcaggactatgactaacaaactggaatttttttataagctttgagtaaacctaatataataattttcaagattgtttatccaagtttccattatctctgtatttactgggtagttttgtcacttgatgtgaaattttgaatggcaatatataatagtttataacaatagtatctaatatttgttgaatgttaatatgtgctaggtactgttctatggacattatatacattaactcaatcctcacaaaattcctgagataggtagaatttatccccattttgcaatggaaacttgggactggtaggttaataacttgctcaaggtcatatggatggtaagtagtaaagtcaagacttgaactcaggcaggatggcttcagagcctgtgtatttgaccatcttactctattgttcatttctaatttgttgacctacctcctgaggttgttggatggtgttatatgatttctgtaaacacttattatctgtcttggccctcagaaaacacttcatagattttagctatccttatcatcatcactgttttaccaaaaggcagagaagcccttttgccatgttctagactgctccttggtttgaaggagagatgactcatcctgccatgatgccaaattagaagctatggttctttttgactcttgcctctgcttcagctgcagcattttttttccttagcaatgtccctgtgtctttgtcctgcattttcatctcattgccacctctcctaattcagtctgtcatctcagtggctccattttattgattccatcaagttcagaaatttctgtgtgagtttcaaggccctccataatcttgagctattctgtttataagtttgcagattttaaaatttaataatctaagctgagtt

SEQ ID NO: 56948 - DNA, 1290 bp, Homo sapiens
tgggggagggaaggaggtgtgtaatcatttcatagattttatgaagtggaaaaaaaataaagacacttctttatctgttttgaatgtgttacagtggctttagctaaaattaacgtatatacagataatatgtgtataaatatatattttagatattaacatattgaccatagttctaaagatttttatagacagtttcaaacttttttgaatataagtaagaaacatagaaaacattttacatagaaaacctgtacatacataggtatgtatatattttatatataacagaaacaagttttacaacagtgttttattctgatacattcttttattttttttaaattcagttcactgtcctctaaatcaattttattgccaacttatgggtgatgacctatagttttaaaaactgttctagatcaacttgaaatacttgtttatagatacacagtgtgtcagtattttatatactgaagaattgtagaattttagagttagaaatgactctaatcacaagtcatagaaaaagcagagcattttaaaaagagattagatttcatcaagactgtccttttagagataaggattaggatcagagattagcaacttatgcagaattgtacaaatatactcttgaacataatttaaaagtgtgtatgagatccagttctttctaaacctttctcggtgaagtcttttaactggggtaacaatgtcagaaccatcatgtcagttacactgttttcagaattaggattcaagtcagttccctgatatcctaggctctgctactgataccatagcagatgggcagtgctgcttggtattggcactgactggccctaaaatgctgctgtttttctttggcaagcatgaagaaaattcagaatatggatattagggatcacagagctattttaagttgacaagacctataattaaaccataaattataattgtggtaattattgaagagtaggtaggtaggtggttttatcttgatttttatagaaagagaaaatgaagtaagaggagtctaagtgatagctcattctacaagttaccttagagtatttgtgagttatttttaaagagagtctattgcattggggcaaagggtgctgatcttgcagaaagaagaaccaaagctggtgactttcttttacaagcagagctggattcattatgtagttggctgattggtgaaactgatttattttgagttcttcatctattagaaatgacataaattaaaccacttctttagcacaggttctgacatgtaat

SEQ ID NO: 56949 - DNA, 1092 bp, Homo sapiens
ttattaggaaaaagatgatggtattggggataggaaaggatatttcaggctgggcgaggtggctcacccttgtaatcctagcgctttgggaggctcctcatttgaggtcaggagtttgagaccagcctggccaacatggtgaaaccccacctctactaaaaatacaaaaattagccaggcgtgatggtgggtccctgtaatctcagctattcgggaggctgaggcaggagaatcacttgaacctgggaggcagaggttgcagtgagccaagatcgtaccactgcactccagcctgggcgcagaacaagactccatctcaaacaaaaaagagagaaaagacattttcaaagttatctgaactgctgttgtcaaggttgagatctttgaggtatttgtaggttgttttttatgaataaattctttatgagtattccaggtcctttcatcactaatgttttttgttttttttttttctctttctaccaggtcttcaatgaaatttatccagtatggacttactcttacctggtgctactgtttcctgtgttccttgccacagactacctccgttataaacctgttgttctactgcaggggctcagccttattgttacatggtttatgctgctctatgcccagggactgctggccattcaatttctagaatttttttatggcatcgccacagccactgaaattgcctattactcttatatctacagtgtggtggacctgggcatgtaccagaaagtcacaagttactgtcgaagtgccactttggtgggctttacagtgggctctgtcctagggcaaatccttgtctcagtggcaggctggtcgctgttcagcctgaatgtcatctctcttacctgtgtttcagtggcttttgctgtggcctggtttttacctatgccacagaagagcctcttctttcaccacattccttctacctgccagagagtgaatggcatcaaggtacaaaatggtggcattgttactgacaccccagcttctaaccaccttcctggctgggaggacattgagtcaaaaatccctctaaatatggaggagcctcccgtggaggaaccggta

SEQ ID NO: 56950 - DNA, 1022 bp, Homo sapiens
atctgttttcccttgactttgtagctcaagaaaacacaagcactgatccaaagagttgtgaaaggcaccttggtcataataaaatcaattcccgttgctcacatagcagatgttacgtgaagtgagaagttggagtatggacaattaataagggtctgtaattggtacatttttgcctgtaggatgtttcccttcaagattcaaaatatcaaggaagcattttttgctgtcattggaaacactgaaaaagaaaaggatctgccttggagacccattagttaagtgctggagactgtagtctttatctcttcatgaatgccctgtaaaagcacctcagtgcagattggaaaagctactgcaagcattagaattaacctggaagatagtagatgattaatagcagttttctgattgaagaaaccaggcattttagtgtggcggattcagaatttatgaattcagatccttcttctgccaatcctgtgataacttgggacaattcacttaacctttctttaaggccaagtttccttgtttgtaaaatagagatgatagaagcatttaccttaggtttgtggtttggattaaatagagagaatttagagaaagtgcttagcgtggtgtgtaacacagcagtagaggtttgttattatgatgctgataatagtgtgagtggggcattccccctgggttgatgtcttttaaaggagaaaatgcaggtttcttatttagaataagttaaagagaaactatctggtcttccccctctcccctatttgcctttctttttgtttttagttgttattgcaaggttggcagtgttactctcctccatcttcattatctaaattgtagttttgtaatagtagaattagactcatgagtaaagatacgttaaattgataatttaaaggatgaaacttagacaatgaaaacttagcagttaatcattttgggacaactatggttaaaagttatgtaacatgtctaagcacagacaatattattggagtgaagaggtc

SEQ ID NO: 56951 - DNA, 2198 bp, Homo sapiens
tttgtttgttgcaatgctccgtcattttcaagggcacttgagagagaattaagaatcagtattgacttacgtattgagggtttcacttgagagtctgacatttgttcacttctagcaagtatcactgactttttgcctggccttaaattaccctattgacctgccagttgtgggatggagtggctgggccgtttctcagtcttgtggatcattacataagcgaccgtaacagttattcataacctatttgagttttaatactgatttaaagcaataatgtcaaaacagccaaatttcatgacagaatgattttacaagaaaattactgcactgatatgagaaagtatgattctggagacccaaaacaaccactgaatctgaggtgtagccactgaggcagaattgatactgctgtgaacagctgaccattaaagtttcatgtgaactgccatgtgatctgcacagtttgtgcgcctttccggatagtgaaacacagggagagaaacatgttcccagtgttgatatttgaaagctgatctgttttgtcatgtgctctgggtagaaggttgctgtgtgacgtgctaccaagatcatgtgctctgtcctatcagaaagcttttcaaggtgagtgaagtgtgttcagggggcacagaaataaagcagagttgccaggcgtagtaactatttgctgattgtgtaacaaaaaacataagtgtacttctcttattgcaaattagttgaggaaaagcgtgggatttgaagagaaatctagtagtctggggaaggggtgtcttctcagaggaccaccaaatcatggctgattctcctctgcttaccttgtggcaaaccctacgtttttttgtataactaataattgaaataaatagaacaacttattcattacttactgaatgcttgttttttgccatggacagttaaataaaaaaaattacatgatttttaagcaaagctaatgctaagtcatattcagcgacatttgtattaaagtttgtatttgctcttagaagactgcagaagggccaagttggtttgaatagagctattgttaactaaatcctaaaacaaaaggagaggagaaaaagatttcttctgtctactctcaaaagtttttttcttagatttcaggaaaagcattaattttaaaacagataccagtgtgtaagttttaagcaggctaaaatttgactgtatgttaatagttgaaggccagactttcagtaaaacagatctttatctctaaaaacttttttatcctttcatcattgtagcatgtgttttgacagacatttactacctttcttagatttttttaaacattccacctattttgcctgatattcagagcctcacgaagtttggtttttacctccttgacagccttatatcctactacaaaccttcttccccttaccacttccacataaccaagctccattcatattaatctaatagtcttaagtccagcatatccacagtctcatctgttgacatgtactcaaagacttattctcttcttggaataatcttcccatatatatctgttgatatctttgttagcctttaggtttctcatccttcaaggtccattttgaagaaacaaccctgtatttcctatttccattataaatactgcatatattatatattcctcactaggttcaatactcctggagagctgaggatctcagtttatttatttagagacagtcttgctctgttgcccaggctggagtgcagtggtgcgatctcggctcactgcaacgtctacctcccaggtttaagcgattctcatgcctcagtttcctgagtagccaggattataggcttgtgccactactctcagctaattttttatatttttagtagagtcggggttttgccatgttggccaggctggttttgaacccctggcctcaagtgatctgtccaacttggcctcccaaagtgctaggattacaggcatgagctacagtgcctagccttattttattcttttttttttaaattttttaattttaattttaatttttattttttgagatggagtttcgctcttgttgcccaggctggagtgcaatggcgtgatctcggctcactgcaatctctgcctcccagattcaagtgattctcctggctcagcctcccaagtagctgggactacaggcacacgccaccat

SEQ ID NO: 56952 - DNA, 1351 bp, Homo sapiens
gcggcggccactgtgctcctgcggaccgctcgggtccgtcgcgaatgctggttcttgccgaccgcgctgctctgcgcctacggcttcttcgccagcctcaggccgtccgagcccttcctgaccccgtacctgctggggccggacaagaacctgaccgagagggaggtacgcgcggcggacgcggggcgcgggaagggcgggcgaccggcctgcgggtgggcagcggaggaagagaggaccgagaaaagcgctcgagccattctcggcagagatttctgattttgccagttggaggtcggcttcgtgctcttctttgtgttcatgattttctgttttcttcggctctgtaggacgagtctcctgcgaagggctcagaacacgcgtccagaggccccgtgccttgtgcgtcaggcagtatgctgatcgtgttgtaatgtggcttagcgtgactgcccagactggtccagcagttcctgctgggggcgagggggcaatattttgacaaagaagtgaaaacagcaaagtgtactttggacacggcttagtaaatattcattgactgaaagtaggcaaccactgcttttctgaaaggatcttccctctacctccttcacctgcttcctgtccataccttactttgtttgcatttggcagaatgggtgggcttaatcaagtaaggacaggacagaagtacagaacatcttaatttgtcttgatttttaattgggtgaggttgtgtccaaggatatcctgcccctctctaccttaagaccaacctccagggataaaggcagatggtgaaacataattgacttttaattatagtgtttcttgtattgcgaattgttgcttcacagatgttagttttgcttctcagatacaaggtgatgtctttgaaggccttctgtgatgttcagggtaattgagagcacgtagtccatcatcaagagtttcttgctgattgattttttccctagatgagggcttacaaataaagtacttcagaagcgcatagtgtactttagaaatgtgctgacctatttaagtgcatggtcaaaaccagcacttgatttttgcagaagaaagacaatatataaactgagaaagaaattaaacccaaagtacttccacaaaaccgaaataaagccgattcaacaccctcttccttgaatacaacaaagggtgaaagctgaggtctcatgttctttttcctactatcagtcaaggggccacttgagagctttttcttttttcctacacctgttccttccaccctgcctccttgccccaggtgctgtaaaatactcctcccatttaaaccttactcttctctatgtgggtagtagtcagt

SEQ ID NO: 56953 - DNA, 1064 bp, Homo sapiens
gaggattacttgagaggagtttaaggctgcagtgagccatgactgtgccactggactcaagcctgggcaacagaataagaccctgtctaaaaaaaaacaaaaacaaaaaaccttagccatttatgttgtcattaaagattttctcttatttggctttcagatttttgaaggaaatactaataccaaaggacatgtgaagaactttttcaaccccccaatcatttccaggtttatccgtgtcattcctaaaacatggaatcaaagtattgcacttcgcctggaactctttggctgtgatatttactagaattgaacattcaaaaacccctggaagagactctttaagacctcaaaccatttagaatgggcaatgtattttacgctgtgttaaatgttaacagttttccactatttctctttcttttctattagtgaataaaattttatacaagaagcttttataatgtaactccttgctaccagtaagtaagataatggctattacttctgcattaatttgaatacaggtaggaaaatatcaagaaccaacaagaaaagggcttatctttcttaatgattgaaaatgctatgaagtaatatttatgtagttaaaatgcttcattataactcttttaaatcctttacacactagtaaaacagatattactttaaataataattgatagacctggataactttcacaaacacatgattttttaatggtttttcttgagtgaagagaaaaacaatattatcaaatgaaataagtacttaaaatatcctgtctttcccatataacaatgatttttctgactttccatgagtaaaaaaacagccaagcatctttccagtagccccattgaaattgtgaatccgtcctggtctccctaaggactgcacacattgatattcaaggttggtggtcattagatatggaacagaactgaaataaccatggtagaactgaatgtgtaatgttggctttattctagctggtactacatggcacacagtttcaaaacataatttcacctactggaaagctcagacctgtaaaacagag

SEQ ID NO: 56954 - DNA, 1017 bp, Homo sapiens
ttcccacaaataaccaaaatctgtaagaatactgagctgcgaatgtttcagaaaaaaaaaaaaatcatacacctagttcggcatgtaattaatatagatcagaacactttaaaaatatttataggccaggcacggtggctcatgcctataatcccagcactttgggaggccaaggcgggtggatcacctgaagtcaggagtttgagaccatcctgaccaacatggtgaaaccctgtctctactaaaaatacaaaaactagccaggcatgttggcgtatgctggtaatcctggctactcgggaggctgaggcaggagaattgcttgaacccaggaggtggaggttgcagtgagctgacattgtgccactgtactccagcctgggcaacaagagcaaaactctgtctcaaaaaataataataaataaaaataaaatatttatatactctgacccatcaatttgtccagcataattaggcatgtgtacaagggtttacacacaagaatgcctattgcaatattgcttttaatgctaaaaaaaattggggaaaatgctttaaaaatatagattaagactgtacattgtggtacagtcatataatcaatagtatacagctattatttattttcagccactgtccaaaatatagcctggcctaacaacattctgttaggatacgcaagcaccgtgaggagatcagctataaagtatcagtgtttcacaccactgctcctttgctaataaccttcaatggcttttaaagaagtaaaaaacaaaggcaaaattccttagtcagcccttaagactctctgttacttagctcaaactacccttttcaacaacactgccctaaccaggatgagttttttgcccccctggagtacattcagcctttccttatcaaaccttcctttaaataagtatcttctccaggaccacttcactttcttccccaatttagcattttctatatctccaggcctacctctataaagcctgtcctaaccactcaaaccct

SEQ ID NO: 56955 - DNA, 1012 bp, Homo sapiens
acagccctccttgagagctgccaaagagcatgctatgcctaaagatttaaagaagatgttagaaaataaagtcatagaaacattaccaggtttccagcatgttaagttatcagtagtgaaaaccatcttgttgaaagagaacttccctggagaaaacatagtttcaaaaagcttttcttctcactctgatctgattacaggtgtttatgagggaggcttaaaaatctgggaatgtacctttgacctcctggcttatttcacaaaggccaaagtgaaatttgctgggaaaaaagtcttggatcttggttgtggatcaggtttactaggtataactgcattcaagggagggtccaaagaaattcactttcaagattataacagtatggtgattgatgaagtaaccttacctaatgtagtagctaactccactttggaagatgaagaaaatgatgtaaatgagccagatgtgaaaagatgcaggaaaccaaaagtaacacaactatataaatgccgatttttttctggtgagtggtctgagttttgtaagcttgtactaagtagtgaaaaactttttgtaaaatatgatctcattctcacctcagaaaccatttacaacccagattattatagtaatttgcaccagactttccttagactgttaagtaaaaatggacgtgtacttttggccagcaaagcacattattttggtgtaggtggaggtgttcatctctttcagaagtttgtagaagaaagagatgtttttaagaccagaatactcaaaataattgatgaaggattgaagaggttcataattgaaataacttttaagtttcctggttaattaacattcactgagtatccaaaatgaaataaacagaaggaccaaaaatttgagtgtttgatttctgttttgctattattttttctgaaattttgatgttgtttgtttagttttgtttatccaaattgtaagtgagctatgttaccagtcttttactcactaggtgaaact

SEQ ID NO: 56956 - DNA, 1042 bp, Homo sapiens
aatcttgaaagtgaatttctttggaccctcccttgaatgcagttatacctagtaaacctgatccacaaccaagatccaagacttttttcccagcaaatttcactttggcctttgtgaaataagccaggaggtcaaaggtacattcccagatttttaagcctccctcataaacacctgtaatcagatcagagtgagaagaaaagctttttgaaactatgttttctccagggaagttctctttcaacaagatggttttcactactgataacttaacatgctggaaacctggtaatgtttctatgactttattttctaacatcttctttaaatctttaggcatagcatgctctttggcagctctcaaggagggctgttttccatgtggctccaagttccttgaactgctggctgcactgagtggactgtctgtgtcttgagagggagctgcattttccattgacttatgttcccacaagtgatcctgaggcaagtcaaattgttctgcagaacattttctgtccctctcttctcctttttgactttctgagactgacagctcttttgaggaatccagggtcaaagctccatctctaatgggtgttaattcattttccagatggtcttctatagtgaaattaaactgaaaggtcatcctcttattaaatgcacacaatctttaaattcagattcttcaacttctggatagaatttgatgatacacacaaatctgcctcaattattcaattagttttgttgggcccaatttctctttagcagcttatacatggtaacaaatatttagagatatttccaaatgactttttagacgtctttggtcctctttccaagcagctctggaaagaaaaaaaaaaaaaaaagaaagaaaatgatgattaaagcaaaatggcacatttcactaaagtgtaatattaaacagccacccccacccctccctgtcccaccatacagctgctttttcttaaaaagttgtggggaagagagagagataagagatttggacactcatacacaccttaagggt

SEQ ID NO: 56957 - DNA, 1002 bp, Homo sapiens
caatttgggggagaggcgggtcacccagtcccgcggctaggaacgcgcctctttcctctcccatcacgctgcaaggcttggagtcacttccggctgcaggtcccggaacaaatccgaccccagaagtggggacttctggccctcacctccccatttgaatgtaatgtttacagtgatccagacctggggatgcttgcttcccgacgtgtcctgggatcgcgcttctgaaaaagctcacctcacaacgcctcctccggacctaaatcgcgcaccagtgagtcgagtcctccaggggctagagaagcccgactttctttccggccttgagggacccgggctcaccaagaaaccagccgccctcctctctatggttttggagccggcggagagcgcgcaagggttggcgggactgcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctcatatccttccttggttgtcacttctacctagagaagggtgtgggcgggtcgcgaacctttctcttctgtcccttcagacccaccgccaggctgggttatattaccgcggcctgaaccccctcttttctttgtcagtgagtgggatgaaaagtgagggactggaggggaagcgacaaccgtggtagatttaagtaaggctttggccctggaaagcctcgcggacgtgttctgacccaaggttttagcagtggatgtggcgttttcttccattccttctttcagtttttctgtactcgttgcttgcaattaagtgtaaatacttttgctagtggataatgggggaggcaaggactgagacctgcggtatgacgatagctctggctcttaatagtttgaggtaaagcgagatactctgagctt

SEQ ID NO: 56958 - DNA, 1029 bp, Homo sapiens
aaatatgaaacatatagaaaaacagaaaagattacaaaacatctaatctgaaatggttaagattttgatgagaacagtctcatctcatttccgtatattcctgccagcctatccatcattcttcgtacatgtttatctacattaaaattggtgttatattttggaaactttttgtttaactacattgtgaacatttttcatgttttaaaatgtcattttaatgatggcagatcctattcaatagatgtacacacacctatttaactggtccacaattgttggatatgtaggtcgtttcctttctctctttttttttttttttggctactacttaatagtttctctgtatagaatgtggtattttgaaagtgtatcaagctttagattggtagtattcttgcatttaataaagggcagtggcctttgttgactgacatgacaatatttttataaaatttgttatttgctttacagaaattttgaaaattattgtagaaatgtttttacctcatatgaaccacctgacattggaacagactttcttttcacaagtgttaccaaaggtataatactattacctgaaaatacatgttataaggaatctagcctcagtcttagatgatttattattaattatggctctctttttctaatatatcaaatatattcaaaataaaaataaggagtaagtagatctcatgtgagactataatggtgttagtgtgatcattaggcagttaaaaactgttacaggctgggcacggtggctcatgcctgtaatcccagctctctgagaggctgaggtgggcagatcatctgaggtcaggagttcgagaccacccatggtcaacatgatgaaacctcgtctctactaaaagtacaaaaaattagctggacatggtggcaggtgcctgtaatcccagctacttgggagactgagacaggagaattgcttgagcctgggaggcggaggttgcattgagtcaagatcgtgccattgcactccagcctgggcaataagagcgatgc

SEQ ID NO: 56959 - DNA, 1029 bp, Homo sapiens
agggcacttatgtcattcatgagggcagagccctcatgacttaatcacttccccaaaggccccacctcttaatagtatcacattgggtgttaggtgtctgggaggacaccaatcttcaagccatatcatctcacttggaaaaaagtcaaaataaaaccagtagatttaattaatattacactatttatagaagcatgtgatgtatcattccttgtattaatttcctggggttgccgtaacaagttaccacaaactaggtggcttaaaacaatagaattttattctctcacatttctagaggcagaagttcacagtgtgtcaatagggccatgttctctggaaggctttaggggagaatatatttcatatctttctcttagcttctcggtgtcactggcaatccttagcttactttggctttctgtgtcttcacatcatctttttataagaacaccagtgatagtgattaagggcataccttactttaatatgacctcatcttaactaattatgtcttcaataaccctatttccaaataaggccacattctgaagtattgggagttagaacttaaagctttttgggagggacacagttcaacccataacaacccctaaaatcgatatttattctcaattaagtcttgaaattggtttcaaaaagagaatattctattagagtttttaatgtatagttttaacatatagttctttagcccccaattttttttttttttttttttttttttttttttttttgagacggagtctcgctctgtcgcccaggccggactgcggactgcagtggcgcaatctcggctcactgcaagctccgcttcccgggttcacgccattcccctgcctcagcctcccgagtagctgggactacaggcgcctgccaccgcgcccggctaatttttttgtatttttagtagagacggggtttcaccttgttagccaggatggtctcgatctcctgacctcatgatccacccgcctcggcctcccaaagtgctgggattacaggcgt

SEQ ID NO: 56960 - DNA, 1082 bp, Homo sapiens
taacaatacaaaattagccgggcatggtggtacatgcctgtaatcccagctgcctgggaggctgaggcacgagaattgcttgaacctgggaggcagaggtttcatgagccgagatcacaacattgtactgcagcctgggcaacaagagtgaaacgctatctcaaaaaaaaaaaaagaaaagaaaagaaagaaaaacaaataatttttttaaaaggggtcacattcaggattttatgttattttgcatacctttgtgagattatatgtactaaagagacatatttttatgcaaagaatgaatagagttgttttattttaggaatttcttcctttcctctctgattcttgctgtactttgcaccaactgtatcttcagatacacaggtaagaagaatgccatatgattattaagatacaacaatgccatctgtgccatgcagtgcttaagtacctaccattttatgataaaacagaataatttttcttaatgttttagtaatttttatctgctagcttgaaataattggagatagaggcttttgaaagatacattccacatgagttatgcttatctttgtattttattagtaccttatacaggagtaataattagtaggtgataaaatccaatggcaaatataaatatatatatacacaaatatacgtatacctttatttttctattggcattttttaatctttatttttattttgtttctatgaagtttaagtcacttagcctccatttaaatttacattttgatacctttctgtaattcactttacaggacagtcttttttctgaaaccatctcagaaaagaactgaattacagaaaggtatcaaaatttagatgggggctaagtgacttctaaaattgatggtttcctccaaagagccctaaatttgacacaaagtgagttcatttatccagcagtcctgttgcagcttcataattcatttagtgtcccagacaactttttcacacctttccttcctcaaacttcctgtatcttccaacaccttcccaattcctcactgtcaatgacctcacttcctgtgtcactgaggaaaaatggaagc

SEQ ID NO: 56961 - DNA, 1215 bp, Homo sapiens
tgggaggccgaggctggcagatcatgaggtcaagagatcgagaccatcctggccaacatggtgaaaactgagtctctaattaaaatacaaaaattagctcgtgtggtggtatgtgcctgtagtcccagcttctcgggaggttgaggtaggagaatcgctcgaacctgggagttggaggttgcagtgagccgagattgcaccactgcactccagcctggtgacggagtgagatgccatctcaaaaaaaaaaaaaaagtttatttagaaaaataaagcaaatgtttctgtgtacaaggaaaattatttttaatatatacttgtgttaaatagctgaaaagatggctttggctcttagaaatattattctacatggactttatgaagagttaaaagtaacttttataacctctagttaagtcggctcttggtggtgctttagactggtgtttaaactcaagtcctttcctgtttctgtccttcagaacacagtactgtctgctttgcttgcagtatgtaattctgctggtgaagctttggatacaggaaaacaaactgcaattatcgaagttgtgagtcagctttgggcttttttaaacattaaacaggtaaggaaagcaactgatcctttccttatcaaaaaatagaaaatatcaaaaaaagaggattgtactgaaattttccagtgtagagtaaaatgtatctaattcttttgggtgcttggtagacctttataagaacttaaagtacctgtactctctcacgcagctttttcagagtgtgatagcattatattagtaaaatcagaatacgtaatgtgatggcagtccacctacttactttcctaactggttataccctttccccacctccccatctcttcccctattgtttctgttctgtcttaggttaatgtatcctatttctgtaattctaggacctttaataaatcttttgggcaatggagagtgagctgacttaaaggtggaaagggctagtgaatggatgtggctaatttgtatttctctttcccagcaaagccaaaaagccaagtgatgatctaaaactaatgatatgcatcccacacatggttgtacacgtgtttcttagtttgaaaatatagcctgtttgttttctttgactaagtagaaattaacattggcctctggcagctagaggaagctaaaggcaacagccatacttttgggaaatgataga

SEQ ID NO: 56962 - DNA, 1049 bp, Homo sapiens
tggcttcaacaaatacttttcctgatgttcacaaatcattcagtattcattcaggatatctgtgctggagatatagcttacaatattataatgtaaaccaaaattatgaagaagggaaatgaaattttaagattactaaggaacatacaagcctttcagtgatagacaagtaattagatcccttttagacttaaatttggatttcagtcacagctctgctttttgtcctagccatgtgatcttgaacaaattgtttaacctctttgaccctgttttcttatcagtaaagtgaaggtaataatatctacctcatagagctgttttgtaaggcataaatgaggtaataaatataaaatacttaacatattacctgatatataataaatgctcaataaaagcttgctattattattcttatgtgattgaaaatttttcttcaaaattactttgtgtttcttaggtagcagatcaaccttatgttcaacagacattcagccttttacttccactgttgggatttttcattcaaactctagatcctaaactgatacttcaggtaagaataatgaccagattgatactttgtttgctaaggaggttgctaaaactgctatcatgtaaaataactttctagaaatagttcctttaaacctcctcttgttgtgtcatatattgacttgtcttcatcaaggatatctcatttctctttcttccttacagtattgttaatatatggcgctgttaattcagcctttatctgttcttctctgtcaccctatactgagcagtcaatactttttgttattactgttaactacccactgcaaacccctgaggttaggagtcatagttcatgtgttgaaccctgcattcatagcagtttcaaaagcatttcagcagctgtgggaatgtggaatctaaccagtgtgtattaaaagatagcacctattgtttctttgaaaaaataaaattattttgaaagaagagcactgctgaatttcctctttggcctccaacttacatggctaggacaggcagagcctgggtca

SEQ ID NO: 56963 - DNA, 1899 bp, Homo sapiens
actgatttatcacagtgactttcaaaccattttaatatttcaaatattccagaacaatcccaaaacatttattgaactgcttctgtattgcaatcggaaaattgtctgaagggtacattactcgttatctcttttacagcttctcaaaatgaggcttagataaatgaagtgaatttcgtaaggtcctctgaataaacaaggaccagaacaggcatacacagcaggcctactgatacagacagacacagacacagtcttccagcagatagtatttttgggtcaaatgataatacatttcattttgtgctatcagtcataagggttaggctgatgaacctaaacctgtaagatgggttgctcctttactcttactgcatttgctgtatagtcatgcctatgatcataagggagtccagaagcattagtatgacccagcagaagtaattaaagcttacaacacttgtacagaagttaattttgtattatccttagggaccctgaaggaatcatgagtttatcacctttgaggatcctctgggactcttacttaaaatgaatttttggttaaggtagctcataaaactcatctatttgtctttgcaagttgttgaaatgttaaaattggtcttgttcatcaattttttaatagggaacaaatcatgaagagatagttccacagtgtctcagttctgaagaaactaagaacaaagttgtatcctttctggagaaggtactttctttacatggctcatgttttattctttgtcctatttttttttttccgaaattatgtaactgtaaccaacctgagtgtcttcttagcttaaacttttcacagtgctgagcacagtgctgacgacttttactaagcaattgaggccacagaagtaaaacacttggggccaggcgcggcggctcatgcctgtaatcccagcactttgggaggccaaggtgggtggatcatgaggtcaggagttcaagaccagcctggccaacatggggaaaccctgtttctactaaaaatacaaaaattagccgggcatggtggtacgcgcctgcagtcccagctactcgggaggctgaggcaggagaattgcttgaactggggaggtagagattgcagtaagccaagatcatgccactgcactccagcctgagcgacagagtgagactgtctcaaaaaaggacacttgtagttcctctgcctgtagtttggggtgtaatagcactgattatccaggcagtgagatgactaatgaggatccctaagctattaataatcataattaaatacacttgatcacataattaggtaggcctgagaggatgtttactaccatattttgggtataatttaggcatggcttttttttttttttttttttttttttatttgggcagcctcccaagccagggtaagctcagggcccttttttttttttttttttttttttttttggcatggcttttttattctctttgcagccaagacctgtttttacaattaaaaccaaaattttgaatcacaaggttcctatgtctatgcatacttgggaacttagtgtgaggaaataatagttaattgaaatactagtggaactgttaaaccacaaatttagactaccaggagaaactgaattatttgatatattacatgtaatgatgcacgttatatattttacatatattacatatatatttttttaggtgaaatgggcccacttgactcactgaactttattttttagacagagtctcgctctgtcgcccagattggagtgtggtggtgtgatcatagctcgctataacctcaaactcctgggctcaagcattcctcccaccaaagtcctgggattagaggcatgagccaccacacttggcctacttatattacatcta

SEQ ID NO: 56964 - DNA, 1024 bp, Homo sapiens
cttattaaaaggcagaatttgacaccaataaggatattcaaaatattgttttgagcactattagtatagtaattagtatagtagtaattcatgaagaacaacattctgataagttttagtcaaactctcataaaaagaaaatacatttatgaacttgtttataagacatgtaagcttggactatgcagcacttctcattgggagccctttgggacaggatacttgttgtataccacatacaaactaagacactggtagtagcactctgaattgctatgataaaccaaaatgcctttacatatttttctagatgactgtgtaggggttttggggtgcatcctcctacccttgtgatccaatgactagaataaaatttgcatgtaagctttactccagtccaaaaggaaggttctttatatttagaatggatattgtgatattacttatgttttttttccagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaatctagtgaaaataatctttatttgacatttagagaacaggattgtggggaatattcttattaagaactttggtacaatgtactacatgtggaacagtcaggaactgcctaggtccacaaagaaccatttactcagatagtctaactgtaaacaaataaataagctgcctaaggaaacctcagcaatttaaaatcatttatataatttatagctaaaattttttaaagttgtatttcataatagagcttactcttatgttaaagaa

SEQ ID NO: 56965 - DNA, 1016 bp, Homo sapiens
agctgaactgggaagataataactggtgacaatagatgtgagttaaactttaggaaaaaggattccctttttttaaaaaaaatcaatacctcaaaagcaggctttgggacaagaaaaccccaaagtggcctgcttttcccatcccaggagctcattatccagtctgtgccaactgaagtaggagactgactgtgagtgctggctaaaagccctgggtggtgaggctcacagtactggtttccaggaggaagagcctttgtgcatttgactgaggccagtttctatgaagagcaagtagctgaggagaggtcgaatttactgctttttccaggacaattctggaagtaaagaaaatgtaattcaagctggttagcttaattttgtgccattctttaacataagagtaagctctattatgaaatacaactttaaaaaattttagctataaattatataaatgattttaaattgctgaggtttccttaggcagcttatttatttgtttacagttagactatctgagtaaatggttctttgtggacctaggcagttcctgactgttccacatgtagtacattgtaccaaagttcttaataagaatattccccacaatcctgttctctaaatgtcaaataaagattattttcactagattcaactttacaaaatttgttttatatctgttagaaaatgtacagacataagtattttcagttgacaaagcatcaaacccagttctgcctagtgataagtttcaccctagagtatgtatgtaacgttttagcttatccatcctttcttggagcgcctccatttccattgaaagccaggctggagcaggacccttttggagtagtgactcagttgcttccaaagcccctgctattgtatgcagcgctgacctgtactcttcttcccaggggaactcctgacgagctctttttgcataaggctggaaaaaaaacataagtaatatcacaatatccattctaaatataaagaaccttccttttgga

SEQ ID NO: 56966 - DNA, 1025 bp, Homo sapiens
ttgagcctgcaagactttttcaggcatatgtaattaacaaacatcccaaggataacactgcctggcttagagcatttctatatttatgtgaatatactgtatgtttggatatttaataaggattgaatgcactagttattacttacatgcttccactgagttaataatgtaagtattatgtaattatttggataacatgtgacatcgttgatcttgagtaatgttctgctgggatctcttttgtttagtatgcatggatatttccaagtaattagacctatactactacacttccttaatgctatccttcccataagtgtagttcttacctttaaccagtattttatgagaataattattttccctacaggcgatccattttctcagcctattaaatttcccataaatggactctcagatgtaaaaaatacttcggaggacagtgaaaacttcccatcaagttctaaaaagtctgaggagtggcctgactggagtgaacctgaggagcctgaaaatcaaactgtcaacatacagatttggcctagagaaccttgtgatgatgtcaagtcccagtgcactaccttggatgtggaagagtcatcttgggatgactgcgagcccagcagcttagatactaaagtaaacccaggaggtggaatcactgctacaaaacctgttacctcaggggagcagaagcctattcctgctttgctttcactcactgaagagtctatgccttggaaatcaagcttaccccaaaagattagccttgtacaaaggggggatgacgcagaccaaatcgagccgccaaaagtgtcatcacaagaaaggccccttaaggttccatcagaacttggtttaggagaggaattcaccattcaagtaaaaaagaagccagtaaaagatcctgagatggattggtttgctgatatgatcccagaaattaagccttctgctgcttttcttatattacctgaactgaggacagaaatggtcccaaaaaaggatgatgtctccccagtgat

SEQ ID NO: 56967 - DNA, 1060 bp, Homo sapiens
tactggttaaaggtaagaactacacttatgggaaggatagcattaaggaagtgtagtagtataggtctaattacttggaaatatccatgcatactaaacaaaagagatcccagcagaacattactcaagatcaacgatgtcacatgttatccaaataattacataatacttacattattaactcagtggaagcatgtaagtaataactagtgcattcaatccttattaaatatccaaacatacagtatattcacataaatatagaaatgctctaagccaggcagtgttatccttgggatgtttgttaattacatatgcctgaaaaagtcttgcaggctcaaataagtttgcctaactcaacttattaacctcactttaagaaatttccctaagtgtagtagttaaggcactgagagatcctgtgcaatgtgttaatgactttgctctcatttccccaaacttatttaaccacagaactctttttcacaacacgcccattaacatctttcaaaactatcattcttggtacaatttggaagatgctgcactaaggcaacaaaagtctcaaagtaaagtatcagtgcaaaaaagaattcaagtaatgtcaacctgcacttctcaccaactataaagaggaggtaagtatatatccaatagtctggagaaacaagatgagaccaaagctgactacataattacaaataaatcagtctcaaaactcccaaaacacccataagcttattagtctcaggaaaacattcatccaagcaatggaaaagctatataaatttaatatttctacctgtctgtaaaagagtattgtagtaatctcgctgtatgtgcttcttgctgttgatgggcgtgctgccagaaaagaaacatttagggaatatgctagagaaggggttctccaagattggcgagatctgactgtgatggctgcagacgacacacataggagaatctgaaggtaaataaaaactccaaaacatgaaagggacagtaaattgcttcttgatctatcacatggttggtgggcatagttaagtgaaatgggtat

SEQ ID NO: 56968 - DNA, 1116 bp, Homo sapiens
aatatgataatcataaaacagcaatccgcccaagccaaaaattggtcatcctcaacacctcttccatctaatgagaaactgagtactaccccttctgtgtccctctactatatccactgtcacactttccccagcctttgtcatctcttagctaaactattctaacagcttcctagcttatctccctttctgtggtctcttccacactgctaccaaagtgaactttctagcacacacaaattggcccactcttctttaggggaagcagtttcctaagtaatgagaggtttcattgtcttccacatgctcaacatttactctttgacctcagtccaattctgagacctatgatgacaactccatttcagagttaaagtgcttcattcctcttctaaatttccagacacaactacatacagggtaacaattactgctgcagatgtaaatacaaagtgctatgttgtagttactacaacacagagactttaaagtcagcccccagcgaatcacacctccagtatccatgcccttgagtaaacccatcccacaatgagcctgggctttttccaactctaaccgagagaatgaggcaaaaatgactgtcagttcacaacctacactttaagaaggcttcttttgccctttttttttctttagccctggccagccatttaagaagtccacctgccttgctagagaaatcatgtggaaatgtcacatggggggatacaagccccccaagcttcctgaaaattcatggagagaaaggcgcagcctctcagccaccccttccaagataccaaggagccattttggatgtgtcaacccttgtcgggccccagatgactgaagactcagctgatatgtggaacagaaccttcagctgagtccagtcaatccaaagaatcatgagaattaataaaatgattattattttaaggcactaagttttggggtacttacatggcaacggatgactgaaacatgtcccacttatgagctccttgaaagcagagagaatgttaatctatctcataggaaaattatttgaaagacaccatgtgattgtagtcttttaaaacaatttttttaaaacctcatactaggttgaatagt

SEQ ID NO: 56969 - DNA, 1018 bp, Homo sapiens
tcagctgtgttcccacatatgccttcttccttcacactcttcttctttgtaggccattctgttgctggaatgcatttcttcccattggcttctggaaaatgtgaactcatctaagatctggctttaatctcctttctgtgactccttcccctaggcattcccctgcccaacaaaattagtcaccccagtgcttccagggcacttagcacgtttatggagattcttagtttacattctaggttatgagcacctgattgggggcagaaactttattgcattcatcttgtattcctagtgtcctaaatgatgttcgggacatataggctcttcaaaaatagtcttcgaaactagcaaattaatatgcttattctgtggatgttggttttgtctccataactaaggttctcaactttctaatctcgtgtggtagcaagacttaagattcatttggtttagtgagattaatgacagatttgttctgtgctagaaaagccttcttattgttaatatctaagcaggaaaagaaagaagtgttctaatttccatataaggaaatcagatgcacagatgcctctgaacagcagagcgtgtctgttaaaccagatgaaggggagaggaaaaggaactaccatttattactgtgccttgtgctgtgccaggtactttatttgcatttttaaaattagaagcattttaaatttgtgcatctaatatgcggcattgatttgaaggtttaattggtgctgtttgcattgctcattgcttatgtaacctgatgtaagagattagttcaccaaacatatgtatgaatcattttctttaatttatttctctgtctagtttctgaggagtattcagtcaataagagacccagcatctatccctcctgaagagatggtaagatgatatacttcacatataatgaaggtgcctttgtgtaattgagtatgaaattttaaaaaactttcctctgcttactcctttctttactgagttatagatgcctcataattcctct

SEQ ID NO: 56970 - DNA, 1189 bp, Homo sapiens
gacggtcagactagcttcagatactttcaaagtaacacttctgtaactcactcttccagtctgactggcttttcaggcaggagttggagaccaagtagagctttctgcctatgaaatggcaattagtttcaaagaacatagacccattcaagttacctgaggaaaagggggctggttgtaagggtgtcaatgggatgttagggtatctgggtggaattagatttgaggctgggcttccggtagtcttgagatggatagtagtaatgtgccccctaagtatgactaagctacggtcccagtgtttgctttttaaaattttactaccaactgacttcctctggaaagtttctgacttcatgtggctttggtttgccgtagctccacctccacctcatagcatccttctaccttcggctatgcttctaataggcaaaaattgttcttagttcaaattcctgggggagacaatgatctggccagtttatctcttcactcaggccatgaaattgatggctaatttgtgaattaaccgccctttggcccaggataggtacctgccaacattaactgtgcccaagaagaggtggcaagatcaagtgctaagcataatcctccctactcagcaggaggttgtgacaatctggccagcactctatctccagaacagagggattagcattgttgcttttacccatggtcccacataaactttttatttgtagtcccagtagaaaggtgaatgttaccatagttgccatacttggcatttcttttagtactgttttttgcttctctgtcatttttaagaaagatacattgccaggtaggtaggaattcagtgaatttgttacaaagcagatttagttcttattctcagcaacatttttagattttgaaaatcttcaattttagatagctttagcctttatacatgtgtttcttatataacgatggttgtggatcggtaggcactttaaattttgttctaggcatgtgttttgagcagcattacatacccagtgtagaaggtgttgtatggaatttcaccgaagtggggaaaaattccaagtagagggtcaatgtgtaatgattattgagtttatatttgtccaaagaatacagattttaaacaaatttttaaaggcctacatagaattattggccgtatttgtagcagtttgctttctac

SEQ ID NO: 56971 - DNA, 1045 bp, Homo sapiens
tgcccgagcccggggggatcctgggggcgcgcccgccctcgggaaggcggcctcattcttgatccaagaccagtgcccgtcccccaaggcccagctggctcctgtcttggcatagtgctttctgtttagaataaagatgaaacatttctcggaagagcatattcaggaatccatgtgaaattctcggagtcgggtctcgaattttgggggtcactgttaactgctgtttttagggacccatgttcttataaaatgtatcttgagctgaaatcacaattattttggtccataaagacttaattgtgtattgcttgtcagctagcaatgctggactgagttccgcagagggaatatatacctgaaacacgaaagcaagggccggagtaacgttaccgctggataccagaatatcagccagtacagtgcatccttaatactcagagtgcaagccattatctttggaactttcaagctaagggagctaggaccaaggtagtctcgagtaattgctgggaaaagaaaatatttggtagaaacatttccatagagcacacgggtttcttagttgagtgtatgagttgccctttgacctagacaagggttttcttaatctacaagcggtccagaaattttatgtgctgcccaagtaggcaaaagagtggagggagattattaaagggaagactgatgcatattcaagtcagagactgtcaactcagcattttattatagagtggagatgctaagtgctacgaaatacctattacgggatactaggatatccttttctaccttcttgtgactttttaatttcaaagctaatgagcaagattttgtgttttccccgtcctcaaaacaacaggaaagcattttggaaggccaagtgtttttcttacatttcaataaatcaattttagctgaattatcatttttaaagcactggcgggcatggtggcacatgcctgtaatctcagcaactagggaggctggggagggcaggtagcttgagcccaggaattccaggttacagtgagataggatagcg

SEQ ID NO: 56972 - DNA, 1035 bp, Homo sapiens
caggaagagacactattttggtgattcaaaggtccaaaatatgttatctgaatacgaaggaaaaaggtgaaatggcactaaataagtaatcctataaagaaaaagtactataatagttgcatatactagtctagagggatacaccacattttatgtgggttaggagtagcaagaagaaactatgtacatacagagacatgcaccctacaagattggattgaattccagtatacttataaatagccacatattcaaactattatctgaagcaaaatggccacacaaggcaagagcagatgtggcatgtcacagcttacttttccttgcttctcagggcccctagtgagggcatacaaattcctgtgatacacactattgaagtcaagtctttccagatcaggaaagcacaatttttcctgcaacgttgcctttttatattcatagtttctatctctttcaagaacttacatgaagaatctatctgcttctgtttaaaggaaaactctccgggttttgaactaaactcagcattagcaaggctgtatccttttcccaaggaaaaaagtaaagtgtctacatattccaaaagaatgtctccaggttttagcatcctagaaagcctgatttcccccactatattagaaagaagcaaatgagagtttaaagaaacaaactgttatgtttcacagtgaatttaattaaaaatgtatgtagatatagttgatttttcataatacaaaaggacctaggacctatgtcaaagtactctccaaactgatcataaatgttttaaatattttttgctttaaacagcaagttcatctgtgatacataatggagaattccagaaaagatcattttagagtttggtttcaaattttattccttttttccaaaacgatatttgtatatagaaattcgaaaaattaaatgatatcctctacactgtaatacacacagatgtctctgggtgaactgctgactacataaatagatctttaccatagtaacctaaagaccatactgttcaagacc

SEQ ID NO: 56973 - DNA, 1091 bp, Homo sapiens
aaatgggtggatcatgaggtcaggagttcaagaccagcctggccaagatgctgaaacccagtctctactaaatatacaaaaattagctgggtgtggtggcacacacctgtaatcccagctaatttggaggctgaggcaggagaattgcttgaacctgggtggcagaggttgcagtgagccaagatcacgccactgcactccagcctgggcaacagagcaagactccatctcaaagaaaaaaaaaagagaaaagataacattgttgtgaattgtagcatatttgatcattgttatttctgccagtacccctctgtaggttctcattacttcacatttggacagctgtaataggttcttcagtgttcatgattttgcctctcaaccccctttcctactacaattatcttcctaaaacatagaatttggtcattctctttcttagcaaccattgacaactctccagtagccaccagttcttagcaggtttatgaaaagcttcaatatctagtcctaacctccctttctagccttatctcctgccatttgcttatatcataaatctaaaactttaaccataacaaaccatttgctcttcgtcagccactcctctctgttgctcaggctgctccaccatcaggaattctgtctctctttgcctgtgagatcttacttgacttttaagactaattcattcatgaattcatgtaatttttgaatgcccactccatgtcagatacaatactagagcctagggatatagcaatggccaaaacactccttgccctccatggtgtttattttctaatgggaaagaaatacaataacaaaatatgtcaggaggtaacagatgcattaaaatcaaagtattttgtatgaagactttctagctgccaagattgtcctgtagcaatttgtacatgtctctaatatactcttatattaaatatttatcccccctcttttcttctgtagcaatttatacatatgctacagtaggatgacatcaggttattatcagaatatttcttccatgttaggtgcctccaatccttatagtcaaggactatgtcgtatttgttattgccttccca

SEQ ID NO: 56974 - DNA, 1126 bp, Homo sapiens
tcttagactttacagcatgtttagtttattttcatttcttattagtatttttcagtacttaatagtctcttgcccccacctccaacaagaactttcctctctgttcaacatcagaaacattttccttttggcatgtgctttctagttccccaaacagtataagcaaattggaaagtttagctgtcattcttggaaggttacagatcacactagcagcctgagtaatccaagaggttttaagtatcatagcatttagtttaaagtgaaatttgctctgacagggctggcagaccaataggaaaaagaaatatttgtgcttggagaagtgcatatgtagagaccaaaagtataactgatggctggaagtgatttcagtctaaaaaaacaaatcattaagagagtgcataggggtaaaatacacagttcatattttaaagagtctcaaaatgaaccagcaactaaggttagcattacatagtaattagttgtggtgttcaggctttaactcactcagtaccagacagtatagttaaactgtcgctgaaaaaacattgctacttacatgatattctctagtttaaacctatagcagtaatttttgtaccttaaaaaaccaaggtattatgacagattatataaatgttgaaccagtaacagacaaacaattatttaaaggacgtgctaatgactcagtttattgacctaggggttatttaagccgctcagcaagttcccttaacatttggtggtatgaaatgaagcattgcttgatagtatagaactgccaatttcaagaagtccttgtgcttaatggaagaaatgtaagttaaagatgactagatggcataccttcattaaaatattgccagaaaaagccaaagacctttataggtttgagtaaatattcatttcaacttgataatcacatctgacaacttccattaggtacctattagagcattttttctgttaataactacaaataaggaaaaataaaatatattttaatggctccagttatttcttgcacgtcatttttctcttcaagaaagcctattatgagccagaggaatctaaaatttatatttttttccttgaatatgcagataaataataataaaatggg

SEQ ID NO: 56975 - DNA, 1081 bp, Homo sapiens
agtgacatacacaatctttattctaattgtattattttaaatggtattctctaaatcaggggtccccaactcccaggccagtacctgtccatggcctgttgggaacttggccacacagcaggaggtgagtagcaggccagcaaaccttactgcctaagctccacctcctgttgcatgagcagcggcattagattcttataggcgcacaaaccctattgtgaactctgcatgctagggatctatgttgtgtgctccttatgaggatctaactaatgcttgatgatctgaggtggaacagtttcatcccaaaatcgtctctcctcccccatgtatggaaaaattcttccacacaaccagtacctggtgccaaaaaggttcggggctgctgctctaaatggtttcagatctatgtacaatatgagatagatggaccaataatgatgatggcaattattgaaatatatttagtgagttccaggcagtttatgaattgctatttattacatcccttatctaatttactcttcacaacagctgaagaagggagacactattattaagaaaactgaagcatgtaggtttaagcaacttaccccaggttatcttgccaccactcaatcaataaactattcttacctttgcccacctttcttctattacaatgaaagaagttttttcaaaatccaataaacccatttttactctagaccccattcttgtcttttcaaggacttcttttatgttgtcactcttttcccctttactggatcattcctgtcaacatataaacataaatcagaatctgcaaagttaaactctttggccccacatcatattccaactgcttcctgtttctcaattccctttatccaaaacttctcaaaagacttgcatgtgctcttcaacttccccactcttgtcaaaatcaccaatagtcttcatattgccaaatctaatggaccattctcatctttacctctcagctggttttgacacagttgaccaggccctgctttttgaaactcccttctttcagctctcaagataccccatttttctgattttcctcctaagccctttg

SEQ ID NO: 56976 - DNA, 1042 bp, Homo sapiens
tcatccagacgcagttgctcagagcagaagctgcgtgcggtacatctggtccatctgcagcctcacacagagccagcacctgtaccagtgcctggagctaaccaccctgccatagtagccagtcagccagcatgcctgctgtgcgtggtgaccagaccctgcgcttggtcacccacacaacctcgccgctccacacctggctaacccttggcaggtgtgggatccaggttggtagctcaagctgagcacagcctatcgggcctagtgggcagaacgagcccagcgggcgcaaacaatactcagggagaaggtgccgccagccacaatggtttctgggtggcaaagcaacaccccaaggatcctgtgacattaggactttgacttagtagaagaaattcagcataattgagtctataaatttaaaacgtaacccgaatatgactggaacctttaaaaatgttaacatgtcaattatggtacagctttgtactagaaaaaatgacacagaagccaatccagttgtgtctggcaagttaattatatcatcaccatttaagagtgattatctagtgttaaacgtcatatacttttcacatgtattgcatttttgttggctttacagatagaaattagttgtaaatttaaatggaaagaaagaaagtctttaagcaaggatgacggttcttatgacatatttgacctagaaatgctcttattgtaaaaaacaaaaatgatttttaaggtaatataatgcaaattaccgtcataaaggcttgctccttcatattataatgagaataacaaaattgtatataattggttaataagcatcactattcccccttaaaaaaataagggagagaaatagagcatgtcatcttttatttcctttaaatatgagtgtaatgatattgagcttactccttaactcagggatattttctaatttaaggtagatttaatctagcctattgttgtcttgattgatttaacaatgtaatttaactatttatgaacagttgttagatttcttatattagaa

SEQ ID NO: 56977 - DNA, 1024 bp, Homo sapiens
attttcatgtattaaaacattataacagatttgttgacttactcttaatatgtaaacatattttaagataagtctattatgaaacatagtataatattaaaaaaatatcattgaatgcaagtcactgtcatacattttatttacactttgttcttgacatgcacatttgcataagtccctaatacttgttcttagctggatccaggttgggatatttgcaagggttgcttctcaatttaaatagaattttaagtcatgatttaaacatacgcagtagaacctctttatagcaacagtaaggttggataataatacagtgtcctgtttacttttaaaagttgctctgattcgggcatggtatatgatttgatctaaaaatactcagatctgtgcaaatttttgttataattgtattcagttatccaaatgacattattttcaatatatgtaaacatctatttcaagccaagtaataaatgacataggtaggtaagaccaatagaaataattttaagttctttccaccttcttcagtattaatgaagcagaagtgtacagtaaaattttttgagtaaaaccataagaaatagtactatatgacaagtaaaattattcctaagataatgcagtggtcattttactcttaaacttgtgggatggtaaaaacaggagaacaagagtgcaatagctatgtcataacatagttctaattaatgaggaaaaaatcaaagcaaataaaaaatttttatagtataagagtcttgatcttacataatctttacatgaaatcccttttttctttctgtgtactttcatagtagctgtcccaattacttttttagttaagaaggtggaataccttaggagccttctaaaagattcaaagaataaaatgtttaagcctttttactctaaatctaagtatatgaagtctaataagttacatttatcttgcatttaaatcttcatgtatcttatttgatcattaaaaagtgtgtgaggttatagggcaaggagtaatatt

SEQ ID NO: 56978 - DNA, 1021 bp, Homo sapiens
cctcttagtttttgtgatcaccttaatagtgctattaccctgcatccctctaactcctttttagacagctgtaaccaaatgtgtttaaagatatgacagaggaatttaaaaccaagaactctaacaatgacatgaaatatctgaagccttttattttctatccatgctatcatttctgctgtccattgttaaagcaatacactactcagtagtagctgcaacctatgggacaagtagtagatggagaagttctgctgtagcttacagtaatttgcctgtttgtccttcaaaaccattcaccaagaactttctttctgacaagtgttacagatacacctgtcagtgaataacctaatcttgctccataggagtttatgatcaaaacaagaagcatttaaagaaataattacaactaaataagataagatcattaatttgtggttggaacaaaaattaaattcaattctgatatttgttttctttagtaaaccattttagcagctaaaacaatactttaacagtacttcccccagtgttatctagactaaaagatacagcaaaatatgtcattttatgctaactacctgtcattagtgccacaaatgcagttgactcttgaacaacacaggtattaggggaccaatccccctacacagttgaaaatccatgtataacttttaactcccccaaaacataaactaatagcctactgttaactggaagccttactaatagcataaacagttgattaacacatattttgtatatgtattatatactgtattcttacaataatgtaagctagagaaaggaatatttttaagaaaatcataaggaaaatatatttactattcaccaagtggaagtgaatcatcataaagatcttcatcatcattgtcttcacattgagtaggctgaggaggagaaagaagaggagggcttggttttgctgtctcaggggtggcagaggtggaacaaaaatccgtgtataagtggacctgtgcaattgaaatccattttg

SEQ ID NO: 56979 - DNA, 1017 bp, Homo sapiens
tgtaataacatacataaattgtaagtatagctcaatgtattttcagtgtaagcatacccatgttattatcactcatgtaagaaaataaagcattaccagtaccttagaagtgcctcttctccctcctctcagtcattaccacctccttcaaagtggttagtttgaacaaaagatagtttattttgtcaccactagattagtgttgcttggttttgaactttaatatataagtggaatctagtttattttgttctaccttatatttgtgacattcatctatgttgtatacaaaagtttgttcattttcattgttatgtataatattttattatataaacataccaccatttatcctttctactactgatggatagtagagttaggtttttgtgggggggaggactattataaataatgctcctatgaatattttgaaacctttcatttggtgaacatatgtactcatttccattaggttcacacgtaggagtagaatggctgggtcacagagtttgtatgtgtttggccttagtaaactatgccaatctgtagttctgctggttttcattcttaccagtagtgtaagagagctgcaatttttccacatcacctccaatactgggcattgtcagtcctttcaattgtagccatcatactggtatttcattgtgattttaatttgtatttccctaatgactaatgaagttcatcacctgtttatgtttattgattatttagggatagccagtaaaaagatgtgcctatttaagccttttgtgcatttttctcttttgagtttttttaatttaatttgtaagttccttaatataattcattttaataggtcatctagagataatgccccatatttgaagtattccttcccaaaattttagcatatttgtatttactttggtacactcttctcacagtcagttttcagatcagaaataattaaaagaaagactaagtagttgggaggtaaaagtaaagacacgtagttgatagagtgagaat

SEQ ID NO: 56980 - DNA, 1009 bp, Homo sapiens
tataaaattaaggttctgtgatttgaataattaaaggcaaaggagaaattgtgttatagctcagccctttttccatggaaggctctaagggaaactgtaattcaatagaaccaaaaattattttaatattgttttgtcacataaagcatttcatttaagaattttgattttagctttttctattaacaccagagacacaaaaagggatttgtaaagaatattataaataattattttaaattttctatctcatgctgaaattgtttgagtagttttgatctttccctaagagtgcagaaaatctaaaattttaattggttccatggaaaaccttatatatgaatattcctttgttttccttctcttaaatattgccaaatttattcgtttcttattttttaatgttattttcctgagatttcataaggatactaaatttatttctgcttagttcagtatcagttataaatcatttcagttctatcattcctatactttgacagatagtttcttatgtctggtaacttaatgctaccatctgggagatctatcatagccattggcttcagcaaatgtgattatctgcaaattgaattggacttacaaaacttggctttacttaattgttagatgcagtctttttggggatttttatagtgttacgtttttaaaagtgtttaaagatttttttggcttatccaagaatcagatcttcaaaaaaatttttttccttgtcaaaacttattaagccatttgacattgatatgtctcaagggtgcttccttacgtcagactatcctgggttggaagatggcaaggaaattccttgtcatagtgtattcttcagtaccctagaatatgtactgatagtgtttcaaaagtaacttgaaaagttaaattttcctagctttttgtctgatgcatcatgcatatattttgttgcacctctcatttgctttggtttagagatttcataagctgaggattgtttgatatgcttgaggatggt

SEQ ID NO: 56981 - DNA, 1120 bp, Homo sapiens
taacacagcagactttagttattaaagttttatgatatgttatcttgttttctatatgtgtaaaaactattttcctctgtctgctttattttttcctgacttatctacctttaattgccatttgatttctattaaactctaagctccaagagggcaggaatcgttgttttattttggttattgtgtccttctcagcattgtatgaattattttatatgtgtgttttgttttagataacacacacacacaaacacatatcccattcagtaacaataaatgttttttaattaaccaattattaaccagttaaaattttcaaaataatatattacctttttagggctatctctgttgccttggtgagtagaaatgattttctaaattattaattcagtatactaattctttatctctcatatattttacttttctagttgctctttatttgcttctgaatcttgctgaggatactcgtaccgaactgaaaatgaggaacaagaacatagttcacatgttggtgaaagcccttgatcgggacaattttgagctgctaattttagttgtgtcattcttgaagaaactcagcatttttatggagaataaaaatgatatggtaacttacaaagctttttcttgaaatagttcatttttgccattttcaagttagaatattttgaaaaaaattaaacactttattcccctaccgagataattctgaataaagattttataatagcaataactcactgatattgcttcattaagaaatgtattccatattagttaatattccaggtgattgaagctttctgaataaaaatcatttctaatatatagaatggatcttgccatattaaacataatatatagaaagtttgtttaaatttaaaattttacttcagagtcacctggtcttgttgttttaccctaagctattttgccttctgcatctctgactttagtttgtggaattaaaatttagccagatctcttcattgttacctacacttccactttgttacctacaattcttctttgttacctgctgttctacttggcagccacaacctgttgattgtttcttaaaaatctcttgaaactgtaatatttcttcttttca

SEQ ID NO: 56982 - DNA, 1034 bp, Homo sapiens
tttttttttttttttttttttttgagacagagcctcgccctgtcacacaggctggagtacaatggtgcgatctcagctcactgcaacctctgcctcccaagttcaaacaattctgctgcctcaacctcccgagtagctgggattacaggcgcgcaccaccacacctggcaaattttttgtatctttagtagagacagggtttcaccatattggccaggctggtctcaaactcctgacctcgtgatcccccttgcctcggcctcccaaagtgctggaattacaggcgtgaaccaccgtgcccggccagatctcactttttttttgcttttaccttctatatagttaccaccagaacaactgaatctgaacatatcaatattgtgtcttgtccctagctgaaaaaaagttagcatttgtgggtatggtcaagaaaatgatttatttatgatggtatggattcttacatttaataatgctaaagactttatatattttatatcagaaatactgttttaaaacagaatctctgaatatgctgtcttgcctagagagtctgaaaaagattttatgttccttttgttattttgtttgtctagttcacagaaaatcactgccttgtatttttctaagcctaattatatctaatagtttattttactaagagtctatggccaggttctctataataatttataatctataaattattttaaagtagtagtattgaagttattacttttataatacgtgagttgaaaaattctgttatacttacagcattcgacttaagagtctcaatgccaacacagatataacttccctggcaaggaaggtggttgaagaatgtaaactcattcatccttcaaaactaaatgaggtagaacagctgttgtactatctacagaaccgccgtgattcattgtcaggaaaaggtaagtagtagaattcctggcttcctaatgcaaatccaaagttgtttgattatagttcatcaagcaactataaaaaaaagtttatcaaactattgatatttg

SEQ ID NO: 56983 - DNA, 1027 bp, Homo sapiens
tatatccattttgtacaacggtcagattatctccataagttagagcttgtaagtgcaatcagggccattcaggcccccaaatagaaacctcccttattagctggactgctgtatagcattcgctaactaaaaggttatcggattcccctctctcctttcaagctgacctgacagccctttctattcccatcctcaagggggcggtgactacggagccactccttatacacggacgctcaaaactgcaccaaaacttccctgctcggctccccggtgcgtcaaactctgaggccaccgcctcagactgagcctgcgcatacaagaggtgcagagcaagcgcatgcgtcgtgacggcccggcttaggcgactctgggcgggtctgggccgctccagtgttttggggcacagaagctgtgggaggagctggaggcttcaccgtggtaaccacagcgccgctgctgccccgccttgcaggcctcaggactgtcatcgcctctgggtgtgagggtactttggccaccgtccccggaaataaccgcgcctgcctctcaagataccccatcctctccacgccgctgccgctgccgccatgcaaggggaggacgccagatacctcaaaaggtgacgactccccaaggctctgtcctaccctccttgccagggccctgaagatgttcttgggttggctgtgagatgtcactgggcaacgctagtttagcagacgggatgggaagcagggagagaagtcaccgaaaggagagggaaaaggtgaagtggagaaaaaaggagagctctgggggggtttcaaagtcctttgacctgactcggcggagccctgacagcattgaaagatggtttcttcgctacatcaccttattccagggggagagggaggtagggcaaggtaaaccgcgtcttttgttttttttttcgcctcttcccagactctccattttcccataatagataaatcccatgagagcctgggaataaagtctggtgcatccgccctcaggcctcagtttg

SEQ ID NO: 56984 - DNA, 1047 bp, Homo sapiens
gtcctaatgaataaaagaacattatcaagaataataggaaggccaaagtcagtggcttttagtttggagatactgtagtcccttctaatctgtggaggatattccaagacctccaatgggtgtctgaagccagggatggtaccaaaccctatacagtcgtccctcagtatctgcaagggattgctttcaggacccctgtggataacaaaatccacagatgctcaagtttcttatgtaaagttgtgtagtatttgcatatagcctatgctcatcctcccatatactttaaatcctctctagattacttataatacctgatacaatataaatgctatataaatagttgtcatactgtattttagcattaggagatatacctaatgtaaatgatgggttaatgggtgcagcacaccaacatggcacatgtatacatatgtaacaaacctgcacgttgtgcacatgtaccctagaacttaaagtataataaaaatatatatattttcaatctgctgttggttaaatccatggatgcagaacctgtggatatgcagggctaattgtagatactgttttttccatctgctgaccgagatggttattaagtgactaatgggtgggtaggtgtggatatgctgagcaaaatgatgattcacatctggagtgggacaaagtggaacaatgtgagatttcatcatgttacacagaatgacatgtaatttaaacctcatgaattatttccggaattttccctttactattttcagacctcagttgaccatgggtcctgaaactgtgaaaagggccacaggagataagggggtactgctgtatttatttccaccatcgaatccaaatggcctctttctgtatgcctttggtaattggatattaaatacctggcatgaatcttgtgataatttccaaatagctggggcataccataaagcttttctctgagagctgtgcttctcaaacttcagtgtgttctctggggctaaggatttgctattttttttaaagtctcacatatgacaagatatctacatt

SEQ ID NO: 56985 - DNA, 1025 bp, Homo sapiens
catttttatgctttttttgccccctaggcaagaaaaatctcgttgggaagtcctccaacaagaacaacggctaatggaagagaaaaataaacgtaaaaaagctcttttggctaaagctattgcagaaaggtgaggcacctgaaccaggagaggctgtttgtaacctgtaaccagttgtgtcatgtgttatatttgttttcccatgtctcttttaataaactgatattttttcttcaaccattacttttaagactaactaaacaaattatgctttataagtgatactgaaatactagttataatttattaaagagaactttttaagcatagagcatattaaatttgtaaatatagttgcagttttaaagaccttcattagtgctcccagttttaaccatctacacattcataagggaagcagtaaatagctatcagtatatgtaaattagcaacaaatgcaagttttaatttttatgtggggaggccttaatcatttgatgtgtagaggaataaggttttctacataagtgacatactcccatgaatcttaattggatttcctatgggcatttttcttaaataatttgccccgcctccacaagtagaagatacatgatatagtttaactttttattgatgactcagggtcattattatgagcactgtgtgagattcaatttttctttcaccttccagtgtctatcagcagccccttcacatttactgcattgtaccagccgcacacaacaacattcccattggaatcattcttcccatcccccaccactcttgctgagtttgtagtttctgtctaatctcctgtggccttaggaaactaaacttagtcaatatatccatggttgtgaatagtgaaaactaaatgcaaggaagtacattttctttttagacttccagaaaagtctgtcaaactgttactgcttgaagctagagtatgtgtaggggcaggagaagagggaagaaggtgatgggtataagagtagttcagaattttgtctgccagagga

SEQ ID NO: 56986 - DNA, 2072 bp, Homo sapiens
tagtagtcttcaatttctaagagatgggaaggctgttttctgtggttttacaaaaagatgtacaggctcagcagttcttctcataagtgcttttgattttagacagcaccagtataaacagaagtgtaaggaaatacaacgtttgaactattaataaatggacaatgaagtacttgacgtaaaagaatcatactgttaagtgaagttttgtaggcagaaaggaagggtaaatgcctaagagtagaaatcaagagaatgtgctatgtaacatggtggatttatgtggggatttttcttcttccttcacaatgtgtgtgaaaatttgaaatgagtgaaatcatgattaaagggttgcttttttatttgtttgttccctttcttaagtatatattgtacttgggagaggggattgagaaattatgaggttggatgtgcttttaaataaggaaaatgagtgttttgatgttcagctccataaagaattttcgtaactagtagttttcctagagaacaagaatcaaagcaataaaagtttggggaaatgggtcccaagaaagttaaaactaagtggatgttctcagatatataaagaggtgtggtttagtatagacatctatctgttcttaatgtcaggtaagtatcagacaaatgaaaatgggcttagcaagaggaagaattaaagactagaaatttggaaagctctgttgaatgtttcaatgtaaagggaacacagatatattcttttagtgtttgttctctttacagaatgaatatcaatctaaaatgaactatttgctgagtttttttagacttatttgttactttatgaaacatgcaaatataaaatttcaaaaactcaaatgttaaccagcttttactttatttcaatttttctgatttttttctaacttttaaaatataaattataaatgtatatgcagtatcttgctttttcacttacattgtatatggacacatggttttaaaatgttcttattttcccactcacatacctgattttctagatccaaaagaactcaggcagagaccatgaaactaaagcggatccagaaggagttgcaggctttagatgacatggtgtcagctgacattggaattctcaggaaccggattgatcaggccagcttagactattcatacgctcggtgagttggggaaattgaatctgaacaaggagtatgatttaattaatgtttattgccagctgttccaggggcttttatgtatatcatcattgaagcctcaaaacaaccccattcagtgctgtatttattcttcttttgtgctaattcaagtgtctcctcttcagtgaagtcttccttaactctgccctactagttaaccttgttcgtgtgccattagagcagttcttgcattatttatttacgttttagtctttgctgcgaaaccctcagctatttaatgtttggaagtgtttttgctcatctttcagcatctagcaaagtaaatatctgagtggtttcgccaaaactgttactctgacaccaagtctgtgttctttccattaaaatttttgatatctgatatagtcctataggattgaagtctagtcctcactttagctttcatcagagtaagaggatctagtttagtttttaaaagcttatgaatattttaagcatatcctctgtcttggaaatttgaaatattttctctttttttttcctttcaattatactctgtatgaaatggtttaatatatgtttccttggtttcaaccattggcattttttaaaagagaaaaaataccatggagtatttttaaaatgaactaacacatgtaatgaattacatggactttgcagacagataaaagggcaaaaaaatatgtccaatttcagggttttcagccctttcaacattgctttaatcatcctggtttgtcttttttcacaagggaatgctgtgttaatgactcagttttctatcttactctgttacactagaaatgaatcagaatgcctcattaggccagggtaaaccacaacatcagaatgtttatataacaatttattaaagcggaaatgctt

SEQ ID NO: 56987 - DNA, 1003 bp, Homo sapiens
ggtctcaaactcctgacctcaggtgatcctcctcagcatcccaaaatgctgggattacaggcgtgagccccctcgcccagcctcgttttattttatagtgaagaatttgagagccaaagatttcagtagcagcttggccagctggctcatttgaaatttaaagtgctagtaaagttgcagttccatattccaggtgtgtcacttacatatttcaggctgtgaagttcactgcactgcatccctccacttgcaaattttgctctataacccgttgaggaagagtgtgtgtgtgtgtgtgtgtgtgtgtgtgtgagagagagagagagagagagagagagagagggagagggagagaaaagtgctttcaaatgtggctgtaaaaggtccactgaacccattattttgaaaaaatgttatcttgcttggctttcccagggtggtatcagagtgctcaggtgatgatataagtgacaaaatcatattgcatcagttttatacaaaggcagctgtatcccatctgtgggaggaacaagagcaaatgaatgagaagtgagggttcattggtatgaagaccatatgcactggcttttccgggatcgccctgacacagacatatttaaaataaaatacagtacatttgaagggctttgatatataaattcacaaatacacaataattgttaatttctgtgaaggaaattactggctcaaaattactgccatgagtttattgcagcattttatagagctgtccctccttgggttaaactactctccttgcttccacttctcaaattgttagagcaaaggtgtatcaggattcctaatgatgtgaaaagtaacctaggggccacctcctttgtgttatctcacttgttctatttaaaagacaatctttaccaaattgtagtaattctcacttaaagtatacatttacttgggtaaacttaaattcctgaatagaggggtttttatactttgattttctattcctttctttagg

SEQ ID NO: 56988 - DNA, 1032 bp, Homo sapiens
gtgatattattgcaggggaatgataattagacctttagaaatccaaaggggctctcttgctctcttccctctctcatttctcttctctctttctctctctctctctctcccttcctccctccctccctccctctctccctccctctctcttgttccctccctctccctttctctctaactctgatgttggcaaagggggttttcttaatcagactgttttttggtcccagggaaaggaggaagaaggagattgtgatggagaaagggggtctgtgaaacgtcaggcacagcacaaaggctttgccacgtaattacaggctcctattaagtcgagatctgccctcccaggggtctccaattttcttgtattccctacaaagcctcctctgcatgccagtttgtgccttttgaagtgccagagagcttcttgatccaactgagaaggaaaaaggagcccagcaagaagagggggagagagagaaggggaaaggggggaacccaccagcaccctccgtcggactcttgaagccttttttttttaattcttaatttttttttttactctttacaaaaagtaaagtgagaatcctgctctctaatacatctgcaagacatcaccctctcctcctgaaactttagtcactcctgagaatccacaggagtgcagagaggggggaacacgttttcttgaagatgttttaaagctggaacaagccttcttctgttggtgcttgaactcttgcctgggaataacttttttaacctttaaaaaaaccattcactttgattcttctctcccaccccttcttctctcttcttctgtttgcctaactcccccgccctgctggcctccgctttcctctctcccccttgttattatttttagtctgtgcgtgtggacacttttggagagttggaagggatttttttctcctgacttgaacatagggtgactttttaatattgtattttactgtggattatctctttggaccgcgccggacttggcctcaggaaatcaaccaatgctgc

SEQ ID NO: 56989 - DNA, 1068 bp, Homo sapiens
attcattaatacttgccaactgattttagacaaatctctgtgtctcaatttcctcatctataaaactggcacattaatatttatcacgcagatttgttatttggaataataaaatgatgtaagcaaaatgcctagtaccctactcaaataaatgctttattataaattgttataaatgccctttagggcaagcatttatttgagtgccttcagtgggaatggtagtagggtactgggcattttgcttacattatttccaccccacagcatctctgactagtatgacttatttcaggcatggatatatgtccactgtggcttcccaaacaatgttggaggccatttagtgccattgaaattaggaatatttgcatattccaaaagccatactcttacagcatgtcacttattgagtctatttgttttctatctacaattagaaactgatgcctcataactttcagtgatacttataccgccacaccatgagtatctggaagagccaggagtttggctcagaagttgctgactatggttatcacctttaggtcacccttcctctctcagcgtgaaacaataacacagatcattttatatttttggatggcaccaatattaaagattttacagggatttaagatgttacagtgattgaagaagacaaatcccctttcctctagtttctgaattttatagagactctatgacatatgcttgggacacaaggtgttaaggtttcttattccagacctgacatagctagtaaatttctggaggccaaccacgttaatttctctctgtcctatagtgcctctaacatagcactgccttactgctccactgagatttctgtgggtttacttaactttttgtacatgaataatgctcaccatgttaactataattatacataaagttgccattcttttgccaacttagatttcctaaaccagttgagtaagatacacattctgtcctccatttgatatgtgacctgttttcatacatattttcctttgaaatctgataagcctggaagacatacagatggcacttctatatcatgaa

SEQ ID NO: 56990 - DNA, 1080 bp, Homo sapiens
gagatagacatatgaaccctaaatcagctgcatgttatggcttctgcgatggagtcaggatcaaggcaggatatagaagggtcacaaggatgaacttgtcagctcagtgggtaaagaaaaacatcatgggagatatgaactataagctgaatagtggcagatgagtagatattcatcacttagaatagacttggagagagaagttataataatcaattttgctcctttgaacccttcaggtgtgtgtggtgcgtatgagaaagtcagttggatcttagcatttatttataataatattcataagcacaatctatagctaacattaccagcctagtttttgaatttgaaaatgtgagaaaataagtgtttggtaaaattcaacttccctgcttcctcctatatatgagaatttgtgtgataagaataattataatataaattagactttaagtattcaaatgtttttattgggtcagggcagattaaatatgtgccacctgaattatgtaccagagaggccctggaactgtgactctgggaaaggtatcagtaaaattaaatttagaagatattcagagagatggatatttcagaaaatgtaagagactacagagagaacagcaagttagctcgatgcagtctttgctgtgagcatcaaaataaggaaatgcatgaactggtcagacatagtccatcagaaaaggcttgattccaaagagaaggtactcgtggttttatctagacagacaaaaagaggcttgagaggataatgtaatgaaaagatgcttgacaaaatttagggatggataatacactaatttgtgtttttgaaagctatcgagagagcaaggtaatgtagcctttcaagtgagggccatattttattcaccactgtttttccagtgccaatcatagacctggaaaatggttgtgcaaaaggtatttgttgaatgaataaatgaaagaaataaagcagatgggttgcatgtttgcaaccaaagagtggattaaaaaatgtttattagccaaccagagagtgaaatataaagtaatgtcttttagaaactgttgatggattta

SEQ ID NO: 56991 - DNA, 1794 bp, Homo sapiens
agcagaactaaaatattgggaccatggcagagaaaagcaggagaggagcaaaatgaaaattagttaacaaatgttcctcctccctctgggataccaccaccacttgtttctgtgtgtgtttattttgtttttctttcattcatgctttgcttaatgtactccaggcttcttcagataggttcagcccacccacccccatgattgtatgaagttttaaaaaaaactacagcagccaaagaaactatatatatatatatatatatatatatccagaatgattgcctctactgtcctcattgacttgtttgaaccttagtgccttaccctgtcctcttcccagttctctttatagaagctctaggagctttcgaaaagccaaagtctttctgaagaatctgtgctggacagacataattccctttctcattgtctccatctttgttggtcatggtaaggtttttccatcagcctctgaaaaaatagttgtgcacaacatctgctcactggactgtctgatccaatgtaattggctgcgtctggctaattctaagcactaaagtctacatctaagctatagatttaagcttgaagctacagattatatcactatcaccaccacccctcaccctatgcaatcaatcaatcaatcatcttaagttaaagatatttgttgtctttgaatgatttgctgtcacagactatttggtagaagaaatatttttcacctgagagaggaagagaaatttctctagtaacacaaagagtgagttctaaaaggcatgcccacatctctttcgtgccttaaggatagtgagatgcacacttatatatatactgtatatatttatatatttatatatatatttcatatatatatataatattgcaagcttaagtttgcaatttcccaaacaatacaaaaagcaaattacacaccctcaccactgttcttatctctatagtgatgaaacattaattagggatcttgctgcttttctttttctacacgaagttttcattaaagccacagaataattgatagggcagctgtttgagaacaggtcccattttcacattagggctttaaatgaattagaaactatttgaggctataaaaatgtccttgagtttggagcctgagctctggtgaaatgctgatacatctgatctatcatgggaattgcagttagagagagtaaggaataccatttagtcatctatccgttcttcacttagcaggaatatgaaagaaaggcacatgtttaagaggaatacctaaaggtttttctaaattccaacatttaaaaggcaattgtgggctatttttattttttaatattttgaaataaagtttagtgtctagggctgggagccaggactgatcttccatttctttttctttgttcccagccatgcttttgtaacttgccaggtggacttgaccaactacattaccatgctgtgcctcagtttacccatttgtaaaatgggattaataatacttacctacctcacaggggtgttgtgaggctctattcatttgctcctttattctttcctgtattctctgtatgtccagcactttgtagccatgggaggaaagggactataaaagtgtacaatgttaatggaatgatacggtacctgaaagccttgttttctagtaagaaaatgctaccttgctgtacatacttataaccttgtatttggaaatgagaaataggtttatattttcagatctctcaaaaatcacatcatttgaccaaagaataatttaagacacatagaacagat

SEQ ID NO: 56992 - DNA, 1053 bp, Homo sapiens
aatctaacagccaccaatctgaaattgtatttcaaatgttgattctgtagttctttaaataataatgaagctcatcttatacattttgctttcaccaattgattccttcttcttttagcccactattaaaacatttcttactgaatggttcatgtaggcttgctgaacagcacgcattacttgcttcctgaagagttcccccattcatccatttgtcccattagttgctgtggattatcaagttttgaaggaactgtacatcccaacagactgaaacattctaagtgaaatgagtataatccaagtaactggtgaactttggaggtttggagcttgaagagaatggctaagaagatttgaattatagggagggaacagaaatcatacatgaaaaggttttactgagaaggggaaaaccttagatagagggacatgtgaaacaaaatcatttgaaattttgattcagacatccatttccagtggcaaacagcaaagcctgaacccataaacccaaatgataggtgaagttgggtggttttatccaatgtctcaagcaagcaatgtctgggaatatcatagagtaacaagtgctggtcagccaaagaaacattcactgctggtgaaccaataccataagcatgtattatctaagcacttgatcaagaaatatacatgttgtacaagctctcaattttgttcatttattatcaaatttttaaaatacaagtttggtatgtgatttggaaaagatgccttctggatcttaagccagttgtcagtggaggtcctcagggctgcaaatgtcaagacataaccctgttcctcaccatcatgataccagatacaggtgaatacataggaactatctgcctgtgtcctcaatctcccttcaaacaagatgctgatttgtagggtacttggcaggttaaattaaaccagaagaggtgacttaataaaaaagggaatgacatttagggtataaagatctcataagaaatgtaatatgtaaattatatcttgctttatgttgtaaaatatacattgtttgcgcta

SEQ ID NO: 56993 - DNA, 1649 bp, Homo sapiens
aattagaaacttaaaaagtgctctcagcagcccatgctactctgttcctcacactagttttactttcactctctgtgataacttttcaatacaccaagacttctcagcttgccccaaattcactgagacatactggcgaactgctggttcaaccatttacacatccacccaccagacataagagtgctcatttcactgaggcttattatcaacttgtaaacgtggtcaattcaagacttcttagaaaggtctcaggtccaagctttgtcctgaaaagataattctgattgcagaaactccctccgtccagcaggaagcgccagcaccctctgtcggggttgggccgccacggaggcttcacgtgatccggccgtctctgcgcaggagtgtggtcttgcggagatttgacctacgtacttagcgtcatgacgtagtacgtaggggctggctagccgccatcttgcttctttttctcgctcgctcgctccccctcggaaagctgcgaaagtgctttggcggtttgtccatccgcagcttcggcttttccagtctggtggcccttccggccacccctttaaccccagctttccctcccccttctttcgatcagagatcggcggagaccctcgaagtgcgcaaacttgacactcaccctgaccggtaaggaaagcgagggtgtgggggccgcgatcaaagagggccccatcgggaacggccagagtgcggcctggggcgtgggagcgcacccagaccctggcgcccggaggctagggggccgcgtggagagggccttgggtccgggcatttcccttctgtttggttaccatcatctctgtgtctggggaagtcggcctccagcttggggagcgggaaaccggagtcagacccgccccatgtggtctgcagcgggagttctggaccggtctgtcttgctcccacctagaccccagtcctggccctgcgaggggattacgcatgttgccgggtaagcgaagggggtttccgtcttcctggactggcggacgtgaagtcttttttttttttttttttttttagtgtcgggtatgcgtttccccaaacaactgaaggactcagccggggctttcactgtctacctcttcctgtgtagtgagggtgggacttgcaatgagcaatgtatgggagggtctggtttaaagacctggttagatgagaggctcttcggggaatcaagaccaaccctacttccgctagggaagtgctgcccaactccggaggaggatttgggtagtcttttcacactctaggccgctccatcctctaacttgcgtggtgaatctcggtagctccctgtctttgagatagcgttgatattggtggtgtcagggtaaaggccccgttttaggactgaagaaaagggcatggggccactatagagacattgatagagtcttccttcctttgcatgagaggagtacctttaatttaaagggatgtatgtgtgttttgacattatttgggatcttttgagggtctgacatgcctgatgtttgctggcttataaagctacctggatttccgcattggctggttttcagcctgggttcatagattcatacctcgttagagtacttagaattgtacagtaggcggctctgctgtaagatttt

SEQ ID NO: 56994 - DNA, 2111 bp, Homo sapiens
taatagggtgatactaagcacctaccaagcctaaccccaccatttttcaaaactagatttcacctcccatattggtaattaagatgctgctttgactggagccatttttaggtgtgtgtcacagatgcactgcagcatcttttctggctcaccccaaatgcattgatcccctaaaaaattaggaataaattgaacttgaattttgtctttagcatgtagtcaaatagtaattctctccttttctgtaagtggattttcagaatatagcctttttaagtgattgtgtttgctctgcttagcttatgtgtggctgttctccattaggtgaccttttgctatacactgagcacagtaataagtccttttcatacattttttttttaatctccacaacagacctttgagaaaagtgctattaagatcatccccattttacagatgaggaaatgaaatctgagagagtagtctgaccaaggtcacatagcagttattggtggtattgtgtaggttcaattccatactgtctgaacccaaaggggatgctctaaaccttcaacctgctttttaaattataaactacagtaactaaataagataaagcattattaactagtagtttttctttagcttgactagtatatgaatattgttgcatgctaaggttaaagttttgaaagttgtaaaaatggaatatatccactttggacttggggtagaggctaatttttttgtgtccttttctatttgagtgcttagagataacttaaaactaactctaccatgtcgtagatataatttttaaatttaggcgtctgatctatattattggtagaatattccctcatctgtaaaatggtgatgataataggacttccctcagaggcttttataggagtaaaaaaagataatggataatgtatgtaaagggcttattactatgcttagtgcatagtaaaaggtcaactaatagtggagggagaatggtaggatattggtagaagaaaatactctcttccaagcaataaataatctgtaaattctcagggtgatgtatatatttctttaggtacataagaaaatttcacctccccttatccctgatatgtctacttatatgcaggattttgcttcttagcgatttctttatgctctacagtaaatatccctgggatgagtatcttgttcatagctgaaaatgcagaagttctggctcattccagccccctctcttcttcttacccccaccccaccctctttagtgataaaatgtctttgaagattatattatatccctgtctgcctccaagtgccacccctaaacactacttcagtttgttagttaggtaacttgtgttttggatgctatttatgtcatatttgtaaatgacaagaattgatcattggtaaaatgttacataagttagtacagaattgtattcttacagtgaaggacatacaaaaattgtgtctgagttatgacacactttcatttcggtaaatcgtgattttgtcaccttatgaataggacaacacaatgaaagcttatctcagtctatgttaattgttgcttacaagtctgagagttactgtgttagttttatgagtaataacattttaaattcctcgctaatctcatcgatgcatgagccagaacacctttgtggataaaagcgttctatagagagggtaactttagtaaattttctatttaagagacagacctaactctgttgccctggctggcctccaactcctgggctcaagagaatctcctgcctcagcctcccaggtagctgggactagaagtgcctaccattgctcccagcattgccagttacatttctagtccttattttcctccagattatcagaaagcatgttttggggcctgtgactacatgtatttgctggcaaatccagtcaaacaaggactgttacttagtttcaaccggaaatttttatctgattggcagacatgattaactagactcttagactgttaactaagagtctgaacacaagattgtaatgaaattattatgtgaattatagtcagtgtgatatactcatccctgtgtggtgctgctatgtgctcaacattaagggaagat

SEQ ID NO: 56995 - DNA, 1929 bp, Homo sapiens
tttgtgatacaaggataatatccatttcccctatctcagaggactattgcaaagagtacatttatgtatttctatatatcttctgaatttaatattctttgatattacacaatatcaagacatgagtcttgaccatatttaaagcagaaaagagaaccacgaaaagggaaaattaaagataaaggggaagatacgttccctataaggttggaagatcccttctgaataaatcttgagtctgaaggataagagatggatacatgtatgtggttggagaatgggtatctagataagttaataattcattttttcttccctgtttgccagtgaacaatctgaaggtacagggctgctatatatggttatgcagcttgtatactgcccaaagatgctggactgaaggaagcaacaagtcagcctgtgttctgcttacagagtcctgtgccccagcttaggcctcgcagagggaactgtgcctccacttctctctccaaggcatcagctccttgccaaaagtgtctgtatttccccagaaggatgtatttttcctagttacataaaggccctatggagagcaatggatgctctgaaagactccttaaggagacatattaaggatacatttagaacaacatcaaaaacaattgggaaattggagaaatggtcactaaggaacaaaaagctttgaactttttgctgagatgggttaggtggttgggcaagtacagaattctcatttatccagtgtactttaaagatctgtattgtagcttattaaatatttttattaatcaagaaactatattaaatatcatagtttatcatatttcaaagaagagtgataagagtaaaacaatacttaacacaatttaatcttacccaaaaactttgtaattttggggtttaaattaaaatttagatttttggtcatgtggctggtagttttatatataagtaactttttaatgttaggttttataattaaagctatataaattttatagctcttaattgaagaagcacaatagggaaggtacacagttacttctgaaggttaggaaaatggaacagtggcattttattttgaaaacagaggacattgaaaacaaaggaggctttagacaggtgaattttaagtttatatttggaaatttgatttgtggtgtacagttctttaagttttagtacgtatggatttttgtagcccccacaactaggatacagaatgtagaaagataaaacatctcccaactgtagaactagagtcttctggcattttggagacagggaaattctcttgaagaaataactattaaagagggatggaaaaagccaagaatggcctacccatgctgaatgatttgttttctgattagaaagaaaaaatattttgattatactgttatatttatgacaaacttgaacatagaaagaatgaaagtaggagaaagaaaaagaaggagttgggtgttgtggcatgtgcctgtggtcttagctacttggaaggctgaggtggaaggatctcttgagcccaggagttgtggagggtagcgcactgtgttctacatatggactgagtgtctgcactaaattcagcatcaatagggtgtcctgggagtgggggactaacaggttgcctgaggaggggtgaactggtccaggttggcaacagagcaggttaaaactcccatgctgatcagtagtgggatagccattgcactccggcctggacaacattaaggtgaccctgtttcttattaaaagcaagagggtaggggaatttttttaattttatttatttatttatttatttatttatttagagacagagtctctctctgtcgcccaggctggaggcagtggtgcgatcttggctcactgcaacctctgcctcccaggttcaagcaattcttctgcctcagcagcccg

SEQ ID NO: 56996 - DNA, 1106 bp, Homo sapiens
tattttctagatgcatacctcatggcatgttagttacattttgtgctttagcaaaattacacgtcatttcacagctctttgggttatttggcaaattgttaaagtaatgctataagttttagtttaatgtaacttactcacttatggataaactgaacagtttttcctttgcattcagtcgtttgttaatgtttgtcttcatgaagcctggagttgagcataatactctaaacatactgtgacaaacataaaattcagtggaactgttatgactccaaatctgtgcattagatttctattaaaattttataaagcagtattgtcacactactagctgtcacagctagaacctttttcacatgacagtctgggtctgtattctgcatttatgaaatccagtttctgaactgttaatatgactgtataactaattgtttaattctgcctagcattctaagacctttaaaaatcttggtcatggaatacattggtactccttcagatgtatatattatttcatatgccatgtttactttccaagtctttattcaagttattgacatggaaaaggacagggtccaacatatccaggccaaattatttcatattgaccacattcttttaaatataaaatgattttctacttcaaacattgtgtgattctcatttgtattaagtttatttaaggagaagtatgtaaatgactagtactttcagtagtcttaaaaaatcaagtggattgagggaaggaagtgactaaatttttttaaggtttatattttgtggatgctgattcacttggaactaggagtgtggtgaatatttgggcttttttattttaaatgggcaatttagttaaaatttgagtgataaaattctggtttttgaagttaatgcatcagtctcccctcatcatagttcaggctgccataacaaaatagtatagactggatggcttaaaaaacagaaatttatttctgacagttttggaggctggaagtctgagatcagggtgccagcatagtagttctggtgagggctcttcctagcttgcacacagccaccttctgactgtattctctaatggagaagagagcaagctctgg

SEQ ID NO: 56997 - DNA, 1080 bp, Homo sapiens
gagaacatagaacgttgtttctgttctaaactgttaaagttaatagagctttgttgggcacatactgcctgatgatgatacagggatgtaatatgtaggggaatgaagatgttgtcctgtcatttggattccatgtgcataggttgatgtgtcagtcatttcaagcatattaaattggataatatatctttttaaaatagacagtctcagtgggttcactgtgttttaactattcacgacagcatggaattataacccttattctctatgatagagttaagcagttataaccatatataactgatatgtttcacaagtgcatgatagcttattgtgatcaattttgttgtgtattggttattggaatttgacagttaaaaagttctatgaaattatcattgatatgggaagttttttcagaatttctgtgaacatttgaatttactgagtttttcatccttatttttctttcttatgtacatcttaaggactggggttttaaggggtgtggcaggaggttttggactcgatgagtttccaccgaaatgtcggagaagtcaggccagagcacaaaagcaaaggatgggaaaaagtatgcaacactcagtttatttaatacttacaaggggaaatcattagaaacacagaaaaccacaggtgagtaaaatcaagtgacacttatgtttttcatggtttgttttgttactataagtgatacacctgctgctatgagaagctaggatgtacccaagttaatacaatgctatttacatttgcgtttttatgcatgcacacatttttcagaggatatgtgataaacatcttataattgaaaatttatactttcatagagccctttaaaaatatttttgtttttctctgttgtcagcagaaaaaaggtagaactgtgtggctctaaaggggaaactcagtcaatgagattgataggcacagacctatatattagtgggaatttagtatctttttaattatagactagagaaagtcttatgtttcgtgtgtgggggtgtgtgtgtgtgtgtgttagatactgtgacctagtgaatatagtgaaaactg

SEQ ID NO: 56998 - DNA, 3338 bp, Homo sapiens
attacagagtcttggaaaagtcggtatttcacggcgtatgcctccacctgctaacctcccaagtcttaaagcagaaaacaaaggcaatgatcctaatgtaaacattgtacctaaagatggcacagggtgggcatcaaaacaagagcaacatgaagaagaaaagtgagtcaaagtctgttaaagaatgaagcccttcccctttctttgtagggaacttatgtttgagtacctgctatttgctaagtgttatgctgtctgtattacatattacatattttatactctttaaagtcttttgactatagtaacttttggttaattttccctattaaaagtatttcaatttgtcagggtagaacagatgacagaattgggaatcacaaccttgcttatgtcatagcctttattaggctccccgctttcatactaccaccaactcaggtattccctttccaatatgattaagagttgactccgatacctaaattccatgatactaaggatgtctgtctgccaatttactgtgtatctccagcattgaaactgcctgatgtttcataggtgctcaagtaataatttgtatatactgtagcaagaaagttaggatagaattaatagtgtccatcttagtcatccttctttcaacaactatttagacttctgtatgtcaaggattttgccagactcttagctaattgaatgaccaagcctaaatagtggtaatttaaaaaaaataagacaagccattggatacttgatgttttcttgcctatctcttatcaaaattctatactcctgcctggggagatttatatagtaaatttgactacttctgtagtaatgtatcaaatacgtaaatgcttgttagctgtagtaaaattattttatagtaatgagtcagttataggtatgagtgtcccagaaacacattgcattttgtgagcctcttaactactttcttatttttaagcattacctcattacaagaattgaataaaactgtacaccctttcaaaacaccttttactcatgtgaatgcattaggcaggttgctgttacctctttgaataacagtagtaagtacagtggtgatcctgttgactgccaggtggggagtttgcttagctttagccctcaactaatttcaccagtccagactgtatgtatgtttatactgctatttttaattataagtgttcacttcttcaaaacagatatttggtaactgtgtttaattaaaagtgtgtgtgtatgtgtgtgtgtgtgtgtgtgtgtgtgtgttttaaacaaaatggaaaacaagcaaaactcatctcattgggttattcaaaggtagagatgaaagacgataaaaatagccataattcatttaaaggaatgttgcagagagaaaacatttattggagatttaccaatgaataaacatatagccaaaataatttgtacacaggtttaccttaaatataatattgattttatttaaacatacagtatctgaaataatggattcatatttttttttaagaacaccagaagtgccaccagcacagccaaaacctggggttgcagctcccccagaagtagcacctgctcccaaatcatgggccagtaacaagcaaggtgggcaaggagatggtaagtggacattagttggggaagctgcctaggcttgatagttactgaacagccatgcaggagataaggggtgaactgtgttttggtagagccataaagcattgttaaaggatatactcaaggctcttaaaaaggttttttaaaaaatctcttgggctagctaagttccaatgtcaagagccatgtatgagtcaatgatattggttaaggaaaggagtctttaagataccctgtgccccacatcattttatctttacctctgcatatccaagcaaagcttgtaccttcaaagtatccagccatcgcatagattgttagaaaccatactcatttttcatctatgtccccaacatctcctgtttcagacatgctgccacgattcctgagaggagaagagctagaaagtagccataaagcaccactgctgtaatattcccctttcccccaaggaatgatggaatccccagcagaatttagttttcccactttcgaaacaggaactgtctataaaacattctatggaagaaccaatctgggccctcaagctaacaaaactagctgttttaatttatagaagtacaaaaaataggtagataggaagttgggtgaatagtgaggtgtaataatcttagctgtaaattaaatcaaagtaaagtaaatgaagcaataaattaaataaaggcattttagcctcatcttgatcttggggtctttattcatcaaacactatttcagtaatatgatttgaacgaattctgagaattcttagcagaggaatttgatgtgtattgaaaatgtaaggagtcataatgaaagagaaacaagctcttcacttgcatggtcatcttaaatgagtcctctggaatggtactggtagattactgtcttagactttcatctcctcatggctgatcattagcttttcaaaggagtctaggtgaattttaaagtgatatggctatgaacagtcatcactgaaatgtggaataatttaagagaaagaggcagagagctctatcctgggagggtggtttgtattatcttcagtataaaagttacctttaatgtttttttaaaaaaatctataggaatccaagtgaatagtcagtttcagcaagaatttcccagcctgcaggcagctggggatcaggaaaaaaaagaaaaggaaacaaatgatgacaactatggacctggacccagtttacgtccaccaagtaagagtactttctctttaatacaaaatgagatcatatttgtgtattatcttgcaatacaacctcctgcttgctgttgcatatattatttgcctacttcgaaaaggcagactttgtactatagtcacttgctactcaggtatgatttttgcaccgacagtatcactgtaacttgagaacatgttagaaatgtgtcatcttgggcctcgcatccaacttactaaatcaaaatctacattttaacaagatgtccaggtgactttcatgtataccaatatttggatttttttatactagtttttgagcaggcttccctaatgtgtaactatttacttactactgtattaatattcggtgattcctcactttctgagctcaaactgaggaaacaaataattttggataatgagggatagtttatgtacattacaaagcaaaaactaaaaataaaagtgtaaaatgttcgagggatttttaaatgtcttctta

SEQ ID NO: 56999 - DNA, 1405 bp, Homo sapiens
atgatgagagacagacaccctccacccaagacagaagcccacagtctttaataacttaatctggagagggacatgctatcacttctgccatattctacaggttacacagaccaaccctgctatattgtgagaagggactacacttagtgtaaataccagaagataaagatcatttgggctatccaggagactggttaccatgcagtgtttcttagcaaaaccacctagctgttttatttggttaagtgtaattacaccagataatttcacgcaatctgttcacttgggggcatctgtaactaacaataatatactggaaacagacaaatgagaatatcactgtcaacccttccagattgtagaagtcccatcttccttccctcaggaaacctcaggtgtgtcactctgaaacatggccatctgatatatggagaacagtgattttaatttctataccaaatattgataaagcttcatagagaagttctaatattttcttctcccaccccagtatttgcttgtggtgacaccctctgaggtacatcctctccactttggaagccactactacgcaaacaacttgaaagcattagtaggacctggattagacttttcctgctctttcactctgcttacttgctttcattttcctgaaatacattttggtttcactttgttccattttcagatttttatctttttccttttttctctgccttcatactagatgttgcttgttggagagatggtggtaaggctgctggctcaccttcgtcatctgatcaagatgaaaagctccctggccaggatgaaagcacagctggaacatcagagcaaaatgatatcctcaaagtggtggaaaagaggatagcttgtggtcctccacaggctaaactgaatggacagcaggctgctctcgcttcccagtatagagctatgatgcctccttatgtgagtattgttaaatgaacaagcattcaaacaagtggtttttgatctggggtccaaggagcgaattgttatagggaaaagtttaggtctttgttttcattaacatctaactaaaaattagcattctcttttattgtatggtatattgtgagaagggactacacatggtgtaaacaccagaagatagagatcatttgggctatccgggaaacgttaccacgcagtgtttcttagcagaaacacctagctgttttatttggttaagtgtagttgtaccagataggaaacaaatcagcagtatctttattattaccagggattgcagatattttcatatcacattacattcaacattacttcaaaataattattagacccatagataatgatctaataaagaagcacgtacgttaccataccacagatttattttgtaaatacagagaacaattac

SEQ ID NO: 57000 - DNA, 2101 bp, Homo sapiens
gggggctgtgctaatcttctctgtattgttccaattttgctgccaaagtgagcatatacattactattttttaatcattctagactaacagagggagatgaatgattaaatacaattacttgttaaatgttttttgctctgatgcctaggctggagtgcagtggcaccatctcggctcactgcagcctccacctcccaggttcaagcgattctcccgcctcaaccttccaagtagctgggattacaggggcacgccatcacgcccagctaattcttgtatttttagtagagacagggtttcaccatgttggctgggctagtctcgatctcctgacttgaggtgatccttcctcctcggcctcccaaagtgctgggattacaggcgtgagccaccgtgcctggccattaaacgttttcctaaaagaagtttgggagtatgctgacctggccttgaaaaatgatttatacccaattactttttttctaatcattttcaaattgtgctaccaaagacccctgaactttcatgtgagagggtaggataggaaagaggggaaaccacgtgggcatcattcccactttcatcagtgattatatttgaataaagtgttccactaattaacaaaaacatttaaatatcactactgtatactgagaatttaaaatttgtttctaaaatgaattttctggcaaattcctagattttaagcattttttaagaccacatgaaattatgtctggaatgaccagatgaaggatttaatgcaactttagctatgaacatatgcctccagtagtgtctttattaacttcagtatagaagtgtgatgcaactgaaaattctccagagtatccctcaaagtttccccagctgagtttcagctgttgcttgacttaattaacattgcttcaacctgacttaagagaaatttcttctccttttttttttttttttttttttaataaagacggagtttcgctctgttgccaggctggagtgcagtggtgcgatctcagctcactgcaacctccacctcctgggttcaagtgattgttgtgtctcagcatcctgagttactgggattacaggcacgcccaccacacctagctaatttttttgtatgtttagtagagacagggtttcaccatgttagccaggatggtctccatctcctgacctcgtgatctacccgcttcggcctcccaaagtgctgggattgcaggcatgagccactgcacctggctgagaaatttcttctttagacagcataatcatataaacatagccttacttcaaatgtaagaattttcttatctaacacacagttactacttactttttagaaaaactagtcttctatttcaggatataaattatgtttttacagtaatataatttcctattatttacataatttgacttggatataagcatatagtcaatgaccaagacattctttgacccttcttcccttcaaaatcataggatgaatcccttggtgttatttgttcccagaatctatcttatgtcttctcttaagtttagtttcccagagccaagttcctacagagaacagtatctggacctgtttgggacagtttataatgatcatctgtgcagtaacttgattgagaattcacctatgccatatacatagaaaatttctgggtagctctctgtcccccttttccaactcacttccttggattgtggactgtcttttaattttatctgagctgagttcttccccacgcctgccacccctacatttttctttttgaggtgctggggctggggactgatgttatcctccttatccacaaatctgcctctgattattctactcctgcttatggaggaaggccaacagcatttgcttttcaaatattttcactttgccgtttgctagggtgcatgtgtgtacatatcctgttgatacaattactttaatgtaatttatatcttgttgacacagttactttaatgtaattttacattacatatctcattgatacagttactttaatgtgtacatatcttgttgatagttactttaatgtaattttattaatataatacagaagtttttcatatgtgctc

SEQ ID NO: 57001 - DNA, 1676 bp, Homo sapiens
cttgttaagatttcctgaaggttgagtggattgtgtgattctgagttgtgtaattgatcgttttcctatcctcacagtacagttgtcattagtaaataattggctaactcttataagacagaacagaaataattcattcttttaagcatttaaattaatttacataggattttgaaaactgaaaaccaggccggggacggtggctcacccctgtaatcccagcactttggaaggccgaggtgggcgattcgcctgaggtcaggagttcaaggccagcctggccagcatggtgaaaccctgtttctattaaaaaagtacaaaacaattagtcggacgtggtggcgtgcacctgtaatcccagctactcgggaggctgaggcaggagaattgcttgaacccaggaggcggaagttgcaatgagccgagattgtgccattacactccagcctgagcgacagagcaagactccgtctcaaaacaaaaagaaaactgaaaaacatggccctaaaattgatgacacttgtttttctcttcttcctttcatattatggactccccattttctttctttttttttttttgcttattatatgagacttgaacatcctcttgaattattttcctcaaaatatatattttgaagttagttttattcatatcgttatccttttaacatatttgttttatcttaaatatttgagaattcttaaaaactttgtcagctgttacttaagagttacgtattatcctatcattatgtattaatattaattttttcatacacatgtccatgcagaacatattaggtatcttggtgtagaaaacactaatgttgaaatgaactaaattccaatcttttagtattctcccagtttagtatcataaacttttgtatcttttccatgacctgcctttcattagaggccttcgaggaagaggcccacctccttcatgggcctctgagcctgaacgcccatccattcttagtgcatcagaactgaaggagcttgataaatttgataacctagatgctgaagctgatgaaggttgggcaggtaagaggcaaaattaattaagtcctttaaattgttagatgctttcaagcagccagtctgagttttccttaatttaataggtgctcagatggaagtagattatacagagcaactgaatttcagtgatgatgatgaacaaggaagtaacagtcctaaagagaataacaggtaagttgtgatatcttttactaataacagtatgaatttgttgatacaatattagctacttatgcaaagaagctttgttaatagacaattgtttgttatttgtagaatttatatattctcagaagttttactgaatagagggtgcttaatgagctagattaatacagtatacagctaatcaaggaattaaaatttgatgcgtctcaagaaagtttatttaaaaacatttagggctgggtgcggtggctcacatctgtaatcccagcactttgggaggccgaggcaggcagatcacttgaggtcaggagttcgagaccagcttggccaacatggtgaaaccccatctctactaaaaatacaaaaattatccaggcgtggtggtgcatgcctgtaatcccagctactcaggaggctaaggcaggagaatcacttgaatccgggaggcggaggttg

SEQ ID NO: 57002 - DNA, 2092 bp, Homo sapiens
atatttggtttttcagcttatctctgagctgtggatgaagaaactcagcacaagagagatgaagtaatttgcatatgatggcactattagtaaatggtagtctgcattcatttaaaaagatagtcaagtgttttcgttgtgtcattgtttaatctttttataagcattccagctgggttacatatggctcttaagatttcttcaccctagtagcttttaaaatcaatatgttaaaaacatttttttaattacttttattgtttttgcatagttgcaagcagtgattttaaaacctgtcattgttttataacacattaatgaaaatttagtcattgaaacttggatgtttcagatgatcctccgattctccactccgggttctagatacgcttttctggatctttcagtctaaagatagaacttttcttcacccagactaatttgtaggaatttcttctcctttggggtatcattacagcactgactctgtctttttcactttgcttctttggctctgtgctttttacctgtagctgtaccttaattttctcagggctcacatgccatcattttggatatttaataccttcatttctctcccttagacattccaactctggcagctgcttctaaagtatccatgctaaatttcctttgtctctaaatttagattttgagattcactgttgtgcttctagttttattcagcaaatactgaatgagcaacaacgtctggcacaataataggtacatactcagtaaacattggaccgctggattaattattctggtcttagtttggtgaattatctagatgtaatatatttcccatcttatgtgttttcattttaatgtgtatgttcatcagagaaatttctgatatttttgtggggtttttccttctccatgcctgatacccagtgttagtcagaaatagagttgtcataactcatctgataccttaatgtttcagcatccacctccagatcgacaggcagtacctggaagaccaggcccctttccctccaagcagcaagtagctgatgaagatgaaatatggaagcaaagacgaagacaacaatcagaaatttctgcagcagtagaacgtgctcgtaaacggcgtgaagaggaagagcgaagaatggaagaacaaaggaaggcagcttgtgcggagaaactgaaacgattggatgagaagcttggcatcctggaaaaacaaccatctccagaggaaattagggaaagggagcgagaaaaagaacgggagcgtgagaaagaacttgaaaaagaacaagaacaggagcgagagaaggagagggaaaaagacagagagagacagcaggaaaaggagaaagagctggagaaggagcaggaaaaacaaagagaaatggagaaagaaagaaagcaagaaaaagaaaaagaactagaacggcagaaagaaaaggaaaaagaactacaaaagatgaaagaacaagaaaaggaatgtgagctggagaaggaaagggaaaaattagaggagaaaattgaacccagagaacctaatttagagcccatggtagaaaaacaagaaagtgaaaacagctgtaataaaggtttgatagtattcttcattctcttttaaaaactttacaaagagctttatgttggttacagtttggggtttgtatattttaaatatatgtaatcaatataaaagtgattgttttatgatagcatttgcagtacaaaatatgggctagagccgtgttttctaattctgtatatgaacagacgtctctgaagtgtttctcagttattagatgagcttcatttctgttttatctgcagaattgtattggcttcatagtcacatatactgattctccccctgcttttttctgactccaagacatttaactaaacaaaatctcatttgttcacatgcattaatacctctaaaactgaactggcatagagcttaatgagtatgttggattatcataattaaatgactgcacctagttcataatttcaggtttgctgtttaatcagtttaaacatgcaagcttccatggtgtagttgatatgctattaaactgtaatttcctggagt

SEQ ID NO: 57003 - DNA, 1012 bp, Homo sapiens
ctagtgatcactctgttgtcttcagacttaaactcattagttttccttacagataatagtccctttacccaataaataactaaataaaccaacatgctctctttttaagtatttataggccatttgtgttttcatgtagattttaatgaactaccagtaaatactgacaattacattgatgtttattgaaacaaataaaaaatatgtggagttggaaatgtttcattatttaaaaaaaaaaaacatagattttatatgatgaagcatttggatctctgctctccatctctaagaatgcagcttttaggaaatctaaggttttgataatctaatgttacctcattgataactaccaatgttaaagtagaaaataatgttttagagtgtcgaggatattttcttcctcattaacttttattatacctcagtctttgtaaaaatcctgtgtttgataagtgtcatagatgaatactattacctttcaccttttctttgagcagaggaggaacccgttttcactagacaagacagcaatcgcagtgaaaaggaagccacaccagtggtgcatgaaacagaaccagaatcagggtctcaacctcggccggctgtattatctggctatttcaaacagtttcagaagtctttacctccacgattccagcggcagcaggtaatgataaaaatattttatcatgtatgtgtgattgaagtggtttattatgcagtagtctgggaaattagacataaaactgataatacgtaaagcacacaaagttcccttgaaattatttttccttgtaaataaaagttaacgtgggttttaccttgaccttctgtgtcattccttttgatcttctgcctcatttatagacaccatcttccatttctaggagatagatcatacagtgcttgagtataaggtaaaatgttatagttcatctttcagttttttgtcttgccaactcttaactgttaaataccttttgaactcttacttttccttcaaggattc

SEQ ID NO: 57004 - DNA, 1128 bp, Homo sapiens
tgaccaactaaggtaggttaatggaatttaggaaagaattttctctgaaagttatcatagtataattttcatgatgtttgtattgacatccagagtcacagtacttggtgtctgatttttatatgcataatattttctttcttttgaagtaaaacaggctgctattgtgattttgcttattttgcttcctcagttcttaaatgcaatttttatttaacagcagtaataaaattccattcacagaacaacccttacataatttccaccaatcttttactcaggaaaaaaatgcttttaatatggagaattccacctaacaattaataacctgtattctatgtctatcatggttttgtttcgttcatttttcaaaatcctcatttcacctttttctgaacttttgttacaggaatgattcctcctaaaccattaatgagaagagaccagatggaagggtcaccgaacagttctgagtcatttgagcatatagctcgatctgcaagagatcacgcaatttccctttctgagcctcgtatgctgtgggggtcagatccctatcctcatgctgagcctcaacaagcaactactcccaaagcaacagaagagcctgaggatgtaaggtaataaattatttcaatttaatagatgatacagaatattttggtaaaaggaaaactgtgtagtgtttctgaagatcattccaatttaggactgaagcataaatctggtttccttctatttaatttagcatgctacgcttactctttggacatattctctgtattcattagggcattttgtaacctggttctgtactcaattgtatgctgtaatttagtattagatgttgaaattggtaggttcttttttgagataggaacttgctctgttattcaggctggagtgcgttggtatgatcttggctcactgcagcgttcacctcccaggctcaagtgatcggcttacctcagcttcctgagtggctgagactacatgcgttcaccaccacaccccgctaatctttgtggggttttttgttttgtttttgtttttgtttttgtttttgagacagagtcttgctctgtctcccaggctggagtgcagtggcgcgatctcagctcactgcaa

SEQ ID NO: 57005 - DNA, 3743 bp, Homo sapiens
ttatttttaattgtggcagaaaccacttagaacattagatatatcctcttaacaaaaatttaatcatatggtaccatgtagttaactgtaagcagtgttatacagcaaatctccagaacttttttttatcttgcatgactgaaactttatacctatttcctattcttacctttacctatatttcctatatttacctttacctatatttcctatattatacctatacctatatttcctatttccccctactcctagcccctggcagccaccattatggtttctgctttgatgaagttgattatttcatgttcctcatgtaagatatttgtcctgactgactgacttcacttaagcataatgtcctcagggtttatccatgttgtagcatatgacactatttccttcttttttatccctgaataatattctattgtatgtgtataccacattttctttatccattcagctattggatatttaggctgtttccacctcttggctattgtgagtaattctcctctaaactttttatatagcgagagaaagattctcattatggttaagagtcattgctttctgttttagagggattattttgctatatacttacgcatgggaaagattgctttgttgattatacctttgaattcttatcatcataggtctgaagctgcgttggaccaggaacagattactgctgcttattctgtagaacataatcaattagaggctcacccaaaggcagactttatcagagaatcaagtgaggcacaagtacaaaagtttttaagcagatctgtggaagatgttagacctcaccatactgatgcaaataatcagtctgcttgttttgaagcacctgatcaaaagaccttatccgctcctcaagaggagcggatttcagctgtagaaagtcagccttcccggaaaagaagtgtttcccatggatctaaccatacgcaaaaaccagacgagcagagaagtgaaccatctgcaggcattcctaaagtaaccagcagatgcattgattcaaaagaaccaatagaaaggccagaggagaaaccaaaaaaggaaggctttatacgatcttctgaaggaccaaaacctgaaaaagtatataaatctaaatcagaaactcgttggggcccacgaccaagctctaacagaagggaagaagttaatgatagacctgtgagaagatcaggtcccattaaaaaacctgtacttagagatatgaaagaggaacgggaacagaggaaggagaaagaaggagaaaaggccgaaaaggtcactgaaaaagtagttgtaaagcctgaaaagacggaaaagaaggatcttcctcctcccccaccaccacctcagccaccagcaccaattcagccacagtcagttccaccaccaattcaaccagaagcagagaaatttccttcaacagaaactgcaactttggctcaaaaaccatctcaggatactgagaagcctctggaacctgtgagtactgttcaggtagagcctgcagttaagactgtaaaccaacagactatggcagcaccagtagtcaaagaagaaaaacaacctgagaaagtcatcagcaaagaccttgttatagagaggcctcgaccagattcaagaccagcagttaaaaaagaatcaactttgcctcccaggacctattggaaagaagctagagagagagattggtttccagatcaaggatacagaggtcgaggccgaggtgaatattactccagaggtcgaagctatagaggttcttatggagggcgtggcaggggtggtaggggacacactcgagattatcctcagtatagagacaataagccaagagcagagcatataccctcagggcctctcagacagcgagaagaaagtgaaacacggagtgagagctctgattttgaagttgtccccaaaagaagacgacagcggggttcagagactgacacagacagtgaaattcatgaaagtgcaagtgacaaggacagtttaagtaaaggcaaacttcccaaaagagaggaacggcctgaaaacaaaaaacctgtaaagcctcattcttctttcaagcctgataatcatgttcgaatagataatagactgctagaaaagccttatgtaagggatgacgataaagctaaaccaggctttcttcctaaaggagagcctacaaggagaggcagagggggaacattcaggcgtggtggaagggatcctggaggccgtccatcacgcccttccactttacgaagaccagcttatcgggacaatcagtggaacccaaggcagtcagaagttcctaaaccagaagatggagagccgccaagaagacatgagcagtttattcctatagcagcagataaacgacctccaaaatttgagcgaaaatttgacccagctagagaaaggcctcgaaggcagcgtcctactcgaccaccaaggcaagacaagccacctcgatttagacggctaagagagagggaggctgcttcaaaatcaaatgaggtggtagcagtgcccacaaatggcacagttaataatgtggctcaagaaccagttaatactcttggggatatttccgggaataagacaccagatttatctaatcagaactcttcagatcaggcaaatgaagaatgggaaacagcttctgaaagcagtgatttcaatgagaggcgagagagggatgaaaaaaaaaatgctgacttgaatgcacaaacagttgtaaaggttggagagaatgttctacctccaaagagggaaattgcaaagagaagtttttctagtcagagaccagtagatcgtcagaatcgacgtggcaacaatggtccacccaaatcaggaaggaatttctcaggtcctagaaatgaaaggagaagtggcccaccatcaaaaagtgggaagagagggtgagtactttgttttaaatatagttgcttttgcacctttaaagaagctaaaagtagagttcttggttgaattatgcaaagagccagtctagataaaggaccaaaaaacattgttcttcccaaatgctttattctctgttctcaaagtgtaagggtgcttaaggaagagaggttaaggtgtcttaggagtctttgcctgctacgttacattttccagaagagttctcttggaaacttgtagctttgggaaaatgttcacatctaaggagggacatgtactgtgtccttatttggtaagttatctgatgagtagccctcccttctttctcagtttctcctaataaacctctaatgctacacaggtgtcctctgagatttaaattaatgttataaccatatactttgtcactctagagagaggcccagaaaacaaatccctgttctactaccaaggacaccaataacataattgccatggcaatggatttttttaaaaaaatattttttctcaagtaagctaaacttggcctgttttttgttgttgttgttgagatggagtctcgccttgtcacccaggctggagtgcagtggcgtgatctcggctcactgcaagctccacctccagggttcatgccattctcctgcctcagcctcccaagtagctgggactacaggtgcccaccaccatgcctggttaattttttgtatttttagtagagacggggtttcactgtgttagccaggatggtctcgatatcctgacctcgtgatccacccgcctcggcctcccaaagtgctgagattacaggtgtgagccactgc

SEQ ID NO: 57006 - DNA, 2053 bp, Homo sapiens
gtgagggacggagtctcactctgtcacccaggctggagtgcagtggcgcaatctctgctcactgcaacctccaccccgctgggttcaagcatttctcctggctcagcctctctagtagctgggattacaggcgtacactaccatgcccggctaatttttgtatttttagaagagacagggattcgccatgtttgccaggctggtctcgaactcctgacctcaggtgatctgcccacctcggcctcccaaagtgctgggattacaggtgtgagccactgcacgtggcccaacacatgaacttttgagggatatgttcaaatcacagcattagtttgctgttccagataatttagaaaaaggaaatttttacttggaatttgaacattcccttaaaattccaagagaatcaggataaccaaaataaacagaatagtttatttcccgtaaccaaactattagaattttaagtaacaatactcagggaaaattttgataagatttttgtgccatgtaaatctcaactatgtagcaagatttttgtgccacatagatagataacaacaactttgaacctgtagaaatggcagtgacgattataattaaatgttttttataagagcaccatatagaagaaatgaactcattcttaaaatgtttcaggttatgaccagggacctggtaagcttttatcttgagtaatactataggctaagatgcaaatgaattagtaaacccatttcccatgatcattttcacttggaaatttaaaaaaacaacctgaaattattcttttaggaaataagaactattaagaactgtaggggatacatttggtttgtgaagtgaattatttccatattaaagttttttaaataattatatcaatgtgtaaatctgattacatttttttaaatgtacatagttgtaaatatagaatgctttttaaaaatttttgttttcatatgctgcccacttttggagagcatccatttgtgaatactttgaacttgcttggatcacagaaattttctgctataaacagtgttaattagctcatttataatatgatagacaaatagactctaagaacttctggtataactagaattctagaatttaattgctggaaagaactctagggagctagtctactttcttgggaaacccggttttagtaaggttgtgctgaacaaaagttactaatgcttgtttggttacagttaagagttttctatcccaacagtgtttcatcttagaatgaactttagaaactgccaataagagcatttttcttttgtttgggtaggtggaaatagtaatatctcaagttatttttttgtaggccatttgatgaccagcctgcaggcacaactggggttgacctcatcaatggcagctctgcacaccatcaggaaggagtacctaatggtacaggacaaaagaactccaaagattctactgggaaaaaaagagaagaccccaaaccaggccctaaaaaaccaaaagagaaagtggatgctctatcacagtttgatctcaacaattatgcaagtatgtcttaggtttctttcattttatttatttatttatttatttatttatttatttatttgctacattttaaaatgtagatgccacaattaaagaagttttccaagaaggaaagatttggacattcaaggtatacatagtggctgattatgaaacactaactgattgaacttaaactaaaataactccagcttttagcgtagccttgaatgcttaataaaatttttgttaaaaataatccaacagcattgcactgttcttccaaaaaagaggaagaaaattcagtaaccactctactttgccagatttgagaaagcacagaaatttgattcttagttatattggtatagatgtattattaaaaacaaaaggaactaaatgttaaactcaataattatgtccttggtaaaattggtgtctaagatgtggcaaatacagaataaataataggacgagaggcagtgtcactgtggataaataggaaagccatgaagtaatagag

SEQ ID NO: 57007 - DNA, 1003 bp, Homo sapiens
actttgggaggctgaggtgggcggatcacctgaggttgggagtttgagaccagcctgaccaacatggagaaaccttgtctctaaaaatacaaaattagccaggcatggtggtgcatgcctgtaaaaacaaaacaaaacaaaaaagacagtaaaaacagataaaaactatatatatttctgaagtggtgatagaaattaagctattcatttcaactcattaaagttatctttaagagttagtcgtctttagttctttttcctggtaacactgtttttaagtaatatctctaacctaaaatgttaaaaagaagaggacattggaaactaaaaagtagtgttcgaattttccataaatgctacatgtagttgggtgaactaaggaagttgaaataataagataggctttacacacacacattttagtgtaagtgaaaaactgagatgaaattagaattatgatgaggtctttccatcagtctgaagtaatgtgtgcatgacatcctttgaaatgtttgacttagacctttcatggaaatgagaatatgcttcattttacagagttaatgatttttaaaaggattttaaaaacaagtagaagtgttttataaatcagaataaactgggtttttttcttttgaaatcaagtttcccttcttttttttttttgtttttttttttttttgagacacagtcttgctctgtcccccaggctggaaggcggtggtgtaatctcagctcactgcaacctctacctcctcggttcaagtgattctcctgcctcagcctccttaatagttaggattacaggcacatgccaccatgcccagctaattttttgtatttttagtagcgactttagtagagggtttcgccatgttggccaggcagctctcaaactcctgacttcaagtgatccgcccaccttggcctcccaaagtgctgggattaaaggcatgagccaccgtgcctggctgaaatcaagtttctattagaaaaatggaat

SEQ ID NO: 57008 - DNA, 1164 bp, Homo sapiens
gagtcgcactctgtcacccaggctggaatgcagtggcacggtctcagctcattgcaacttccacctcccaggttcaagtgattcttgtgcttcagcctcctgagtatctgggactacaggtatataccaccacacacatctaatttttgtatttttagtagagacagagttttgccatgttggccaggctggtctcaaacttccggcctcaagcagtatgcccatctcggcctccaaaagtgctgggattacagacgtgagccactgcacctggccagttttaggatttttattttcaactttaagagtatgaaatcttttcagatctttacaatgaatggccatgcaatagggtgagaaataggttatacactataagttataggaactaggcctttggctagttttttttttttttttaagtactactgtactaaacatttttattaattttcatttgaaaaacagaaaatatcttaaatcctttcccacacccacaggtgttgttataattgatgatcatcctgaagtaacagtaattgaagatccccagtcaaatttgaatgatgatggttttactgaagtggtatccaaaaaacaacaaaaacgtttacaggatgaagaacgccgaaagaaggaagaacaagtcatacaggtttaaatcttgtttcaacttgttgctagttatctagatttgttgcccaaagtgtatcagcaaatgttcaaggtttttatacttgtcaaggctgttttcattattcaagtgttaaaagtgacatcatcttcccaacttttaatcattttgaccagaatcaaaggaaattttaaataaaatataaggactgtagctccttatattttgacttacagcaaagaccatctttttttttttttttaaatactgtaagttctagggtacatgtgcacaacatgcaggtttgttacatatgtatacatgtgctatgttggtgtgctgcacccattaactcatcgtttacactaggtatttctcctaatgctatccctcccccctccccccatcccacaacaggcccaggtgtgtgatgttccctgccctgtgtgcaagtgttctcgttgttcagttcctacctatgagtgagaacatgaggtgtttggttttctgtccttgcaatagtttgctca

SEQ ID NO: 57009 - DNA, 2563 bp, Homo sapiens
cagttcaagcttcccagttgctttgtttacctactcaagcctcagcaatggtggacaccactcccccagccaggctgccaccttgcagtttgatctcggactgctgcgctagcagtgagcaaggctctatgggcgtgggacctgccgagccaggcgtgggatataatctcctggtgtgccgtttgctaagaccgttggaaaagtgcagtattagggcgggagtcccgattttccaggtacagtctgtcatgacttcccttggctaggaaagagaaatccccccaccccttgtgcttcctgggtgaggcaatgccctgccctgctttggctcaccctccgtgggctgcacccactgtccaaccagtcccagtgagatgaaccaggtatctcatttggaagtgcagaaatcacccgtcttctgcgtcaatcacactgggagctgcagactggagctgttcctattcagctgtcttggaatggcaacgactacttcctcaagaccatctttactttaacaacatatcgtatgctagggacaccttatttgccccaaggcaaagttgagttgattttaaattatcttggaaagctaatgaacacaaatatcacgaaccagtagattttggattcctggcctacaaaagtatctattgtaatttatattagttcatttaaatacacagaatgaatcaaggtaaattattcatttaattgcctataacctttggaaccaaattttcagaagtcatttatttagaaaggtaaaatagttgtgcatctaccctatatcataacgtaccagccacactgcccaaattaatgcctgtggcaaatatatgagttaagactgtgagtagcattttgttagctcaggtaagttttgctgccagtgaatttactgcaaaatttcttagttcttgaatttcagaattatgtacctgtatgtcaagaatgtacaatacctatttgtcttttgtctcaatatcattttggcttctcatcattcaaaatcttattagcaaccctgacattttgtggtttgagtacctattttgaaaagtaaaggagccaagttagtgggagttgttaaaagttgcatttatgaactgttgcattcagctgcattattgacaaaaatggtccccgttaattttttaaggtctggaacaaaaagaatgcaaatgaaaaaggaagaagccagacttctaagcttcctccaagatttgccaaaaaacaggctacagggatccagcaagcacagtcttcagcctcagttccacctctagcttcggctccacttccaccttcaacctcagcttcagttccagcctcaacctcagctccacttccggcaaccttaactccagttccagcctcaacctcagctccggttccagcctcaactttagctccagttctggcctcaacctcagctccagttccagcctcacccttagctccagtttcagcctcagcctcagtctcagcttcagttccagcctctacttcagctgcagctataacctcttcttcagctccagcctcagccccagctccaacccccatccttgcctcagtttcaaccccagcttctgtcaccattcttgcctcagcctcaattcccattcttgcttcagccctagcatcaacttcagctccaacgccagccccagcagcctcttccccagctgccccagtcatcacagcaccaactatcccagcctcagccccaactgcctcagtcccacttgcccctgcctcagcttcagccccagccccagcccctaccccagtctcagccccaaatcctgccccacctgccccagcccagactcaggcacagacccacaaaccagtccagaatccactacagactacatctcagtcttcaaaacaaccaccaccatcaattaggctgccttcagctcaaacacctaatggcacagattatgtagcctcaggaaaatccatccagaccccacagtcacatggcactctgacagctgaattatgggataacaaggtggccccaccagctgtgctgaatgatatctctaagaaatgtaagttgcaaaagagaagtgaggggtggggaatggcataggaatactgaggtttcttttcaattttatttatatactctttaagtgttttctagccatctcattttttattgtaggaaaaagtaatagtaatcctctcaactttcttaaaatttttgttttaagcatgtttaacaagcatattatattttatggaaataattttgtgttgatgagaaaataataggcaatgtttgggggggtcttgtacatgcatatctcatttgattacagtttgtggacactgcatttttaaaaattaaaagttcatggtaactgtcaagcaagtcttctggtgtcatttttccaacagcatgtggtcatttcatgttctgtgtcacattttggtcattcttgcaatatgtcaaatttttcatcatttatctgttatggtggtcagttatctttgatattgtaattgtttcagggtaccatgaacacccaaataagatagtgaactt

SEQ ID NO: 57010 - DNA, 1912 bp, Homo sapiens
ataaggtgtgtctcacttttagacattaaacacttattttcaatttagtctcaagaaagatcttaatgaaacagaaaataaaagtgcaattattgttttctggacttttctcccatgtttctatcttgaggacttaagtagtataagtatttagaaactgtttatagcagatagttattctaacataatttctcaaatgtgatattggtaaatgactgttgggggtcagtgattcttcattcattcattgaatgaacatttactaagcactcacagtattctaggtagtgttctaacctgcgggcttacaaaactgggactaaaaacagtcaaaaagccctactgtcatgggacttccattgtcctgtgaggagaaaccactaataaaaaaacatcgtgatcagcactgtggagaaaaacgaagcaggaaaggtacataaggaattttccaaggttcacaaagacagtttaatatagggtgaccacgaaagcctacttagataatgcttgagttaaagacttgaaggatataagagagtatgctattcaaatgtctgaggaaaagagattccaggttcagataatagcaaatatgaatgccatgagacaggagcacacttggtttgtttgaggaagttcagggaagtccatgtagctggaatgaagtaagagatggaaagagaatagatgaagttggaagtcacacctgagtagcaggtggatcctgtagggcctatggaagaggtgggaagacactgaagggttttgagcaaggagcaacaggatctgacttttcaaattattctgggttgtctgtgaaaaataattcataggtggcaagagtagaagttacgatattacaataattgaatgatgatagcttaaaacctgggaagtggcatgaaaggtcatgagaaatagttggtttctgagtattttgaagattgagctgacaagatttactaaagtgttaaatggagtatgagaagggacagaggagtcaaagttagctccaaagtttttgggttgaacagtaggaaatactagaattttcagtaactgagattggacagtttttgacatgttagatttaagatgcttattatgcctctgagtggaaatgtagttggatatgagtctgtagttcagaagagttcatctagtttgaagataatgaatttgaagtcattagcatatagatgatgtttaaagtgatggaatggtataaggttaccaagggagaatgagagtagttaggaaagagaatcaaaaattaagtcttggggctttctgactccaggaaatgtaggaattagagaagctaagtgattagagaagtatcctaaaagtcaagtgaaagataagttcaaagaagggatagattaagtgtgtcagatggctgctggtaggtcaagtaatataggtgttcaattgatagagttacatgatggtcactgatgactttgataagaacattattggtggagtagtagggatgaaagcctggatgaaagagtgagtttaagaggaaatgaaaggaaagatgagtaccattttctctccacatctgtagagattggttctcaccaccatagaaaccaaaacccagggatgctcaagtctcatataaaatgaagcagtatttgcatgtaacctatgcataacctccctgtgtactttaaatcatctctagattaattatatacctaatacaatgtaaatgctatgtaaattgttgttataccatattatttagggaataatgacaagaaagaacagtctgttcttgtatagcactgacaaccatttataatttttttctgaatattttccatccatactgggttgaatctacagatgtggaacctgcaaataaggagagccaactgtataaagaacttgaacgtcattt

SEQ ID NO: 57011 - DNA, 1793 bp, Homo sapiens
tactgtcttttatttccagtgtattcatctgtttgttggtagtggtgtctttgtgtgttgcttttacgtttgttttaaatgaggaaacaacttgaagctgtgctttgcccatgatcacactcatgagagccaggactttaaaaacttaagtcttgtgctagtttcatcttatcagttgttttctagtacagacaaacaacagttaagagaaaattatcctaaaatataattaatgtcggtctcagttaatatgtagattgtcttaaaccttctattgtacttaaactgtatagtgcttcataaatcagtcacatctgaactatactttgcaagcaagttttaaaatattcttttactagggagcgaagaatggtcaagaaagtggactcgaaattggaactgacacaattcagtttggtgctccagcctcaaatggaaatgaaaatgaagttgttcctgtgctttcggaaaaatctgctgacaaaatacctgaacctaaagaacagcggcagaagcagccacgagcaggacctatcaaagcccagaaggtaaatatactttataatccagataaaattttatgaaggccactgacatgaagagcaaataatacttttaaaagtgaacttaattttaatgaatatctttgatcatggtgcaatgatgaaagatactcatctatcataaacatagttttatcataaacatttgactttagcttccagatttgagtccagtagaaaacaaagaacacaaacctggtcccattggaaaggaacgttcattaaaaaatagaaaagtaaaagatgcccaacaggtggagccagaaggacaagagaaaccaagcccagctacagtcagaagcacagatcctgtcacgacaaaggagactaaagcagtctcagaaatgtctactgaaataggaacaatgatctcggtatcatctgcagaatatggtactaatgcaaaggtaagccacatgtagggattaccagttcaacagatgcaagccatgtctaaaatgaacgagaagaacagcaacagtctgcttttttttttcctgctgaggcatataactctatagattatttccgcaaagaagattttgtttcatgatttgcatatgtaatctaaagaagttctttatagcaaattatatttctttttgaggaaatttactctgaattctggactatttgagtagcttaaagtgaaaaacatctatacaaaatctgaatactttgaaagatggctctatatcacttttaatataaatagaattacagtagagctttatcttgcccactggtgacattctaaagtcaggaaataaggcagacttttactaactccagtatagccagttttttttcatagttggaacagattactgtttctttggttgaacactggaggctgttgactcacatttaggggccacattgaatgaaacgtgtatctaaaaatgctcattaagacaagatatgttgattgaccatgggaacagacactcatgggaatagcaaacatatctgcgattttatattgactctgggacataaactctgagaaaaagttacatgcaattttttatattatctgaatattagtctctttttaattgccatacagctgaattcatataagtaatagcttatgtggtcctactctgccatatttcaaaatgagatttgtgacaggaaacaaggagtgtaccctaaaacctgagtaattgcaacaactaagatcttggtaattgatagtaagctaagaatgaatgtgggaaacacaca

SEQ ID NO: 57012 - DNA, 1162 bp, Homo sapiens
agttgaaatgctatcattttgatcgtgagtccatgttgtattattccattgttagttgattgagtgagttgagtcttaaagtctgctctcttcccctgctttcttccagaacaactttacaactattaggctatcattagaaagtgagcaatttggccaggcgtggtggctcatgccagtaatctcagcactttggtgggctgaggcaggcagatcacttaaggccaggagttcgagaccagcctggccaacatggtgaaaccccatctctactaaaaatacaaaaattaatgtcatggtggcgcacgcctgtaatcccagctacttcagtgactcaggcacaagaatcacttgagcctggaaggcagaggttgcagtgagctgagatcatgccactgcactccagcctgcatgatagcgagactcaaaaaaaagaggaagaagtgagcaattaattcagtttaaaatgtattttttttctattactacttcacaggagtctgtaacagactatactacaccctcttcttctttgcctaacaccgtggctactaataatacaaagatggaggatactttggttaataatgtaagtaatcagtttgagatgtggcaagtttggattggaacctggctattattatcaagcacattatttcatgttttatttactgtagtgatcaatatttaactcagggaaagagttgatagtaaatttgtgtttaggagtactgtaatataattagcaaaaatagtcaaagctgagttttttatttttcctctgaaagccatctgctttccatttaagatgaaggtttgtggtgcgtaggcttggtttcgtgtaaatactaatcttattaacctggtattggtaagaagttgttttagctctcacatttacaaatttaacatgaacggttggtgattttgttcttacataaaacctttttataattcagtgaaacccaacttatttaagataactaaaattagaattaaaagacaactatagaattcccaaagaatcaagtatgtctttaaaaaagaaaaaataccagcgtgttaacaacattcttgttgtgtagattgagctatattgtattgtatacataagtacgccaaacactctgatatgctctaatataaggtgatgttaagtcat

SEQ ID NO: 57013 - DNA, 1035 bp, Homo sapiens
tgtttcaaaacaaaaaacaaaaacaaaaaaaaacagcaagtcaccaaatattatgtatcatacatagaaatgtgtttaaaatttataccaaacttttaaaattaaatgtcaatcctctaaatattttgctagattctagtaggtaggtttaaaattggagtagaattgctggttcaatgggtagattcattttcaattttagtagattatgtgaaattttaccactgacaaaatctgcgtatctataccccattggcggtatataaatttttttttcatgccttcacaagtactagttatgtttgtgtgtacctgtctactagaagttttccatcttttcacatttgcatcttgtcacgtttttagtttttccatggctgtattttcagagggtgcacttaatttggaatctgctacaaaacttggtttttatttactgtttggaaaattctgaaattaggacacttactactgcttgtttatcctgatggtctacagctcaaatcccagccttctatatggacacaagtcatttattcaatacccaacatgcacgattggctccgccatccttggctcaacaacagggtttccaaccaggtctctctcaggtaatatcaaagacttcttccatcctgtatttgttccttcgcatttctgtggttataatagttatcttggaacataaataatagactctgaaattacaagctacccacgattagcttgatattctataagcaaaatttaaaatttttcccaaatttaccaaagcttaatagtaataatgtagaataagtagtgggttgaaagggaaatttagatgtttacattcagttttgttttaaaatggagctgatatatagtattaattttactcttttcatgtctcaaatttttatattccagtgttaatgatttatctgtatgatgttgatatatatgtttacatactttctcaatgcattgcagccaacttcagttcagcagattccaatccctatttatgcaccactgcaagggcagcatcaagcc

SEQ ID NO: 57014 - DNA, 2356 bp, Homo sapiens
tactgtatgtaactgtatgtactgaactgttaggactgtaggtgtagtaggtttgtttatatttaatactagcaccagcaaaaacacttgagtcatatgttctatgatattagaacagctatgatgtcactaggtgataggaatttttcagcttccttatgatcttatgggaccatcaatatatatgtggtctgttgttgactaaaatgtcatgcagcacatgactgtattgggtcatttgggatttgcattcttaagattttcagattccagatgaaattaacttctaacaatattttctctttaatccttatgtagatctcagccagcttttatgcaaagcagtttatcccagccatctgtggtcctttctggtactgctattcacaactttccaactgtccaacaccaagaacttgccaaggcacaatccggtcttgcctttcagcaaacatcaaatactcagcccattcctatattgtatgaacatcaactggggcaggcatcaggactaggaggttcccagctgattgacacacatcttctccaggtaagtcaggggactagagcaatgcaccctcattgtattcctatgccacagatcattttaaggaaacatttttaaaagaaaacatgttagaagatgcaatgaaaaaaacaaagtcctttcatttatctaatactaaaaattgctagacattgctttgaagtcataatctccacctctgaatttgaaatttttttcagtcttactcatgttttcttaaaaaattttttctaggccagagcaaatcttacccaggcctcaaatctttattctggacaagtacaacagcctggtcagacaaatttttataacactgcccagtcaccaagtgctctccagcaggtaaactatggcatggtaaatttcctcaattttctttattattatttttattgcttttgttattgtttgggaatttaaattgaaccaagatgcaagatggaggatggtttttaaactgttcactgagatgtcctgaagaattccactgggtccacgtagaaggggtttcaggctcatgacaccccccttctcaccaccatcaccccctacttcagtcattcctgtttttttatatcttccaggttttttgttggtttagggggttttgttttgtttttttctgtcacctaggccagagtgcagtggtgtgatcatggctcattgcagcccaacctcccaggctcaagtgatccttgcaccgcagcctcctgtgtagctgggactacaggctcacgccattatgcctggctaatttttcttcgtagtttttgtagagacagggttttgccatgttgccccaggctgatcttgaactactggtttcaagcgatctgcctgcctcggccttccaaagtgttgggattacaggcttgagccaccacacctggctgctttttgttttttgtttttttttaattaagggggaaaaaacaacttaggtttccgtgtaattatttattctattttaacaaaggattcaatgaatataaaaccttgaaaaccattgtccagaatatagttacattaagtgtgatacaggtggtttacccattagtgctagggagaagcctcccaaagaccatctggcaggttagctatacatacaacagtgtggcagactgtgatcgagcataaatgacaaacactttcttaagtgtatgaatgcaataataattttcagtgaaaagtatatggtacgtttaaaactatctctaataatttcattagcttattctttaaaagtggtggagggctggtgggggaacaaagtcattagtcattttcttataactgttgttgtttgctattttagggagtgataattcatgaatatcttattgacattcagattaaatatagtgtttatgtgaaaactgagagattcttgttcttctcatagctcattttgaccagccttgaaagtattatgtaaaatgtctgtttggaaacttgtgaatactgcttatattgtgtcctcatttactttgtgattatttgacatgtcctgtggataaattcaaagatagtcctaattctttcagtttctattctcttcactacaagtagcattaactaaactatgttgtacctttaatagaagaatggagatacggttgagggttgagtgtctcttaccgaaatgcttgggaccagaaatgtctcggatttcagattggtttttttttgtgtgtttgcgtatacataatgaggtgtcttggggcgaggggcctgtctaaacatgaaattcctttgtttcatacatactttatacatataacctgaaggtaattttaagcaacattttaa

SEQ ID NO: 57015 - DNA, 2181 bp, Homo sapiens
gatgtgttctatgtattttattttattttattttattttattttattttattttattttattttattttgagacagagtctcgctctgtcgccaggctggagtgcagtggcaggatctcggctcactgcaacctccccctcctgggtccaagtgattctcatgcctcagcctcccaagtagctgagactacaggcacatgccaccacatgcagctaattttcgtattttttttttttagtagagacagggtttcaccatgttggccaggatggtctcgatctcttgacctcgtgatctgcccgccttggccttccaaagtgctgggattacaggcatgagccactgcacctggccgatgtgttctgtttgaaatcttactcaaaagtatttgaagagttgtgtatagttgtatggatatgtctgtagtaaacagaaacaaattgcttcagtttctctttacttattttctaggttacagtacctttaccagcatcgcagctttccttgcctaattttggatctacagggcaacctctaattgctttgcctcagactcttcagcccccattacagcataccactccccaagcacaggctcagagtctgagtcgtcctgcacaagtaagccagcctttcagaggattaattcctgctggaacacagcatagcatgattgcaaccacaggaaaagtaagtaaagagacatttgcacaggttatttgagaatttaaggtagtgtgttcagatatatgcatctgtgttatctaaaaaactaaaatgcgtcagtttttaccaccctgcaaaaatctcaaaccccagtatatttacattttatctatttacttttaatgtgtttggccccatctagtttttacctaataacaaagaattcacaaatttattggaagaattggatttatagtgtctcttgggcttatttaattataagtctgtttggtcaggtaattccataatacttgaagcctaactataggagttttgtactaaggttctttgccctttcctagattacgtcttcacgtataggacatgtaaacacagcacttagcttgtggaattaaagaaatgttaagtttattttatgcttctcctcagatgtctgaaatggaactaaaagcctttggaagtggcattgatataaaaccaggcacacctccaatcgctggtagaagcaccacaccaacatctagtcccttccggtaaaatgggcatttaaatttgcttatgaaattccaatttggtcactatttgttaaatacttatcagtcctgtgtgacataatcccttttccaagcagaaaaggaattattaagacattctttttgatagttttgtctaaaatgttaagcttttaaattatttaaaatgtgtttattgtactatattttaagtaaattcttttgttacagagcaaacctttttttcttttattttttttgagacagagtctcacactgttacccagactagagtgcagtgccatgattatagctcactgcaacctcaaacacctgggctcaagcaagcctcctgcctcagcctcctgagtagctgggactacatacacgtgccaccacacctggctaatttttaaaaaaatattgtccaagctggtctcgaaccagccaatctaactggtaactggtatcctttcttacctctgctcctccaatgtctctcttctaccagaatgttttggtaatcatcatagtaaatttttaccaactaccaagtatgatgaaaataccaagaacggtgtttgcaaaaatctaacagcattatttacttggtattactatactgactagtaatggcttctttccaagggctacttctacaagtccgaacagccagtccagcaaaatgaacagcattgtctaccagaagcagttccagtcagcccctgccactgtgagaatgacacaaccatttcctacacagtttgcaccccaggtgggcagacataattaagaaatgagtattatttacttaaaaatagttgctaatctgataaattattatcttgccttatgttaaccagttaagaagtacagtttttaataaaaaattgtttctgaatttaacaataaatttattttataaagatagtctgcgatttatagccagacatggtaattgtttagttctaaagcagacaa

SEQ ID NO: 57016 - DNA, 4685 bp, Homo sapiens
ccttttgaaaagatagcctaattaaaagtctttctatccccccttcagaatttacaactgagatgctaggaccaactgaagtgccatagcatgctttgcctagtttttctgttaaactctccaagcatggcctgtttattccttgtccttgttaatggaatggcacaatctgtacacttcctttcactggtaggatgggcacagatttactctgggatgagccaacctggtctagttggcagttttttttttttttttttttttaacagttcaatgttgtatgttttgtttttttcactcagattctctcccagcctaacctggtccctccattggtaagagccccacatactaacaccttcccagcgcctgttcagaggccaccaatggcactggccagtcagatgcctcctccgctgaccacaggcctcatgagccatgctcgtttgccacatgtagccaggggtccttgtggatcactatctggagtcagaggtaatcaggcccaggctgcgttgaaggctgaacaagacatgaaggttagtacagtgttaacagccaacagatcaagaatctgtctctgaaccatgtcttaaaatgcctctggacccataactgtatatccaggcattcattgtcttagcagacttaaccaagctaactacttttattcattcccccttttttttcttttttttcccccattcccattcctttcatcttttttttctttttgtttctttttctttttctttttttttgcaactgtagtcaggaaatgaattaatgtcttaaactgtggccaaatgaattgttatcaaataaatatttgagggagatctgagtttagatgcacacttttttttggaatagcaaagaagtaatatcaattattatagacttccccattttctttctttttttttttttttttaatatatattttcttcccccctttcccctgactctcctcctcccagcagcttaaaatgtaaatcatggttatatgaaaactctggaatgggtaagatgtgttactatcttagtacttttttccattatgagtcatcaaagtacagttttcttctcaaactgttttcatacccttattggcctaccacatgaggtggttgtattccacagtggattgtgcagttatagatgaagaactcagaaaagcactttgggatccttcatgatgaaaggcactgataaacatgaggtttgctaatgcagaaagagtgcctttaggagtctgtgtggggacagttttgtagcataaaccttacatgtctgccagtacagccagttgaatccgtttatttctatatttactttaggcttgactttcagggatcttagtaatttttgcctgttttgtcactacatatgtcatcagatcagactagaacaaagaaaagcttactgctttcaaacagggaaatgtgcatagtaatgctttactctgaattagaaacatgtttatgataatcctattagaaaatttgattgattgattaaagtgtctttttgggtcgacatccctagtgtttctgatcctgagtaatcaaatttaaagactacccagcagcaaaacttttattaaataattatctacttttattaaggctgtatgcctaggatttccatctgtttgttataattagaaataccagtgtgagtaaaaatcttaggaagttatttggccttggattccagttctactcctggctccttggctcttgattttcgcatattcccatgttggaaataacattagagcttaatagtagtaatggggtgggagagggtacaaacttcttgaaaattgcttcagatctttggatagtacaggttacctatagaacataaagcatttttttaatatgcaagaaggatggaaacttaagttttaattgtgaatgttacagtggtaaaatttacagatttgacgtaagtatatttttgggggcacatagtcaaaactaagaaattatttaccagctcagaatgtggtaggagctatcagaacttagtgatcaagtgaagtcgtagttactaatttctgatgctcttcccctgcagaagagagctgtgggaagaggactcagccacaagacatttggtcctaggtgttggtaatgccacaatataagtgcttccttttcattttattgtagaccacatattgataactagaagttttaagtgttacatgtatgtttttagatttgcaagcaggttccctaaataaaatttaatatgagagggcagaccttgaaaaggtggtgggaggtggtcctgtggttttttttttttttttaaatcacatgaaatatttcaaaaataggaagaaatctattcattaaaagctcaaagatcaatgaggtacttttggctttggccaaaccagtgtggggaaaactgatttgtgattggtaaaagaatttgaaccaagattgatttgacaggctttggtaatgctgcagtattttcagttgttctttctcattttttaaggcaaagcagagagcagaggttcttcagtccacgcaacggttcttctctgaacagcaacagagcaaacagataggaggaggcaaagcccagaaagtggacagtgattcaagtaaacctcctgaaacactgaccgaccctcctggggtctgtcaggaaaaagtagaagaaaagccaccccctgcaccctccatagccaccaaacctgttagaactggaccaatcaaacctcaggcgatcaaaaccgaagaaacaaaatcttaaaggctatggtttattgcaggggattgggaggggggcgggaaaacatggagaattaagtcagataatgctggcagccaaaggggcaaaatggcctgtgacattatcctgttcagagcttggagatgtacaagggacataggagcaatttacactgacacacagctgctgtaccagtgaaaacgaggctttgcaagcttgtacctactatataacatgtgcttggttgatggccatgcatcttcagtcagaatttatatataaatgtatgcacccatttttttgagtgcatataatttagacctaaaaatccttatgattagatgaaacaccaaaaatataaggaaaataacacagcagaggaatagctcagcctgaacagtgtgatggtcccagctactacatcagatgcggtttttttgctcccttatgttcttcggatatggttatggcatttgtaggcttggaggtaaagaactgaagataactggtgctggatagaggagccttattttttattatggcagcttgctatttttataacatggtgattgagttgaacacaatcaaagtacagtagtaactgatgtccccttcttcctggatgaatgagcagataaatattgatgtcagcatccttgaaccatatcaaagtgagcagtgtttggctactgcttctatttgaaatggtgctgtgttttggttgtggtctgaagctttgaagcgctacttagcatctcctttcttccatggagctctcacgattcaaacatgacagatttggtaaaatgctggttaggttgagtcttccttgcccccactcagtcatctttgtatgaatcccatgatttgggggtttttttctttttttttttataccagtttttagctggtgtttatgaagaacagtgagtacctagaactgtgccactaattaaaggaaatcctaagaaggtgcatttctttacagagctgtgtcatgccatcctttgggccctctgctggaaaagtagaatcaagtctcaaataatgcctttttaattgtatcctctagtattatagatataggacagtactgtatcatacctctgtgaatgtaaaatatcttgtacctgctttatgatacgtagtagtgaccgtgctttatcagagctgtttttaatgatgttattctagaatgttttctttccagatgatgattcagaagctaattttaaaaaacggtgccaggtaccacaacagtaacagaactttgcaattttctggggttttgttttttacctttttccccccttttttttaaatggagtgtgctggatgtctctataattttattcagatgactgcagaacctggaaaagctgttgctgctattgatgcataacatactgctattggtctttttatataaatatatatatatatatacatatatatatataatttgaatttttggaaactttagctgtgctgtcaactttggaaaaagtatcccggtttactgtgttgagttggcattgtacagaaattaacagccatattggtctagaaacgttaaacttaatttttttccatttgtacaggggtaacgcactgtattaaatatgtaaggtcttatctacatgggtttgattacagaaactaataaagtattctctaaataatgattcttggagcttataatcatttcctaaaatctgaagcaagagggtttgtcatgtattaaaaatagtggtcaagagtactggccagtcgcagtggctcatgcctgtaatcctagcactttgggaggccgaggcgggtgaattgcctgagctcaggagtacgagaccagcctgggcaacatggtgaaaccccatctctactaaaaatacaaaaaaaaagtacattatacagccgggagcaat

SEQ ID NO: 57017 - DNA, 1033 bp, Homo sapiens
ttggctcattgcaacctctgactcccgccccaggttcaagcaattctcctgcctcagcttcccaagtagctgggattataggcacctgccaccaggccagctaatttttgtatttttagtagagacagggttttgccatgctggccaggctggtctcaaactcctgacctcaggtgatccacctcccttggcctcccaaagtgttaggattacaggcatgagccattgctcccggctgtataatgtactttttttttgtatttttagtagagatggggtttcaccatgttgcccaggctggtctcgtactcctgagctcaggcaattcacccgcctcggcctcccaaagtgctaggattacaggcatgagccactgcgactggccagtactcttgaccactatttttaatacatgacaaaccctcttgcttcagattttaggaaatgattataagctccaagaatcattatttagagaatactttattagtttctgtaatcaaacccatgtagataagaccttacatatttaatacagtgcgttacccctgtacaaatggaaaaaaattaagtttaacgtttctagaccaatatggctgttaatttctgtacaatgccaactcaacacagtaaaccgggatactttttccaaagttgacagcacagctaaagtttccaaaaattcaaattatatatatatatgtatatatatatatatatttatataaaaagaccaatagcagtatgttatgcatcaatagcagcaacagcttttccaggttctgcagtcatctgaataaaattatagagacatccagcacactccatttaaaaaaaaggggggaaaaaggtaaaaaacaaaaccccagaaaattgcaaagttctgttactgttgtggtacctggcaccgttttttaaaattagcttctgaatcatcatctggaaagaaaacattctagaataacatcattaaaaacagctctgataaagcacggtcactactacgtatcataaagcaggtacaagatatttt

SEQ ID NO: 57018 - DNA, 1087 bp, Homo sapiens
catgaaaaagacttggagcaagtaactagcccctgaatcttggttttcttacttttaaaaaggggatgtatacagacttacccgaaaggatactataaacatcattaattaatgtcaataaagcacttgggtgttgtatttactgggtgctggtcacacagaagcctggcttccacaccagaaaggcgtctacctcttcattgctaggcacagcagttcagacgccccatttttaaattaccacccattgcatgagcttggataaagctcactttctcatctgtaaaatattatgataataatagtacctactttataagagtgttatgaaagattagtgaagtaatcctggtaaagtgctcagcatggctcctggcacagggatgtgcctaataaatgtcagctattattagcatcataacttgcacctcttctgctctgttggctctttccctctagcatataaacaccttaagttttttccatctaaaataaataatatcccttagatattaccttttattttttctcctttgatttatttttctctggtcatatcctccattttggctttggccacatacacatagccaatgtcaatgactaaggagtctgtaatatacacctgaccaaggtgcaggagcaaggaaagcatgtggcatagaagaggcgcatgaggtcatgagccagggtgtcatctgtttaaatcttggctccgcaactttctaggtgtgtgaccttgggcaaatttcttgtcatctctgaaactcagctttctcaccaataagctagagataaaaacatctgccttgcaggactgcagtgaggttaaaacgcataatgcacataaagtacacagcgcaatgaaaggcacggtaagaaataattatcacccaaaatataaagttcattgcaacttgcaatcctgttgaggtgaaaagactgatgcatgaaaaatgattcaagagcaagttgagaggtgtctgccaccgtctttaagaacaaagacagagtgtgtgttgaagcctttgacttcactcaaaaaaataagtcattaaaaaaacaactttgggccgggcgtggtggc

SEQ ID NO: 57019 - DNA, 1049 bp, Homo sapiens
gcaccactacacctggctaatctttatatttttagtagagacagtgtttcaccatgttggccaggctggtcttgaactcctgacctcaggtgatctgcccaccttggcctcccaaagtgctgggattatagacactgccaccatgcctactggctaggcatggtagctcacacctctaatcccagctactcaggaggctaaggcaggagaatcgcttgaacccaggggacagaggttgcagtgagctgatatggcgccacttcaatccagcctgggcaaaagaatgaaactctgtctcaaaaaacaaacaaacaaacaaaaaacataaaacaactacaagtcaaagcactttttatctccacaaagggaagagcaaaaaagtagggctgttagccttataaaaatataattttcttaatgaaaaaaatgttactagctcagtgaacaatggcttcttttataaggaaactgggaaaatatcattgttttccaactttttccctttaactttcaatctttctggcgatccttaaactaaacctgtttattatcctgtaaggtgaaacttttatttcccatcttgagtcaagaggtttcttcaacattgtcaaggtagatttaaaacaaaagtttaaaatcctctatttcagacaaagatcagccaacaacaatgaaaagccaaccatttacttagttttgtttcatttctgatacttaaccttatattcttctatctaatttattcaatggagcattttccccatactatgtctttccttcaagtagtgtccattgtttcctagcgttcctaaaaagcttgttgtccccaaaagtttatgttatgctgctttccccaaaagcttacattgtcttctaagaccaatctctgtaaacacagcccaaatcccagttcttgatggctttcacactgagctgttttcaggtccaccaccagttctaggctcagccaagttggctcagtattatatgtgcctaaagttgcctggagacatactggtgccaggaacaaacttcaggcatttcaaact

SEQ ID NO: 57020 - DNA, 1011 bp, Homo sapiens
acagaagcctattgccttgcagcaattttgttgttataatactgattaattggttactccttcttattataactcagtaatacctgtggtcatttggttcctctatcctgacaaagttcactggaaattgccctcagattttataaactgggggatttcttaattagataaaagttcattactgaagatggaatattatataagatggaggaagggtaattaatagacatgagatatagaaatactttgttagccctgctatagattgcctattgtagtctttctgtgcatttcaatagtctgtattaggaaattataacttcagcacttttgatagcaaaaattggcatctttcaattctgtatagtatgtgactatcctgtaaatgataatatgtgtacagactgagaaggcaggaatataaagtaattgaaatctctcattgccggtatactctaaaacatgcttgatgccttgtcagcatcattgcacacattgactctgtatttacatctgtatatacactatgattagaaaatatgcaagaaattgtttttccatgttaagaacaaatgccattagaagatgtccccttaattgtattgtcagagtattactatgtcaaggatgactgttctgttaacctaattttgtgttttcacatggaaatgtgattggactccatttttctgtgagttgagagtaagagcataagtcagtttgaaagcatttacaagtttgttttagaatgtagtaagggctgaaaggtgctctacttcttaacttgttttttccatgttgtagacaaatgaaatttgtctaaatgcttttgtctaaaaatgcatttgtctaaatgctttagattgatgtagggtttagatcctctttaatactttgagatagtcttattctgattttttttttcttctggaaaccaagtagaattagggatgggaatacaaatgcatttattctggcttctgttttattccaagaagcttcttggaacaa

SEQ ID NO: 57021 - DNA, 1705 bp, Homo sapiens
atttatttaagatgccaatgttagacatttaggttgttttatgatattttttgcttctcctttcccattgattatttattacctcagataaaagttcagtcaatcctcattacccatttctaaaagtagacacaactacatttaggaatattgcttcaaacatagcatatatatctgatgttgatatattgcttttttcatgttttctcttacagttcttatagtcatgaaataccgtacttgatttgatgacagagatcttcattaaacaagatctgggacagtaataaaagattgctgcataatttaaatgaaacctatgtgtatataactttcaaaacttctttttcaagaaactaagaggcaagtatcacttcaaattggaacgttgagaatgtccaattatcttctccctttctaacaaaatgttcttttaataattatgtttaaggcaaagagaactagcctctatttttccatatttcaaggatctaatttgaaactagatacttgccagttcattatttgtgtatataaacactgattataatatttcatattaatattttaatggcataaggacttgcattattgcattagggagcgggtcatgctgggggtcaggaagcctgtgtagagtaccaaattatatgctgaaagagatgcataaccattctgtcaatatttgcagaaatatagttcctttcatattacagttgttttgcaagcaatttccacatttataggtgtaacaaaagctaaatgttgtaaatgttgttgccctcaggtataactaaaaacattccagtaaatatatttttgactgtgtaagagaatgtgtagtaatttttttggcattggattatggaaatggaaatttttaaacagtgtgaaaaaacatggtatggcatcataaaactggagataataaagttattgaagagtgtcattggagtatttgaaaatgaccaatatatagctgccagtcatggtccagtctgttttctgttaaactccaataaagagagaccagtcagtcctaatgtgagtaaatgaaatttacaggtaacttacttactccttaattttattttagttaatagcctctaacttccaactatctcatttaccaaaagtacaaaaagtagcaaaaccatctattaatactttgaattttatatctttgcatttcctgttcatccttgaggagatgtatgttgcacaatcaaattttgcatcagccaacagtaatgagtagtagaaagtcaggaacctatgtgtatatatatatatatatatatatatatatatatatatatatatacacacaaacacacacacacacacacacacacacgcacacatatgataatcagtcagtcggtaaccaaatgctagagagtgaccattaacctaagcctgtttttataatgaaaaaatgtgttaactttaaaatatgccaacctccttgtgtcttttaaacaagtcagagtgaaaatacattgtcccctaaggtgtggggagaggaagctttataataaaattagtgattctgcagaaacttgtgcactggatatcttgacaatatgaatataaaactccctaaattaaaaatagggttaatagaaattatcagtatttaaatagggaaaaatgattttatgtttattttatttaggttttatttctttggtcatcttaatgc

SEQ ID NO: 57022 - DNA, 1038 bp, Homo sapiens
gaagccagctggagcagagacccctaccccagcagaaggccatcaggggtgtctgatgggattctgtcctgggggcccttcagcccttagggcagtcccatttccagtggccaagcttgtggccgagggggcaaactgtgtaaggcttttccccatttgtcccattgggacagtttgcctttcagtggcctggccttctgcactgatggcagttacctggaggatattctgagggcaacccagactgggctgggggctcataaagcagccagcagttgagcctgccttttctccttgtgttttctgtgtttttctttcccgttagccctgtcctttttattctgctctcagttataaaagactgaggaggctaatttgagaatttcctgcaaaggggccatgctgttaatatatgacacaagaaaattagatgtgccctattttttctgcacctctgagcttactgtctgtctggcttttttaagttttaatttccaggacttgaactcgctgccatgtccactaaagaaggaaagatcttcgtgggagggctcaacattaacaccgacgagcaggtgctggaagacgacttcagcagcttcgggcctgtctctgaggtggtcattgtcaaggagactcagtggtccaggggttttggtttcatcaccatcaccaacccagacgccatgagagccatgaacagagagtccctggatggtcaccagatccgcgtggatcatgcaggcaagtctgctggggaaccagaggaggtgactttggggcccatgggcgtggtcacagctactctagaggtggtgggaaccaggactatgggagtggcaggtatgacagttgacctggagggtatagatatggatatggacagtccagagactataatgtcagaagccagggtagttatgactgctactcagaaggaaattacagaagcaattatgacaactgaaatgtgacatgtgcacataatatacacaaggaatagctcttctgatccaggattgtccttccaaatggctg

SEQ ID NO: 57023 - DNA, 2478 bp, Homo sapiens
cacccgacggccccagatgagcttcttgaagatggacatgacgcagatggagtttcctgatgcctcgttccaggtggtgttggacaagggcaccctggatgctgtcctgacagatgaggaagagaagaccttacaacaggtggacaggatgctggctgaggttggccgtgtcctgcaggtgggcggtcgctatctctgcatctccctggctcaggctcacatcctgaagaaagcagtgggccacttctcccgggaggggtggatggtgagggtgcaccaagtggccaacagccaggaccaggtgttggaagcagagcctcagttctccttgcctgtctttgccttcatcatgaccaagttcaggccagtccctggctctgcccttcagatctttgagctgtgtgctcaggagcagcgcaagcctgtgcggctggagagtgccgagcggctggccgaggcggtgcaggagcgacagcagtatgcctggctgtgcagccagctgcgccgcaaggccaggctggggagtgtgtctctggacttgtgcgatggggacacgggggagccacgctacaccctccacgtggtggacagccccactgtgaaaccatcgcgggacaatcattttgcgattttcatcagtgagttgggattgctccctctcttccctggaggggctggcttacaggggctggggcttgggctggggctggggctgaggctgggctggggctttggtgggattctggactgttttttgtcttgcaggggtttgtacttccagaggattagactacccaaggcatgatgaaaggagagtaatagctctctagcaacctacttggagttgagacctattccttttcatctgccattgcaaaggcttgatgaagtgtgagaatggggttggtagggaagagagagaatagagataaatttaggaggtcacatatgatatagagatgctagttactttgtagcatggagtaatggaagtaatgctggactagcaagtctaagacataggttctagtcccagctgtagcctgtgagctgcaggacctggggaagttgctgtgcttctctgcaaaatttggagaggcagcatagggtagcagctaaaaaagtgagctctggaaccagactgtttgggtttcagttttggctcagtcatttcctgatggtgtgacattagacaggttacttttctttctctgccttgatgggattgtaactctggtgtagttgtgagaagtataaaagctcttagaaatggtacctggccttggaagtgctgtgtaaatgttagccattattactgaaagcagtaagttatatcagatttatcttaataaggataaaaaagatagtaggaggaagtgctttcaaaagtggaacattgtagacaaatgcaaagtgtttatggtcttggtgttacggtaatttgtttcctggtgactgagctagtttttcaagtattctataattctgtctgtccatgtgtggaaataaatagtgcagtgaatacaagcgtgggtagagtctggggctagactgcctgggtttgagtcccagcttcaccatttacttattgtgcgaagttgggcaaatagtgtaacttctgtttctcagtttcctcatatgtaaaaatgggaataatactactacctgcatcttggactgttggaggattccattaatatatatttgtcaacagcttggagtcatgcctggcatggcttatttgtgttggcattactgctgtttttcttgtggtaggtgtctgcctccttcccctacggacatgcccacacttcttctccacccttggtcctgccttatgtctgatgggctgctttgccctagatgttgtgaactagagaattgttagctcctcagtgggtcacagttggggaagatgctggtcttggacagggactggctccctgccgtttgggccatattggttgtgggcttgatcactttccaggactccctgtaaccaagttcttttttctagtccctcagggccgggagaccgagtggctctttggcatggatgagggccggaaacagctggcggccagtgctggcttcaggaggttgattacagtggcccttcaccgaggtcagcagtatgaaagcatggaccacatccaagctgagctgtcggctagagtcatggagctggccccagctgggatgcccacccagcagcaggtaacaaagctttcgtacggctttcatgggtctctgaagtcatgttagcagccagggaggcagagggagccttggcaggagctaggactagagtctgtgactcttcatctaatcctggaggggtatcagcagctaagggttaaatggcagggaaactgtcctttgccccaggcaatgagaggaaagtgagcacagtagcgtctgtgtctgggggagcctctcagagtccatagacatggcaggatggaaatgctctactca

SEQ ID NO: 57024 - DNA, 1147 bp, Homo sapiens
tatcctggtcaccatgggtaacgaacaagtgattttactaaaagaacttcatgatgaggagttgatccttttttttcttttttgagatagggtcttgctctgttgcccaggctggactggagttcagtggtgtgatcacggctcactgcagcctcagcctcaacctcctgggttcaaaccatcctcccacctcagcctttggtagtagctgggactataggtgcaagccaccatacctggctagttttttttttacattttttgtagagacagggtctccctatgttgcccaagctttgatccttcttgataggtgggaaagcaaaggtatctagaggcttggtgcaaatagtaacagatctgaaaaaaaagaacccaggctcctgggttcctggcctgtggttttgcccactaggctgactcgtgtttacagatgaatgtaagtttgattcttcctggccaactttggggttgatgacccctatttcaaggaagcccagatcctctgaggagcttcatttgtggcctctcaccagtgcctgagtctgcagggtcaggagatattggtgattattaactagtcttataggtctttaaaaaaagaaataaagatagggggaaggagtgggaaagtttagggggaaagtatatttttctcctaaggttcagaaaagtgggggaaaaatagatgagaataatcaggggaaaggaatatctctctagatttggagtggttgtttctcccatggattttgttatctttattcttgtgtagattccttctcataatcacagccccttcctgagggttccctctagcttttgttatcctggactattgagagttcttttaggggttactgatgagaaaaacccctaaaagaacttggggagaatcagctgcatctcactagttgtttgggagatctttatgtgtccagttgattttcaaaagatgaattaaacctttgagatcagttcaaaggctccagaaaagtactttaatagaatggcaaatctgtggagtagttgttgtctagaaccgtggtatggggatatatacacacaaaagggaaggggttataatttctcttatttcttaaatgagctgctgttttgaccacatctctggttgtaccttcaggtc

SEQ ID NO: 57025 - DNA, 1029 bp, Homo sapiens
tttggccaggctggtctcaaactcctgacttcgagtgatccgcctgcctcagcctcccaaagtgatgggatcatagacatgagccaccgtgcccagctgggaatcacttctttctcaaagctattctttgagaagctatttgggaaactgaggcttggagaatggtaaaataacatgtgagcagcacagaagagcaagaaataaggctggagtttgtttatggctcacatgctccccatgcttttctccatctgcctttctatgctgtgtattctctgcaaactcatcaccaccgtgtgttttagtccaccagtctccctgggacaggaattggtattttcctcaaagccgatccttgtctttcatatgtctcctgatgtgaggtcattctgacttttcttcctaccctataggtgtttttattctcaaccttgtgtgccgagacttggggctaaaagactcagtgctggctgggctcaaggcagtgttccccctcctatatgtccggcgaattgagggtgaagtgaatgagatcctgttctgtcagctgcaccctgagcaaaaacttgccacaccagagctcctagaaacagcccaggctttggagcggaccctgaggaagcctgggaggggttgggatgacacgtatgtcttgtcagatatgctcaagacggtgaaaattgtgtgactgcttaggccaagcagccctcctgcctagactgaccttggactcccagcctgccagagaatgaagaaatacaacgcacagtacttttgaagcttcgtatttttcttggtttcacactcagctacatgtgacctccagcttggtgaggttgcctgaagattagggaaaataaaaatgtccttcccatcttgtcctcttcagtaccacttgggttggtttgtctttgcttcctacaccacgtccttgagtggagttccctgctgaagcccctagcacacactgcatgccttaacaagtgtgtgcaagcccctcagaactcaagacatccaaattttattgcg

SEQ ID NO: 57026 - DNA, 1059 bp, Homo sapiens
agtatgtttactggtggaaatggatacaggtcatttcagagacagaggctgtgattacaaatggtgagtgacagaaaggcagagagggaataaaaaataatttcaaactttgagtagatccctggaggaaggatagtaaaattcatagaagtaaataagtttagagagggaaggaatgcattctctctctacttgcaactggtcagatcttccattctaccatcaagctcagggttatccatggaacatcccgtttgaacactctgtctatgctgattttgaccttctcagatgtcctgatgacttatggttcaaaactgtttaaaacttgaatatttctgactgtttcattaacattagcttttgcttctgggacagactgcaaacccttaattagtattccccacagtatcttgaatgatagtgttttaggtaccattatggactgaacgtttgtatctcctccacaaattcatgttgaagcccaaaccccaaatataacgatatttggagatagggccaattaggaggtaattaagattaaagaggtcataagggtgaggccctgatcaaataggattagtgtccttataaaaagaggcactggagagctctctctctctcttcctctgcacaaaaagaagaggccatgtggatacagagagaaggcaaccatcatcaagtcaggaagacagcccacaccagaacctgaaccagctgaatcttaattttgggcttctagcttccagaactttaataaataaatctcttttatttaagtgacccagcatgtggtattttgttatggtagcctgagcagactaataaaagtacttaacttgtattgagtttttgctaattaaattgttgatctgacttagatgggttggtactgagagtgaggatcatgtgtttaagtaagagatttatttttacatttatgagaaaaaattcactgatgcactaatattcttagcttgataagctagtgtccttagcccatgtgcctcagtttttgaggtatccattctttcacctgtacttctctcttcattttct

SEQ ID NO: 57027 - DNA, 1351 bp, Homo sapiens
tgaattgataattgatattaaaatagaattactctcaactcaccagaattaaattttatatctgcatatttaacactattagctcatataaattataagaaaaattttcaaaggatctggttttaattttttggatatgaaatgaatttgccttttctgccttttcttaagtactattttgtaactatattgcactaactatatccaaaacacattctgagcatcactgtgagtaacagccttccagtttgtacccttttgattcacagcatggccctatagttaattaagaggtggataacttaagctcacaactgcctttaatttgatttcacatccacagttataaactttgcatttaaaaggaaaatgagacatttaaataggttcctgttgtttcacatataattggtaaaaacatattcccttgtaggatcctattatcagagcatcaaataccaaagtcagcaacttgggttgccaaataaattaggctcattaattattttgaaaagggctgctgtttccatgtaaatgataattttctttttcatggacaaggttatggtacttatctactaaaagaaacatgcataaacatagtttttatctttaacttcagtattaaaatatgcagttttttgcaaagaggaaaaacatctggttcaattacgctgaactctgactacatgtgggccagtaataatatgaattggacttaagaataaaccttgtgtttaatctctttttttccttaaaattttaatgtgagttttctgttacgcaaattatccatgttagcacatttggaacaaatgtataaatgtactttctgaataaagtcaaaagtctaacttgtttttagttccataatgttttaatgtttaattatattgtgtatttttctccctttccccttactctccaaaatcaccaaatctggaaaacaggctgattgtatctgtctatgagcaaaggaaacctgaaggaaccaagggcctggctggacagagttgtcatgtgtctgcctgtctacacttgctgtgcagaacatccgctcacctgtacagcaggcacagacaggcagtcacatgacaacccagcctgaatgacaaccagccattgaaagaaagcagccctcacaccatagcatctacaccaagagctacaaccaaaatgaggggctcgggggcctggggttttaatctgttggtttaatacttaactcatgtattattttattttgattcaagtattaaaacccaccaaaagtaaagtgagtggtgcctatgaaatataataaaacccatttctgaaaatgttcctgtgcattctatagttctcttttcct

SEQ ID NO: 57028 - DNA, 1033 bp, Homo sapiens
ttttttgacttagcgtgacagccagtttcctggagttgctttggtttaatttcactacagaagacttagaagacaattcttttcttacatttttttccttaagaaataaaagacaaaaagaaaacaaggtgtaataaccacactaaaaattacatggtatgataataatacaaatagctcttttatgttttagctagtattttaagtaataataaactaatattcaacctataatttgggagattaaaaaaaggtcaatatggttttcagtctttcatctttttaacaagtttaggggcaggttcaacataacaatgaagtgtgcatatgtcacatagttactgtaagtgtgttttaaaaatctatcagaaacataaattgtccaaaagccttatgaatagaacaattgttttcagcaagattttttttttcccctgaaaaactgttgtggtttttctggctcaaaaaatttttatatcttgccttaataaaactgttttatattaaagcataacatacaaactcacaaatatttctttttattttttcaggttgcatgcatcattcctttaattgagcagagttaactggatcaaattatttatgggagagagaggaaaagttataaagaattatagtaatttttaatttccaccaatatactctttgtaagtgaatcactctataattactttctgttgcactgaatgcagcaacaataacacaatagtattttaaggcactggtttttggcatactctaaccttgtaattatttaaataacagccaagtttactcatgtttttgattctgtcaagaaaaaaaaaaagttcctttactcgaaagtgatggccgaaacagaatcggaaatttgttttcttgaaattacataaatacacagaaaatggcacttattagcttttgttaaaacattaccttacctaatcactgcataaaagtccagatttgtagaaaattgtaattttctcagtatctaaaactattttgctttccattaagtttctatttgcta

SEQ ID NO: 57029 - DNA, 1028 bp, Homo sapiens
agtgttcagactacctgttcaggacaatgccgttgtacagtagtctgcacattggttagactgggcaagggagagcaacgccatggaccgctggggacaaaatgggctgtttccaaggagaagacatttgtttgctccttttttgaatctcatatccagtgtttttcttcacaggttttgcacactagggaccaagaagccctcggggacactgctgagaaaagactgccgaagggaagaccagcgggtaaggccttcttgactgctcacctggtctgtgaccaagggaacctaggtggggagcccatgatttgtgttaacatgcaagggaaacagaggtacatgtgtgatgggtagagatgtatttaattttaaaagagcaaaagtgtgtggtatatagcgatttactgttttttttttttttatttctgaagattgataattcaagtgttttcttaaaggttttcccacttcaaaatgaaatatgaaaaaactcattccagacacttaagaatagtttaatgaggctacttttgaattgtttaataataattcaaagatttaaaaacttatatggatgaaggctgtatgtataacttttaacatcccaggactgaagtcatttttccccaaagtaaagaatacttgctggtttttaaatgctatatggatagtgcttttctgaagatttccttctgtaatataaacaacaggaataatagtacctaacaataaaagaagaacctgccaagtcttgcctaccagacaatgcagatgggatttgcccagagaagagcaccgacccacaacttattgagtcagcaactgagtaaatcagggaataaaaacctctatctttagatacccctgtaaatatctgttttacattttttttaaatcaaagagtggttaataattgctgctcagctgagccctcttgcctatagcttacaatgcttccacttctctgagcatttaaaataaggcactttgtctagaaacccactgataaaaaaggaatttgtaaa

SEQ ID NO: 57030 - DNA, 1054 bp, Homo sapiens
agaagaggctgaattctaaatatatatccaaggcagagccatcatatgtttctgagaaactgggtgcggaaagtgaaggcaagagaaaaatccaaggtgatgtttaagtttccagcatgagcaactgggagattggaggagcatgtctgggtggaaagaccaagagtttaattttaagctggggttggtaggaagaagcctggatatagatttgaagcccagaagagtaatcagagttggatgtgtacctttagggtcaacagcatatagatggaacaagcgcacttaacattttcacgataaaattcgtgactaaggtgttcaggatcttgctggaaatcaagattgatgatattgacaacagcaatgtaaaagaaccaagcacatgcatttgctaattaatttgtgccaatttgggaattattcaagtgcaaacacccatacactagtattctgtgcaaatgtatagacataagagaccctttttggggtacaatagtccactatccaaatctactcaattaaatagttttctaaagtttgtgtatttcaaatgaatatgcttttactataagaatctgtgtattaaaaggaactgaaaaatgcttccaattatttttcaatccaacataaattaattattctcaagctttctcacaaaataattgctccctccaaaggtggcaaagcatcaatcgtttcctcaacacacacactcaatcatttcctacaataaagggagaaaaatgacatacagtctggcaagattatgcttatgaaaccagtttgctagtgaaaataagcaaagtgaatttcagcaacagaaaactggcctaactcctctgggttaagcatggggagactgatcttgtgtcccgggaaaagtcgcagtgataatagaaactaccagagaaagaacattttaacctccaaattaagtcaatcactgtggtctgctggggttcttctctagtcagcatgtgctggggtttgttatggaaatgccacagaactttagaggcagtgaagtaaatggtacaatgagacactggct

SEQ ID NO: 57031 - DNA, 1063 bp, Homo sapiens
ctccaaccccggcggcggccttaagattcccgggctgggatccctgctgcagagggggtaacggtgtctggcttgccaagcaatatttgttgtggtctatcatggaagaaataaagtcgggcaatatgaattttttttttctcaaatttgccggatggctgtggtgtttctgactcttagttttctcattgtgaaaaaggaatgattatcttcttcgatcctctcaagagtttccttgttttgagtagattgatagctctttaaaggatgctaagctcagctaatggaagaagagtctagtttctttgaggctttgattttggttaaactatagagctcatacctttctgtatggtgcagcttactattgtctttggattggtaacttaaaaaatacaaataacatgcctttgagaaccaataaaaactatggatattatccctataaatttacacaaatccagatataagcatgcaatgtgatatacctaagggatatgtgaaccactgagttaagaactgctttagagggagatacaatgtgagacacaggctttgggataagactttggtttgaatcctggctctgctctgttaccttagggcaaagttacttaagcatcttgaatctcagcttttttaccaaagcaggactaatactaacttacaaggtggtgaggattaagtgaaagaagatacataaggcacttagcacatagtaggtactcaataagcgatagctaacagatgtctattattattcaaggaattataattttcaaatctgaaatgcagttttaatgtcccataaggtgactaccacatacatttttctcagacttttagtaaactgagttgatttgactttatctcagtactactcttgacctttcacaactttcgtaggttcacagtctctctttttctaggaacttggctgtgttgtcctgcctcagagacaaattcatctattgtaggcctagcccctgcctttgaaaacaaggaaaggttggtagaacatcaacacagcatggaatttccagggaggtctcatttcaaaact

SEQ ID NO: 57032 - DNA, 1900 bp, Homo sapiens
ccaatcaacatctagctcaatggggcagtccattgccacagggaaagggcttggtgcagcttccctcacaacacacacgtcattctaggccattccacgaactgtgctcaaaagaggaaaacagtgcaacagttccaaagctgatcagtctcgtggtgagcagcgaaactatagacttctctaacaaaaccatggattctaggagggactgggaaagagaaaaacgaattctggaaggcaaactacaactcccaaaggcccttgcgcggactcagcgcgcgagggacgaagggcggtccactgtaaggggaaatgctgaggatcactgggctcctcccggctttctgaacgcaagccagcaagtgggcgggacctggggcgggcggagcggcgaaagcatctgctcctgcgctttgtggtctcctgcctccggcttctccgcctgcgacgtcgaagggggcgtggcctgcgcagaggctggtgggggtgcgggcgccgcgggacttgggtgacgcgtccctttccagctcagcggtgtgtgaggtgtcgcggccccgccggcgattggctgttgagaggcgagtacgcggcggccgttggtcgctggcctcacggagcaaggcccccggcgggcggggaggatatggggcggcagtggcggctgcaggaggcgggcgtggacgagccggtggctgcagcggcggcggtccccggagtcctgtgaagcgcccctgtccgcgcctctgtggggccctcagagagggctgccaggacgcgagccactgaggagccgctcagccagcgccatagcccttaggactatcggtcacattctcgcgctcctgctccggctcctccatcttggcctcggcagtggcggctgccgggaggatgtgccgccttctggcagggggaagaaggaggagaagatgaagaagcaccggcgggccttggccctggtctcctgcctctttctgtgctctctggtctggtgagtagccgcgacgacaagggagttcccgtgaggggagtaaatgggagggagcagcccaggtcacaccccctggtcattttggcttttagggtccgggtttccaaggcccccgtggaagggacaaaccgattacttctcgactctccatctgactggtctggtagtgctctgtgcggagattttcatggtgtattttggaatttacagagactcagtgggagagagagaggtgccaaggtagagggaaccaccaagtgcctttgtactcagttcctctaccccttggagacggtgcagggtttggggtgggtgttcagattgatggtaagtaagttgctccgatttgccgccagtctttgcgttcttagtgtggtaaggggataaagcacgtcggatgtgatgcgttccggacgtgcgattttaaaacgtgagtggtcatgaaggtaagagtaatgtataagcagtagttctcctggacatttctcgcacagcgtttgatcccaagtacactcgggccgctgtttttggaaacttggggggcgtgtgtgtatgtgtgttatgaagcactttttcaattggtttggtggagagggtgtcttagatgtagtgtgtgtagtagtttttggtaatgccccttagtgacgggaaggtaaatgctgtattttcaaggcgggaagagtgctttgtccctaaagcactccttaagttttacggagtttctgttaatcccaggcacttctggagttttttgaggagcagagaaagcttgtaagtcgagggactgctgtcaccgtacttggaaaagccattctttcctcccagggaatttcttcaaagatgtgtgacaattgatgactgaaaagatgcttcttcagtctaggcgatttgctgtttgttatattaaaa

SEQ ID NO: 57033 - DNA, 1660 bp, Homo sapiens
tgtcccttaattagtaaaaccttgtgcatccaccttaattgtctataagttatgtacatgtgccaatatagtaatagtatattagtgtatgtaattaatgcaagttagatatttaagaaaaatgagaaaaaaataataatttctgttaacggtaccttttgttctcattaaaataataatttttagtgagagctatgtgattgacctactagattattttatgtcatagtatagaagaggaatagcttcaactacttaggagtcagccctgtcattttcttgttggctgtgcttgcattattaaattctttgcagtaatttttttaaaagctgcttcccgatgttgtgagggtcaattcagttaaaactgaataattcctaagtctacctaactggggaaacataaaccacagtgaatcatggtgtgctgtaagtaaaacccattgtttgtgggacttccactctttccctgggtttctgtatgaatccttacattaatcttagtaaaacttattttttaaaactaaacaaatctattcttccttcaccccaaaggatcatcttggagaagcttatatttagactttcgggaagagcttgacatttaaacaagtctcatacatttggcaaatataacaggtacttacaaaggtttttaggaacagcaaaggaagaattcatatcctacttgtggttctgtcactaactgtatgtctttggacaagttacttctgtgaacctcagctctcatccataaaatggtctgcaggatggatagttcacaatgagcgaattttgttgtaggcagagagaacacttacccagttatctagagcgtgagtgtatgtgaggagagatgggaagggaggctagagctaggttttgaaaggatttgattatcatgcagatgaattctaattctaaccacctgacagaggatgagtaagtgaagtggtttaaactggagaacaggagcatgaggtcacatggatcttttaattagattgctgtggagggtaaagtggaatgtaggggacgtactttggaggcacgaggtcctaagtcgtggtcccactagaagagagttgatatctaaatcaagatgttggcctttttgtccttagtagtaatttttctgagtatgtcagaccagtttttatcagtttaagaggtttatttcctggtttgtgattacatttctgtacccttttgctttttctctcatgattgctggtctattaatatacataagtgagcagaaaaaaatttaaaaactagaacaatatataagctgttttttcttttttgaggtgatgaatagagcatattggaaacatatcgataaaacattttgaaaattccccaggaaatctggaggaatttttttgcttgtttctgcttctgtctctaaactttcaaggtacggaatctatttcttttctgaataatatttgaaataaataaaataataaaacaatcccacttctccaaatcatttgatgccttttttttctttccttgaataaaccaatgaaagatgacctttacaaaaatgatttttttagtggaacttaatgtgaaagactgaggaaaaaaagtttatctttgctctaggatatatattctgaagaaagcacctggtatttttatttataagagg

SEQ ID NO: 57034 - DNA, 1005 bp, Homo sapiens
aatagagatttttgaggaggtaaatgatttaattttgtgaaaggttggcaagctggcagtagtgcagtgcagtgcagcagataacagcattaggctaggattctaaataactggattttagtttgcctctaaccaaactctgttcaacatcccctttctgttgtccatctcaatgcaaagagatatttacttaggcttcagtgtgctgtatcctatacaggattctggtggacaaaacaaagtaactgctttcttggagcacactgtcactgagagtacattctagggcctaaaattatgaatctgtgaaataaagttcaatgagaaaagaaatgttaagcattttttgtttgttttctgtttgtttgcttgtttgttttaacttgggcaactagaagaattggtggtggtcaaaaagaagtggaagagttggcaaagggcttggaaggggaaggagctgttagttggaggtgaatggaatatccaagtggagacattttatgggcacttaaaaatgcagacttgaatgcagataaaatttggcctggagtgccaggcacggtggcttatgcctgtaatcccagcactttgggaggtcgaggcaggcggatcacctgaggtcaggagttcgagaccagcctgaccaacatggagaaaccccgtctctactaaaaaaaatagaaaattagccgggcatggtagcgcatgcctgtaatcccacctacttgggaggctgaggcaggagaatcacttgaacctaggagacggaggttgcggtgaaccaagatcgtgccattgcactccagcctggtcaacaagagcgaaactccgtctcaaaaaaaaagaaaaaaagttggctggagttatcctcgtaaagcagaggtccccagcccctgggctgcggaccagtactgctccgtggtctgttaggaccctgacctcacaacaggaggtgaacagcaggtgagtgagcattactgcctgagctccacctcctgtcagatt

SEQ ID NO: 57035 - DNA, 1046 bp, Homo sapiens
actgttaggttctctatgcaaaaataatttggaagcttctatgcttttaaacagttgaggtaactttaggattatctgttcttaaatatttgttagaatttataagaactggtactttccgaggaggttagctatttgacagctttctgtgtaccttgtgtgataattatcagatactgcttctggtgaagactttcctgttgtaccttcatggaattcataatgtcttacttggaatgctgataataatgtttatgtttttcttatacgtattgattttcgtcattaaattgttaaaaggtattaggataggaaccatctgtctgtttatcgcctcaaattctagcccatatagaaatatgttgacttaacaacttttcttctttctttctctttctctttttctgtttgttggtggtggtgggtgttttacaggcttcccagctggcgtgtatgttgtaaagagagttcttcagcttcagcgtcatcatattactctcaagatgacaactgcgcactagaaaatgaagatgtacaattccagaaaaaggtgccttaaataaagttaacattataatttgtgtgtcagctttctgagagtgtctgaaaacattcagaataaaagtaatttcaaaaatgccatgccataatttttggtggagattcgtatttttctttgctattactcaggtaattcttaaattatgacggctcagagatatttatatgtttattcttgttgcttgtatttggaattttgtaacatccttagtcctgtagtatagggtagtgcatgttcagagagctgaaaatgagtgatttgtttttaatgatctataatagagtttttaaagaaaccccaattttgcaaatgagaactattagaagtgagtattccagggagaatctacagtcagtggctttgtagtttgttttatgtaattaggtgcagtaaatataaagactccaaaaaacctcatggtcttaaaacatgtattattttaccattctaaatgataaatggagagtattgacttgatttggct

SEQ ID NO: 57036 - DNA, 1154 bp, Homo sapiens
tgagactctgtctcaaaaaaaaaaaaaaaagcatgtaaagtatctcattaatttttaaattttgaatacatgttcatatggtaatatagtatttgataataaggcagtagtcattttctcaaggcctccatcataaaaatgcagatgactatttatatttttttgtgaatttctcggtgtaaataattccccaaatgatcatactttatattctccggactgcgtgcctcgatgtttgtttgtgctcttgtactggccctccttttctttaatgcctagctcttctaattcatcatagtccttagtttctttttccttgagctgaacatgagtacctctcacttgatattcatttattgagcatttaaacacctactgtgcgctagatactgtgctagacactgggaatatgaggatcaagagaacatagttcttactgaggacatttatggtatagttgaagaagagagggagacatgaataatggcaattgagttgttatagatgcagtgataaaagtgtacagagaacactggaggcataggggaaagggagtagttaattctgtttagggttgatcttggaggaggaggtgctgatagaggttttcaaatatgaacaggtgttaggtagatttcacattgtgttttggaggactgaaaggcccaggtcattcaagactgaaggagcagtaagaatcatttattgcttcatggtgttacttgaacatatcttatatcgttgcttattgatacacattatttcctaaactgctcagggtcaagaactatgtattgtactgttttgtacatgtccatagggtttctttgttgctactatcattcatcaattagagaagagggaaatctctgtaggtcctgatgcaaagtaggaaataggtagggagaaagtgctttcctagtttatgaaatgccatgaaaaatgcttagggcctgtattttcatatgaaatgcattccttagggcggtaatattggaagaaaggatttttataaaagtactttttttagtgaacattgtttatattgtcatttttcagaaatgctttccataaatgcccgttctgctaaagagatgttatattaatctcaacatttaatttagctgacttgtttttttaaacagaatacagag

SEQ ID NO: 57037 - DNA, 1053 bp, Homo sapiens
taattatcttcagaatacaagttaataatacaagattaaatttaggctcttcagtcagaactattttaatggaacattttacctttcattatttgtgtgcaaaatacaaccagaccaccttatattttagagtgtgattcttataattaaggcagggcttatcacagtggaacagttttactttcttttctccttctgagttctaccttgacttcatgcactgtagaatttcttgaaatagtatcaacacagcaatttaaacttccctcaggtaagcaataactaagttacagagatgaagtatattccataaacttaacaaaaacaaaaataaatagggtccatgagtagttcagtgtgctgactaccacatccatatttattcctctttaatttggggatcttttgttctctgctttctttttcacgtattttcagtgaatcttcacttacgactaactaaacttcattctggagactttcactatcacgggaccaactgttttgacgatgtttcttacaaatataggagctcaggatttcatagtctaacatcttgaaggaactacttttctcagtgataccaaatcacgcatatgttaaagtttagttgtcagatatcacatccatgaataaaattagacaaacgttaaaacacatctttgaaggtatttataataatgtcaaatgtaaaattcaagcatggcagctaactttgtcctagatttgcttgttctccttagcagactgaaatttctttattaccttagagacttaaactgtttgtgagtctatgctaatcggcaaaagagtagaattttaattaactgtattaattactttctaaatgaattagtatcccagaaaaatcatgacagataatgagcacattatgagtaatagccaatagttttatgtagtatctacttcagaataactctgtcccgttaagtttgtgtgagtgggagagaatttgctttctgatgccttgtgctagcctcttatttcaaggatctgtgagacactgattgccgtacttatacagagaatgct

SEQ ID NO: 57038 - DNA, 1054 bp, Homo sapiens
ctcaaaagcatgctcttatgtagcaaatataaactaaatgagacttatattgtttaccagagtttcctatctaatagattttgtacacttctcaatatagtgttagtgaacacatcaaaactttgttttaggaatacagaaatgattcaataatggaataaatgtctgtattcattattcagtttaagaggaaaaaaagtcacaagattggatgcccttcctcagtattccttctcttgtcttcagatataaccactgtcttgaatttagtattttttttgtttagttttagagcttttcaaataagtataaataatatatattatatggcatagtttaatataaatgacattcttaagtaacattttattcaacattgttttgagatttgttcattgtttccactgctctgtttatagtgactactgcagttcatccattcctcatttaatggatatttaggttattatttttggtattaaaagcaatgctctaatgaacattcttatgcatatcttttggacacacatgagtgttttcacttagatttatacatggggtgtatttagggattatgcacatcttaatattgttaaattttaaactccttttagcatagatttctcttggctcaacagatatttcacacttggccacagactatcacactttaaactccattagatttgtataatttatgtcagcatgccccaacccccaggccacagaccagcaccagtccatggcctgttaggaaccaggcgcacgacaggtggtgagcagcaggtaagcaagcattatcgcctgaattctgcctcctgtcatatcagtggtggcattagaatcttatatgagtgtgaaccctattgtgaactgcacatgtgagggatctaggttgtgcactccttatgagaatctaatgccttatgatctaaggtggaacagttcatcccaaaaccatctccctgccccatccatgggaaaactgttttccatgaaactggtccctggtttcagaaaagttgtggaccactgatttatatgatatctcagg

SEQ ID NO: 57039 - DNA, 1022 bp, Homo sapiens
ttaaaacatctaaaattatctagcttcctttaatggatgtattaacttatattttaaggtggatgcatggcaagtatacaatttattcatttgtacaggctatatatgagtaattgtttgctttagagttttataaattatttttttcaacgacctatgcttatatcacttaacaagtgaaggaacacatcctaaaaagaatgtttaaattatctcaagagaaattcaacttttaagtaaaccaaaacctttctttttacgttttttattttttcaaaatataatcattcattataaattggaactttaatttgacagaaacatttgtatttatttctaaaatttatttgtattatttgaaagttgaagtcttcttactttttggtgtttctttcagagctctgattatacaaaaccaggagacattgaccctacatcagtagcaagtcccaaagatccagaagatataccaacatttgatgaatggaagaagaaagttatggaagtagaaaaagaaaaaagtaaggaagtatttgagttctttaaattttttttttaagtatatggtgtagtttaatatgctttctttttttgattggtaaaacaaaataaaatttacttttgaaaactttttaaaggtgaaacttaaccaagttgctgttgatccatccatccatcatgtacctgtatataattacatacagttttagttttaattaaaatccattcttgtaaattattaagtgagcataaaataaggcatagcagtgattttcatcacaatacgaggaaaattgaggcatggaaactattttaaaattcatatggaactcaaaaagaacttgcataaaatccttgggtttaaaatattctttaacttaccaaaaggtgttttacatatgatgtttcaagaacatacctaaagaaaagcttgcttatgttatgaggcagaggagggtgactaaaattataatttattccctgtgtgatgggttattaggtgcagcacaccaccatggcac

SEQ ID NO: 57040 - DNA, 2082 bp, Homo sapiens
aaaaaaattgatatacaaaattttcgatatatttaaagtgaagaaataattttctcttacgtgagttaataccatagaaataaaaactgtgaaacctttcttttgaatgcattttggaaaaatgtcaaaatatcctcttttaaaaaaaaaacctcattttgtatatttgttttaacttgcttgctattttgctatgatgataatacacagaaacgttttagactgatatgaaaactcatccatttaaatgccttaaatagattagttttacattttaattgaaacagtagatgacttaaatgtaaggagcagccattatttttgagtccaaaagccagtggccctcaaaatatgaccaaagttgatgtttgtcatttattgtgaagagattagtcttaacgagtgttttgttttggaagtctttaatgaaattgttgttgatagggtatttggcactagcatggtggaagaatatgaagaaattgctgattcccagtatcactcagaacgccaggaactatttgatgaggactatggtaagtgacatcaaacagatgactgttaggtatattttttttactttttaaaaatcgaatagtaatgggggagtatagcttacttaaatcaatatgactgttgtcttcaggcttttgttttgttgtttttaactctaatcaacttttacttaaatctgttttctaatatgattgctttgtattcgtattgctttccaagcttatctatcacttatttgtaactgaaactcccttctataacattaatggtataaattatgattatatccctatgccagggccaaaaatctgttaaactcacaagatactgaaatagtagaaatgagctttaatgcctgtgatttcccatgagcctaagagcaagcacattttggcttcctgtgagccattgagaaatcctgtgactctaaagagttagaggaaagttttatgacactctccatttcctctttaagtccttattttaagatgtgttaaactattgtttgaacaatctaaattttctcaagagtgaaatgaagacattgactaagagttggtaaagtatattgaaagcttgaataaaaacgtcttataaatgtggttaaaattttggtaagcattacagttattttccttggtttatatttgtttgttaaatggtttcttaatcttacatgctttttgtgaacatgttttagatatatgattcatatttatcataaaatgttttaaatgtcagctgactttgacaggacataatttgagcttttaaatatgttaccattggagctagatctcagcataattacttttattttcgtttttaacagattatccactggattataatactggagaggataaatcctcaaaaaatcttcttggttctgctacaagtgagtattttgaggattttctattcattctactactttttcattctgacacacacagacattttgtcatggtatggttgaggagaattctcccagtgttgaactttgagttgaaataaaagatactgtcttttgaaaagtatttttatagaaatgcgataagaatatatgaaaagaaagaggagagagacaaatgcaatcgtaataaaggtgtttcttctactctaattaggcgctgacattttgggacagattccttatagtgaagaaagggctatggattttcttggggaaagaattattaaaacagtcataccacagttaatctatgggtatggttagtttgccatttagttacaaaatataaagggtgctcctaccatcatgataatgaataccaataagaatactagtaataatatactccttgtaaactaagaaacaatgaataagatatactggtgctttagtttgttgttattccaaagtcgaatcccaacctagtggtaggctcactaaggagactactagaaagaccattacctgactgacactttatttttcatggttagattctgtgtaggtatatttcaatgatgtttttgattatttctgaaaaatgtaaaattaactacaagtagttttctttttatttgaaaattattaat

SEQ ID NO: 57041 - DNA, 1063 bp, Homo sapiens
acattactggaaggaaggtcttctattcccagtaccattttttatggagttctgatattttgttatgctcatgtataaatatatctatgtagatattgaggtttgtaccacttttttcatgtaaatatcctccttcaaaagagaagtagggttagcaggtatgcaaattgctttttacaacactttgttttatgaccttgacttttcattaatctgccccatacctgtccccagccaattaactaaagaatttgtatgctttatgatttaaaaagattgctgttttggtcaatgagttttttaaaagtcatcaaagagatttgattctatgcaatatcaatttagaatttaaccatattaccatagatatgataggctaatcattgaaaatgttttctgcttttttttggataatctctgttttgtttttacctgtgataatcacataatgtaggaaaagcatttgcttttttacacttttttaaaattttaaactgtagagaatttttaaagaaaaataggtttttctgtaaaataagaattttggtcatcacatttttttccctgtcccagtacagactgtatgttgagttatacttgagtttatagtatgctgaagacagtgttttggtaaagtgtctagggaagttttacaagaaaagtatatttaaggccaggcgcggtggctaacagctgtaatcctagcactttgagaggctgaggtgggcagatttcctcagctcaggagtttgagagcagcctgggcaacacagtgaaaccctgtctctactaaaatacaaaaaattagctggacgtggtggcatgtgcctgtagtcccagctactcgggaggctgaggcaggggaattgcttgaacctgggaggcagaggttgttgcagtgagccgagattgcaccactgcactccagcctgggcaacagagcaagactccgtctccaaaacgaaaagtatatttaaatataaaattccttttgaacataaaaatttagatacacactttacacttttggctaaaatttatttgtgtcctatattggacttta

SEQ ID NO: 57042 - DNA, 1050 bp, Homo sapiens
gagattttgatgtcctaatggtacttcaagtatgttattcttttatgtgttaaatagctacttgatttagaaagccatcttttccttagagaatgacagatgataatatttttggcaagaagaaacagtcttgcctttttgtttttttaaaaaatgcttagatccaagtgaacacttaaaatgactcatttatttcctctcatttaacaactctttcagtatctagaaggcatattaatcacgtaaggttacacaacattcatagtcacctgacttgatttaattatctgagaaattgagaaacgatatatattacttgtgatcttatatgatcatttcttcctaaaagaactttgattttttaagaaaaagtctgcagtagcaaacctatttggcttttttcttctcttccaagaaatttgttttagtaaaatattttcatggtacagcttttaaaattgaactcaacattgggcatctttcttaaaataggaaataaaagtatatctgagaatgccactgccacagctgcacctaaaatgcctgaatcaactcctgtttcaactcctgttccatctcctgagtaagttataatgtgatattaaatagaattttgttacaatggagagataagtatattagtataaaaaaaggaatttgtgatttgtgtgtgaaatgattacctgtagagagctctgaatcataggatagacattctgtggccacttagaaaatctgagttgcttcttcccattagtgtatatgcatactgggaatataattcagatcaaactttttttggggggggtattatatattactttcattattcacaacagtgactcttttccatactggaaataattgaccttactctgcaggtataggcttgaggacaaattttaaaggcccccccttttttttattaagttcaagtttaaaagcattgatctgtggtatccctagaaagctaccaaaatacctagagcagtggttcttgaataatgtatttgccacacagcaagctcttaactgttccatttctctgaa

SEQ ID NO: 57043 - DNA, 2623 bp, Homo sapiens
attactttcttctgtctttgctattgtgacattagtctttatttgaagacatttcctggcatgcttagtaatttttcagaatgggaaaatgtgtgtttgagcataattatttttggtattgaaattaccatattttttcatattggactttttatgtataaggctacacccagtaattaactatctttatcttggaaggaatcacaagcattataatttataacactgtccccataagcttcatccccccactctcctgtatgccacatacatactccacagcctcaaaatgggatagaatattaatagtggcactagtagtttaatagcagcactgttagcatatcataagccagaattgttattaaagtggttaggtatttggcttagaagattagcctagatgatagcaaaattattttaggaagggagatatgtttcttgtccttaaagtagataatcctatgtgtgtaggtgtgtgtgtgcgttgtgtgtttaatgctgtattggagttcctcaaatcattcttagaaaaattatgtttgagaccaacctagctgccttttgaaaatagggtattcaagtacaaagtgcactcataaatattaagaatcctagattctagttttagctctggaccttatttaagctagtttattaagctagctcttagttggcttaatttctgatgtgtaagggatagtgaagcttgtaaagattcagtgaatatttatgagaggaaaggaacactacattcagtgaatggaagtattcacttagaaacaattcttaaacagattaaaagaaagcaagtttgatatggtaaatatggtggtttgagtcatctggctagtcacttgataaatagtatttctcttatcatttctgagcagtatttgtttttataataaaagtgttttgtaggtgaaacatttatccaaaaacaaatttcttctatatttccaaccttttatcttctgtatggatacatttatttttctttaacatatttcaactttagacttctaagtaagtgatttataattatgatatatgtatttctaggtatgtaaccactgaagtacacacacatgacatggagccgtcaacaccagatactccaaaagagagtcccattgtacagttagttcaagaggaggaagaggaggcaagtccatctacagtgacccttctgggcagcggtgaacaggaagatgaatcatcaccctggtttgagtcagagacacaaatattttgcagtgaactgaccacaatttgttgtatttctagtttttcagaatacatatataaatggtgttcagttagagttgctctttatcggcagcgcagccgaactgctttgagtaaaggaaaagattatcttgtgttagctcaaccacccttactacttcctgcggaatcagtagatgtttcagtattgcaacctctgagtggagaattggaaaatacgaatatagaaagggaagctgaaactgttgttctgggtgatttaagtagtagtatgcaccaggatgacttggtgaatcacactgtagatgcagttgaacttgaaccaagccattctcaaactctttctcagtctcttcttttagatattaccccagaaatcaatcccttgcctaaaatagaagtatctgagtctgttgaatatgaggcaggacatataccatcaccagtgattccccaagagagttctgttgagatcgataatgaaacagaacaaaagtctgagagctttagttctatagagaaaccatctattacctatgaaacaaataaagttaatgagttaatggataatattataaaagaagatgtgaactccatgcaaattttcacaaagctgtctgaaacaatagtgccaccaataaatacagccactgtacccgacaatgaagatggggaagccaaaatgaatatagctgacacagcaaagcaaactttgatttctgttgtggattcttcttcattacctgaagtaaaagaagaagaacagtctccagaagatgcccttttgagagggttacagaggacagctacagatttttatgctgaattgcaaaattctacagatctaggatatgctaatggaaatcttgtacatggatcaaaccaaaaggagtcagtatttatgagacttaataatcgtattaaagccttagaagttaacatgtctctcagtggtcgctatctggaggagcttagccaaaggtaagctttattatgaattagcacagtcagcttcacacagtgagttaagcagcatagagtatgacctgtgattacaggagaggatttaattatctcatgatataatagaggtaagcgcaattttagcaagagagagaaagaaagctacttgaatgctgatcagtgccttaatgaattgattttttgtttttaattttaaaagtactttccagtgacaaaacacttttattaggctggcaacaagtttgaattatctatactcactttcaccttttttcggttgcttaactttagccactttttctgcttgattcccagagggctcatggaaaaaaatgatagtatatagaccttaaagcttttagtggaatttgaccagatatcacttaag

SEQ ID NO: 57044 - DNA, 1009 bp, Homo sapiens
attcttcagaaaattttcaatttgtctttgcgccaactgctttgctttaaaaacactgacttcttaaatatttctggttatatgctagtttatatatatggaacacatgttaatttgaaaagtaatttaccaaattctgttatacagtatttcacattgtagcagtgggtgacaaaaataaataaataataattcttgttggggagggttagacacggtcccagatacttcgtgttttgtttatttctaaaatttctgttcaaagtttacttactcattgagattcctattaatacatttgttttggaataacttaatggttttttttagattatttgacttcaatttataatgttaatagtttgtagttaatattcaaaaaaaaataaattcctttatcataggatcagcggcaaactgaagccatccagttgctacaggcacagctgaccaacatgacacagcttgtttcaaatttatcagcaacagtagcagaattgaaacgggaggtaattgttattgctggtattgcgagacccaatgcatgtatagaggttgtcataaagccaggcttgttaacatgaacatggtacctaaaactttgaccaaacaaaattgtcatttgtagtgaactttttcaaaaaccagaatatggcatttttaagttttgaaaatatattatcatagtcttttgtaaaatatggctttcataatttaggccatacctataatataggtataaaacttctagcaggccttttgtaagcattgatagtagcaacacgtacttcattttcaattcaaaaaggcctataaagttgcttaacaaagcaaacatttcattgatttaaaaactttttattgagcatctagtgtatgtgaagtgcgagctgtacactcctaggttgtggtatacggtagttaatagtccctggcctcacagggtttacgtcctgggggagggatagaatacatttagtaaataaataaatagatgataatttctcct

SEQ ID NO: 57045 - DNA, 1109 bp, Homo sapiens
aaaagtggagaacagtgtaaacttgttgaattcagaatatttgtaagttgtagaaagataagccttaaggaactaaggttgatctctaagttttgggcttacgtaactgggtggttgatagttcattttataagatgggaaagactgggtaaaagcacaattattttttctccttgaggaggagatagtgtaaatggaaagacaaacaaaatgtgacaaaatgttaacaattggtgagatagataaaggtgtaaatatatttcttgttttatttctaaaacttccataggtttcactcctatagaaagaattggaatgctgcaaagaattttttttctttaatgtcatagtttattttcaaagagcatgccctgcatttctggtctttgaagcacattaaaaaaatacttaaaatgatttgtcctttgaattttagatacccttatatttttcctaatatgatttcctatgattattatttaaccctcttctcatctcaggtttcagatcgacaaagctatcttgtcatatctttggttctttgtgttgtcttgggactgatgctttgtatgcagcgttgtcgaaatacttctcaatttgatggagattatatttcaaaacttcctaaaagtaatcagtatccaagccctaaaaggtaatatcagcattatatttcacaattttattttttttactatgctttgtatatttttgagaaattttaagcaaataaagggagactgaggtaatttctttccctatatgattatcttgaaaccaaaacattaaaaacatcattcgatagtaagatggtcctatgcctaacctggctctgtagactataatagagaaaacactaatagtaagtgcatgaaacccctgaaatatttggttgagaaagatgcttaaatgtggaattcaaaggaagaagagaatactattttaatacagtaccttttagacaaagatctctaaatttttttttccacctgtattagcaataactggagtgttagagttagtcccgtgtggtatgtacagttctcaataacctctgtgtagcctcaacaaaagagtaaattatatgtgctttactcgttgtaaccaat

SEQ ID NO: 57046 - DNA, 1070 bp, Homo sapiens
agggatgttttgatattttcatatatttgatgactttctcaataaatctctgaaatataatgtaaaaaattataattggttgaattgtattaataaatttcccaaatgtgtagagcttctgtagtgaatttactatgtgtaagcttttgtctctgtcagaccttaaattgtttatttttagtggattgaataggactaaagtctcatagccttttaaaaatgtgtgtctattttgtcagtgtgggggtggggttgggatatatcttgaagctgcttagagtaatgaaaccttagaaactttgggctaaaactaataaatctaatttactcactatgccagaagtgttcattcattattgcttagtgatatatattgcatgttcaagctgtttttagattgggatttcatagttttgatcatagtaataaacagagaaaaatatcttggatctctttttgtgtttatttctctaactggcttccaaacacggtcacgactacttgttgcacattgttaatctacctttgtgacacagtttagaggctagtcttttagggaagtattcaaatgatctgtaggtttggtgtgagcttacccaggaatgtttcttttcttatcaggtaaaagagtgaggctgggcccaaagaaagatcgttattgtattggttgataaccagctactagttaacaacttaaggaagtatagttatttgaagacgaccagtcaagcataggaatcatatcatcttccaccttgcctctttttgcttactaatttaaaatgcataaatatatagttaacctgatacaaattcattggttctattactagaggataataaggaatgaatgatttgtcttattttagtgtttaattatagcaaatccaccaaatccactttacattttacatctgcttttttttttttttacttacagtagacccaaatgatttgtacattgtagaacccctcaagttttctccagaaaagaaggtaattgtttatttctttttaagtttattgctatgttttgtgataataaatgaagaaaagaggttgaaaggttt

SEQ ID NO: 57047 - DNA, 2733 bp, Homo sapiens
ctatattcataggtagcaggtaagcaatttaaagagttttgattcagtagtatttacaaaatgggaagatgatgctagtatctatatagaacataacaatgtatgtgttctgtgctgtttataatactgttttacttttcaccaggaggtggcacttctctattagctcagctctctaggtgtttgataaggttactatgggaagtatcattactaacttttcttttacttgtgttgtagaagaagcgctgcaagtacaaaattgaaaaaattgagaccataaagcctgaagaaccattgcaccccatagccaatggcgacataaaaggaagaaagccctttacgaaccagagagatttttctaatatgggagaagtttatcactcttcttataaaggtcctccatctgaaggaagctcagaaacttcatcacagtcagaagagtcctatttttgtggcatttcagcttgcacaagtctgtgcaatggacagtctcaaaagacaaaaactgagaagagggctttaaaacgaagacgatctaaagtccaagaccaaggaaaattgataaaaactctaatacagactaagtcgggatcattgccgagcctgcatgacataatcaaaggaaacaaagagatcaccgtgggaacatttggtgttacagcagtctcgggacatatctaaaattaattgaacttttcatacagaagacttttttgttgttgttctttgaagaacagtctgtagtatttgaagggtttgggggagggagaaaatattaatgggaaaggcattcagaaattatggtttctacctttttaaaaagtagatgggattgtgtcaatcttggttaatgagctacagttttacaaagctgatcacttcctataaggacaatggtagacattttataaagatgttttttcacaagattaattactgggacaaaagtaatttggaagcccagttccttaggtgggataggaatgaaagcctaaacctcttcctttagctttgttcctatttcttgcaccttcccatatttatgtgccttttgtctatttataatgccactggaagaggagggataactttttctgttatttgatttcttttataactttgttaggtttttgaagctgcaaacactacaatgctttgagggggtctgtgcctgaagctcaggagtgtggatcagacagtctaaagatcctaaaaacttgccaactggatctttgtttagcaaactcactggaaatgaacacttaatggaatttttaagtctgttctgttaggtagatggtgatgctcttgttattttcacttattcagactggattacttcttacttagttactaactcaatgaggaaaaatccctacaggatctttttttgcaaacaactgatatatgcagacaaatttttgacaaattcaccttttaaacacacttaaccatttgtgaaggttttctttagcttacattttaaacatacacaataaacactaatcctccaaactttcactgtttttattagtatgaatataaaatttgaaggtttggccaattagtacaagtctcatgatataatcactgcctgcatacatatgcacagatccagttagtgagtttgtcaagcttaatctaattggttaagtctaaagagattattattccttgatgtttgctttgtattggctacaaatgtgcagaggtaatacatatgtgatgtcgatgtctctgtctttttttttgtctttaaaaaataattggcagcaactgtatttgaataaaatgatttcttagtatgattgtacagtaatgaatgaaagtggaacatgtttctttttgaaagggagagaattgaccatttattgttgtgatgtttaagttataacttattgagcacttttagtagtgataactgtttttaaacttgcctaatacctttcttgggtattgtttgtaatgtgacttatttaacgccttttttgtttgtttaagttgctgctttaggttaacagcgtgttttagaagatttaaatttctttcctgtctgcacaattagctattcagagcaagagggcctgattttatagaagccccttgaaaagaggtccagatgagagcagagatacagtgagaaattatgtgatctgtgtgttgtgggaagagaattttcaatatgtaactacggagctgtagtgccattagaaactgtgaatttccaaataaatctgaacacttgtctttattaattactggctcttctgtcttttaaaagagaactcagaaattattaatctttgaacagagatttaagtttttgccacttttaaagttaaatatagcagcattccattcaatattgatcacatttcagccaactacaaaatgatggtacttttacataaacattttgctccctatgctatcagaatttcagtttttcatatctaaatacagcataacattttgtaacatgaggtttattttttcctctctcacataactacatgagaaaaaaaacttaagtgaaaataatagatttatgcctattaagaagcaaaaactatatagatatttatccaatgggatttttagtgttccctgatgatcaacctcattttatttcttctaatgttaagtaaagcattaaaacagtatgaaataaaaggaaactagggaattggtaagaacaaggatgcaaagtaaaacaattcttttaattga

SEQ ID NO: 57048 - DNA, 2740 bp, Homo sapiens
ggctgcttcttcgccagaaccaaccggttgcttgctgtcccagcggcgccccctcatcaccgtcgccatgcccggaggtctgcttctcggggacgtggctcccaactttgaggccaataccaccgtcggccgcatccgtttccacgactttctgggagactcgtaagtggccaccgcgtagccctgtcctggcctcggttgcgccggactcggaggtgccttccctgtttcttctccctgccgtcctcccggccgctcagccccctgcgccgccctcgccttcccccgcactggttccggcgcgcgccaggccgtgtggcctctgctcagcgtcggctgcgctgctgggagctggcacccgttcggcctgccctgcgcgggccactcgatccctcctggcctccccgcctccggcgtggctgggcaaggccacgccaaggtggggggtggggaggataaaattgtgttctgcgggttctggaaactcaccgcccgcgggagggtttgttgtccatttaactcgtcttagtaaactgtgcaggtagcgtggtcaggccgagggcgcaggggcggggcggcattgacgatcacttccccggactagtgcccagggtcgcaccgccctcccaccctccgttctggaatttgctccctggggaggatgggtgtctaaagccaaagtcggaggacacagctgctggctataggttacaggaaggccaacgtatcatctgagggtgcagtggtatttgcaggcttctgggcacaaaatgtgaaatttaaaaccactagctgccaagtaggtggccgaaagactttttgtccagagccgcctccaatggccaagatatgatttgataacagctttaggaagagccaagaacactctgcgtaggtgtgccttcagagattccagaacttgcaacacttggagggaaggactttctgacgctgttccgctggagtggcctattcttgctagtgatggccgttccaggctccaggacacgtgtactccccaactttgagactctcttgttttccagtggcttgcccctcactgtcccctccgctttctaccttgcttctagcacatgagcttgctgatgatagccaaattgatgacctgtgatctgacttggcagttttaccattatggataggagtagtaaatcggtgttgcccttttttttttttaacagctcctgaatcagcaaactggaagttgcttagttttcatcagaagcattccaggcatgtctagttatattatggttctggagtactagtggtcccactacactgtggggctccaaggcttgacaacagttcttccccagattatatcctttttatatacagtatccagggagacaggcttatgaaattaatcagtgattggacagggctgtgcagagaaccagggacagattcttacacatcatatgcctatccaaccctttataacctcttaagtcccttttccagccactgaatagggaaaagttaagctttgtgaaagataggactaggccagaaaaaggttgagaaatggaatattcaaaccttgaatgcagaaaaatactttagaaatacagcttatggccattcttatacttaggatctaggtagtaatatttctccagcaatccttgggatttttagagttgtgttccttcccatttctacctgcagccctcatcccccatccccatgaaacataaactatttccagaactcttagcttgtatagattaaatattagcataaaacgtatttactgtgccaacagttataaatgctgtcactttttaagctaaccatacttttttggggttttgttaatgtttattggcctctagatccatctagatttgatcaaaagtggtactttatcagggagccatagttaggaacacggtagaaatatctgcatttattaactaatatacaagtctgcctaggatcaggtatagtattccctaccttaccgggaagagaagtttgagccttttatatgtttataacacatggatttttgcctgatttttccaattttctattctgtatatgatcccaaatcagactgtcaatttttgatccaggtatttttgagaagaaaaaattaaaatgtatttctctaccttacccctgatcattgtaaacaactaaagaggttgggtgctacattgggtgagtttaccttatcgctgtttctttaagtggtagaagcagcttcttcatagtacatcttcactaagcaaaatatgtgttttccaggggtcttctggggcttagtaagtgggaaccattctcttgaaggaggaaaccttttgtcttttgaaaatgggtaagaaaatgggagcatgtcactgaattactcttaagtgcagcagtaggaagacttggaggggaaggaaggccaaggtaagacattcttggagtttatcctatttgtagccatgaggtaaactggagtttcacttctgagggagggaaggacgtgaactggcttaaaaccagttccttttgcatgattcagcaaaacagtctttatggactcacagtggaaaaagaactcctaacttttctaatttatcctccttttaacgatagaggaggaaacgccctgttccatttcttctcaacttctggagaccttctgttaagtctcatctaaccattaaatagatcgttttccatagaatctaaggcctagattttactcatagtgatatta

SEQ ID NO: 57049 - DNA, 1341 bp, Homo sapiens
aatatctgagactagaagaatcatgtgtaggagaaaaaagaagggcagttatctgtcttgaagtagaattttttttcattccttacacttctcagtgagtggtaactgtagtttttgctatcatttttcattttcgtttttgcagttgaacatacttttttcactcagagagttggagggacttgcccaagactgcccaatggcaatgagatttcaacctcaaatcaatgttctttttaatgcaagatgataaagagtaggatttagcctaatttaggatagaataaagccaaataatttaggataggttctttggtgttcatgggtgtaatctaatgcccatgatgcaagtggcagagtagagaattagtgcacagcaataattaaagtgacatattgccaaaggaagcggttatagcccattatataataccttttaaaggacagacgcatactcaggtttattttacctgctgagcttctgccttagaagttttcagaattgtgattacattgaataggaaaaaagtctgaactatcagaagcagtgccgcaactttgacaaacaactgattatataataatctgcctctagcatgagactatattaattattatttagctctggtgacttcataagcagccagtgacaacagaaagttaagataataaaatgaaggaatgttacaatttgttatcatccgggagcctgaggcaggagaatggcttgaacccgagaggtggaggctgcagtgagctgagatcgcgccactgcactccagcctgggcaacagagactccacctcaaaaaaataaataaataaaaagaatttgttgttatccacttcagagctcattaatgccacatttgtcacatctccgttgagaaatccacaatggttttgtatctgctatgccatcaagcccctgttttactttcaagcctacacacaatagacgttattccaattttaaatcctcttttccattacttgctaaactctatccaactaagttcctcactctcctatcaatagtttatgtacagagttgcccacatgtttcattaatatcgttcctggccgggcacagtggctctcgcctgtaatcccaacactctgggaggctgaggcaggtggatcacaaggttaggagttcaaggccagcctggccaagatggcgaaaccccgtttctactaaaaatacaaaaaaaaattagccggtgtggtggcgggtgcctgtaatcccagctattcaggaggctgaggcagagaattgcttgaacctgggaggcggaggttgcagtgagccaaggttgcggtgagccaagttcgcaccagt

SEQ ID NO: 57050 - DNA, 1045 bp, Homo sapiens
tgggccatatccttcttcataaggcagctctgttttaaatttttatttgttctgtcctccgcccactagaaaacaaacccaatccctcatctgaataaatgcacaactattcaaggaacaatatcaactcccattagtattatttttatgatagtcatccccaattgacacagcctttccctcgattaaatttgcatatcagtttttcttactgggaaagccagaaccaaatagaattcccttctacgtttagaaaataacagggagaagaaaattatctgtattccagccatccacattagcagttggtgtatccttctagatgctttgtttttgtcttgtttttatacccttgaacattattaatgactgcagagctttctaagtggctttaataacactcaaagaactcttcctatttatgcccctctgtgctttacaggtgtttgtttttggtcctgataagaagctgaagctgtctatcctctacccagctaccactggcaggaactttgatgagattctcagggtagtcatctctctccagctgacagcagaaaaaagggttgccaccccagttgattggaaggtaaagatgtttttaaaaagcagtttctctacttgcctgaagggccagtctctaaatggccaacttcaaggtctgtgttacctgtttctagcacgcaagtacactgggaggatttttcctcatggctgagttcaagatttgctgaaaggcccttttcaaggtctttataacaccttttatacacaacacaaactccctatatggctttccaacttttagataatttggaaaaattattggtcagaatgattccttttcctaatagaaggtttaaaaaaaaaaattttatctaacccttccctgatggcaaaatatttatcgcacaatcttaattggccatttccgttaagtcatggctgtaaaagtactggtgtattaatgtcattaagtatttaatttctcttaagcttcattcttttaaacctgtgctagaattctccaaaatttgttcataaa

SEQ ID NO: 57051 - DNA, 1046 bp, Homo sapiens
tggcttattaaatgaaaatggcactaaaagtttcttgagattctttatactctctgccttcagcaatcaattccattcatacatcagcactctgctggttctgtttgaaatatgttctgtatttaaaactcaaatcttgttggatctctgcagggcttgtgaccaatgaagtcatatttgttgatggttgacaaagcttgcttcactccatcagagaatgactatcaatttttttttaactgtcctatcacgtcctctcctgtcacccattttgaagagtggcagaacttgaagttcaacttcctctgtaaatatccaagtataaagcccaggaacttctagaataacccagatgcgctttaattttttttaatatgttttgatcacagaacttctagaataacccagatgctctttcatattcttttaatacatcttgatcacagctgggggaaaaaaagctttttaattctataccttcctagtagataagtgaagagcagggaaagagacctttaaatattttgctataaaaaaatttgtgataagtttctatcaaaatggggagattgcagaaaaggcttcccttggctcccaaggaggtgtagcaggtgtgagcaatattagtgccatgtgcctttcacacagggtttgcatttatcagtctgttttccgatgatgtgtacatgaaagagtacaccatgtgaagagaagagagaatgattgaaaatgttttagtatagaactcttcttgcagtgggttgctattttctagattttactttttagggaacaaaataaaatcctttgttaaaactgggtcagagaattctgttgtcatattttgaagtatcagatttatgtcctaaagggcagaggcttccttcttcctaggattggcatgagtaatttcttccaaagacagatacataagattttatataatgaaaatggaggaacagctgaagaacgtgtgatgtcaccacatatcttggtccactttgctccttcatgttacttgtttggatcctacagtcccatgatgt

SEQ ID NO: 57052 - DNA, 1050 bp, Homo sapiens
agaccccttagtataaaataaacctattttccctctttattaatctttcaatccttatcctcaaactttttatagcttttgatatatttgctgatgctatttttaaactccttgtgttggtacttttatgtcaattatgattcctctactctcttaaaactgcttttctaactccttcaccagttcctcttcttcctcttgcccccagttgtgagaatttctcaaaattcaatcctaacctttggtaaagcaatctgtaattctctattccatgaccttccctgtcaccagtattatgaagaatgagtctttccctctttagggcacccatagtgctaatagcctcatactgtattctacttaattgttcacaggtttgtccttctgtgtgaattgtaagctttttgagggtagggattttgttttgttctttttttatacctaaaaagtccataaaacagtaagttagtaaataactgaatgaattatcttttagtaataccttatacatagaactcattacctcttcattaatttatagagcttgtgcacctttataaaaatgactcccaacacttatctccatatcttgccccattttaactcctactcctctagcagataagccacacatacatccaacatctctacgcctaatttctcctctgaccttctattttctaagccttcacattgaatgtcattttactttctggcatgtgaaccaagtgattacaacagattcctggatctcatgtcaaagattcctttgatgtgagaatctgaacatttatttatatctatagatttacaattttagtccattttgagagttatagtatctcttgttacatattgttacattgaattatagatctattcataggcaactttaaatgcccgtaggctttgagtttgagctgttacataggtagctgcatggctttttctgaacatccacaaagtaattactattcaaagtgcatactaataaatcaatgaagcctccacattatttgggaagtagtcaatcaaaggctaaattcaatg

SEQ ID NO: 57053 - DNA, 1099 bp, Homo sapiens
tgctgctagatattctcagactgagtgtgttgaattcctggactgggcaggtaaggaagctcacaaggggttagcaaactgactgatgtgatgagtttttctcctatgagttacaggatatgtcaccttttttcacagtgttttgtttgtagatacaaccacagtcacagttggtgataatacatgaaatttccccctctttctttgttttgctattggccataaacattgtatttattaggaactgaacatattggaagctagttgatttaccaacttctgtctcaccaataattgtctatgagaaaataatttctataagaagattattgtatgttcaatatgtatgttcaaggccattttttgagagactcaggcaaagtgggtcatttcttaaatgtttaaaaaatagcatatttgagtaatacatttgattcctcaaatataaaaggttgtaacaataattttagaaaggtttatttaggctaaattaatttatagtgctaatagtcagaatagtagctacccttacggcatggggaacttctgggatgtaatgttctttttcttaacctggttgctggtacatgggtatgtttctttgaaaattcattgagctgtatgcatggtttttgtacttttctgtttgtaagttatacttcaatacgaagttcaaaaaatagtactattttgaatttgctaatattttgcatatatacttccacaaccctgtaaagtatagcttaaagagatttcaggaagatgtacctttgtaactaagctagtatttatgaagtttacagcatttattttgcatggttatctgcattcctgtttttagcaagcatttattgaattcccattgtgagcatagtattgctgtagatacaattggttgttcctaccctctggatatttgttaggtgggagattataagttatggacacattcaacaattatataaaaatatcagaaagactgtgattaaaggttaaaattggcagagcaagtattctgtgctatagagtggtggaagaataggaagtcagagcatgttgggcttgagctgggccttgaagaatggatgggatttgaata

SEQ ID NO: 57054 - DNA, 1048 bp, Homo sapiens
cactcacgcctgtaatcccagcactttgggaggccaaggctggcagatcacgaggtcaggagatcgagaccctcctggctaacatggcgaaaccccatctctactaaaaatacaaaaaattagccaggcgtggtggcaggcacctgtagtcccagctgctcaggaggctgaggcaggagaatggcgtgaacccaggaggcggagcttgcagtgagctgagatcacgccacttgcactccagcctgggcgacagaccaagactccatctcaaaaaaaaaaaaaaaaaagagaaagagcctgtgttatgtgagctgaagtcataggttgttttctttccttgggacattttccaagtatgagtgtagaaaatagcttaatagctggcacagatataaattctaagacgtttttctaatgactaagtaaaatgttagattttcattgcacatttgactatagcaagtccgtgtactcagtatatcgttagtgtgatttcagatcttatgaaaaaggcttcacttaataagaacaagcatacagtctggtttccctcactgcaggtatgatccgaaggagaacaagtggactcgggtagcttctatgagtaccagaagactaggtgtggctgtggctgtgttaggagggttcttatatgctgtaggtggctctgacgggacatctcctctcaacacaggttagtccctcccaaaggcaatcaggttccccaaaagcagaacattttcctggagagtcctcctacaaaacgtgtagaaactccaggttatcctataatttactaggaaaatgcctgatttttccctccagcagagtgcagctctcagctcttcctcagctcccactgtagtcatattctaagtacgttccccaaatatttatttcttcccctgctttccaagctgctggaaatttataatgaattttaaaaactactttcttatataattagttccttttcctccatcacaacttctcctcaaaaccacaacgtactctaatccaagaataaataaaaacttagaactacaaa

SEQ ID NO: 57055 - DNA, 1277 bp, Homo sapiens
ggaaagccacaactctcacagagatttaagtgacatgctttggatcctacatatgtctcacagctccatatgactcagtggtcacaaaactaaagtcaggctaataacagcgtgtacgttttgctcctacatcacatttttacagtcctgttcattaagtaaagatttattgatggccaggcacggtggctcatgcctgtaatctcagcactttgggagaccaaggtgggcggatcacctgaggtcaggagttcgagaccagcctggccaacatgatgaaacctcgtctctactaaaaatacaaaaactagccaggcattggggtgggcacctgtaatcccagctacttgggaggctgaggcaggagaatcacttgaacctggggtcagaggttgcagtgagcagagattgggccattgcactgcagcctgggtgacagagcaagactccgtctcaaaaaaaaaaaaagatttactaagtgctccgagccctggggatacaaaactgaacaacaacaacaaaaattcctgccaagcgcacgcctgtaatcccagctactagggaggctgaggcatgagaatctcttgaacccagaaggtggaggttgcagtgagccgagatcacaccactgcactctagcctgagtggaagagcaagactccgtctcaaaacaaaacaaaacaacaaaaaagttccttgccctgctggagctaaccaattgtattgagggagacaaacagtaccataccagtagatggaagtgctgtggcaaatatcaaagcaggggagggggctagggagtacagggaggggaatctgtttttaaaggtgttcagggaaggcctcattggaaaggtagcattttagcaaaacctaaatacggtaaaggataggtaatggcagctttgggcctctcactggcaggatattttcttccatatacagctttctatttttactaggaattttgattaagcataatttctgaagacagccaaatttactgtcacttaatcactataatcttatctgaggacttgtttcttagtaactgtcactaaatagaattagtaatagatgacaaagtaatagtcatgaaattattgaggatcatctgttgaaagattaataactaaatatttgcagttacatatccaagacttaaaaaccaactctacctcatagctgataagggtctagtattcttctccatggaaagtccttaattttgaagatgatcttgtcacaaactagatgctgactttactcaaatctgg

SEQ ID NO: 57056 - DNA, 1381 bp, Homo sapiens
tggggagctttgaccttggagctttgtacagcttgagaaaacattagaacaaattttattatttgccggtgcctcaacaaatggaaatacaatccaatgaaagtacttcacctgcaagatgcacaataattttcaactctgtgcagaagaatatttatttttggttttaatttatcatggttttttgttgttttcgttttgaacttatccttcctcccacaaaaaaagaaaagaagaaaaaattccaagcagcaaaacttactttgtttgtaaggtattcatttaggtttgaaaatactatttaataagggcagaagggctatatatgatttggctattatttctagacactccatccacatgattccactaacaaggattaccaggaataaaggtaggtatgcaaaatgtattagctacccattattctcgcactaaccaccagaagacttgaaaatcttaaaaaaaaaaaacaaaaaaacaagaaaaggcaacatctcattttaaatagtacaattcagaagggatactaaatcaataaaaaccaggactcagacactacagttttcatcagtgtaattttatgtcttgtttctttctatatgaacttgtttatttagtctttttttcataatattctcatagagtttctgctagatctagagctctgctcagtgcctcttataaaaacaatatataagtctcatatgctgtcttgagaatccaagagaatcacatgcagctctgcaacagtttttgctcaaaaatgttactgactaaagcaactgtccttcctgtttccttattgctaccaaggaccagcagggagaaatgtcttctcccagcagtgaattctgttatgcaatttattcttgatgctcaggcctggttaagctgaggcttacctttaataacagcctccaagggaatgaattattcagttaatgtaatagcacacattaaagagtgtaaaatcaattgaggcattttattaatatcttggttcttttatacaaacaatgtatcattatcttcattctataaggtcattgttactacttctctcaaattgcactttctggtaaaaagttaaaaatttttaaggaaaaaataatttcaatggttaaagttttttttcctcattgtattcatagacaaatttttttcaatatattttgcaagaaaaatctttgaataagactaactgcatttaaaaggaataacctccttctccctttccccaactacaaaaatgtttggcaactttgtgtttacatttaaagatcatttgcacctttttcaaggaaaaaaagtattgagtaaacaattgtttacatatatcatttatgcttttttctagcatgtataacttttttaaata

SEQ ID NO: 57057 - DNA, 1004 bp, Homo sapiens
ttagaaagatattggggacttggctgggtgcggtgcagtggctcacgcctgtaatcccagcacttgggaggccaaggcgggcggatcacctgaggtctggagtttgagaccagcctgaccaacatggcgaaaccccgtctctactaaaaatacaaaaaaattagctgggcctggtggcacatgcctgtaatcccagctactcgggaggctgaggcaggagaatcgcttgaatctgggaggcggaggttgcggtgagccgagatcgcaccattgcacgcaagcctgggcaacaagagcgaaactccgtctcaaaaaaaaaaaaaaaaagaaaaaagaaagaaagaaagatactggagacctcaggggtccacagaccatactttgagaaccactcatacagaggcttgatgaaaaaggcttaaaactaagctttttgaaagcaggggctgttcctgtttagaagtccaagggttcactgatctaaattcaccctgaagatatgtgtccttttttcctaggaattcaggcttaaacagtctttctaggataggggtattagtaggttactgttattggaataatcccaaatattttatgatagttcagtgaataaccatcctttcttttttacatttaaaataatctaagttcctaaccttacacagctaaataattgaaagatcaatattaaggacatgtaagacaacttagttgaagagttttgtcatttcttgggaccattcttttcagtcatttccagcagggccctcaaagcaatttacagagccatttctcacaattgggcagacatactcaggtttagtgggtcatttttgcctcctgctgcttctttctctcctcttctgtatttctttccttcttgcatttttttctttgcccatctgtttcctcagttaacataaagtttgaaaggttcgtcccctactccgtcacatcttgttcaggaaagaccccttttacacagtggtcaagaagtattatct

SEQ ID NO: 57058 - DNA, 1087 bp, Homo sapiens
caagattttgccatatatcatgtttccactgtataagaatattgggggccgggcctggtagctcacgcctataatcctagtactttgggtggccgaggtgggcagatcacctgaggtcagaggttggagaccagcctgaccaatacagtgaaaccccatccctactaaaaatacaaaaattagctgggcatggtggtgcatgcctgtaatcccagctacttgggaggctgaggccggagaatcacttgaacccaggaggtggaggttgcagtgagctgagatcacgccaccgcactccagcctgggcgacagagtgagactccatctcaaaaaaaaaaaaggccaattattttgataagccctgttaatcattagggagactattccctctatgtttttttttgcaagtattacattggctcgtcttatttttaatgaactaattttgagaagatggaatttagaagtaaatgtacttttgaatttaaggagcctgtttactttctttgtagattgtgtcaaaatctcaattgccatctgagaatagagaaggtaaagtgctgtggactggctggttctgctgtgtatttggagacagtcttctggagactgtttcagaagatttcacctgtctgcccttattccttgcaaatggagcagagtctaacacagcaataattggaacttggtttcagaaaacctttgactgttatttcagtcctttagcaatcaatgcatttaatctttcctggatggctgccatgtggactgcatgcaaaatggaccattatgtggctactactgaatttctttggtctgtaccctgtagccctcaaagtctggacatttctttcgcaatacatccagaggatgcaaaagctctatgggacagtgtccacaaaacacctggggaggttacccaggaagaagttgacctattcatggattgcctttattcacatttccatagacatttcaaaattcatttatcagccacaagattagttcgtgtttcaacatctgtagcttcagcacatactgatggaaaaataaaggttagtttgaacaatctagttaagtaattttt

SEQ ID NO: 57059 - DNA, 1123 bp, Homo sapiens
aaatggcaattttagttgcttcactgatacggaatcggcgaggcgccaaggaggcttcctgcgtggggccgcagagcgagtcgggaaacgattttaaactgaagaggcggcggagggccgaattcccttttctcaacggcttgatttcagagctgggctggtctctgacaggctcagctggagagggacgggttgggacgcactgtccttttgcccttccccctccgcgagcagaagctgactccgcaggagcgagggtcgcagagctgggtgagcggaaatgtccctcccagagtgaagtcgcagggcccgccccgcgtctgagggagcggaggtcttcctgggtgcgtttgtgtctcttgtgaacccacttgtggagcgagagggaatttgggagggccaggggttagtctggcctctgtcttagctgtcattttggcggttttttttttttttcttcaggggatttcagtctccacatagttttggagccggacttttgaagaatgattcgtgaatccggaatgggtgacagcgtcatcacggcattttattggtaaagatgctttgtattggtcccggacctgctttaactttgtatttgccctgttgtgtggtcattatcttacaatacttgcgtgttgaggtgtgtttaaacactacgtgcttaacactggctaagtattggcattggggcggttggatttaggtattggtggcaatgtagaaaagtgatcaagtcagagccccttcacggactaatcacaagagaaacaacaaagctttacttgtgtgctgtgaaccacaactgcaagtggaattgtcaagagaactagccctgccaagctcaggaaaacttctgaggagatggcacatggaaaatggataagatttactgagacaaacgggagtagagaagtgtttttaattggcgataaggtgaataaaaaggcagggagaacagtagagtgatcatctgtctagagtagggggtgcatgtttgggtatagggctgtcatttaacctcttaaagaattgtctactggaactttcttcactcccatccccccaccccccaatgttgtatacaaaaccttagaggaagtgtatgcagaatgttgga

SEQ ID NO: 57060 - DNA, 1530 bp, Homo sapiens
aaaataaaaaaaaaattagccgggcgtggtggcgggcgcctgtagtccccgctgctggggaggccgaggcaggagaatggcgtgaacctcggaggcggagcttgcagtgagccgagatcgcgccactgcactccagcctgggcgacagagcgagactccatctcaaaaaaaaaaaaaaatcatttttcacagaattataatagtgttttctagtgtacaagtggctgttaaacactagattcatactaaagctaaatagttcctacaccgtccatttctgcagtttctaaaatcctatttcatttgaggaagaaatgtgcaatattaagaattgggtaattaggattttaggtcaatgcaaatgctagaagatcaaaaaaattttgatttcctaacacaagacagaaatttacattcagttattcacttggcttttgacacatttgcaggtaaatttaatagtgaatgaattaaattacatactctgacttattttattttataaatttcccctgtagccctgacatacctaagatatattttgagaattttcatttttaagcaacctgcaagtgatgtatttttaatcttgccttttaaagtttctttttttttttttttttaaagaattcagtagctttgttgtccggaccaacacatgtggagagttgcgttcgtctcacttaggccaagaagtcaccttgtgtggatggattcagtaccgaaggtaaattgagaaagacagtctaagaatgcatggtggtggttttcccagggcaattccaaacctttactaatttacaaccagtccgaagaataaaacgttttgcaactcctgcaggattaagaacttactgaattttcaactttgttttagttttgaaagacccaagtgtcattctcagtagacattttgaaagacccaaatgtcattctcagtaggtacatctcagtaacatctgttgaagggtataacaacgaagcttgatccaccagtggactgaaatgatactgggcttactaagactgaagagttcctataaccagtaattaaaaatgggccagcctcctataaaccagctgttaaactccaatagcatgggggaaaagctcatcttattccatgtaggtagagaagaagcctagaaacataaacagtgattccttaagatcagagcccattttttgttgttgttcatctctctattccagaacatgcctgaatagaacattaattcacatggaagagattcaaaatacataggttatatgaccttcttaaagaatatgtcccagcctggcgtgtaagcctgtaatcccagcactttgggaggccgaggcgggcggatcacgaggttaggagttcgagaccagcccagccaatatgatgaaaccccgtctctactaaaaatacaaaaaaagttcgccaggcggggtgatgctcgtctgtaattctagctactcaggaggctgaggaaggagaattgcttgaacccagaaggcagaggttgcagtgagctgagattgcgc

SEQ ID NO: 57061 - DNA, 1078 bp, Homo sapiens
cagtggctcacacctgtaatcccagcactttgggaggccaaggcgggcagatcacgaggtcaggagttcaagaccagcctggccaacatggcgaaaccccgtctctactaaaaatacaaaaattagcggggcatggtggtggcaggcacctgtaatcccagctactcgggaggctgaggcaggagaatcacttcaacctgggaggaggaggttgcagtgagccgagattgtgccatcgcactccagcctgggtgacaagagcaagattctgtctcaaaaaaaaaaaaaagacatttctaaacattaatagttactcgatttatacagtctatgaaattataaaactacagtttaatttggaaatgcaattaagaattacttggataggaaatgatacacaaaattcattcatctagtaacaaaattggaaattcaattccgcaagcataaacttaacacctaccgtatacaatggtgtttaaagtctactatgtccaagtctttttagggactcaaagataagcaggaaattgtctctgtcattgtaggaactttgttctttagtcattcattgataaactgaagtaacaacttctactagttagttatactttgggtttgtttttgttttttaataatctgtcttctctctctttctctctctttgaaagggtgccaaagagtttttagtaccatccagggaacctggaaagttttattctctccctcagagtcctcaacagtttaagcaacttctgatggttggcggtttagacaggtgagctttttttatgctagcagttgtcagaaaaggaaaagagaaaaacaaagggaaaaaaggaaacacaaaatcctctctgttctcaagagaaggatagaaaatttatgagagtttggagaatacttataaaatgccctcataatttatagtcatcctttattaaaggtttattgggtggccactatgtacaaagctctatggtagtagatgtgagaggggatttaaaaaaaaaaaaaaaagaataggttctactctcaaggtgttaaggctagtaagccagaataggataatgaataa

SEQ ID NO: 57062 - DNA, 1082 bp, Homo sapiens
aatccaggctgtgtcatttcctgcctgctctgtcaagaagttaactcaatgtttacgtcttctgtttgcagtgctctttgttaggaaaattacgactggaatgtgctgaccttctagaaacaagaggagtggtgctccgtgaccccactctgttctctttcctttgggtggtagatttcccactcttcctgcccaaggaggaaaatcccagagagctggaatcggcccaccacccatttactgctccccaccccagtgacatacatctcctgtacactgagcccaaaaaggtaccgtatctatacttccaaatcaaaaggaaatgtgtatataaaggcaaagaacttcagacttcaaggtctgatgaaagataggacccagttctggaagccccagaagaaattgtggagtttgagttagtagtaatacattgtctttaaaaatctacagggtcttcaacccgtagaacagaaaaccagacattttctctaacataaagtatctgtgaatcttctaggcccgtagccaacactatgacttggttttaaatggcaatgaaataggaggtggttcaattcgaattcacaatgcagagctgcagcgttatatcctggcaaccttactaaaggtaacaaacatcatctgctatcctgggcttatttttttaccagaatatttttcagttttgtgttgttgttgttgtttgcttgtttgttttgtttttgagacattctgtcacccaggcaggtgtctactggtgcattcatagctcactgcaatctcagtctcctgtgcttaagccatcctcccacctcagcctcccaagtagctgtgactacaggcacatgccaccatgcccggcaaatttttttatttttttgaagagataagatttccctatgttgctcacactgctctcaaactcctgccctcaagcactcctcctgcctcggcctcccaaagtgctgggattataggcatgaaccactgcatctgacttaaatcagcctattttattaaacatttgttatgattggaggattcacaagatacaaaatagcatcagctatctctctaccttt

SEQ ID NO: 57063 - DNA, 1042 bp, Homo sapiens
gcctcagcctcccgagtggctgcgattacaggcatgcgccaccatgcctggctaatttttgtgtttttagtagagacggtttcactatgttggccaggctggtgttgaactcctgacctcaagtgatccacccacctcaatctcccaaagtgctgggattacaggtgtgagccaccactcccggccaataatatctttaaaactaaaaaaaaaaacagaaaattgataagtaaaatgacttttactattgatatcagttttgtttaatctgaaactataaaatagagatatatctacctatttatggatggataataccatcatctcatatttgtggaatgctttatagtttttcaaagtacttttattcactttatcttccatatatgttatctcctctgattccagcaataacagcccggtgaggtagccagggcaagtatgtattttacacattagcaggaagggaggctaagcgaggtttatgtaacttactcaggctgaaacactgaagaaaaatttgtgactctcatttcagtgatgttttctgcattattaaaaaatattatgctactcctcactatattatgttgatggttgaaatgtcattataaagcttaatttatatgattctcttgatgaggatgatgaagcaaatgctccatcaactcactagtttacaggggcaagcattttcctacatttcacacataatttgattacctctgtcctaagtgaataatctactatctgggtatgagaaacatgatttgaaaacactaaaccactatattatttcaacaaagaaccatctttcacacctaagtaaaaaggaacttcaaaaaaagtcctaaccaaaaaaaatccaaatgatgcatgaaatcaagtcaaaattgggtatcttttatctgtttcttcgttgtggtgaagaatgttgcctggattccttccatctaaagacttgattgttagacctgtggcagaactctagatctgactttagccttggggaagcaaagaggacaaaacctaaaagctcaac

SEQ ID NO: 57064 - DNA, 4813 bp, Homo sapiens
gcggggtgaaggaaagtagctgagcgccccaggagcgcgctgcggcggagggcgggcgaggtgaccccggtgcagggaagtggcactggggtgtggggcccgagtccagtcaaggagcagcacctacctccgggggtggaaatgggccggaatgggccggaacaccgtcccggaagtgaaatcccccaccccctcccacggagcgggcgacgtgccggaaggaaatcactcagccttacaccgcccccccttcccccatccccagagctttccttgcctcgcgccccctcccctctctgctcttcctcctcagtcgggaggagggcgggagcacggcatcacgtggacggtcatgtctctgcccacaatggcgaggaagggcggggaaaaggggcggacttaaggggtgggaagaaggtgatactggatgagaggaagattgagggaggttagggggaggagccgaagcggacgctgccgggagcgtgcgtcgtgacgtcatcaaaagaactcttatatacaggagcccaggcaccatactgtcttttcgaggtaggagtcgactcctgtgaggtatgttttatctttgcgaatgttgcgggttttggggcgctccagcctttgtctgctaaggtcaccctgaattgactgggacttctaagccagtcgcgcgcctttgcagggcctacaagttgaggatggtgggggattgcacatatggtgcatgcgtgacctaagctgcgactatgttagagtagaactgcggagaagcctcggctctcgtgccctgcctctgatgaagcctgtgttggtagggacatctgagagtaatgatgaatgccaaccgctctgatggtggcacatgccgagtcacccgagtaagctattgttaagggccgtgacccgagcctccatcagccgtccgctctcatgaaaggctgtcggtggtagtccacgtgcttaagtgcctgcattccgcagtgtcaccaatatttccattagtgtttcttttttcttttttgagaccgagcctcgttctgtcacccaggctggaatgcagtggctcgacatcggttaatggcaacctccgcgtcccgagttaagcagttctgcctcagcctcccaagtaactgggactacaggcgcgcgccaccatgctaggcttttatatttttagtagagacggggtttcaccatgttggcgagactggtcttgaactcctgacctcaggtgatccaccagccgtggtcccccaacatactgggattacaagccgtgagccaccgcgcccggccgccatcggtggttcttaactgcgggtgcagtgcttctttgtaacattaagtgtatcctttacctgtcgctagataatgaatggtatgttacctgcatcattggtttaaaaagacgaaccgtttttttaaagaacactctttaaaaaaaagaaccgtggaacaatgaattaaaatctgtacctgatctctttaggtatggtgctgggtgcagatgcagtgtggctctggatagcaccttatggacaggtaagaattggggaaagtatggtgggaagaatgaaatctaagaggtggtctcagcctgtgatgctttaagagtagtggacagaagggatttctgaaattctattctgaggctttaatgttaacagcatttatatttaacgtgactgctgtgaggttcattctcactgttttgcttgcatctttttgttttctagttgtgtccccaaggaaggatgagaatagctactgaagtaagttgaaaattccctctcaaaaaggtttaaagccattggatgtgccacaatgatgacagtttatttgctactcttgagtgctagaatgatgaggatcttaaccaccattatcttaactgaggcacccaaaatggtgagttggggaacatagagagtacacctaagttcacatgaagttgtttcttcccaggtcctaaagagcaagcctaactcaagccattggcacacaggtgagacacctctattttgtacttctcacttttaagggattagaaaatagccaaagcaatgatgattatctatgttagtgcttctctcccctcttttcaaatgagaattttgctctcatattgatactaagtttaatactgaagaaaatgtgaaaacagatactatgatggttgcatagttcagcagatttaatcatgaagagatgtactatctgtctgatgtatctggggtagttgtggtttgctgttaatggttaagcagtgtaccaccaatctaccattaaaatattttttgctgacaattttgtattaaaattacaggcattagacagaaagctggaagttgaaatggtaagtgaaactgtatccaagtaagcaggtaactgggcaaacttcctacggcacaaatggctttttagttacctcctagtgctgaatgcattaaataaatggcggattcttgtcttgttatgattaataagaaagtttgtaaatgcagcctggatgatgataagcaaatgctgactgaacatgaaggtcttaattagctctaactgactaaaggcatttgttagttttggcagggggtgaacactcatctgtggctattctaagaccactcttatttcttaggtggagtccaacttgcctggaccagcttaatggttctggtaagtattaatgaaaacagtagatagacttaatgaaaatgctgatggtgatatgcttactgctgagctaatggcttaaggcttggctgatgaatactgactgtattttccttgagcatgtctggaacagtgtttatgtgttttccttgagcatgtttggaacggggtttgtgtaatgatgttgatcaaatgtctgacctgaaatgagcatgtagacaaaggtaacactgaagaaccctgtgacagacaactttgaaaagagtttaatgatgtttagcattttaatggaagtcctcatttgtattccagctcctggtaacgtttttatccatggatgacttgcttgggtaaggacatgaagacagttcctgtcataccttttaaaggtacatgttttattgatgttaacgttaattgattgagctactgttagtgatgattttaaaattaaagcagatgggaatctctctgagaaagaaaatggagattaatcttaaactgaaacagtagttgggaaatcttttagaaatccacctattactacctattggtaaaggagattaaatttctacaggtatggagagtcggcttgactacactgtgtggagcaagttttaaagaagcaaaggtatagcagttccaagtattttttttttttttttagacaagagtctagctcttgcccagaatggagtgcagcggcactatcagttcactgcaacctctgcctcccaggttcaaggaattctcctgcctcagcctcttgagtagctgggattacaggcatgtgacaccatgcctggctaattttgtacagctatgttgtccaggctggtctcgaactcttgacctcaagtgatactgcccgcactgacctcccaaagtgctgggattacaggcgtgagccaccatgccccgcctcaagtctggtttttaagtgttgtaaagccgatacaatgatgataacatagttcagcagactaacgctgatgagcaatattaagtctttcgctcctatctgatgtatctggcggtaacattctagtttatgccccgaaaaggggaatatagccattctataatgtttggagattttggattactcctaattgtatgcaagttgtcttactgtgtattgtcccttaatttcaggactcagaattcatgattgaagaaatgcaggttagtttaaactttgaaggaaatttttaaggtggcaaaaggttttggtggcatatacaccttaatctgtagatgggagtgattagctgtttaaaagttaaaatgtgactgagaaggaaattgagtagggcaaattttaaatgggtattatttttcatcttcaaacaggcagacctgttatcctaaactaggtgagtcagcttttggtacatgtgatgattttcagtgtaaccaatgatgtaatgattctgccaaatgaaatataatgatatcactgtaaaaccgttccattttgattctgaggttactctactaacaagcatcacacatttgtattttgccctgattaatatgttggcttcgctttcagggtttttaatgaccacaacaagcaagcatgcagcttactgcttgaaaggtgaggattggaaatgttgggactattataattgcagaatacatgatgatctcaatccaacttgaactctctcactgattacttgatgacaataaaatatctgatattctgcattcccatgtagcattttaattgaagtctgtaaatgtggctaaaagtcttgtcttattttttgagacagggtcttgcctcacccaagctagagtgcagtggcctttgaagcttactacagcctcaaacttctgggctcaagtgatcctcagcctcccagtggtctttgtagactgcctgatggagtctcatggcacaagaagattaaaacagtgtctccaattttaataaatttttgcaatccatctggagtgtgtagtgtttacttaaaaaaggacagtgcttttcatctgttcattagctgtaagcataaatcacattcaaaagctattataactccatggtatttgcttcattaacactgcagccagttaaaattttatgggtattttacaaggtgtcttatgcattaaagtgcaatatttc

SEQ ID NO: 57065 - DNA, 1052 bp, Homo sapiens
ccttcaccccgcctccaggcaccgggcgaccttccacccccttggcccccggccgggctgatctgccggacccgccccctcgcggggcccctccctcaggaccccgggaagggcggccccctcccccaccgcagccgggacacacccagatacgcacacccacctcctggcagctccccgcccgccgccgcctggagccggtccctgggcgccgcccccttcctagttctcacctgagcgctggctcccccgcccgacgccttgtccccatcttctccgaagttcctcagtgacattttgccctttagccagttcccctctccccaggcttcctaacgcagaagaaagctgctcaagtgctggagtggccaaccccatgccgttcccaattctcccttttacagctctcacccctccagtgccgacggtagcgaaagactttcctccaggggcttcctcactggggaattgccggaaagagcaaacaaaaaaggcgctggtgtaggctccaaaataaacacatctgaattcatgatggcatcgacagaggctcttattggattaaaagtttcaaaacaaacaataacgctttggaaaaaggtcagattggctaaagttgattgttgaaaacagtgtatacacttccctatttaataagtgtgttgttaatgcggggcagtactgtgagcttggcagagtaagttcctgaagtttcaggtgtggtgtaactatgtaatatatagataagtgaacgcacattgggcttaagtaaatgtcttcctgttcggatttatacaaactattttcagtagttgaaactgtactttcaactatcttgtatacagcttcaggtttagtgtttcagccattttttaaaaatattttaatggaaaaatgttggcatacttggtaaatgctgtattttttcatcggatctggagaactaagtttcaggatggaagtattcatcaccacctcggaattgccaacttcgaatttggcagatttacccagctttcctaattttgacaactgaacttcacattctctgc

SEQ ID NO: 57066 - DNA, 1166 bp, Homo sapiens
tactccagcctgggcaacagagcaagactctgtctcaaaaaaaaaaaaaaagtaatatcaatttcaatgcaaagattttttaatctccatgatctatatcaatagtctaaaatacagattattatgggaccttggggaagaaacagccaaaaacctggtaattacgtagaagaaacaaaattataggccccgttttaatttattcttttatggtctcccagtatttatataaggaagaaagcttatatttagctttagcttcaccagctcatatgttctatctgttatgtcattttgtgtttattaaatttactagggctaacctattatttcaaatcagattatgtattaactccacaaaactattcctcagttatttgttgcttggtttgttcccccttcctcagccatagaataaagaggggcgacatcaccatttttcaggttctttgatgctgcttttgtattagtcccctttatgttcctcttccaacagatttagcccctccggcagtgttgttcccttgacagagagacacagagccagaagtgagtctcctgggagaatggatgagcctaagcaacccagctcccaggtatggagttgtggatttagaactgctttggtggttggaggaattgctactgtgtatgaatagaaaataatgaaaaagaaaagatgtaggagaggtaacaatggccctgttaaagaaatactgtattttttttccctgagggtagcagaagtttaatattaaaattatacagagacatcaccagaaaggaaaattgcagactggtatttctaccaagcatagatgcaaatattttgaaaagaacattaacaaattaacactgatagctggtttaacattttaaaattaatcattgtaatctgtttcattaataaggaaaaagtgataaattacatgtggcaattttgataaatacagaaaagaacaattggctaaaactcttagcaaactagaaatacaagggaactggccgggcgcagtggctcgcgcctgtaatcccagcactttgggaggccgaggcaggtggatcacctgaggtccggagttcgagaccagcttgaccaacatggagaaaacccgtctctactaaaaatacaaaattacccaggcatggtggcacgtgcccgtgat

SEQ ID NO: 57067 - DNA, 2203 bp, Homo sapiens
aatagtttatattttcaggcatatagaaggacctcacttaaaactatgtctcgggtctgcaaacctagtaattcataaaccaaccatcagcaaaccatagctggtgactccaagagctttgctttttaataatatactacagggcacttatcagaaaacatcatgcagaatcatgttgcaataaatgatcaaaggatcaattttggtcaggtttggttacttagtcattcctaagatttttaaaacttcaagggacccttttagtaattctgggtatttctaagattcttaatccagcactgagagaaagaacttagcaaacatgtagagctttggataccccgtctttcatgaagtgagagaaggaggaatattaagggatgccggcaaatagatgcttataacttacagtgcaagttgaaaaatctctagcttctgttgacggagcactagttgttggggttcttttaagtatgtaatggtttaagaaattgtttcagtgcagaggcatagatgactgtaaaagagatttggcagagggacaggttgtacctgcactggtgaaccatctgtgagaatgttagtcatgtgctcctttcctgagattgctttgtggtatgtgaaaaggtgggtagaaaagaaagaaatctctttgagataagaaattagaatgcaaagggtagatcttaagcaatctgagaattgtacatgtacataaagctgcaccctctcacaagagaaaggttattttatcttctgaaaaagcatagaaatgcatcttttatgggaagataatgatgctaccatttaataagagcctacccttaaaggcagcattgaaactgtattttgtctttagaagacatagactggtgcatcctccgctttagttagacaacagcatgataaggaaaaaactgtcttctaaagccatctttagggactggctgtgctctgtggcatagaaaaggtaaagttgaattagccaaaaatccttagggaaacaactggtaataaggttttcagtggacagattttgtcattactaaataggcagtgaggtgagaagtacagattatgctgctttggatggagcctttaagcctaccaaaaaacttttaagtccatcctacttttgagaaatagtatgctagaaagttctgtttttctttttcttcttttttatattttttagagactgtgtcttcctcttgtcacccaaaccagagtgcagtggtgcaatcatagctcactgtaatcttgaactcctaggctcaagtgattgacctgcctcagcctccaggtagctaggactataggcatgcaccaccatgtctagctaatttttaaatttttttgtagagacggtgtctctacaaaatttgcctaggttggtcttgaactcctggcctcaagtaatcctaccaccttgacctcccgaagtgctaggattacaggcatgagccagtgaacttggcctggagaaagaattctttgttgctttgttagtttcttagattatatgtgagaaaatggagctttttaaactattaccaaattttaaaggtgaagtgcagtaatttctgtaaagagaaactttgcagcatttgtcaattctccttccagggttagcaacaaacaaatgaggtagggactatctcattcatgtggaaatgctatgaatgtttggtgggtttcccctcccttttcttttcattcactttaaatagccttttcctatattgatactgtgaatagggtgcttcctggtcatctaggaccactttagcacaatcatgtttgctggttctctcaattggcctagccagagccacaaaattcatgaaaatttaaggcaggctagcttttaaacaaattaaaacttctgaaaacaatttcagctttttcgttaaaagagatgttgttattctaaataactgtccaagactcttacccacatacactgtgacattgtcctagttcttagctaacaacacattggtcataggagttactgatgttctatctacattaatgaacagctattggtgtatgcacagaggatacctcttaaggatgtactaaatggactttgtttggttgatgctgaaaattaattaccaaatcttaacttgcacgtgttaccttgtgaagggaactgcattagcaatgagagctacatcatcatgaagtactttaatgc

SEQ ID NO: 57068 - DNA, 1034 bp, Homo sapiens
gtctttggaaattgagctctttatttaggttatatgtgaaagagtttaaaatattgaaatactttggttgctaagcagatttagaaaagcaacaagcaattgtcgggcaaatccctaggtttgagaagatgtcctcagcaaaatatacccttaggacttacggaattagatcagggttcagcaaacagtagtttccaggccaaatgctgaggctacttgcttgtgtaaagaaaattataatggaatagggccacacttacttgtttaggtattgtttatgccttctttctactacaatggcaaagttgagtacttgtgacaaagatcacgtggctacaaagcttgaaaatatttactgtctggtacttgttagaaaaaatttgccaactccaagaaagaattacctcctaaagttgttactcatgacattttgcctttataatagtttggttgaagttttaaattcatgttgtcacatatacatgttttcttgaaagagtttgccaactttttctagatcctcttatcataactctttttgtgctccttcatgatttttttgtgctccttcatgattcccattactttaaaagcatttagaattggcctgttgtttgtccttgtcttaatggtgccggtattttaaagtttagttgtaagtaagttttgccattcctctgagttaacttgaactggtttgcataatggtgacaagaatgaattttttcccaagtggattaaaaactaatttcattatgaagaagtattttgattcatatccaaagtactgtttttctggattagaacccctaccttttccctttgcaatgtatcttaattttaacttctttaaacttactctgttccatgtagagcagtaaaaagccaagtttttcttccttttttcctggatgttttgaaacataatgaaacatctgaggatttcaaattctttttagacctatcttcccatttctgttattgtctataattcttctaaatacatattggaccattaacatgtttgctttgtg

SEQ ID NO: 57069 - DNA, 1139 bp, Homo sapiens
tctaatgtgcagccaaggttgagaatcactccctatgtaatccctagtggtcatggcaggataacctcaatccagtcctctttgacctgaaaatatctttattgatattccatgcatggctctcaattcaaagtgtacagtgggtcaaggcttaggtagtaaaatggatcatccatttgtcctcagaataattctggagggagatattgtcatccatccagtttcctctctataccaaatacaaagtacacataaataagcaaaacaaattttcaaagttccttctctagaatcctctttcttttgcatatgtagtttcagtggagatttctcaactagctgaaatggagcacttgaatatattaaaagagcccaaactgcttacagcaatttctatttgtaaaataaacaggtggcattgttaatggagaaaaggaaggatcctgcctgtggtgatggtaatatgtttgattatttatctcttagcctgtcttctaagtgggatttcagtgtcagttaactttcacttttcttggattgtttttttgtgaatgaaatgaactagttaaggcttaagtatttctgaataatatatgaaatgtgaaatgagtcattttaggatctttcttctgggatgtcaaagacctaaccaagtaactcccaaatgaggttccagattcatttttctcatcccaggtagtaaacgtgttttaatgggtttgtttcttgcccatggcaacctcaacacagaggggagaactgttttattaccctaaaatagtgagaaccactgttcaaactaactagctaccaagtgacttctaactcatgaagaaaatttgtatttaagagcaagttcaaatgtagcaggctctcttctgagagtattctggataccacggaaagtttcatttatatattgcttacaagtacgtggtaatttgaacttcagtaggtgatatgtgcaaggagaaaaagtaggtcaaggagaaagttggttagtgcagaggactgacttagcatcagtctgtgaaatttcattaaagtagcactaaggcctggctgtttgcttagcatgtaaatgctgcagtgtccaagaaaatgcctcctatgccttagaaaatttgctgaaggcttcc

SEQ ID NO: 57070 - DNA, 1458 bp, Homo sapiens
aggctggtctcaaactcctgggctcaagcgatcctcccacctaggactcctaaagttacaggtgtgagccactgtgcttggcctagaactctgtttttggcatttctttctaaatgagtacattggaagaacatttaggtttccaggctcctcataatttctgaatgggacccgctctgctctgcctctgaaaggaggagaaaaggctgagggttcaaagacagaaaagtcaatgtagcagaaatttgatttccttcagatggacatagtctgaaagaaatctatccagctgttctctatggtgcttatatgatgggtgacagctgtccccatctacctgtccctggcactgtgccttcacactggtcactgtgaaaagcagatcacactggactcagaggccagaatccaggacaagatcccccttctcatcttgagcccatcacatctttgtatagctgttaatgtagcatttacttctctatgggaaactcttgggtttttaacccaagaagaaattgtaaagcatttaaactagtcagaaaataagattctgatggtagcgatcaaataaaggaaaatttcacttcctctcagttgatattgattgatagcaaggatcaactatgcccacctcttcctaagtttctaaaggctaccataatatttgtaaacaacaaatttatctaatattttttacaacttgctaatcaaggaggattcatattaaaacagacaatcagtttctaaaatgttatccctgaaagggaatggaatagagtatttttagctgtaagaacctaccagtctgttttttccctttgaaaaaaactaatgtttgagatttgtgtcttttcatctgaagcagttactccattaatagtaaagatgcctcgggaaagtcagtgaaccagaatagtgctcttgcaccactgagggtgctagactggctttgtgcatcttatttcctaagaatatcagtttttattatgaccttaattataaatacctatatataggagtaggattttctctcacccaaccctactttaatcattatcacttaagtgtaaacctccacctccccctctttccctttaccgaaaaaaaatgcactttaattcctaaggagagtggctgttcctggccctgaaaccagattacttcaggaggagagttaaggagggagagctcttaccagaccctgtgaaatgaaccaaatttcttaatgtaaacacacaagtaataacatccacttttaagtggcccccactccatgccaaagggaaaaagaaccgccaaattgaaaaagggttctaaatacctgtcctgattttggaagtttcactggggaaaaactacctaagattattttcacagctaccaatttgtcagaaactttggtggtgttttgtgggaggctgagattttttaaattaaaaatcaagtgaaaacaca

SEQ ID NO: 57071 - DNA, 1115 bp, Homo sapiens
aaggcaagtccccctcagctgccccagcttccagccagccccaggcttgcccaacggaccacgtccgtgaatctgcactgggtgcctgtctttctctcccaggagaagatgggaagatccagtacccacacacagacccccttgtgtacacgcaggaaccataaaccagctggaggcagcccctgccccaccctgtcttatctacaaaaaatattacaagagactttatctcttgatttgcttcatcgagtgtcccaactacctcatttttttaaaatgtgaaattagcttcatttaccttcattgaatccatgttggcgactattaaaaattccaggcaataaaaagggatgagagcctgaactaaagcagtggcaataactggtgaaagagtaaaaaaacagaactgattgactctggggtgaactgattgactctggggtttgactaaatgaggaggagagagggaggaatccagggtgattctcaggtttctgtacgggattcactgagcccactcacaggagcaggcctgtgggggagaattaattaccagttcagtttggtcctgtttccctgaagaacttgtaggagttcctggtggaactgtccagcaaatagtcagtctggagctcagtggaagggttagggctggagctagagatgtaggaatcttcagcacacagatattgccattgtttttgtttgtttgtttgtttgttgttgctgttttgagacacagtctcactttgtcacccaggttggagtgcagtggcacaatctcagctcactgcaaccttcgcctcctgggttcaagtgattcttctgcctcagcctccctagtagcttgggactacaggtgtgcgccaccacacccagctaatttttgtatttttagtagagacagggtttcaccatgttgtccaggctgatctcgaacacccaacctcaagtgatctgcatgcctcagcctcccaaagtgctgggattacaggcgtgagccaccgcacccggccagatattgcctttgctccatccatttcttcttacttctcttgtgttgctgaaatctctctgctgcatctatcagagtccttccccaaacagtttctgta

SEQ ID NO: 57072 - DNA, 1081 bp, Homo sapiens
gagcccatgagatttgagtcaggttgtaagtgaaatcacttacacttttggatagaatttatactcctgctcttataaatcagtggtagacttaccattttttaaagttttcttgcatttttttgtttttttattgccacagctccctattctttcttgcctgcctccacccccctgttcaggaaaaaaaaaaattgagccttaaagtgacagctgattttttaattgctgaattttgtgaaattttactttttccaagtgtttccaactttaaaaagagaagtgaagacaaataggttggaatggtgaagacaaatggattggaatttcacaggctgtgaataattccttaggatctggcaaaccgtgaagtcttatttgaagaccttatctcctgagagttcttttggagtaggaaaaagaaccctatttgaaatagaccgtttttctcttgtttttaatctgtttaatatttctgatttttaagcagctttcaaaacaagtgtggtggaaaaaaagaaatagtagtaggaagatgtttagggcagcagaactctgggtctaaataagtacatgttcccacttgttgccgatttttgagagtactagggccatctttctcaattttgtattatttgtgtgcatgtttatatcaaagatgcccattttgttaaaatgctatttcctttattaccttggaaactgactcagcctcatgttgctcctaattagtgtttaaggctcccatgagttgcagataaaatgatttattttaacaagtagaaggaggtgattcaccttttggattgtaaatatatgaaaatgtctacaaggtctttatctgctttctgtcagcatttatattaaatgataaattaatgaggaacgtgtgtattttgtaaatgagtgtgtgccatcttattctaatcttgagattactttcttacacgtttttaatggagggggcttttttaggtgaaaaataaagaaatggctaatctgcatgagcaaacacatacttggagtagccaattttgtgtggacatcacaggaattagtccaatcttaaataagctacagt

SEQ ID NO: 57073 - DNA, 1395 bp, Homo sapiens
ctactgtcatcattttacctgagtgcccattttgctgatccacattcatacctttctaccttggacagctatgatttttatatttatttgttgcttcagctcaggtttatgaaattttcctgctgaaatgacttattgggagttgtaggttgattatagttactattaaacattttctcaatttagcttttctgagccacttcaagaagaaagctgtttttgtcaaaaggtactattaattgtagcaagtaaatcttaagatttgaatttttaagattttatttctgtgttcactaaagatctttccacaagtaatagattataattgataagtaatactagctatagtgttaataaagagtaagactatcaccaccaggaataagtaacaccttttaataataaatctattcctaataggtatgttttcaatactgcactgaacaaagtgggtaaagagccctttgaaatcttattgtaataaagggacttacctcaccactggaatccttgttttcagagcctctggattttcagccaaacactgaatttctcctaaactttatccctgaaacatccctagagaacgaactttattttcacaagaaaataaggcacaataagggggaagaacttaaacctcaacataatatcgtgtccaaaaatgtgtatttagaaaaataaaatcctgtggagtttgttatcctaatgtttattttatactagataaggtgacttgttttcttgtattgaggtcttactgtttcagatttgtttttgtttctgttctaactctaagcagacagagctcacaagtctttggcatccattttaggttgtacactcagagtcatcttataactggaaactgtcaggtggtcccccaccccagtgagtgtatgaaagagtcaagaaaaagattggaaacaaactattgggtgaataattggttgctctattattattattattattatttgcctttttttaatcaccatttatttgtgtaatctttctccattgattggctgtcattcttataatatctgaactaccccataaaataattctctgacttaaaggcatttagcttttgcttatcgtttttacatcctctattcaactaagacactgtcttgagagttattttttccagatggatcgttggcctaaattttcacacttctcccctgttcatcctttttcctcttccctgcttcctgggaataaaaggaacttttttaaaaaaattaattagtccacaggtctcattatctttctttatgattaatctatgactttttggtacaagaacaatggaaaaagtgaattaaggtaatgaacaaaacctttcacccacttaaacattttccagttttgagattcctcttcgtg

SEQ ID NO: 57074 - DNA, 3425 bp, Homo sapiens
taaaaaacaaggacaatcaactatgttttaaaactgcaacatttgatttgaacttaaaatgaatagagccacattattttaatggatgttttgttttacttgtgaactgattgagtcttaaggatagtttatgaattgatcacttgttgctcagaatcattagtataagtaggtaggaaatagtttgaagtcatttttcatagacttaactgtccaatgttgcaaatgtttcttcatgaaaatattgaaaagagtaaggttttttttttttttaattctgctgcacatattctgatgccatgtgtctgtgcttaattaactaagaccctataaaacgtgtttagtggggactgtttgatatagttgccctctccattcctctatttgcctgatttttttcagtttccctttctgtattttactactaaattagaaagcactggttatgtaataagttactacattgctttggttgagtaaaaacaagagtttatatttttcttgtttcttattttcttaacccttaactcctgctgaggtcataacaacctcagtctaagctctgtgtccatcatactgttaacttaaacaaatgggtggtgggggtgggaagggtaatacagtcctgccattgcctaccagtaggagagtccaaacagaacactcttttgagtagcaattatttaatttgcccagtcaaggcaccgtgtttatatactatttcacattgaatttgattatgccctacagacctggctggtcaaggatttgatatacacatattggcttgggattcgagctttcttttttatttaaataaaaatttatatatatattatatatatacatatatacatagctatatctgtatatatattgggtatgttttaaggattttttcgcatgagcgcagctgttgcgataaattgaccgattgggaggtggtagaagcactgaatgaaggtgaggctttttttttttccagttttcttatacatttgtcttctttttttaaaaaaaaaaaaaaaaatatatatatatatatatatatatatatatatgtatgctttttcttttttttttggcttttgtttgctttttgacttttacttaaaacccttttacatttccactttaaatgcctattgtttattgggagaaggaaagaaacttttgtatgtctgacagagtcccaagatttttcatttctctgcataacagtaaaaggcaacattattggcctccaaccttctttttttttttttttttttttttttggagagggagtctgcttctgttgcccaggctggagtgcagtgggttgatctcggctcgctacaacctccacctcccgggttcaagcgattctcctgcctcagcctcctgagtagctgggactacaggcacgcgccaccacgtccagctaatttttgtactacaaccttcttataagcagatttggactgatcttctcctttgggtatgtcagatcatcctaaattttagaagcagttgattcactttggaattcagaatgattcttgtattagaagataatttgtgggtattaatttttgtttaagtttaaaataaaagtaaagattcattttggatatcagttgaaaccccttagtaactcagtttctgttattcttgttctcatttcctttaaatacacttgttcttggcttttgccattttgattctgtgaagtaggcaggagcagggattaatttatacagtattcctgttctgaacaaaaccagaaaagtcactgtataaacttgacttaaaatagtatctttctcttttcatgtattttcatttgggggaaaaaaaatctctttaattgtaacctgaattcaagctgtacccctccatggtcctacactctagagctaatctggttgggcagaaaggcagaaggatggtatattgtcccattgtgcctataatgtattttaaattggtcattccaccttacctaatggaaattcttgcagctttcctagtgctcatcagcggttttaggaattcactaacacccccaaaatttgttttttgttttttgctttttttccttttccttttctctgtgatatcatgagcctgtaaggacaaatggcatatttgggcataactgcttgactctgtaactacttttttaaaatcaaaattgaaaaggtattaattgcttctggctttttaatttttttttttagagacaaagatgaaaccagataggaaatacagtttttatgttttctacttactaaaatattagtttcttctaaatattactttatttgtatttcactaaattccaaagcaaaaatcagatatctgagatgaacaattttgaatgggttaaggtaggagtaataagcattgtgttcactcatacataggtgagggaattttatttatagcgagaaatataaaagtattttgacttactcttttttcaaggagtcgctaggaaagggtagaagaactgagaataagacatctagattccatttctggtttatatgtagctcttttgcctaatttatatataattttgtcataagataagtccagtaactgtcctgtcttagataacgtacagaggctgaagtgaccaaagatccattccttattacttttctaattaaaagaagagttagctagatttctagtagtagtattctagatattgataagacattattcctaatgccaactacaaatattcaactactcagaatgtatttaaaaaattgtttggtacagcattaatgttggtgattcctttctcccatcttatttcccttcccttctattctttcccatgtatttcttttgcctaaaagaatattggtatgattctcatttgctactttgagtatataactccatcagactttccagagttcttcagggatggagctcaaagtttacatttttccatatatgtctttttttttcttgacctttttccaccctgtaatttccccttgacttacccactgccctccccaatctgcaacagtgacagtttgctgcctcaaaacagagcattcaaatgaattcgcttagccaataacttctgtgaagttgccttttctaatggtgttattactcagtgatgcacaaatgtggtatttgccctactggtaggcaaacaaaggtctggttaagaatggtaacctgctgttttctttaaaggagagccaaagacttgtgctttactctgttttggttttgggggaagtagtagccattttgatcatgaaaccttttagtatttgtgagttgattgtactgtgtaagtagatttatctaaagttaactgttaaagttagctagccttataaaatgtaaaagtaatgaaaattcatcagtttctctaagccagtgaatgtcgtcttttgtaatattgt

SEQ ID NO: 57075 - DNA, 1048 bp, Homo sapiens
tcagcagtgatgtaccaaatggatcagccttgacacaagagaatatcagcctcctatcaaacaagaccagctctctgaacctgtcagaggaccctgagggaggaggggataataatgactcccagagatcaggagttactcccagttctgctccttaaaatatgaggagtcctacttttatcttctgctcctaatcagtttgtcgggcataggggtaggagaacgcataacttctaaactttttctcttaagagcggtcagagaaatccaggaaattcaccagaggcaatgtgcacaaacaccactactaaaaacaaaccctgcacatagttcacattaatgcatttttttaatttaaagaaaaagaaaattagcagtatctgcaagcaattcagattaaatttgtttttgttctgtgaatgaactttattttaataactttggacgccttggatccagggctttaaaaaaaaaagatattatatatacactctgtttgattaattgtatgatcttaatgaagtaggttttcttgtattttggtattacatacccagtgtataatttgtataattcctcacccccaatccttatcaattctcaccaccccataaacttaaaacagaccaaaaatgtcagctttcagagaattctgtggtgcttgagaaacagacagtactagactgagttattagaaaatgtgcagcaaaccaacttttcccagagctgttatttggaattctttatccctttctagatcactagcttcattggatacgtatatttttcttgacattgaagctttttgtttgtttgggagggttttatttcttgtttttattttcaacttttcaaatagaattaccaattttgaagtcctcattttcatattaaggatcatttgcattctcttaatataatcagaaagctgattcagtgtttaattagatttaaatgttgatcaagaattaactgtaacttactagcactgaaaatacatgtttggtgtttcgcctgcgttcagctcatggttggaaatttgaagcag

SEQ ID NO: 57076 - DNA, 2437 bp, Homo sapiens
agcccccaccaccgccacctccaaaatggcctgggatgatctcaagtgagcagttgagcttggaactgcaccaggtggaaagggaaatcgggaagagaacacgggaactgagtatggtgagtgttatggtggggaaagagagggaaggtgaaatgaaatctttcatgtggctctagaattatctagaggcacagaatcatcacttcaaggcactctgatgagtggttaatatttaaaataattctcatgcaggtgggctaccttccgattttatcattcccttcctcattctcttggtttgggtgtgttctttgtcttataattcttcgttaacttttagggaaaacaaggttttaatgcttctgtaatttaagaacttaatggaagtcttaaatttctgtttagcatactgattagggaagcaaataggatggtgtttactattttgcaatgacaacatgttatataaagatgtattcaccaaataacattctagtttcatagcctttataatgatgacctatttttgctatgagtgatatgcaatctgcacattgtttcctgtatccattatgtatgcttaggaaaaactatatccattaatatgcttaggatttgcttcatagtgcacagacattcattttagtaaattttgaatcttaggggcttcctcaggttgcatgatatgattttttttgttgcttagttttcataatctttctttttttttttgaggcggagtctctgtcgcccaggctggagtgcagtggtgcgatctcggctcattgcaagctctgcctcccgggttcacgccattctcctacctcagcctcccaagtagctgggactaggcgcctgccacctcgcctggctaattttttgtatttttagtagagacggggtttcaccgtgttagccaggatggtctcgatctcctgacctcgtgatccgcccgcctcagcctcccaaagtgctgggattacaggtgtgagccaccacgcccagccagttttcataatctttctaagcaaataaattgagcatgcaggttttttttgctttcagtaagtatgttaaagatatttattgtactttggttttcttttcttttttttttttttttttttttgagactgagtctctgtcacccagggtggagggcagtggcccaacctcagctcactgcaacctccgcctcccatgttccagtgattctcctgcctcagtctcccgagtagctgggattacaggtgcctgccaccacaccagggtagtttttgttttgtattttattttttttttagttttttttttttgaggcggagtctcgcactattgcccaggctggtgtgcagtggcacgatctcagctcgctgcaacctctgcctcctgggttcaagtgattcttctgcctcagcctcccaagtagccaggattacaggcacctgccaccacacccagccaattttttttatatttttagtagagacggggtttcgccttgttggccaggctgatctcaaactcctgacctcgggtgatacgcccacctcagcctcccaaagtgctgggattactggtgtgagccaccatgcctagccttttttttttttttttcctttttttgagagggagtctcactctgtcacccaggtggggagtgcagtggtgcaatctcagctcactgcaacctccgtcttctgggttcaagtgattctccccctcagcctcttgagtagctgggattacaggcgtgtgccaccacgcccagctgatttttgtatttttagtagagacggggtttcgccatgttggccaggctggtctcaaactgacctcagcagtccacctgcctcagccccctaaactgctggtattacaggcgtgagccgccatgcctggccgcctttctaggtcattgtttttttctgagaaattttttttcatgttagcttgaggcattgtctgtcttattgtccagcttggttagtgagcaagtggattgtattctgttatgtttttatgtatgtcactcttttagtctgccagtttctttggttattttacaaaattgaatatgatttctggatcatcactttgtattatctgtaatttggtctctcccattaacaccattaaatagatgataactgattttatttccttctctttcaaaggaaaaccagtgttctctggacatgaaaagcaaactgaatacaagtaaacaagcagaaaatggacaaccagaaccacaaaacaaggttccggctgaggaccttacattgacattcaggtaaagaaaaggagattgtcgtagccatattaaattacacacaaaagagaaactaatatattatccagtcatatcagaaataccctcataaatataatttgattcttaaaatatcattattctgtgtacataaagaatattttt

SEQ ID NO: 57077 - DNA, 1048 bp, Homo sapiens
aaaatacaaaaaaaattagctgggcatggtggcgggcgcctgtagtcccagctactcgggaggctgaggcaggagagtggtgtgaacccgggcggcagagtttgcagtgagccgagactgcaccactgcactccagcctgggcaacagagcgagactccgtctcaaaaaaaaaaaaaaaaagaaatcacatccctgatcttccttccacactcataaactttcattgtttgtagaattgcttacggaataaggtttgacactcttgactatggcattcagagccctcttagttttttatcagcctacttttatagatttgctcccaaaattgcttagtaaaccagatcaatgttactagaatatatagtgatttttttccctgactgctgtcctttgatcatcctgagcagtcaaaagagaactttcacaagttcctaaaccatttttgaccccatttctcatctacctaccacttcatttctttttttggcacactcttgaactcaactccagtcaggcatttatctccactgctctatccaaacttattttgtcaaggtcataaattacttccatgtagctaattccaaaagtcagttctcagttcttactgtacttgatttagcagcatttaactttttttttttttttggagatacagtttcactctgtcccccaggctggaggcaatggcaagatctcggttcactgcaacctctgcctggttcaagcaattcttgtcccgagtagctaggattacaggcttgtaccaccacatccagctaatttattattcttattattcttattatttatttttagtatctttagtagaaacagggtttcaccatcttggccaggctgttctcaaactcctgaactcaggtgacccgcctgcctcagcctcccaaagtgctaggattacaggcatgagccaccatgcctggccattgttctgtactctctcttccttgaaatgcttttttcttggcttctaggctactaattctcttctttattggactctcctcagcatcctctgctttc

SEQ ID NO: 57078 - DNA, 1336 bp, Homo sapiens
ggagttcaagaccagcctgaccaacatggagaaatcccgtctctactaaaaatacaaaattagtcaggtgtggtggtgcatgcctgtaatctcagctacttgggaagctgaggcaggacaatcgcttgaacccaggagacggaggttgcaccattgcactccagcctgggcaacaggagcgaaattccgtctcaaaaaaaaaaaaaagacttagataaacttaagagactagggtcctggatggaactttattattaacttcaagtttcctcttaggcaggggactacttcccatctctaaaatgagggaatggaaatagatgttctatcatggctctaattctgtaaaagtgtaaaaagatggattacagtgatacaaatgtggtataaaaagttgtggaataagactggacttgtggttctttttcaacagtttaattgaaaagaaagacactcaatttttttcctttttctttattttcaggttatatttcacactatgtgctgactgtatctacagaagatatttaaaaaaaaaaaagataaactttttttcaaagattttgattccagtggaatctttgctttagatttgtgtgtgtgtttgtgttcgtgaattgtaactccagaagcaatgcctgtacaagctccacaatggacggatttcctctcctgcccaatttgcactcagactttcgacgaaacaattcgaaagcccatcagtttgggttgtggccatactgtctgcaagatgtgcctgaataaactccaccgcaaggcttgcccatttgaccagaccactatcaatacagacattgagctcctccctgtgaactcagcattgctgcagctcgtgggtgctcaggtaggatgggtgacttaatacttttaaatttctccctctctctctctctctctctgtgtgtgtgtgtgtgtgtgtgtgtgtgtgttgtgcgtgtttttctcctgagagaaacctgttgaattaaaattgggtaacattgccttctatttaaataggtataattctgtttggtactgtaaatcctttatttcagcatgttagatttattgtggtagtccagtgctttttagtcatagtacagtaacatccatttaatcttgtcagatattcaataaacctagctatgcagatcgctagagaaacctaaggccgggtgtggtggctcatgcctgtaatcccagcactttgggagggccaaggcgggtggatcatttgaggtcaggtgtttgagaccggcctggccaacatggtgaaatcctgtctctactacaaatacaaaaaaatgagctgggtgtggtggtgtgtgcctgt

SEQ ID NO: 57079 - DNA, 1101 bp, Homo sapiens
tcaaggatgattccccgtacgtgtgtgtgtgtgtgtgtgtgtgtgtgtgtgtgtgataggagtcttgctcttgttgcccaggctggagtgcagtggctcaatctcggctcactgcaacttccacctcctgggttcaaggaattctcctgcctcagcttcctgagtagctgggattacaagcgcccaccaccatgtctggctaatttttgcatttttagtagagacggggtttcaccacgttggccaggctggtctcgaactcctgacctcaggtaatcctccacttcagcctcccaaagtgttgggattacaggcataagccaccacgcctggcagttccccatgcttttatcacagtaattggtatgtcactcagtcactgacaaagagaacaaaaggtttggtggggaggagatgaacatggatgacttagtagtcaactggttatatggccctggcactcagaagagaagtctgaacttgagagagagatttggaagtcagcaggatctagttggtagttgaaaacataaaaacagatgaaattactcagggaaactttctagggaagagaactggggaaggaattctaagaaccaacactattccaaggatgaatagagaagaagaagccctcaatagatatgggcaaggagtggcttgccaatcattggacagtatgttgtatagaacctagaaaagggcagcttttgtaggagtaactttaatattattaaatgctatatagaaagaagtaaaataagaattgagatatgactcttgaatttcataaggttcttaatgtgcttgttaagaattattccacaatagtggtggatggaaacagggacaaggattgaatgacttttttagatgagacaagttggagacaaatttctttcagctcctgaacaaagatttaagcatgccagtggggaaagaactaataatgaaggacaagttgaagaaacagaatattagtgccaccctctaaaatgtcttaatttcatcatattcctgaggattctataggatagtatttaacaacctgaaacataaatttatcaggcacaggttagattttctttccattgtgattat

SEQ ID NO: 57080 - DNA, 1057 bp, Homo sapiens
acaaaaaaattagccgggcatggtggcaggcacctgtaatcccagcaactcaggaggctgaggcagagaattgcttgaacccaggaggcggaggaggttgcagtgagctgaaatcatgccactgcactccagcctgggcgacagagcgagacttgtctcaaaaaaaaaaaaagtgtagtggaaaacttttgaatgaaacagaatcactaaattcttagctttattatagaacagtatttaatttgtccaggtctcagtttagattaagaagtaggccaaaaaaaaaaaaaaggcctataattatcagaaaaattaatgaactaaatcatctgcactaacatattggtttagaagttctcttgctttgtacataattcaaggaatttgattatctattttctcgtcccacagcagattaaaaggtgcaaattagatgttggagtagagccatataggtaggatggagggccagctgggtggcaggaaaaaagtcacattagcctgaggctgtttaaaatagggacagcagttacctatacaacacctcattagactctgagtatatcattaactgttatattgtgctatatataaagtattgctcctgatggaaaattcattgtgggaaaattatgtttgtaattttgggaatcataaacatatatacagtagagtggtgtatattagaatatagacctcgctaaaaaaaatagaacatacactttggagtccagtatatctaggttctcatcttctatgacttaagcattataattcctcatctctaaaaacagaaatggtaatacttttatctaaaggttgtttggaaatgtaaataataatatctttagtatagtacctgacacctttaatgaatgttattttcctccttaaattctgtttaacaaaaattagaaagatattcatccagaatatttttgatcaagttctactgtaaaatgttaatatagaagctacatataaaaccttatatagtttagggttaactgtatgtgtacttttgggagtggtagtcagaaatgaagtaattcttcat

SEQ ID NO: 57081 - DNA, 1052 bp, Homo sapiens
cagggcctgggccaggcggggaatgcgcacgggaactgctttttggacccctagtctgtgggggtgggggagggcgaaggcgtctgtaaacaggcgccgcctcggcctcccagcacctcagggctgcttcctcccccagcccctgaagcgctccccttctttggccaagtggatttcacggtgtctgtttccctgaagtccctggagatctagcctggtagtcttctccctgctggcgatgggaaaattgtgtgtgtgcaggtgtctttaaaaaaaaaaaacaaaaaacttaaatgcaacaaaaacatataaaatgtggttatcggtaaaggatggagtggtaagggatgcgcctctctaaacatctctaagtatcagttctataaacatcagttatgcccgcatcccaggtgagagtggattgaaacaagggctcttttggaacagtaataacacaactcttgacataccagaatagcctatgaaactggaaacaaacactggcaacgcggagacaaactgtaatgtttaaagaggacttttattccagctaggcgttttgaattactaacatgcagtataagaagcaacattaactagcataaagtggacctcaggaagcacttcgaaaggagacaggtggttcatctccggccatagagcttcttgtgccttgtctcgtgtttcagtaatttttcctgaaattgttcaagaccagtcttttctctgagtttgaaatttgatttcgtttttgttttgttttgcgacggagtcttgctctgtcacccaggctggattgcagtggcacaatctcggctcactacagcctccacctcccggattcaagcgattctcctgcctcaccatccggagtagctgggattacaggcgcccgccaccatgcccggctgatttttgtatttttagtagagacggggtttcaccatgttggccaggctggtctggaactcctgacctcaagtcatctgccctcctccgcctcccaaagtgcttggattacaggcgtgagccacctcgctcagccttaaact

SEQ ID NO: 57082 - DNA, 1042 bp, Homo sapiens
agcaagaaaataatctctccacattcagagttaatcttccgaactcagcaactgccagtagaacgcaccccggtcagggcgggctcgcgggcgcggtcccacccccaggcccctccgccgcggaggttctccagcgccgcccgtactcccgcctttcgcgcgtccctgctctaacagctctggttctgtcaggacctcactcctccgctcccggcgcaaccgcggccacgcagcgacgtgcacgcgcgtgtgcgccgccgccgcccggcagagtgggcgcctccgacatcaggagcgcgcacgccgcgcagaggggcctggacgagcgcgcttccgacccgccgccaccgcctcctcccctccttctcggcccgccccctccctcgcctcttcctgccaggcggcccttctcccctcccctctcagttccctccgccctcctcgggctccagcggtggcggagcgaacgggaccggcccggcttcagagcgcgaggtggagggtggaacgcgggcgcctgaaggagttgttgtctcggcagcgcccgcggagacgtgaagaggtgaggcgaggacggcctcctagggacacgagggcggcccggcggcccggatccgcgggccgaggctgcctgggtgtgttggcgtcgggctgagcctggggagggtcgagatggggccccagccgaggactgggatgcgggaggaccgcggtaaggagggtagggggcgggttcaggactgtcggccgcctcccggacaccgcagttctcccaggtggccgctcctcgcggatagggcgggcggggtcggcgcccttacctgggggtggggtagtggctttggcggccgcctcctccagctgtgccctcctgacattgctgcctcggcggctgccgcccgctgctacgctgtggctgctgctggattcgcagtcccagccgccctgcgtccggtgggcgagtggttagggtattttcttacccacacgcaggcttctgtactcgaccatttctctccctcgcccttcctcttcctccgcc

SEQ ID NO: 57083 - DNA, 1135 bp, Homo sapiens
cctgtaatcctagcactttgggaggccaacgcggggggtcacctgtggtcaggagttcaaggctagcctggctaacatggcaaaaccctgtctctacaagaaatacaaaaattagccgggtgtgatggcaggcacctgttatcccaggtacttgggaggctgaagcaggagaatcgcttgaactcgggaggtggaggttgcaatgagccaagatggggccacttcactccagcctgggggaaagagcaaaactctgtttcaaacaaaacaaaacaaaacaaaaaagatagttattttatatatcatatattgtcatagtaaaactatttgttctttttttttaaaaaaaaaaacctaactggaaatatgtctttgttcttcgagaattaatattttatctaacttttcattactgttctacagaattatagaccaatccagcaatgtggagatagcatcttttccaatctataaggtgttattctgtgcacgtggacatgacggaacaacagagagcaattgctttgcatttacagagagttcccatggttcggaagaatttcagatacatgttttctcctgtgaaattaaagaggcagtaagtataatatagtatagcaatttgctatagagatgaattagggtaatatttttgagctctaatttcactgttgtataaatatgttacataaatttggagtatgtttctaaagacaaaattaatatttgtaatgacatagaactgaatgtggaaagccaagtctggtatatctgcataggtagggcactctcacagcttagcagttgtcgtagaaaaatacaactggatgagttgcctttccaccttaccatggtagtaaattgcttatgctcagaagggagactatttttgcagctctcttattattttgccctagtagattggtccatgtgattttaaaaagtgcctataacgatacctgtttctctgatgggcttgatagttgcatattgctttcatttagatattgcattaagattattttatcaatctctgtggttttcattgatgattatttgttttgtgctttcttgctcagaggctatattttgctccagagaactggcttaaataaaattacaaatgctcacttaa

SEQ ID NO: 57084 - DNA, 1057 bp, Homo sapiens
gtgcttgtacaagaaaaagtggcagaatatgtgaataaaacaaaggaaaacagaagacctcatactttaacagactcttctgttatagggagtattcctgtttcaagcaagttacaaatattgtattcctagactaatacagttcaagaagtactttgaattcactttatctaaagtgagggatttattaatgttcacagcattcttcttatctgtacttcccaatgtgacacattgaaaatatttttttaacccttcacatttcaccttgttttctttgtcaacctatgcgtgggctgagagatttggagaatctttggtgcttcaagctcacaagtttgtgatgatctgatgcttcttttggaaccaagaagtagaataacttctggagaagtgttggatttagagtacttcttcactttaaggaaagaatatgagctatacacacaaatacacacacatatgtatatacatatatatgtatatatgtatgtataaaagtagtcactagagtggcctaataccaatagaatagataagaataagaccatttcagcattcattctgggaacccaacacttatagcacaacaacattgagtaaaaatactggtagctctttatgttactgactgtattgctaaagccagtatttgccttattctatggttctgtatctagcccctgaggctgagggaagtgaagagagaacttggagacttggccaaaaccttgtttgtgagagtgtgttgggaagattcagataccaatatcattttagtaaattatcttaggatacattcaatttcttgtatattttgaagcctagaaatatctataaataaatacagtttattttgtgaacttaaattagttcaatatctttatcaccatgtttaaatgtcagagttgtgagaagcaaatatttgaaagatagctttttttttttttaaagtaaaaggaattccttctttctttctttctttcttttttttttttggagacagagtcttgctctgtcacccaggctggagtgcggtggtgcaatggctcactgc

SEQ ID NO: 57085 - DNA, 1154 bp, Homo sapiens
atcctagttgcagctcctaaatcatagttctcttctggtctccagtatgtatgctggtggtgcttagtgttgaactttatctgtatatatttgaaaaccctcctcagatttgaacttaagtttccatgaagtgaaatgtaccccattattaatttcaaagtaaaaaattctgttaatttacttcttaagcgatatttcttcaatatttcccttcttggacttcacattgatgatagtttttaggttgtaataatttagagtttggatggtctacatttaccatctacagttgtttactccctctttttttaatgcacaagtgatgaaaatgttgtcatgtaatatctaaacaatgataaatacttagactatatataaaaatatatattctgccaaagaaaattgtcatggaaaattgtagattcaagagttaggagagaaggatatcagaatgcaattaaaacctttgcctaatggtatttccttttttattcttttaggtaagcagaattttgtacagtttctgtacagcattcaaacgttcttccagacaagtgtctgatgttaaagactcagttattcctacccccgacagtgatgtgtttaccttcagtgtctccttggaggtaaaagaagacgatggaaaaggaaactttaggtgaggcatttggaaagattaaaaattcgcattgtatctggagtataatataggcgcatataaagtttcaagaaactatacagtgttggcataaagcctcaaactgataaatatttggctggtgaattaatattttttattcttgtgcttgtcagatatttctttccttttttttttgagatggagtttcgctcttgtcacccaggctggagtgtgcatgtgcaatggcacgatctcgactcactgccatctctgcctcctgggttccagtgattctcctgcctcggcctcctaagtagctgggattacaggcgcctgccaccatgcctggctcatttttgtatttttaggagagacggggtttcaccccgttggccaggcttgtctcgaactcctgacctcaggtgatctgccttccttggcctcccaaagtgctgggattataagtgtgagccaccgcgcttggtcagatacttattttcttaatgatttaaaa

SEQ ID NO: 57086 - DNA, 1011 bp, Homo sapiens
aaatcctttaaattttcaaaaagaacaaaaagaaagagagtatactttccaaactgttagcattatttcctaaggaggctgacagaagggagaaattattttttctttacatactttggtatttgttaacttattatggtgactatataatgggtttgtaatttaaaccctataatatagaacattgttcttaaaacaaaaaaccattagagatgcaagctgaagcaaagtatgtagggatgtgtgagataaatctgttctcattgacctaattttttagagagtcaaattttatttctaaaaaagaattaaatcttttattcttccttagcaagaatttagggcagtagtataagaaatagtacagtgaattgcatgattgattattatttaatttgtgtagacagtgtttattacaagaattcataggagagagatcatagcagtatataggtgaaattatgaatactagagtataattatttctcttgtagattatattttgttctctgtatttgaaaagttatcctcagagcttaccaactttagctttgctatgtacgtgatcatttttgggtgccagaaggaagccttgaacaagtgatcctcaagaacttataggaagtatacatttactccttactaagcttacatttggacaggaccagtgatcttgctcatgtcagcattagccatgatactaggagagtaaacctttgaaaaacaacaaggatgagaataacggttgagtggttagctgccactattttgaaattgaaaaaatcttatgtttaatatagttatattctttaccctttctataaattgttacatagcatatcttgaagttttgggaaactacaataaaaacattcttgtgtgtgggtatgtgttgttggcagagggaccctgtggacagattacattgcttctcaagttacgagacctataatatagcagtatgaatttgggtaaattgcttaacttctctggactttactttgcttacat

SEQ ID NO: 57087 - DNA, 1599 bp, Homo sapiens
gtttcaagaaaatcctctttgaaagcaaaggaaatccactagatgagtccatgacatttttttgatcctattaaattcagtgagaatgtttgcttctaaaaaagcattcttttttgtttagctttagtaattgacatattaatttcatttcataattatattcattcacttaccaaaaatgtattaaatgccttttatatgtggggcactgtttctaggtgcttaagatatataagtaaagaagacaaagattcttgccattgtggagtttctattcatgcattaaaacctagccaattactgtatgattaatagatatttgatttatgtatgactttaaaaataattgtattaggtatccgtcttgtttctagggtagagttcagcatgtatcataactagttgcctattttcaagttcctgataactgcagttaatgtatcaaagcaatggcaatgtgtaattacattttaatcagaaatattgaaagcaatgattatttttataaatttctcttttatttatttggatcttctctgatcatagatatatactagcagcatctagcttaatatttattagtacttctcaagtgatagggtgctgtatgcagtataattgctgtactgttacttgggataaccagtaaaataaggctgttaatcaagcagtgttatgagtgacccagttctttttaaatgcctgtctctaaagataaatagtgctttgatttttaagagaggagaaaagacattttcattatgcctggccaaacaagtggctgagggtcagctagaaactgaatgtcaattgagttagattatattatggtaaagtattcattggggactgttgactattaatcttaaggagtatgtttatgtacgtgtgtatgcatgtgtaggaagagatattcaaactttaaaatatagttaaatcattatgttattatatatcattatataaaatattacagttaaatcattatgcaaaataatctgggccaaccgagtatttaatcaagctgcttgttactttcattctgcctacaatgttggaaatatgttatagtaggtccagtgaatgttaggaggctattgcagaagtctggggaggataaagttggttgcagttgagatggaagtgcatgaactttgtagaggttgagaaaataagatgtattagacttggtggtggattagtaatagatgatggggcaaaaataattcctaggtttccagtttggatggagtgtggtaacaatttctgaggtggaataccctggaaaacgaccaggttagggagaagaaactgagttcagacttgggcatactgactttgaggtgcctttgagcttctagaacttgggatacatgtttataggtgataatgcctagagacaagagaatgaaagaaaagggcaagagtaaagagagataacttcaagcccttaagaggttaatagaggagaagcaatcaacaatggagtttgtgaaggtggataaagaagtagtgctttgtcactgaagccaagggaaacagattggtccacagtgaaaggagtgaaaatatgtcttgaatccagtggggcatggagag

SEQ ID NO: 57088 - DNA, 1758 bp, Homo sapiens
ggtgtatttaaactaacacctatttactaatttgaaacttgcttttgtcacttggcagcataactgttattttaaggtatggtagcacgttaagtcatataaactctgcctttctctagtttatttttgcttcaagcccatcagtattatcagcttagtttctctaacccaacaatacaaaagcttagctagaaaaggctaaaagaaaccattaaatctgatggtttactaaaattattaatgggatgagtttacttgaacttgtttcagttgtggaagttttagtttttttctgagatagcccaaatatgacagtatggggaaagcaaggaatatattttcagaggaaggtatgccaatactggggtttgagctagaggtagaagagtgtgtataatctagtgaagcaggtgggaggccacttttagaaaatagacatgtggattctatgactttcgaggctcaaaacttgaaaccagagcctggggtgttagatcaaaccagagtacattgtcaaggtttggagtcccagtggttgcaccagagtcagctctaatagataaaaaatgagcaacaaatacaagtaaagtctgagcaaaaaggcatagaatatagttccagattcaagctaggcaccaggaaaaagatgacaaatgaaattgcattcacaatattgagatatgcaattcagtttcttggtcagatgggcatagtagcatatttactatgttgtgatcattgattttaggaggagagatctttgcctttgttctgacgctgcacacctttgggatgtggtaaagcctgataagtatgtgttgcttccccagcaagttggagttgttgtgtaggttctggtgattgtaggaaagggttaggtccttcctttaatgagcacttgctgttgtaacaagtcagggagacaaattcagacatgtaaacaataatgaactcttcttactagaaaacctatcttaggttgttttaacttggaggttcattgatatctaagtttatgcttgaacaaagaattccaagttaggtcatcaagagatagggcttcctggaggacctgggagtcaggatgtggccgccaggtaaaacttgactataatatgtatgccttatgcctcctatactgtggagtctgtctttggcacttggcccagctcagcttggcctcagagaagtgggtatagtcaaggtgtgataggcctatgatccgttttcaacatcatttcctgaaccctatttcctaccacacatcattgtccagcttgctgtacattcatttcagggaatccagatggttctttttatgccttgaaatgttgcctagcaatatataactaacacgttaattattatgagtaagtccataggatgatttttaaaagtaagtgagaagaagaacaagcttttcctggaggtagaattacctggttcaccaataagaagatgagatcaataaaaaaattgaagatataactgagcttaagcagtactattgtttaatgcccccccacaaactgttttctcttgacccaagcttacacttttatataaactagtatacttttcatggcaacagcagttcaggagttgtaaaggaagtgtgaatggattattttcttgtcttctcaggcacagtaaccttggtgcacgaccgaaagggctgtctactctggtgaagagtggtgtccctgaagcattgagggcagaggtatggcagttattggcaggctgccatgacaacca

SEQ ID NO: 57089 - DNA, 1024 bp, Homo sapiens
tgaacatagaatagggccgggattacaatgtggaacaattatactttatatggtcttgttggttttataatctatagaaaataaagttcttcatatcattttgactggtagtaaatgactctagggaccaaagtttaaaaaagggtgaaaatctctggatgagattcaagtgaaaatgaagcaggttaggagctgtagaccaactgataacctcaatctggaaccaaggaccaagcaggaccagtcagaagagctgttatatgtaaatccgtgttgaatcactctccacttcagaaggagctttcaggcacaccttgccttggtaacagtggtagcttcgctttaggaggagattttagtgctcactatgcaggaagaccctgggttcgaatctcaaattctgctacttactggttggtgaccttgggcaagctccttaactatcttcagtctcacttccttttttggtaaaataggcataataatatgtatcttacaggattgttgtgagaatttagtaagataatttatataaagcactcaatgcatgcctaatacatgataagcactcacccgtgatggggaatgaggaaaattataaagcaatatatgcataaatgaagtttgaagtaagctttcggaattaacatcatcagaaagtactataggaaatatggagattactgtgggctcttgaggtccgtgcaggtttcaagacattcatctgagaaatggggagaaagaaaacaggaagtgtgtagcaccctgttatctacttgtaccgctaattcattcattatttatcaaacagtatctcttctgtatcagaggctatgctaagcactagacatgtaaagaagactaatacctataccctatccttgaggagtttacagcccagtgggggaagatagtcaaaaaggcaaagaagcagcgataacatggttaagcactgtgacacaggtatgagcaaagtgacaagtgaggacaaagactggatacagccatttctgcctaggaacag

SEQ ID NO: 57090 - DNA, 1104 bp, Homo sapiens
aatctggaaggcttcttaacttctaatcttaccacattttaaatcctggaacaagccatgctgcttacatataatcctagtagacagcatttgagtgtgtatgtaaatatatataaacaaacgtgtttgtcatgcaagatgaaaatttaaaaatctaaccattactgaattaagtatatcatattgacatttctgttgacttactagtttatttggcttaactaaagtcttagagaattactatataagagagtattttaacttaacaagagtatgtgcattacgtatgtgttatatgtgttgtttcccaggctgctttgtgtttgtaagatgattattatatctaggatttgaggtgtttcttaatttaccaaacgggaattgattataaactaatgagaattttataattgttcttgatgttgtttttgttaattttacctcttctttttttgatgtttgtcctaatacgtatacaccatcacaagtttattagtttctaaaataagcaagtagttggatgaattaggaaggtttttggcattactttcaatggcaaaaaccgcaattacttttgcaccagcctagtaagaactggaaagctactctcagtgaagactggaattttaacttattcttcttatatccttcccacccttctgtccccaaccaccatttattaatggacacataatacgtatactctgagcatatttttatgaagccaatttgaattgtggcccattggggattaatttattctgtgctattgtagtatttcaaatcagttatagttcaaggtgctaaatcttatacaaatgatgctgcattacagtctaatgtttacaaacttcatggcacgcttagccagggaaaacaatcttgcgaatgttgggggtaattgccttttaataggtagatgcagttctactggcttgtttgtttaaacaaaggaagaaacttattaaatgcccaacttatatgtgatgcatctaatggaaacaagacagtatcttgaacaagaacagtgataaagcctagagccatgggttttattcaagttttgtatctctgggcttatatttttaatagtttgttttaaac

SEQ ID NO: 57091 - DNA, 1049 bp, Homo sapiens
tttttttgagacggagtcttgctctgtcacccaggctggagtgcagtggcgtaagctcggctcactgcaagctccacctcctgggttcacgccattctcctgtctcagcctcccgagtagctgggactacaggcgcccgccaccacgcccggctaatttttttgtatttttagtagagatggggtttcaccgtgttcgccaggatggtctcgatctcctgacttcatgatctgccctccttggcctcccaaagtgctgggattacaggtgtgagccaccgcgcctggctggattcaggttttatagggcatgaagcttatataatttggaggcaacagctctttaaggacaagatcccattgtgggtgtgggtgcaaattttacaaaagtatataatgatgtgaatgtgtttctagggacccttctgggacagaatgaagacaagctaagcttcatcttctgctactatcacaaactgagatgacacttcatatttttttttatcttgaagggtagtccactatatttggaaagagcataggcttatgttacaactgggattcaaaaatgggccttctccatcttctttgctaccgttagagtcttacgtacatctttttcctaggcaacaacagctttcaaaatggtattcacatttccatctttgtttttttacacactccttccctatagcctgttctctacagtgcagctgaagaaccctttttaaaaatgtttcagtgacatattcaggatatagaataaaatccagaatttttaaactattttcagtgttcttcattcattcccaaaatctaagtttctctctgctgtcatttctcttgagcctgaaataatttttttagcacttcttatggttcaggtctgttggtgaaaacttctcttagatttcctttatttgaacattctctattttgcctttattctttattcttgcagggtgttttcactggactactgagttgacagtttttgctttcagcattttgaaaatgttccactgccctctggtcttcatactgcctgat

SEQ ID NO: 57092 - DNA, 1046 bp, Homo sapiens
tttagagatgaattcaacaatatacaatatacatttattattagctcaccaatatttttactttgtgtctttagactgcatctgatgtcgtaggaagcactcaacactttattgaatcaacaaataatgaatgtaaaaaatatcttttggcagcatctgatgtcctttggacttttgcttctttattctgttctggaaaatgtactatgaataaaactgctttttctctaatctcaaatgaactgcataatatttccaaaatgccgtatacctgcattttgaattatgagtcaactgataaaaaaatttaaaagacttctgggccaaaagggctatttacatgctaagtaatatgccttgggatgaaaacacattataaatatttatatttaaccaattttctctaaacccttttggaggtcttttgaagatttctttgtttgctccttcctagttcgctttctccctcccttttttcctccctttcttatagggaatgctattctgtaaaagctatattctatcttctgccaaaccctcaaatctaattttggaacaacttctgtaggtaatttaagtacagaagatagatttaatgttcattttacttttgatttatatatgacatctgtttggaaccaaactttctctgtttttagaaacagagaaaaaaaatattttgggatatgtaggccagaggcaaatgatctgacaagttagcccccttgtttctaaaggaaaaattgccacagtttataagagtggtataaaggccaagaagttgaccaagaccaaaggagatcacaaagaaagcatagcatatagtagactttcaagaaagaagtttactgaatgatgaaggaaaatatgtgtctatggtttttatggcctacctagcatataggatatatcttctttttttccgacccactaccaaagaagagttataaaattcctgtcttcagtcgtgttgacctaaaataagatgtactgtggtatgacaataccaacctttatgtgccttattttcagactttgtgccttta

SEQ ID NO: 57093 - DNA, 1050 bp, Homo sapiens
atgtagggttgtctaaagccacattgttgaatatgtgtagaatgatgaaagatataagtgatataaaaaataattaaactcatgattaagattttgttttttgttttttaacttggactgcagagacatctcataaagacaagagcatgagtatttcaagttttcttttgaaaactgagtcatagatgttgcatttcaagccaaggtttgatcattctatacttcatggctttttaaaattctagttgctataacaactttgatatttctttattatttttagcacttcagttgccataacaataagatatcctaaaaaatagcaattttcttttataagagaaaattttcttttaattaaaaatgaatgtgaaccaacacttcttacctataatgtgaacccattatttaaaatgggtctgtgctcttctgttttcatacaattttagcagacttttgtaggaaatatcttaaggttcaacttttctctctctgtttttactgtacaaaagttgaagggatacagctgttttgaaccctttctatgagataattctaatttttatgggatttcattgatataaaaatgaaatgatataaaaaatttaatttccagatttgttagtttataaagcaggaaaagatcgtgattaatggatagttgtaagccatgggaaatgtaagaaacgttgaaatttccttttctcctgtgttatttttaagtgtattttcatacctgttgccatactaaaacaggtacctcctcacttatctggaaataactgacagcttaagcctgagctatggcactttactcatagagcagttacctttatttgctctttgagaaaaaattcttataagcttagtttctgatacagaagcctctagaaaataaggacagcaaattagaacaggaaggaggggctatgctgtgtttgctatgcacatagattcataaaatatagagttatgtattatttttaaggtacctaattcttatggaaatcaaacaaatccagcagctacaaaggtatgattgtatcagaa

SEQ ID NO: 57094 - DNA, 1426 bp, Homo sapiens
tgaagacttggcaaatttttaataattaataagttttttctgccaatgagcattagattactgctgactttttagtgtcatagtaccttgtggtagtttctttacagggtttacaggagtatggcagtttattttttctgtcttgtccatacgaaataatctttacaaatgctataaggagaataccttgagaagttcataaatgccttaatatattataaagatcggtcagttccattgtcttcttttgtcagtcttgatcggagcttgccgagtaagtctataagcctgcatgtgcctggcaactgttacctagtgacagtttcagctgcagtagccattggctgtgctgttgattggggcaggagggccgagtcacctttctgatggtgagtttttctgcatcagcccaggatgaggaggaggagtagggcttgggctcaggtggagtcattgatgctgagagattgtgaagaatatactgacagcatccttgtagctgcatcacagtaaatcggacttctgaatcaagcagcccagcctagcagctgataagagtgaatgtaggtgagaagcattaccttattcctgtaacaagagaactgttttgtgataagtgaaactaggaatgtagaagaagaaatatcctatggctattataaaagaagaaggacttgcctgaatgacttggtggtgcaccagaaaataactttcagaagaatgctttctgttaagctgctgcattgttcctggaggaaatgttatttctaatgcatgttatttcttcaaaagataggataacaaagaatgacaggagactctctgaaatgacttcacttttaaaaaatactttggcaaatgttaacctgatatcaaaatgaccttggaagcattttggatggattctatcctggcagccttgcaatgtttcaaactctaggatttaaagttcatcttgatactttagaggtattttaaaataagactatcttgcaacctacctaatggcccctgtgttaattgagcacttgctcaaaatagagtacagaaaaatagaagaggcattttttaacatatggctgctacataactgcaaatgtaataaacaaggtaattttccactttcagaagatatagttgaagtaatgatttaatgtgttaaatcatctactgaaaatagaaaaggtatagcaacatagaacatgaagcctattagaaatacctaagtaataaataatggcagcatttctggtcaaataagctcggagtatattggaaagttttattgtctaactttatatttacatatatatgtgagatatgggtatacagttgcaaaggtgagaaataactgtgagctacatattttattatcatgctccattataaggaaggtggtatatgaaataacaaatgttattttaag

SEQ ID NO: 57095 - DNA, 1023 bp, Homo sapiens
aagttctttgagggcaccagaggaaactaattagtgacctcttttcacctcctttctagcttatccccttctctccaccccttaccgccccccccccacccccccgcccgaaagctgaggtgtgtcactgctgaactgaggctggtgaagagacttgagcactctctgggactctcagctgtgacagaagcactgacactgtctactgaagcaggttctgaaacactcatgtgcggtgtttaacagatgctgggcagggcatctgcttgctgtagccaagtctgcaggtgtctttaaatttccaagccatgaatgaatccaggtggactgaatggaggatcctgaacatgagcagtggcattgtgaatgtgtccgagcgtcactcctgcccacttggatttggccactacagtgtggtggatgtctgcatcttcgagacagtggttattgtgttgctgacatttctgatcattgctgggaatctaacagttatctttgtctttcattgtgctccactgttacatcattatactaccagctatttcattcagacgatggcatatgctgatcttttcgttggagttagctgcttggttcctactctgtcacttctccactactccacaggtgtccacgagtcattgacttgccaggtttttggatatatcatctcagttctaaaaagtgtttctatggcatgtcttgcttgcatcagtgtggatcgttatcttgcaataaccaagcctctttcctacaatcaactggtcaccccttgtcgcttgagaatttgcattattttgatctggatctactcctgcctaattttcttgccttccttttttggctgggggaaacctggttaccatggtgacatttttgaatggtgtgccacgtcttggctcaccagtgcctattttactggctttattgtttgtttactttatgctcctgctgcctttgttgtctgcttcacttacttccacattttcaaaatttgccgtcagcacaccaaagagataaatg

SEQ ID NO: 57096 - DNA, 1049 bp, Homo sapiens
aattatatgccaggctcactgttcacttttacatgtgttataccttaaatcctcactacagccttttgagataatagttattatttccactccagagataaggaaacgaaagaaaaatgattattcgtcagttaactagtcaatggcagaggttcccgcccatccagtaggcctgggccaaagcctgcctgcttcaccggtaggctgcgctgctttcatttcaaaagcctttaaatttttgtacctctgtctgtaccttttccctacaatatttctctgagttttatttatttttttctcatcgtaagtcttttgcttgagttcttttcttgtcttgtgatatctttttctttgatcttaaaagtttcttttattaaaacagcaatctgataagctcaaacttaccagtttagtctataatcaaactgaaattgttgatattactttggtttacttttgttatttcccttgaatacctttttgaaatctctatcaatttctttttggaaaaaaattgttttgaagaggaagagtgaaaagaaaggctttatcataggctgaaagaggctgaatgaggcaaattctgagtttatttatttactatagtattttatatacaactctaggacaaaccacttaacttccttttatcatattttaatgtgtttgtataataagctaatccttattttgaaacctctctttttaggtaatgtgttttaagaataggaagcataaccatttttctcatcattatattgtattttgtggtaattatccagtttggctataaaagacagccaaaaaacaatgcattctgtattctttttcctaagggttctattatttgcatagttgtttctagagttatagagtgttggaaagcttcataattgacactattagtatatgaaacttgggctgagatccaggccctcataaactgcttggccttgggtaagataccaaatgctccaaaaccttagttttggcattgattaaaaaatcttaagtcagagacttgtagctctctgtttagctgaatttga

SEQ ID NO: 57097 - DNA, 1040 bp, Homo sapiens
agccaccatgcccggcctattgagcgtcttttgtgtgcaagtcattgtttaggtatttggaatctggtgaacaggaatgataaactcttttctcatagagcttacatccaaatagagataaaaagtattctatattaagatgccagcaagtaaaaaaaaataagataatttcagattatgattaatgccatgaaaagaatagaacaggacatcaggatggagaagtgatagagatgggaggcagcttctccatgaactttggtttacaaatatctcatcattttggttgccttccaccacaacaacatgcatggacttggcacttttaacatatgatcttatggtgaaagacttctgatctgctaatgtcctctgtgtacatagggaagtatggagcttcttagttatgtgggagatgaagctgtctgaactacatcagtgagggaactattaaagaaggagacacaaaaatttagaccttttgcagttatcgttagccgcagtattctcttgctcagtgtgctcttcttacagtgggatgagtagttgccatatttggacaatgtgcttcccttagtgcagctccacatgtaatcagctgttccaacaacaggtcaccttagctttgtagtgaacttatttaggtctagatctcacctgtttggaacttggaaaatcagtttattgaacatagttgcagggctttgcagttattccttacttactcagcacttccttctactttaatgtgatctttttctaatgtttttaatagatttagaaagcttatgttccttgttgtctttaaagttagcaaaaatgatgtatacagaagagtacctaggcaaaacttagtaaaaagctttcttctaaattgatttttctttatttaattagcacattttgagtaaggccataggtctacctcaaactgtacctgaacctgttaatatctagttcccattttttccccttttgtttcaaatattttataaaatgtttgctaaagacagtgaagcataggctgggcatggtggctc

SEQ ID NO: 57098 - DNA, 1221 bp, Homo sapiens
accactgcactacagcctaggcaacagagcaagacattatacccccaaaaataaataaataaaatttgagcctagtagttgttgtcatttgccacttttctagactaaatcattattataagctataccatattactgacatgttttgattaatgtaacaaatgcttttccagcttaacatttttcacagcttattttgatatggaatttctcttaatgttatagtaacatctaaaaatagttttatttagataaatttctttaaaatgtatagtacaaataacatctttgttagatctgtaactaagaggcaataaatttgaagcacactccatatgagaaattgtaaagccaaactaacaaaatcgtgattactttgggatgacacagtgtcatgaaagtcaagaggagagtatcatgaagactgaaaagtgatagcactgaatgctgctgttcttttaaagatgaaggttcagctatcagagcaggaacctaagggcaaaatctgaaattaataaatcaagaaatagcaatataagcatatggctatttaggaataattattactattagataagaagttgcttctggaaagaggactcatgacaacaatggaatcatgggctgttttgtgatactggatttttaaatcatgaagcatgtgttatattttaagccaaaaaaaaaaaaaaaaaaaaaaactggggagggatcttcgtgttggtaggattcgttttccacctttaaaaatttaggtaaggaaagtgggatagaagccagactttaaggagacaagaaatggaaaggaagtagaacagcagccatagactagttcctcaagaagcttgacctgaaagagttatgtatcagttaaagaccatgagatagaggagggtaatctgctgtaagttataacttacacagtttgctgatttttatcatgaattaaaaatatgtacttgtttaaacgttgcactgccatttaccatttgctaagtagatgcataagaacattgaggccaaaattacagtcccaggagcctcagtttcactgtggagttttccctcagcaaatgtttgcttttgcttgtccttttttcttagctaaccttggtttctagatcaagatgattttccttctttgttttcacacagcatattcaattgcaccacactctttttaatcacaattctttctgatgggtttttgattggatccaa

SEQ ID NO: 57099 - DNA, 1080 bp, Homo sapiens
caccatcatccaattcttgctcctcctgttcctgaaagaaagtttagccaggcagggtggcgggcacctgtactactatggagagaggtgtagagtggtgctacctgagagcataacactaatgatctgccatcgtgtgaattttccatatttttctgcattgtttgtggtcattgtggaaaagtatgattctgatgcatgtatcaagatcttttaaagaacacaaaaaagttataatttttttcaactctaaaatcttccagtgaaactaacttttaaggaagatcttccatgagtatcaagtggcttcacataccctatgcaagagtattgttcaataagggctcacccagttagttactctcttccttagtccaccttttaaaaatgctgccagatgaatctccttgaagcttacattgttatgtaatttccttattttctttagaaacaaattcagaactccttagcttacctggtaatgctctctacaatctgccctgaacctccctttccaatcttagacctcatttctctcgtcatacgtgctgtggtacaacaatctctgaaccctgctttgggaaaaccatttctttgcttatgttggtacttccatttctctttgctgtgaacatttgaactatttccaaagtccagatcaaatgcctagtccctcttaggctttctcctgcttttcaacctaggagtagtaatttttctcttttttggtttctttgtaaatctcttctaaattttattagtatttaacccttcccttatagttctttacacatctttttgttctctgccagaatataaactacgtaagaataatcttttacatgtttccaaacccaacattgtctactctgtatcctgtatagtttgtgccctgtaaatgtctactgaattgaacttaaactttgaagtataaccctatagacataccactaatctagggacgtttgtatactctttcaatgctaccatgtactctttgaactgcatcttgacatttaatttttctatgacttagttttttttaacccacaaggtggttataatgatatttcactgtgc

SEQ ID NO: 57100 - DNA, 1149 bp, Homo sapiens
aatttagtggccgatacttgaaattgtataggtagataggatacagcatatgttattttcagtgtatctaaaaccatgaacttgggtcctgtgtgagtgcaaagtggatactgaaaactagtttaatttcctcagattcatctgataggttatatcctactcaaaaatgacaggaaagccaaaggctactatgttagccatttctgctgactcttattggtatcctgtaccctatacttcttaaacagattacattttttcagtatactagtagatctcaaaaggagatagaagaagcagggttatttctccagggtagagtattgttttgactatttcaattttttcttaatgtaaattatagaaagtaaactcaacaaaattttctttcagaggatgggaaagtggtggctgtaggtacttgaaagataacataagaaagcattaaagggggagactggattttaaacattggaatgcaatcctatttagatattgtaacatagcattcttgtaaagagaaaagccactgcaagtctctacaaagttggccaccattccaggctaaattttagaagtatgtagagatgaagtaaaaatctgagacttttagtaatagctcttgagatctcaagaaatggaacaagctgaagaagtaaaactattgaaaagccaagccaacttgttgctgaattccctaaaccaagaataatttcagaagcttaatttttttcctacaaatagtatagaagaattaacattaccattaaataggggttgagcactataccagtctgaaacccttgagattaaaactagctagaagacaagctgcagaagacaagacagtttataatcccttccttcagcctcacccaaggttttggaaataatcttatgacagctgagagtaagccaggtgcagtggcattccctgtagatccagctacttggggggctgaggtgggagcattgcttgagcccatgagttgaaggctgcagtgcactgtgatcatactgtaaatagctactacacttcagcttgggcatcatagtgaaaccccatctctaacaataataataacattttaaaataaattattaaaatttcacatttagaattatttttctactacagtaattggtacc

SEQ ID NO: 57101 - DNA, 1108 bp, Homo sapiens
tatactctgaaagtatcattttactaatatgtttttgaaataggtactatattttctattgctcatattatcataagtcttagaactttatctattcaaggtaataaaaatttcaactttggtctgcccagactgtagaaaaccaagcattgacacacacataaaaatatgtatatacacatacagaacatttactttatcaaaaagaagagtgcatagggacttcagatcactgtattgtgaagggacttatccgcatctttgataatttaggatagagtatcttaaaataacctttttatgttctagacaccaaactgtgctggactggtaacatattaagaatatgcttaaaacattctctcaatggaaatattacctttttaaaatattttaaatttcaagacggtagaagtccattttcttgtactgttgagtgagattgaaaataagactagagaattgagtggaagaaataatttcatttgagccattccatttcacgtctttcctaaatggtcagttcttttggttctggttctattgaagtcctcatgatgagaaacagggttagtaaagccaaaagcatgacctgggaacaataatgggttattgattctgccagaagtccacctaccagtggccctggcactgtgagaatagagcaggcacatgtatccaaaaaagttcccttttggccgagtgtggtggctcacgcctgtaatctcagcactttgggaggcctaggagggcagatcatgaggtcaggagttcgagaccagcctggccaacatggtgaaaccctgtgtctactaaaaatagaaaaaattagccaggcgtgttggcacatgcctgtaatcccagctacttggggggctgaggcaggcaattgcttcagcccgggaggcagaggttgcagtgagctgagaccacgccactgcactctagcctgggcaacagggcgagactctgtctcagaaaaaaaaaaaaaaagtttccttttatgaaagctgtatttcagtattgacaattgcagttcccttttgggtttctgtgtcaagaagacttttttttctaccacgtttcctcatcctgcagactgcactaa

SEQ ID NO: 57102 - DNA, 1062 bp, Homo sapiens
agatagaggtcacatttagtgagggattcgtggtttaatagattggaagaagggattattagatgggatgggtttggtggaatatgtgagttttctaaagtcattaggtgttttatgcatgagaacataaaagagctggggctggaatcaattttattctaatctaacagatgtcttctactcttaagacacctgtgtaatgaaacgtggctttccccatatctccctactttcactccacttaattaatatacgtggctgtacattgacatactatatcatctattcctaatagaggggttttgcttccttagattttaattatcaataacttcattgcagtattctctgctttcttggtttccagctaattgccccacttgttttttgtttgactagttactttcttcttcatttatgacccctgtctgtagcttatcttggcttctactttctcttatgttctcccctgaattcctttacgtatgttaatattaagctgattgtcataatatttataaggttttcactgtctggacttgacgcagtttggaattttcctagcacatctgaagttaaattttaaataccaaacaaagttgtgctggtttgtatagcttaaacaccagcattttaaataaatgcaaaatgcaataaatgttttcagacaggtaattgttgatttgttgtataacattgtattaataatttctcattcctgattaggttaaatttctttacaattcattccaaaaaatacaaagatatctcagtgatacttacagttggtgaatcctttacatttttttttttttttttttgagacaggttctggttctgttacccagtctggagtgcagtggcaataccttgctcactgcagccttgacctcccggcctcaagtgatattcccacctcagttcctcaagtagctgggaccacaggcacatacatgccaccacatccagctaatttttgtagaaattaggttttaccacgttgcccaggctaatactttactttttattgagtcttttttctgtggtgtcaagcttttggta

SEQ ID NO: 57103 - DNA, 1070 bp, Homo sapiens
tttactatgtgtcaggtgctatgattggtatagataatatctaatcttaaaacaattttgaaaattagaattagcatcacaattgtggtgggttagtaggggaaatgaagaaaacaaagcttggcgacattgagtaacttgtctaagagtatacagtgtgtaggtggctttaaaacccgagtttttttcacttccataagctttctgaaacaggcattccattatgaagggtcagcctcagtgcttgtccctattgtgcctaaagaagattgagaaacatggggtggggcggggaagtcccaaaatcatcttggatagcctaagcctttatgcattctcactgcttaaatggagaactctggcaatgtcaacataatcagatcactgccatctcaatacaggattaaataaaattgctctcatattttttggcagtctgtgggtaaaaattatctctgagatctgtacaatcatatgtggagttcatttaagccaaagtctataaagaatgtttaagaccatgcccctgtttgtgctttttactggtgtttctctattagcctggagtgataggatcagtccttgttaattataactgatagggaaacatggctaagaaatatcattcttgggtcaggcacagtgtctcatgcctgcaatcctggtgctttgggaggccaaggcaggaggattgcttgacttcaggagtttaagactagcctgggcaacatagcaagactccatctcaacagtgacatttaaaaattagctaggtgacagagtgagcttctgtgtcaaaaaatatatatatcattcttggtgatgggcttggccactttgtaagaaaccttggtatctcagatgatagatagaagaagcaaaaccgtgagcatttttctctgtaatgtttagttgtgaggccaataaacttaacactcttggaggcaggttttaagaacttcttttctatcattttcttcttccctgtttttactcccctactcaaaagatgtatgtgtatgtgtttttttttttaatccctcctacagagagaaaagcttgtggcaaag

SEQ ID NO: 57104 - DNA, 1033 bp, Homo sapiens
tcagaattaggagctaaaactttattcaaagtcaccatgttgtaatcacaatattcacaaagcatatgtggttatttgtaccaaaaactctacctgattatccaaattggtgtagtgaacagttccaactccgctattttatagggcaatactctttgaaagtataaaccaaattcacatcttcaagttctagaatattaaaataagtgaatgctaaaagttttgataaatattcatagacttttatatactgagctgagtttagtatttcatggtatttcataaaaataggaaagtgggggtatgacattttaacagtttttgagttatatatagtatgagcttgcaaatatttgttattgcttcacaatttttgcagaaagagattaatttcatactagattggttctatagtgttcattgtagaaaagggaataaaattaatgtgcttaatcataaccaactaaatgtgatttctcaatcacttttcctagagtggtatctctgcccttcagttcactgggatggtgactttctaaagtgtctgcccgaatgttggcacccgtggcatcggaacattgtccatgggttttctggaacctagattcaaattttatcttgaagatacatgaatttctaatgtcagttaagaaaactagcaacatttgtgctacagaaaagataaataaatttattagccttcccgtcacttgtcaactgtgacttacaatcagtgtttgaaaggtcataatgttcattaatattaataagaacatcatagatattacctttcctccccttaaacctgtactctatagctgtttaaggaagttggaaaacttttcaaaacatagattgtaatcatagcatcatgatgttcggggaagtaaatggtaacatcctttaccattaaaattgcttttcagaataatctattggaaacaatattgtagtgtgcctcaggatatttattctttccactaactcatctttgtcaagaattattttacaaaggaaatttttgaataaactt

SEQ ID NO: 57105 - DNA, 1004 bp, Homo sapiens
aaataactataataaaatggaaaatatataattaagctagaggaaaggaagggtgggagtcatcctttttttttggtatatgttagtaaattaatagtaaaaataagggaggacttagccataagggttttaaaacagcatgtctcaatttgtatacaaggctactatgttggtctgtgaaatacgtaaaaaaaaaaaaaaaaaaaaaaaaaaagcgattgattttcagtgctgcaatcctgacctctagtggacattcagaacaaaacccaaacatcacattcttttatttagttactccatcaagcaccattagccaacctaaaatattaaactttcaaagagattaaaacatgagaagcagaataaagtaaaagaatttttggctaatattctaaatattcttgctgtagaacctgtatttaagagcagctagtattaacttatttctttttgcgtgttaattatctgtcactttcactactttctttgaaacaatgcattgctttatagatcatagcagcaagaaatttatcagagaagccaaatggattttcttttgattacctgtaatatataacaagctatacgaaaactgagtggctttaaaaggacaatgatttttatagtgagacatatagtgatgttatgtaacctcctgatagaatgcactgagaagggcacagcatcacttctgtggtatttgtgcccaaaatacatattctgaatttaatcataaggaaccagtagacatatcgagttgagggacattttataaaataactggccaatactcttccaaagcatcaaggtcatgaaaaataaacactgaaaacggtcccatatgaaaggagactaaggagacatgacaaccaaattcaatatataatccagaattgcatcctggaccagaaaaagggcattagtggagcatttgataaaaataatagtttcttggttttgatcattatactatggttatgtaagatgttaatgtttgggta

SEQ ID NO: 57106 - DNA, 1087 bp, Homo sapiens
cataaaagaaataatacaaattttttactgcccttcattagataaagatagtaagagagaaggcctctgggccgggcacggtggctaatgcctgtaatcctagcactttgggaggccaaggtgggtagatcacctgaggtcaggagttcgagaccagcctgaccaacatggtgaaaccccgtctctactaaaaatacaaaattagccaggcatgatggctggctatttttgaatgccagtaatcctagctactcagtaggcggagtcaggagaatcgcttgaacccaggaggcagaggttgcagtgagccaagattgcgctattgcactctagcctgggcgacaaaagtgaaaaaaaaaaagaaaagagaaagcctctgtgagcaaaatgacattggaattgaatgatgcagtagagctagccatatgaagattggcggcaaaaacggtgcagaggcccttctgaaattctgctgcatctatttgaagccatgagtgtgtgtgtgtgtgtgtgggcagggggcggggggtatgtgtttatgtatggtgggagagctagagtgggaggaggctgtgcaatctattaccacctttgtttcacaacatggacttgtccatttcaagaaaaaaaaaatgaggctgagcgtggtggcttacacctgtaatcccagcactttgggaggctgaggtgggtggatcacttgaggtcaggagttcgagaccagcctggccaacatggtgaaaccccgtctctactaaaaatacaaaaattagcctggcgtgctggcacgtgcctgtaatctcagctacttgggaggctgagacaggagaattgcttgaacccaggaggcagaggttgcagtgagccaagatcgtgccattgcactccagcctgggtgaagaagagagactccatctcaaaaaaaaaaaaagaaaaaaaaatgaatgtccctatcttgacatattaattttgtagaaataaattcacttgctaatacatgggttggcccatataactcctccattgaaaatattattttttacagtgacagctgttaaacatatacctaacattctatgtaatatga

SEQ ID NO: 57107 - DNA, 1013 bp, Homo sapiens
gtatctctgaaagaggcttgttgtctctggttttcttctccttctccccattctgccgagaaggaaatgctgagtggccactgttgtgcagctcatttggagcctggtccacaccaccccttaattggttagaggagatcatggctcttttctcagagcccagggtcacattagtggcattatctctgtggcagcaaaaaaatggttttctgcctggctaggctcagcaataaagcagaatacccaagtgcttgatgtaggcattctgttatgtatatctccaaagggttaaattttacaacagacatagcaacttatctagactgtgtgtggtttgctttctaacctccccattagattgccaatttgattgttgttttgttttgttttttgatagagaattttaccacctaaaaatactttggtaggaaattttaggtttctctcctagaatgattgaactgtttatctgtgaaacagcttaaagctgctggcttctgtgctgtgaatctgggaagtctgacttgcttgttatttgatttcctgaataagagaaaaatcacccttcctcatttcctaccaagggttaaaattaaatacccacaatcgctgttgcaggcttgagaactatacctagcaactattctataaggtaattggtttacagtagtcctataccattatgtggtaatggaataagaataatttagccttgtctgttttatagaatggagtttaataccattttagactatttcctcactatggttctctcatattagagtcttttcagtacagtatttacatgactgaatttaactcttttctctcctatatctcccttcactataattcatctctatttatacttatctttacaattactagttcagtctttatgtatgtatttacatgcaaatataatctcttctgtacaatcataacagacatgttagatagccatgtaaataagaaatttcccatcctaaggaaagtctatttgtcattccaaa

SEQ ID NO: 57108 - DNA, 1063 bp, Homo sapiens
ccttacttaggctctatcagttagagcctaagtaataatgccacctgcattatgtgtgaaaagcatatgctaggccagatgcagtggctcaagcctgtatacccagcactttgggaggctgaggcgggcagatcacctgaggttgggagtttgagaccagcctgaccaacaatggagaaaccccatctctactaaaaatacaaaattagccgggcgtggtggcacgtgcctttaatcccagttatttgggaggctgagacaggagaattgcttgaatccgggaggcagagattgcggtgagctgagatcgtgccattgcactccagcctgggcaataagagctaaactccatctcaaaaagaaaaagaaaagcatacgctgatttatcttgggggccacttgaaaatctctggctttgttttacacagttgcacttgaaaaattattggtaatacgagggtactctacattttgggaaattacaagttctttaattagcaatatggctgttagttgggctctgctattcagtaagttactgctcaaagtttagcatgtgtaccagggggaaattgttcagccttgtgttattgaactggctaatgatgtgggatcaatggctaatctgcacaggacactcctaagaggaatcctgccacatgcagtattgcaatcttttcatttctagtcaagaggaagtactaaagtgtaaaacatctctttacctttttagtcatgtttcaaacatgaatgcttgtgggttaagcacatacaagtactttattttacttttaagatcccattatttttttttcatcataaaaccagtcatttttcaaaaaaatcaaataaatgaagatttaccaagatagtgttgtggatttggtctctgagccttattacttattgttccctgattcacagagggatcgtcaaactactagaactctaggtttctttaaccttcagttggaaggaggttactgatataatagaggatgcacatttggaatttttgcttgttacccttcaaaggtacacccagttaaggacaattttcctt

SEQ ID NO: 57109 - DNA, 1025 bp, Homo sapiens
tgaaaactctttccagaaagttgtagtattaaggtgagagagcactcttaaaatatttggaaccaatttactgatgttaattcttatacctctacaatataccagggtatctttttacctaaccataacgtaaatataaattgttttcctaaacaaacagagatcctggtcttagggactttacattcttgcagaaggaaacagacaataagcaacataataaatacattatttatttaacatgttagaaagtgataaatagctgtgaaaaaaaagagagtaggggaagataaagggaggttggattagtgggggagcaaaggttatgattgttattagatagtcaatgtggacctcactgagtcaatgaaggagatgagagattagtcatggagatgtcctggggaaaagctttctaggcagagtcaatagccagttcaaaggtccagagactgcctcatgcctgggtgggcttgagaaacaggaaggccagtgcagctggagtgaagtgaatgaaatgggagtagtaggaatgctcacaaagagccagaaaatgtaggccattgtaagcatttaggctttactttgagtgaagcagggagctcttgcagggtttttagtggagcaatgatatgatctgtctgaggtttttaaaggatcacaatggctattttgttaaaaacaaccataggaaggtaagagaagtagggacatcaaacaggagattttggagtaatcctcttgagagatgatgatagactgaaccagggtgttaacagtggagatagagatggagtggagatggagatggttggaacctgagtatttttgaaagagaaccaataagatttcctgatatattaaatgtgagtgtgaggagaaaagaagagttaaaatgattgcactgattttgaactacgcaactaggagataagagtcaccatcaacttattaagcatattacttaaaaggtactttgacacagacttcttttaggcaccagagccactgtaacattttttggt

SEQ ID NO: 57110 - DNA, 1190 bp, Homo sapiens
gtgtctttttggtagaacaatttattttcctctgcgtgtatacccagtaatgggattgctggttcaaatagtaattcaacatttctttgataaatctctaatctgttcaccgcagtggctagagtaatttacattcccaccaacaatgtataagcattcccttttctctgcggcctcgccaacatcttattttttgacattttaacaaaagccattctgactggtgtgacatggtatctcattgtggttttgatttgcatttctctgatgattagtgatgatgagcatttcttcatatgtgtttaggctggttggatgcatagactgggaggcttaaacaacagaaatttgctttctcacagttctgaaggttagaagtccaagatcaagatgttggcagggttgatttcttttgaggcctctcttcttggtttccacatgggatggtcaccatctcattgtatcctcacatgattattcctctgtctatattatctgtgtcctaatctctctctgtctttgtttttttttaagagatggtgtctcaccatgttgcccagactggtgtgcagtggctagtcacaggtgtgattatagctcactgcaatcttgaactactgggctcaaacgatcctcatggcttagcctcctactgagtagcaaggactataggcatgtgccactgtgcccagctctaatctctttttataaggacaccagtcatattggattagagcccaccctaaggacccattttaacttaattgtctctttaaaggccttatctcccaatacagatactggaggtactgggagttaggatttcaacatattaattgggggggcacaattcaccccataacagtgttgttctcatagtaactgagtgcgcatttcttctcaatttctctgaaaacattctcttctgaacgtgaatcttgcttggcagctctgagctatacctccaatatcttataacacgtgacagtttcctatttttgtcagcatacccaacatcacccattttctcctaaactctcagatgatctaaaagatcctatttttttttacagctccaccctccacttctatcagcccacttggttggcaaggaattttctctggcatgcatgatagcttgttagaagttctaatttaccttacataccctgttctagtatggtcttgtt

SEQ ID NO: 57111 - DNA, 1053 bp, Homo sapiens
gtggctggtttctgttgcctgttttgatactcttctcctggtaagttttagcttcaaatggtattgtccacaccacagcccttgatctcaggtaattctccacaccactgcctttttttttttttttttttttttttccaatgcagttgcgtggtgtgaaggcgataactgcagacactcaggtgtaaacaacccagggaatcaatgggttggggggatggtaaaacaggagttcgtagacaggactgtgtacaatagcttctgaagttttggagggtattggtgtagctgttatttctgagaccggagaaaatgacggtagagtgacagtttctctaatcatcagttttcaaagagtatgtttttcgttggaaccacaaatatagtacacttaataaggggaaacgaaaccttgaatttttccttcccagactctgaaaagtaaagtaaactttaaggaacattttaagggtgacaaaaggtgaagattgcaaatcaaacttagagtgtccctgctcaagaaaatctgtgcactgcagctacaatagaggaccacttgggtttagaaatgacatgttattaataattctagtcactgtggctaattagaacaatctgttgaaggttataaattatagaagctttttaaaacatttatctaagaacctgtgtagaattctaaaaggactgaattatttgaagttattagtttctgtgtatgtaaacttaaactatttttaaagcctttgattatttttctaaaaatgtttttgcatgcttatagcctgatgccgtaaatgttttatgagtttaatgtacagcacctctaggtgctatttaaaattgttttttctggtccttttcttttgggttataagggttcttcgtaaccaagaagattacctatggttacgctgaatgcactctcccagggtgcataggcgctgctgaactgcggttataactcttgtttgcccctgggtggttgccagcagggagtaaggcattgtgggaagtactttctttaccttccacaacaggtgtctttgtcag

SEQ ID NO: 57112 - DNA, 1042 bp, Homo sapiens
gtggttagaacactgccctttaacaaaagccatttaatcagactaacacatggctatactatattggcactggatagatattcttcactgacagaaaccaaaatagcagcactgtgccagcaaaggaagggagctctttcttggagctacagtttctctttctataaatgggagacgagggtaagcattctgtaattacttcctccttatcggattggcacagatttcatcaagcatgccaaattaaaaaacaaaattcagagcaattccatatgtcagagatggagaaaacaataaaatcaatactgttatttctaaatctttactagatatacatttcaaatattgattagaataaacataacaattaagattcatccatattttttaaaaatgttatctgaatattttttattctcattgttacatagcaagtgcacattttggcactatatcaatttcagttcagttcaagcatccaaccaatcatttggttgatcagttctaatgagttaaggttcttatagttgcaagtaataaaatcttgtgctatcttaaataagaaagggattttatcacgtggacagcaaagtgtgttcctttaaatgcaagggcagttcatctaggcaacagagctggtactggactgatgctggcaaccattctccctatctcttgccatctaattaaaacttctctcttgacatctactttatttctctgtctccaacttcttggcttctttatttctatggcagaatattgctgctacacagcatccagatttatagttctaccatctgaatcacaactccatatttctttggtgagaatctgaccgagtaatgttaggtgagttttgtgatagtatagagcagagcccctgagcacacactcaaactaaactgcctgggtccaatcctacctcacttgcaattagctctatgactttgggcagattacttaatctcaaacctcatttttctcatctgtaaaattggagtctgcaagagaaagtagtccggactgaaatcggccagaa

SEQ ID NO: 57113 - DNA, 1024 bp, Homo sapiens
ggataagctggaactgtctataagtggctaggatgtatcatgccttatcacaagaaatagcagaaaaaaaatatatagtctttgatttcattaaattcctttgtttgtttgtttgtttgtttatttttggacacagggtctctctctgtcacccaggctggagtgcagtggtggtgctaacatatctcactgcagccttgaactcttggctgaagcaatcctcctgcctcagccttctgagtagctgggactaccagtgcatgccaccatgcccagctaactttttcatttttttgtagaaatggggcctcactttgttgctcaggctgttcttgaactcctggcctcatgtgatcctctcaccttggcctcctaaagtgctgggattgcaggccagatgagccactgcacccagccaatttcacaaagtttcagtattctcagaaaagaacatactcatatctagaaatgtcttatgacttaaaaagcaaagtataaccatgtgcatattaatagggcacaaagtgaatctggtagagtgccagctgtgtctaatctgataagtttatttcatatggaaaatgtgtgtcaatcttagatgaggctaatttgttgaaaataactgaattctggtctcttttagattgtcagaaagggattcatttaacagtaaaatttaatccagatatatgtagtcatatgtttttaaactttttaaaccctgaaaattattgaaatatgtgccattttaatagtatcagcttctgattgcttttattccatcatcatgtgatatactcctcattaagcagcaccagtaaccagagtttaattattgtgtagcactgtgtgaaagcttttgtctctttatcatatatggcacagacagtactcttggttgtaagtagggatatccagcatagtttactgtctacatgcttatttctttagctttttttttttttgagatgaagtctcactctgtcgcccaggttagagtgcaatggcacaatctcagctcact

SEQ ID NO: 57114 - DNA, 1042 bp, Homo sapiens
cacaaggcctaaaatatatactgtctggacctttacaggaaaagtttgccaacctctactctggaatctctatttttctcctaactttgagttgagcatgttcccttagaatgccagaaatttaactagcaaacacacctgaattttttttcataaatggtgtccttgtctaacatggttttcctcaaatccctgcaggtaccaaccaagaagctgaagaaatatgagaaagaatatcagacaatgcgagagagtcagctgcaacaggaagacccaatggatagatacaaggtatgagaaatatgttgcacctatcaaagtaccttcttttttgttttaaatgagactgagtcttgccgtgttgcccaggctggtcttgaacacctggcctcaagcaatcctcccactccagtctcccaagtagctgggattacaggcacgagccaccattcccagcaaagtacctttttttttttttttttttttttcttaaagcagcagttgtggcaagttcaattccctctgttcttccttgattgatttagatgctctctgatcatgctaactgtccaggtatgttttcatttcaggagactcccaaatagccaaccataatatttcttttctttcagtttgtatatttgtaggtaactccagctgttgcatttatactgggaatcttcataagaagctgagagaaagagaggggaaaaagaaagtggctttctactttcaaaaatgaaacaaaaaggaaaaatggcaaagtactgttttagctgtgcatgtcatatccacaaagacttttagcaggtgaactgttccaagactgacacaaggatgtttcaaacttgcctctgtctgtagaaaatgttaaaaataccaactcacttggaaggaaaaataaaaatcacaaaggtatattgagcacagtagtggtgtttgttgcaacatttatttccacaaatgaatttatgaacaacagtgatatttgagttaaagtatgaagtttcagaatcaaaataatttcattttaatacgttcg

SEQ ID NO: 57115 - DNA, 1036 bp, Homo sapiens
aaacttcagaagtcttccactttctctttgagcttggataatccagagagttcattgttataggatggtgaagatgcaaaactaaatccttttggcttctcaagcaatatagctaataaggagtgggcgatttctaacaatgctggtctgctagagtcccttatacttaacccttgggggaagaatatgctttaggaacactaagaatttctagtatgtttactggtgatcttcagagttttcaagaaactttcattaatttttagaaagttttcttttctgtttaagtattactgagaaaattacctgacactaatatgtttctatatcatctagaatgcatctgctttttgaaaatttgatttgtgtactagagtagagcaaggatctgcagactgtggtttataggccaaatctggctcactgccagtttttgtaaaccaagttttattggaacacaaccacacctgtttatttatttatagtgtatggctggttttgtatgacatttgtagagttgagaaatttcaacatagaccatgcgacctgcaaagcctaatatagttactttctggcaatttacactagaagtttgctgacccctgtgcaagagtataacctaagatagttttttaagcgctgaaagaaatgcagtctgtttggccagctgtcatttatcactgacaagattttgtttttagtttgacatttaaaaatttgaaattttccactacaaagataaaattggatgtgatgagtaaaggagggaagcacaaaaccttcaaatatccatattttctttctcagatcttcattatggacaacatagatatttaaacattttatctgtaggcatttgaaaacttgaatatgatagctgtcaactcttttaaaagaggtatccaaaagaaaatatgtgagagttgagtgtgttgttgctaataaatttgcactgagtcttttaggaaaacattttctcctgacccttaaaagtctttaaaagcatgtgccaagaattcatcatagcagcagacaa

SEQ ID NO: 57116 - DNA, 1027 bp, Homo sapiens
gaacataccaagttcatagtgtttagttaaggaaaggccttgcttcataagaattagtgacttggttttttttttttctttctttttgtttgtttgtttgtttcgtttttttgtttgtttttttatcatgtaactttgtttcagatttttcaaggttgggagcagaaatcctcagtaatttattttacccagaatgttttaatctgaaattttttaaaaaacaaaaaaactagatatcttatgactgttgctctcacacaaaaataggtgttcagaaaagtaaatatattcttactcaaagaataaaaatgtcagctgttagcaaagtcatgaacccatgtgtcatgattcttgatttagagctcttaaatatactcaatatgaaccctgtcttagaaaaacaatttgaagaaatgtctggtggttttcccctgtttcattcctactgtgtcttgtggtttctcttgaggtcaagggtgagactaccgtgcatgtttcaaataaagaattgtttgtgtctgtgttctagatctatgtaaaaacctcacaggattgggggggatatgctcagaaagtttgttctttgtggcacattttttataatgaagttccatcttgagagtttaagggaccagtttcaccgggtagagaaccgcatctgcattgctagctaaactcactgttgtttcccagacagcaatcctgccttcctgtgccacttgcgccttctcctttttacacctttgaaagttcactttgttgcttgtttttcctcaccagttctgttcgtttctgtatgtccagacactaatgcccacctctggctattgttcttctgcagagggagaaccgaagattacaggaggccagcatgaggttggaacaagagaatgatgaccttgcccatgaactagtaacaagcaaaattgctctacggaatgacttggatcaggtaatccttagaaatgagactgtgatgacttcctcagggcaaagaccgatttgccctcatcaccgcccccacaaa

SEQ ID NO: 57117 - DNA, 1047 bp, Homo sapiens
aattagtggaaatattttttcaattatatttaacatgcctataaaaatagtccttgcaggaaattatttgataagagcaaaactatttttattttataaactattttggaggcctctgatcctttcaaaccaaccaaactactattagatatgtacaataacatttgttgatattaatcattggcctcattgttgaacatattatttgcaaagaatcttaaactctgtagtgccagaatgattctcatctgtgccatattttgcaattaaaagtaacacacccttagaagaatcaaataagagccatctacatcccaggaggatgcaccaagttgctcacagtggatcttttcctctaaaatgatcttttatgttctaaaaagtgaaatcccctttatctgtgtttatattctctacagcccataaaactgatgtgattgttatgttatactcatcagataatacttttcttacataaatctttcattgttgttctgacatctttcattacaaaatttattttcttaacaaaaaggaacataacccagcattccaagtgtctgtgttggctttaacattctctacatggtggtctagataagctaatttttttttttttttttttgtaaaatgtaatagctagaaaatgttatcttggcgcttgtttttgtaaatcatttagtataggctgttagctttactggtactttacgctttgattccaagaagccttgtgcagttgccttatcaaatggccagctaaattaaagatgctcttttgtgttgtgaatttcatagttctgtacagagcttgtttcaatttacaaaaataagtacattccacagaatgcctaaagtgtgtaattttctttaaataatagtaggtgagggagaaacataatggctctaggtcaatcccttatctaaagaccttgttcaacttcatagtccctttccttttaaagaggagaagagaaaaatcccccctggccaggcatggtggctcacatctgtaatcccagcactttgggaggctgaggtgggtgg

SEQ ID NO: 57118 - DNA, 1061 bp, Homo sapiens
agtccatcttttgagttttcttttagctctttcaaaagattacgagggcaatacatattttttttttttttattctccagccccatatcatacttgggtatgcctgttggtaccataagcctaaactctccttcactgcaatgcctttgagtcagtagcaatagtaaagactagaaacaaagaaaattcagaatttggtatgtgatatgattgttcatacaatatgttataatagcaatattccaaacaatatgtccttcactgtctattgttggaaaactcatgcatcccagcatgaagtaactcctagttttaattttagttattttgagatatatttgagaattgcatctcttctcttgaatttcacttagaagagattaaccagccaaatatccaggaaagtttcaaaacattctagtgtttttcatcctttgctaggatgcactctgtacaaaacattcctctgaaaatctaatatttgcagtatctaagaattgatcatttctattttcattaaattctgtggaaaaaattaaatgaatgaaattcaacttcataattcagttcatcagcttttgtatcttgagaatctaaacacgtctttaaatctgaaagaaaccaagctggattttgcagtgcatatgtttgctagcttcccacatcctgaaccatgtcaaaatttggttttatttagttacatataatttaatgcaaagaaattctgttacttaatgttctgtttatttatgagtgcctatcaggaacactaataggaatgccattcaaccagtgtcttctgcccctctcccagctgttaaattagtacttcttcattggctttctgaaatgtcctgagtaaagtagaaaagcaacctttgtatggatgtggggatatttaatagtatgtatcttgtttcatttttttcctatgatgtattaatatttatttttctccaacccctgctccattttcttaaaatattttccagttaataactagttgctttatttcctagctgaagtgagaaaaccaacggaaaacaatacagatttgggca

SEQ ID NO: 57119 - DNA, 1045 bp, Homo sapiens
tctggtgtcatgaaagcacaagaataaggctggagatggtcccagatccaagatgtcccaaaagccttttgtatcagtttctctatttttggtattttgcataatgcatggatccttagttcaaatgagggacaaagtttctcagtcagccccacttcctttctttctaactcctacctttcccttgcagaggaggtagtagagattctggaattgtctatttttatgaattccattattttgtccatggcatctctaatgaaaacaggttctagaataaaggagttgattagtctgaacagtactaattaactacaaaataaacgttagtgatcagcctcttcctctataaacaatgaccaattagacgtttccgtaattccatgtattatgtatagtacactctataaatgtaaatgtaatgcttgtctaaaaagtgcaatttattgtacattgtcccaacaaatgtttacttttataatcgttatgaacttgaattggattagtatcttgtttttatgtgtgaatgaagccttgtgaaataaacaaatgcaactgagaaggtaacaaggtgactgtttttgtgagccagtgatgttttcaatgctttgtgttgcccctttggccccattaagcagtaataaacatttgttctgaagtccatgtatgtcttttttatttttttagttgactttattctgactcatttgaacccaatgtttatgtaacacttcttacacctgaccccagactccagtcaacgtagaaaacacacagtatataccctgcaaaatgataccctgtgcagcaccaccacaaagtgcttcattttcctctctactgaggttccttgattccacgtaacagaaacccttgcaagctagcttaataatagtaattttaagaggcaattaattaaaaggaaataggatatctgtatcataggtcccaaaggccaaacacttgggcctgaactggcactaggacaaggggctggaatgccatcaggactctgaaagcaactgttcccaaaattgtgcttctg

SEQ ID NO: 57120 - DNA, 1064 bp, Homo sapiens
gaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcggtacgttatttccggggctgggttaacgcagcggttccgagctgcgactgcgcagcgtggcccagcgcggtcaaattataatacataaaagttgtcagggcggagagcaagacattactcttctcggattgccggttcgctcgcgagacttgagcgttgctaggagattcggcaggcgggcggagccagactcggcggggcggggaggggtggggctaggctcggcgaggcgaggaagggtgggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctccttctgcgcggctgcagctcgggacttcggcctgacccagcccccatggcttcagaagaggtaagtggtccggccccatattccttatgccccccggctggagctgcagcgccagcctcccgccctaccgccgtttccgtgggctgagccgccctgcggccacccggtcccgcgccagtcagtgcgccgccttcccgggggacacctcactcgccccttgctgcgccgtcggctccccagcgcttccactcgacctcgcaccccactcgcctgctgggctcgagcgggggtgtgcggcgattatccgtgcaggcggtgcggggagtgggtctgggagagcggccctttgcgcgtgttcctcaggccctttctgccctggtttcccagccagtggacaggaagcttcattcaagcaaagctgggtgcaaacatgagtgtcgttcttggtagagggcggttg

SEQ ID NO: 57121 - DNA, 1050 bp, Homo sapiens
tcactgcatgttctctcatctcttaaatattttaaaagtgtctaacatctaatgacactcggattagatgttacaaggaaatctatgaatcctttgtcaaaaaaaagttctttgttttactttttaggtcgcagacgtttcttgtaaatattttaaaacataaactggaaaatttaggtttgaagacctatttattgtttgttcaagattgttcaaagttttccttttgaaaaaaaggaagcttgagttaattacagttaataagccagatggaagaattgaagttgcaactcaatcctagaaaatttagatgaacttcttaattcttagtgcttatttcagtaagttgaaatgagtgatacgcacaatatcaagccatttccttatttatcatagctaacttattttttgtcttaacacagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggtatgacttgcttccctatagccagttctgcctccgagcaacctattcctcatagtggtctaacaaattcatccccaatgagttttgagtctgtgtttttggtggtttggagcaagacccatcagtttttatttaataaaacttttttaagatataaataggaaaggatgcgttctagaagctgttaacaagagtaaggtgattcactacaaaatgtaacaacaaggaaggaacttattctgaaattgttcagtataagacacagctttggtggtggtggtggtggtggtggtttttaatcatgttttatgtttcactctgccaaccaccacaattaactgaggagaggaatccagttaaattcaggaaatatttttgagcacctaatgtgtatcactattgtgcttt

SEQ ID NO: 57122 - DNA, 3151 bp, Homo sapiens
tactgccttatacgacttggtttcttgcctatccccgacccctcttattatattactgtctttttcagtcactaaaatccagccactcctcctgctcctcaaacacaccaagatgatcccatcttggagccattctgcatgctctgccaactgccttctcctgaccttaggcttcggctcagatttgcctcagagaggccttcctaatgaagttcctgcccccaccccccattaacacccgctttgtcttgatagcactttccaggatatcagggtattcaagttttacttatttatggtcttttcacaccatgaatgttcagattttggcctattcatacaagtattactggcacccaaaataagtctatacatactagggacttgatcaattgaatagataattgttttataaatattcatgcttatctccatgtcttctaagctgtatttgttttcctgcttttcttccaggtcaagactgatacagttcttatattgtgtagaaagaaagtggaaaacacaaggtgggattacctgacccaggttgaaaaggagtgcaaagaaaaagagtgagtctacttccatttttttaaagaattttagtgtattgtttgagatcatggatttttaatagtttgtctttatggataatgtatttctgctttcaactgtcaaactacctgaagagggcacgtccagcaagttgctttttaaggtctttgtagttaagggttggctctttagtgtggttcttaaccctaggcgcagttgtgcttctatacaaataactgtgcccattcccagatactctgtttcggtagtttgagaggggcttaggtacccctgtatgttttaaatttctcagatgcttctgatgcgtagttttcattgtcactggtttatagtgaaaaagataaaatatttttatccttcttaataatgaccttttaaaaatgtgtattcaatgatacttgcgttctaggtcagttcatcttctaaaggtactgactaaattaattcaagacccaggcccagatctgtgtatctcaggcttaagaggagagtttttctaattaaaaaatacatgagcttcagggtacatccatgtgtaatgtttatgattttccctcaagtgttttttttcaaattatgaggaaacatgcttttaaaaaatgaaaacaagttagaaaatcaaattcttattttacctgtcaaaaatcacaggaggccaggtggggtggctcacgcctgtaatcctagcactttgggaggctgaggcgggcggatcacctgaggtcaggagtttgagaccagcctggccaacatggtgaaactctgtctctactaaaaatacaaaaattagccgggcatggtggcatgtgcctgtaatcccagctactcgggaggctgaggcagacagaattgtttgaacctgggaggcggaggttgcagtgaaccgagatgcgccactgcactccagcctgggcaacagagcaggactgtctcaaaaaaaaaaaaaaaaaaaaaatcatgggaaatccctgtgcctaaaaatagcccctaactattttgatgacctctttcgtgcaccaagtgtgtgcatgcttgatacgtgtgtgttgttttcattaagatgaatttgtgcgtgccgttttgattgtaaatatctttgggtactctgtcttccttcttatccctctacttcctgccagtgttaacaacctgaatgatagtatcttccggtgctttcgtttccccattgttgtatatgttttctttttaaaggaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattg

SEQ ID NO: 57123 - DNA, 1041 bp, Homo sapiens
ttcaggttttactcaatttttacactggtggaagctgatgtcagtaacttaaaaggcaagcaaatacttttccaattcttagctgaacaaaaaatacacacaatgtagcgtttttattgggcaagacttgctttttatatttcacgtgagaatgcaatataacccttccttgaacaaaatgaccagggtactaataaaaccatctttgcaggagtgtttaataagcatattttatttaaataaatcctccagtaggaaatggagaattcattgcctttacttagaaggctatgtaaatagctatctgtcaaatttatatatgcagctcaccaatattcccttactggaaacatcagtatttccacatcacatcacagttcccaaaacgactttaaagtctcaaaattccgtgtctcctttggcttgcttctctcttgattccacccaggctttattaatggttcgcttcatatcatcgtctccatcttcataaattttctttagaacattcatcaatccctcactaggatctgtttcagtgtcataggagggcttcctttaaaaagaaaacatatacaacaatggggaaacgaaagcaccggaagatactatcattcaggttgttaacactggcaggaagtagagggataagaaggaagacagagtacccaaagatatttacaatcaaaacggcacgcacaaattcatcttaatgaaaacaacacacacgtatcaagcatgcacacacttggtgcacgaaagaggtcatcaaaatagttaggggctatttttaggcacagggatttcccatgattttttttttttttttttttttgagacagtcctgctctgttgcccaggctggagtgcagtggcgcatctcggttcactgcaacctccgcctcccaggttcaaacaattctgtctgcctcagcctcccgagtagctgggattacaggcacatgccaccatgcccggctaatttttgtatttttagtagagacagagtttcaccatgttggccaggctggtctcaaactc

SEQ ID NO: 57124 - DNA, 1031 bp, Homo sapiens
atgaattatggtactcatgcaatgaacattacctgccagtggccaggcgctgtggctcacacctgtaatcctagcactttgggaggcagagatgggcggattgccagagctcaggagtttgagaccagcctgggcaacgtggtgaaaccccgtttctactaataatacaaaaaattagctgagtgtggtagtgcacacctgtaatctcagctactcgggaggctgaggcaggagaatcacttgaacccaggaggcggaggttgcagtgagctgagattgtgacattgcacaatctaacacccacagcctgggtgacagagcgagactctgtctcaaaaaaaaaaaaaaaagaaaagaaaattacctgcaagtgagaaggagcaaaatacatgtgcaacaatgtaatgtgatctgtgtaataatgtgatttcccttaggatgtggctgatgaagaaattgctgccctcccccgggatagctgtcctgttagaatcagaaatcggtgtgttatgacgtcccgtccgcgtggtgtgaagcggcgctggaggcttagtcgtatagtcttccgtcacttagctgaccatgggcaactttctgggatccagcgagcgacatggtaaatgagctccagaacctattgagcttgcagggaagccaagcttgcagttccagcaagcaaagattttttttaatagaccaaaccctaatctctacaggggcccagtacagttgtttggcctacctgatgctatctctaaactacttttaaaatgaagacatttgggtgtttcatgtcagtgaattatcttttctcttggacttaacaaacatactgttcccatacatagtacaaagagtagcataataaatattttctgtgaatgttttttataccctccttttaagtttaatcttttagtaacatataggggtttttgtattaagagcattatttcataaaatgctatcttatacataatccaactaattgacatgtagctcatgtatggcagtttgtaatcctggactag

SEQ ID NO: 57125 - DNA, 1003 bp, Homo sapiens
gaaacagtggatacctgtggggcaagggagtcattgggcaggtgaggaatgaggtggggggagacttttcactgtgtgtcttcttatacctttttgatttttgaaccatgtgactattggcctaagtacaggtcaaacagaataataaaaatttctgaaaatctgtctttcaccttccaatacatatgttattgcattatattattatgattttgacttaatatacatccataaaagttatttattctgaataaattaggaagtctattatcttaaactattaaactgatctaaaacaactcttaaaagaatactaaatgataaatagtggcagaaagagaattgcagggttgaggaacactcagaatgttgtcctggctatccttcacttgtcccttgtctctgtctttcagatggttccttcatcagcttcaggccaagttcgaagtcactatgtagactggagaatgtggcgcgatgtgaagagacgaaaaatggcctatgaatacgcagatgagaggctacgtattaattcactcaggaagaataccattttgccaaaaattcttcaggttagctaattaagatgagtccctttgtaccacaagatcattaactcaacatcagatcacttttgatactgtttgttgtgacttggtatcaatataatttctggagaataagatccacatcaatataaacaaatagtcttgaaactgattttgttgagtttcaaattaaagactattcactcctaactagccttacaactgtttcattatgccagccttagaaagtactggtaaattgggtggttattttcacctaaggtctctccctgacttcatcccaatttttttttttttgagatggagtctcgctctgttccccaggctggagtgcaatggctcagtctcggctcaccacaacctccgcctcccaggttaaagcaattctcctgcctcagtctcctgagtaactgggattacaggcacatgccacc

SEQ ID NO: 57126 - DNA, 1055 bp, Homo sapiens
tgggcttggttcaggggaggtccgagctgcagatgtcaatttggttttcgtaagcatatgactaactggtattggaagatgtgagattgactccgatttgtaagggagtaagcagataggagacgagttccgaggattgagctctcagagacttgtaacgttaagagatgagaaccgtgcaagggagactgaaaggagttgtcagctagggagatggaaaactaggagagtgggatggccgggaagcaaaggatgacagaatttcaaagtgtgaggagtgggcaactctgctcaaagttgataaatcaattaaaaagaagtgctgagaattgaagagtttagcagtgtgaaggttgttgggaccttaatcacagctgttctgatggtgttatggggacgaaagcgttcaagagaataggaggaaataaagtggagtatagataagcctttaaaggagctttgctgtaaaggagagcaaaaaaaatgggtcaataacgggggcggggaggggggttgttttcttttaacatggcagggaaaacagcatgtttgtgtatgaaagggaaagatcctgtagtaaaaattgatgatgtagaagagggaagaattgctagagctgtacctttatgtaggcaagaggcaatggaggctggttcgagtgcagtggtgtttacaactaattgatcacaaccagttacagatttatttgttccttctccactcccactttttcacttgactagccctaaaaaaaccaaaaacatttaaaaaaaaaaaaaaaaaagagagagaggctatggggtcttgtgcatgaagtttggtcttaggaacctggacagttaatctgtagcagtgttgttcatagaaatataatgtgaaccacatgtgtaatttaaaatttttctagtagccacatttaaaaaataagaaatagatgaaattaagtttaatataatattttatttaaccaggtatatccaaaatactgtggttttaacatagaatcaatataacaatgacttatgaaatagttacattcttttttttcatactag

SEQ ID NO: 57127 - DNA, 1053 bp, Homo sapiens
gtgaaaggtgataagacttttgccaaccctctgttttgagattttggcctcctgaagtatctaaatcaaaagaggactgtcaaaagaaaacaaatgagcattctagctgaagtgaagaggagaaaattgatagtgatggacaacacaaggctcccctaagaaatgcgatcctggaggtcaggagggccgagagagggagaagcacctgggagtgaatggaaataaagttagcaggaaggcaggggagaggctaaggtggctgccctgattcactaggggctggttaactcactttctacaccaattcagtgaaaagctgatcaaactctaattagagcaaaataattatttcacaaatggatgttttcacctttcacacaatgtgaatagtataataataaatatagtgctttacagttggcaaggcaattttaaggcacccactgtgtgaaatatacttacacaacatgcttcacacacattatctcatttactctgcccagcgatgcattaattcattcatccattcagcaagtacttactgccagtccactttctaccaggccctgtgccagatactgagagtaaaatgatgtaacgcagtgaataaaacacctagccctctgagaaagatggcaatatctttgtttacagaagaataaatggaaaaagcacttaagtgaatgttccccaaaccccacaccatgttagtggtggagacaggtttttttgtttgttttttattttagagacaaagtctcaccctgtcacctggactggagtgcagtggtgcagtcactgtaacctcaaactcccgggctcaagcaatcctcctgcctcagcctcctgagtagctggaactacaggcatgtgctaccacacttggctaatttttttaatttttatttttgtagagataggatcttgctatgttgcccaggctggcaaaattcttggctacaagttttctggcatataagaagaaaaattaggaaatttccttgaccttgaggaggtaaatatgaggaagttgacttgctaacagactggaga

SEQ ID NO: 57128 - DNA, 1003 bp, Homo sapiens
ccatacttctagtgaaaaaggaaggtaagtttcatagagatatacagatttgcatgagatcttggagacataaataaacttactgttccattaactctgtggtccctaaccctgtaactattccaactttggtactgtcatctacaaatatttttttctgtgattagtctatattttgctttttcttctgttcctctagtgggcaagtctaaatgtattttgcttttacttacgaaagagcccaatatctgtggcaaataattcctacaaataatgcctccctactattttctctagttattttgaggaaaacttagataaatttgttccaccagaggaatctataattaatcaatgtgtagatgattggctggtagcctcagaaactaaagagcaacacaaaatgtattaaagcatctattgtcagctgaagactgtaaagtgttacagtctaagagtcaaccgattttgaatatcaaacagctttctatagagaaacaattgagacaattttggggattagtaggacattgaagacaatgaatcccaacttctgctgagtgtgcaaaaccttcgatgagcaattgcatgataactctctctggcctttaaaatctgaggaggcttttgtacaactgaaattagctataacttctcccctagtcttgaggattctcaattttgaaaacctttccacttattttgttatgaaaataaaggtgctgctagtgaaatattagcttaaaagttgggattgaactatagggcaatagtttatttatcagttctaggagccactgcactgagaatgcctgggtgtctgcaagaggaagaggtagccagcattcttattggaaaagcccaaagtcttaccttgagtcacatgacttatttgcatgtcccacatgctgtgacagcaatcttacaagtccataaagcctagcatttgtcagtatgccattgaactaactgtgagcaagcattattaggtagtcctaacata

SEQ ID NO: 57129 - DNA, 1034 bp, Homo sapiens
gggatgtgcactgactcttgtgggtaatcctgcaaccagcccattttgcttgtttgaggacctggagatgatccaccacctaaggtggcactgtgaccagaggaaattgattaccactcccctacaactacggaactgagcacgttagagatccatccagagcgattgctagaagcaatccactaaaggtaagctgggagaagttgcaatggtgtacctagaagaagaatgagtcctccattgatttccagcagcagtttttggaggctttctcagaatttactagcatggacccaggaggagataaaatcactccctaatcttggcaacctttacctctgctctcttgctgactaaccaagcccaaattaagcaaaaggtgttaggatagcaaggacagactattattcaaatcctagcagcagccactactcagtttagggttaagacaaagaagaaaagcagagattaaagactgctgtgttggctactcagtgagaattattactaaggaggataatccctataccgggcaaagtataaatatagcaaaggaacaggagaaaactgaatgttattattgcaaaataccaggacattggaaggactatagaaagagactcgggaggataccaaaattgcagagacaggagagtcaggaaagcctagaaagatgaaaccctcaactaggaaatagttggcaaatggctcaaaattgacagattgggggtatctcagaggtgggaagtggtaaaccatctatgtcaaggacttttactgaaccccatccatccttggcttttctggtagatattggtgctacttattctgcagtttcctcagaaaattcctgctttccatctggcaactgattagtacaagttgttggtactttggatcagcctccatttattcctttttctcttggattcccaaacagacaggtgctcttactgaggtaccttcattctgactttctcctgtatctcctataaacctattggtgagagacctactctgcaaattaaaggcta

SEQ ID NO: 57130 - DNA, 1101 bp, Homo sapiens
cgataaagacacacctgagactgggaagaaaaagaggtttaattggacttacagttccacatggctggggaggcctcagaatcacggcgggaggcaaaaggcacttcttacattgaggcagcaagagaaaaatgagaaaagcaaaagcagaaaccgctgataaacccatcagatctcatgagacttattcactaccatgagaataggatggaaaagaccggcccccataattcaattacctccccctgggtcccacccacaacatgtgggaattctgggaaatacaattcaagttgatatttgggtggagacaaagccaaaacatatcagccatcatcgcaggttcaatgaaaagctagtttaggaaaatgctcaaattaagatttctgaaatatcccctttcctaccacatgtccagtgcattctctcaccggagagtaggacttaggtggcaggggctgaaccagcatcacctctactagtcttcttatatgcaggcaacaagactgaagaagggaaagtgaattgagattgcaggcaagagataaggttgtttgtcaagaaaaaccccgatattgatcatatctatggagccacaagtggaagccaaaagtggtcttcccagtgtgttaatctctgggaggtgttcttatcttccagcatctactcccttctagttatctaattgcattgtaacaaatctttatgacagaagtggaatgcctctttctccctccctttccccacctccccttggtatgtgatggtagacagtatagtgacttcgagtgtttatttaactgtgcatgctttttctccatcgtctaaacatccgccaggaaccttgacattagtttcacctctcctctggggctgagagatgggaaagaagcgtcaagaacttgaacagaaatccagctctcagtacattgcagtaagtaatcactttctttttttcctttcagagtaaaaaaacctgtttcaaactctcttcagggcaaccaatgaattaaatatcctactcattgcagacatgcttcatatttcaccatgatgggcagtcttaaagtctctacttaactattgatagccattgagatc

SEQ ID NO: 57131 - DNA, 1054 bp, Homo sapiens
tataaggcagtttctcaggcttgtagcacttgtatggagacttggaacctgattcttttttggaatgaccaaatctcttataagtattcatatcttatagctaatgtttgtgcactggctaatttcgaggggttaaattttgaaagaattaataaattacttttctgctaaattagctactattaacaggtagccattttttaaaatattcttaatatttagagactaaactttagtccaggggtgtccagtcttttggcttacctgggccacactggaagaagaattgtcttgggccacacataaaatacactaacactaacgatagctgatgaacttaaaaaaaaattgcagaaaaatcttaatgctttaagaaagtttacaaatttgtgttgggccacattcaaagccgtcctgggctgcatgtggcttgcacgttatgggttggacaagcttgctctagtcagtgtttacactttagaagtcctcacttccccttcccaaattccatttggtgagtcccaggagagactcccatgagctccactccatggttcccatgggaaaggcagccttctattcctagaaatggaatgtggtgctctgtgctgttgaattgcaaagctttgtggaacagttttagtaatatatctggaaaggcttctggcacttagaaattaaaaagcactccatgaatatagggcagcattagcatatgcatattaaaatctagtcactcctcagtttttttattttttattatagggaacaaagaagtataaagtataaaaattaccaaaaaaaaaaaaaaaaaaaaaaaggaaggtcaaatggctattctggaattttcttttttttctttttttaatttttgtttaattatactctaaattctggaatacatgtgcaggatgtgcaggttttgttacataggtatacacaggccatggttgtttgctacacccatcaacccatcatctacattaggtatttctctggaattttcaacagatgtaggggccaacaggtatgggggttatggtggcaagacagg

SEQ ID NO: 57132 - DNA, 1789 bp, Homo sapiens
ggttctcataggatcccactgacaaatctaagattttgttcagcatcattgacttcttatgttaagtagcctagttacctaatataaagacaaaagcattatggaagcacatatattagtcaagccttagctgagcagcaggggaaaggttgcacgtttaaatatttgctacttagtgagtgttgtagtgtccatctaatgtaattctttttgacagtgtctcataactatcctcctgttccgtgatctttcttagccatttgcttcctcttagttttagcaatatcacaacttacttttttatgacagtatactactttaattctaaaaatacaaagtatctggacgctagatgattggctagaaatggatgaagcagcaggaaagagcaagactttaggtcctgtaaccttgatcattataaacagtgtttattgatgaaagaagaaaacagattaaaatcctaaacaaggatacttaaaactttcataagaatgtggaaagattccaacatatattccaaaaatgtatttgtgctatgcattagccaatttatttttccatgtgttttatgtagtttaccttgaaggcttccaagttaactgtggagatagctcatctgaaagagttcatgcagctgttaagctgcaggtcaaaaaggattaatgtccaatccattcaaattctttggcattttcccagttgggaaacgttttttaaatttgcttttctattggtaaatatagtaaagagtcattaaattccttttatatcttaaatgattttattaaatggatccttttttccccccaattaggtgctagaattggtatgaagggttaactcaagtcaaattgtacttgatcctgctgaaatacatctgcagctgacaatgagagaagaaacagaaaatgtcatgtgatgtctctccccaaagtcatcatgggttttggatttgttttgaatatttttttctttttttcttttccctcctttatgacctttgggacattgggaatacccagccaactctccaccatcaatgtaactccatggacattgctgctcttggtggtgttatctaatttttgtgatagggaaacaaattcttttgaataaaaataaataacaaaacaataaaagtttattgagccacagttgagcttggaaagtttttgtcaaatgcagcaagagataactctttttaagaagtagcatatgtgaactataatgtaacagtgaataatttgtaaagttcgtatttcccaacctctttgggaattacacatatcaatgtaaacaaaatataaagtacatagatttctgccagtgaatttactgtttacggtagatagaaagattactttataaaattctttcttcattctctgaccagatttatatcatcagcaagtaccatgttgtccagtctctctgaatctggctaagatctaaaattttgatctattgagaccacatttaaacagaaagagaatgttagtctctgacagctagctctgtctttgcctttgaaatgttacaaaaacataccataagccctaaatgtataccaaaccaactagtccattgcttttagtaccatcctaggctgagtaatgtcttggagcaggagtcagcaaactttttctgtaaagggccggatatattttcggttttgcaggttatatggtcagtggcacaactattcagtttggccagtatagcaggaaagcagccacagacacatgtgaacaaatgtgcatggctgggaagtaggcagagggtcaga

SEQ ID NO: 57133 - DNA, 1068 bp, Homo sapiens
gtcttaggaattgaagtgaagaaagaaggatgaagaggaaattatctcttggattgctctccaggaaatccttctctatactttaaaagctcttgttcttttctaggagtccaatgtgctgattgctgctaacagtcagggtacaattaaggtaagctatttactatatctccattttaaactcaggcccatttttagactgaaacaggattatagaaatacaccattgtactgagccttagagatcatcccaaatcatgggtctgtgtctccttacaaatggcttgatttaagggaaaagaataggtagcttgcatctgtggagaagatgatagtgcttattgaggttgtatggatgctggatggattaatagatggtcagtttgaaaaacagataaagactagtgaacattcactgtgggctaagcacagtttagcttctgttatgccagtacaactctcccacagggctttcagtagatagagcccaaaatatagcaggagatgcaagatatagcagaagatgcttagacatcaccagatttaaacatatcttggtcatattttattctcttcctcatggttctctttcttctgtcccctaagaagtaggtttttcctcagttgtcaaaggggagaaaaagttattttagtgttcagttgaaaattgatagatgtgattcaaggaagcctagccataaaaaaaggaaagaaaattgattgatgcatatatagcacttgtacatgatacattggataaataaatcctgagataagcagtgaactttctaaacaaaacacccttttggtggagtacgtgtttctgagagtacctgttttttccacatattctctgctgatttggtagaaatattgaaagttttttaacataacgtgtgtgtttctcctgccacttagcattaattttgccatagcttccttagactcatcataagtggagaataatccatcagccaaggcagcaaatcctagcctaaacattctacagaggtgaaatgagcaaacttaacgcagaagaactgcactaatttacatggtagtctcctt

SEQ ID NO: 57134 - DNA, 1938 bp, Homo sapiens
agaaattgaatgtctaaaaggattaagcagaaccaaaattcagatccaggtttccatgccttgaatgtattgctttttctgttaacatggtattccccaaatagtactgaattctagaatcagctttaccagagtagtctggaggaaatttgcgaatagctctcttaaatatgcacggttctatgctcagaggagctcttctcagtattaatcagcaatccagtcatttttttcccctcatacttgtcattgtaagcacatttttctcaagctttactcagaagatcatccagagatattaactgttaacatgtgctgcaagttgaaagtgtttagagagaatatttgagtgcagtgtgacaaggataatcaagttgtttagggccagttggcgagaagactttggaaagcattgagaaaggaatgatgaatgtatgtgttgttttgtatctaaatccttcttcccttgtgtatgttcttcacagccttttctccctgaataaggatcactttgactttgtatgctaagtgtgccttcttaatggttcttttcctgttatctgaatcctgaagtatatttaaatgagaatttgatgcagttagttaattggaatataaaagactggttaacaaaagtcttcttaataatgaagcacaccagaaatggaagctgctggaaccagccatgtggacaaatgaaaaaatgccttttgtctacagattgcagcgatcctacataaatatatggaggtctctgtctggcttaggacagctggctaagtctgatcgttcccctccgtacagcctttaaaactgccactctaaatacttggtttccttgccattttattcagtatctgctggttatgagtactgtattattttttaaatgggcaaccaagtaaagttacctctgtatccgtctgaactggtttttgaggtatcttacgagttttgaaaataggtgttatttgcttatttaaggaacctacaaccaggaagtagaatgaatgtggaaatattattcttctcttgccgagcatggtggctcacacctgtaatcccagcactttgggaggttgaggcagatggatcactgaatgtcaggagttcaagaccagcctggcaccaacatagtgaaatcctgtctctactgaaaacacaaaaattagccaggtgtgttggcaggcgcctgtaatcccagctacttgagaggctgagacaggagaatcacatgaacctgggaggcgaaggttgcagtgagctgcgattgtgccattgcactctaggctaggtgacggtgcgagactccatctcaaaaaaaaaagaaaaaagaaatattattcttctaaggggccacattggcttaacgaattcagggttaccagtgaaggtcaatactttagatatgaaggagctaatcagagatagcttccgtgaagattttctcattaagaaagtgatttctccaaaatccagtttatgtaattttttaaggctgtaaccaaagttcagaaataaccatttgcagaggaaagctgctgctaagtattaaccttcttagtactgaattcaaaatcttggtttttcctgttgtgtgttttgctgttaagttgtggggagaggttgctcccacctacctcccctaacttctacaacttacagcagccacagctgggtttgtttgtttgtttgtttgtttgtttgtttgttttttgagactgagtctcactgtgtcacccaggttggagtgcagtggcataatctcagctcactgcaacccctgcctcctgggttcaagcaattctcatgcctcagcctcctgagtagctggaattacaggggaccaccatgcctggctaatttttgtatttttagtagagatgagctttcaacggcgcggtggctcacgccagtagtcccatcactttgggaggc

SEQ ID NO: 57135 - DNA, 1234 bp, Homo sapiens
tagtgctcattattaattggaacattacagctggagtcaaagatctgcctcctgaaaggtactgtgttctgatgtttacagccaaattccattaaacattgactgatttattacaatggatacaactcagaaatagctcatgggaagagatgcatagggcaaggtattggagagtggcgggtggagtacacagaataggtctgtgctggtgactcttggaaacactttggcattttcttcccagatgggtaccctcctagtacctcaatgttttcaccaacctggaggccctggaacctccattttcaacaaactccctttgggatttatatataataaaatgctataaaatatcagtttttgagctcttttctgtttgtatatttgcttaataagaatttgctaaatgaataaattttatctgattaagttttcaaggacccaaatgaccaaaataagaacttactgtaagactcaaaatataacaaatgaggttaatttaaatcaggcagtgagtttttggagaatatgttctgtacaacaaaaaaaaagttactacaaaatacccttccaactttgacatattaacatccttatttccttctggctttatcagtctttctaagtcatttaagtctaaaaccccagaatcattattgttgcatctctttattttccatctaattattcatcaaatagcagtaatgctttctttgaaatgtcttctatatatctttgttttcgtttctgcttttcatctcctcatttctgttccttccccttccccttctctcgatttacttctaacagctttatgtccctttcagtcggcctttatgcactaccaaatattcatctttatacagagataatcaatcaaacattgcttgttacctttagttgacccaggtctttcagaaaagtttttttcaaattcagcatttgcatgtacctctatctggtatattttggccaacactaaaaataaggggaaattttgataaatatattacctgaacttgttagttatttaatctatttcacttcagatatctgtatctaattttaaaattatatttacccttactattaaatatgatccttaagaaaattataggaaaaagtacaatagaaaaaaatactcaaaggtaactcagatttcaaaatttactagtatttagaaaattagcctttataataagtatagaacaatgtcgttcctatatctacttct

SEQ ID NO: 57136 - DNA, 1040 bp, Homo sapiens
ccaatcttgaagcatagaattgatgccaatttttaagctacttgctgtttttggttttagtcctgccttttttaagggaagaaaagaaataatattaatttgagagtgtattatgaattatgccattatcctaacagtaacttttattgtaatctcaccatgctaaaaagtatccaaaatattttgagatgggaagggatttgagtttggtttctaatgtttatcttttggtaatccctaccaaattttcatagtaatagtagaaagaaggaaagtgaatattggatattatttcctttacttaaaagcttttgatggatactatttgaattggtgtaatatgctgaagtgtatgtaatggaaaaacattattattttctaaattgaataaaatggatttaataaatactgaaagcagaattaactaagcaaaaataagtatgttttgcttagaaaatggatggcagttgcttaagaaaaaaggtttttttactaatttaagaatatacagattgtctggggaaaagaaacttttttttgtattttacttgtacagtctcacatataaccactgttgttctcatgacactctcctatattgatgtgatctttatatgatttgtaccttttttatctcttattccattatttcttaaattctattttattcaccagtttcccaaataaagctatcagggttgacatcagctatttccaggaaaataaaaaggttattactgctgaacactggaataatttgattatgtagattgaagaaaagtcaatctgttataattgctgtaaagaagccatttaattttgtgcctgtttgcattagtctttttttaactagatatgcagattagtgggatgaaaatatatattctttatttgaattgtgattgccaactgaaagatgaatatgagggcagaaaatgaatctaaatctttggtttaaatgataaagtctttacacattgtagagaattaaataagcagttggtcatacttttatttatcttcaggatcttttgctctct

SEQ ID NO: 57137 - DNA, 2084 bp, Homo sapiens
cctgcattcttaaccagcaaactgcattgcctctaattagtagtgatgagtttcgtgccaagaaattttaagtaagttcttactctttgtacttttcctcagctcaacagacagtcagctaaaactgtggaatgtagggaaaccatactgcctacgttccttcaagggtcatatcaatgaaaaaaactttgtaggcctggcttccaatggagattatatagcttgtggtaagtgaaaccatcgtttccaggaactttttaacaggtgtttgttattgaaattgaactcagtggaaatagaataaatactaagtcaagaaatggtctgtgcactcagaagatagtataatagacatgatgccccagcactactgattttccttgtgttgtactagaagagcattagtccttcccttttttattgtgtagaaaccctgaacacctcaaatacctgaacacctgatttttaactgttttatagttgttctccattataacataattctttagatattgtgtagaagacagaaaaggttaagttctgttagtaatatttccaattttggagacattatgtgtcttcttaagcttgatattcattttcccctatctgctgttctcttcatgaagtaatctgtttgcatagcattgatctgttattctatggcttttattgttgataatttatacaaatttaaataagaaatagaaaaatcaaatttgatattattcaaatgctctgatacatctaatgcctgaatagatgagctttgatcatacttttaaatgacttggcctttgttcagcaaagttgactttctccacatatgtatgagactgccaaagcaaatatctggaacaattattctatctttaatagatggctcaaaaataaaaatacagttcatagaccattaatagaataattcctatactgagaaatggaaataaattatgtaggctatgaaaatctgcctgtgtaagtgttgccactttcttttacctctctaaatggaaatcttcctaaatgtaatttaagattcttataatatatttctggttctactatagacttattaggctggtgcaaaagtaattaaaagtaatgacaaaacccacaattacttttgtaccaacctctataaatgattttatagggtaattttagccttagaattatcagtattgttgtatcatttaacactgattgtttctttagattagtaaagtatagcttttgtccaagaatccttttcttacatgatttctaattagtcctgtgatctagcctttcaaatttgcccataaaagatctttgaactataactttggctgataattactattagactgtgatgtcctaattccgagtttttctattctaaaatactattattattatttgttttcaggaagtgaaaataactctctctacctgtactataaaggactttctaagactttgctaacttttaagtttgatacagtcaaaagtgttctcgacaaagaccgaaaagaagatgatacaaatgaatttgttagtgctgtgtgctggagggcactaccagatggggtaagttttcatatcagttttttcaccttgggatctcatattatgcattatgtatacacagggtttgattaaattttaaaatataaattggtatgtggtatgtactttttaaaaaactttgtaatgtgtcaccaaagacaataggcattttaggtagtgattgaaatgcatagtaatagagcaatgtcatggtgtcataatgtccctctgtgacccatagcatttagtgcatatctcagttataaccattatcatattgtctgttcatatctcttctataagactggaaattcctccaaaatatgcattctgtctcattttctttattgattatgtgcagtataagcttgataaacattaagctgagctggtattttaatagggagggagaaaaagaattggtacaggtaaaggatagtggcctatatggtcctctaattaagtactatttcaaagtagaattgctgtctacaaaatacatttatatatgaatatttaagcatatttagtat

SEQ ID NO: 57138 - DNA, 1263 bp, Homo sapiens
cccccatactgttctcgtggtaatgaataagtctcatgagatctgatggttttataaatgggagttcccctgcacacgctctcttgcctgcccccaggtaagacatgactttgctcctcattcaccttctgccattgttgtgagtcctcctcagccgtgtggaactgtgagtcaattaaacctcttttttttttttttaataaattacccagtttcaggtatctttttattagcagtgcgagaacagacaaatacattcagctttaacacttttagtcctagtaaaccaaatgttttagagtggcacaaaaagatttctggagcaataagccaactttcccaagttacagaagcatttactaatgtattacttgtttctctttttgtttttattgtcctttgcccttagtgaagctgtggtctaccaatctagacaactcagtggcaagcattgaggcaaaggctaatgtgtgctgtgttaaattcagcccctcttccagataccatttggctttcggctgtgcaggtaagaaatgaaagcagatttgtcttcctttgatgttggttaaatatcatggtaaggataggagagcattttaaaacaaataactcttttgtaggtttaaatgttgtttttattattaggctctaaattagaagtatacagtatgccatcattactcatttagtgctgtaccttaattgcactattctgtcacttatctttaatacgtagatatgaatttgttaatttttgtcatttttcttagtgtttatatgcatgaattaatgcttattacttattcacaaacataaggtcataataacatttaaacaattaagctattattaagctatattgtataggcacaggaacactttttttaaggcaaactattctttcaacaattatttattgagtccctactatgcacaaagcactcatctagggacagtgaataagacatagtcttgtatcatggagttcatgctaacatagtattcaaaaaatgtttgctattattatcataccaaataatcatttggtaaattatttttcttaactagggtgaccatatgtcggtgtttgcctgggacagtcctagttcacaccgtttgtaccattgtatttattattagtgccctctttcattcacaaaagtgtcatgagttggaaggaagataaatcatatggtcaccctacccttaatttttttatctttcatattttcccccttgaatatttactaaaatagtaaatac

SEQ ID NO: 57139 - DNA, 1029 bp, Homo sapiens
ggtgacacttagaagacactttacacattaacgttaaagaaataaaacttgtatagaacacttagtgttaagtaacaaatttatggccaactagagtatgtttctttattttaacctcctaattatggtatgattttcctaatggttactcttttgattatttactgagagccaaaggaggccatatgtaaataaatacagtgtattttatttgatttaattgctttagctcttcacctagaagatgatattttcttttaaatttactttttctttcgaagggaattttcgtcaataaattctgaaatttaaattttggaagttaaatgaaattcttactaccatccttgcaaggaaaaagtaacagtaaaggtgttcttattaatttgtatactgtctccttattttgaggatcgcctcatttatatttggcttagtttcttctcatacttgatttcttctacgcttcctccaaaagattatactattttatctttcgatctgtgatgccatcttaggatattaaatagatttcaatattatttcattatatttgttgtattagttttttagggctaccataagaaagcataccacaaacaggctggcttaagacaacagaaatttgttctctcatagtactgaagaccagaagcccaaaattagattgttggcagggccacactctctgtgaaggctctggggaaaaattatttcttgtctccttcctaatttctggttattgatggtcattcttattatttattgacttgtagctgtatcattctggtcttggctctcttcacacatggccttcttctcactgtgcctttgtctctaaatctctctctccttatgaagacaccagtcaatggatttaggacccatcctaatctagtctgacgtaattttaactttgttacatctgcaaataccctatttccaaataaggtgatgttcacaagtacctggggttaggactgaaacatgtctttttggggaacacaattaacacctgttttgtttaat

SEQ ID NO: 57140 - DNA, 1045 bp, Homo sapiens
tttttagatgttgtagacttctggagtacttgagaatagccaaaaccataaatgataaaagtttgattctaacttttagatgcttttaattggaattttagtcataagttataattagtcaagtcaagacttttgggatgtaaatacagaaacccaattcactgtagtttatttggcttatatgatttggcacaactggatccagggggttaaacagtctcatcaggtctgtcattctgccatggtatgccttgagccctctggatagtatcaccttcactgatagacatcgtttcctcatgtatcaaagatggccagtgatagctctaggctcacatccatcttaacagctagtgatcacagtaaaaggtggttagggtcattacttgttaatttttatttttaaaatttcaaaattattggtatgtcttttcccaggtatgttgtgggcagaataatgattgtgaactgatagagaccattttaaaatagtgcaaatctttctgaacacattaaaattatttttatcccattgttatttatttttatgtaaagtaacttttaactgtatttctttcagctgtatcagttggagtagttaccataagaacctgttagctagcagtgattatgaaggcactgttattttatgggatggattcacaggacagaggtcaaaggtctatcaggtaaataagggtactagttacatgttatatgaatcatacatttggtttgttaaaacttttagaacttcatgtgccttataattacagatttgaagtcactatttagtattttttatacctgtgtaacacctatgcaataccaaatgcttttttttcctgtctcccacttttggtaccatatgcttttccaaagcatttcttcagacttcggtctttatggaatgtatcaggtaaatttctaaaagcaataattttggtaaatgtataaaaagttttggaagtactttatatcaacatcttatttgcttttcatttgttttctagcctgttgtctttccctctccccgtaacaataa

SEQ ID NO: 57141 - DNA, 1051 bp, Homo sapiens
atagatacagagcactagctaggcattttgagagaagaaacacacatacatagatattgaagatacattcatacacatagattttaaacctttaaacctttagcctttacactttgagttttacattaagagctttgatctgtaataaagcatagtaattattagcaccagctctgaaaccagactaccttgtgtttgaatcccacctcagccacttacagattgactaactttgggcaatttacctcacctctaatcttcattttctcatctgtaaaatgtagataataataatacatatatcacaggttgttatgaggactaaatgaggtaatacatgcaaaatgttttagtaagtgaatgattaatgaatattaggtattattgtgtaattaattgtagatcagtgagaattcttatcgctaaacctctagaaaagatgcttaaatcatattgaggaataatgtatgtgatgattcatttcaacttttactacctttgggctaattagatttccagctggttatgtaacaactgtgtttaggctgcaagttctgtaaaagcgagtatgatcttgtacttgctttcaaatagcttgttttggagcttatataaaaatgatcagcaagagaggagtgaataacgctgaaggaaaggagattatttatttatttatttatttaacctcttttgtgatatgaggaatgtgtattggggttttataattcagagagatatttggggagggggattaggtatggatttggggaaaagtaatgataattcagtggttctgttatatgtattccatccccttgtcatcacccaattgcttcagtaattcaaattatatactaatttatttattaaaaataaaatttaatattgtgaaattctactacctccacaaaatggcagggaaataagtagaatgtatggaaaaattagttgataattgtcttttggcatacttttagtatatcaaatgattcacgccattaaatctttctcagtaagctgtaatatggttattagaactgaatgaaaagca

SEQ ID NO: 57142 - DNA, 1971 bp, Homo sapiens
taaaatctgagacacaaacacatgtattagcctaggcctacatacggtcacggtcaacagaatcactgtgatctcttccacatcttgtctcactggaaggtcttcagtgccagtaacacacatggagctgtcatctcctatgataagatcttctggaatacctcctgaaggacctgcctgcggctgctttacagtttgtttgtttttttttaaaataagtagaagatatacactaaagtaatgataaatgtatagtatagtaaatacacaaaccattaacagttgtttattttcaagtatatgtactgtacattaattgtgtgtgctgtacttttatacaactggcagcatggtaggtttgttcacaccatcttctccacaaacctgagaatcgtgttgttgcactgcaagtcattaagttaggaattgttcagcttcattataatttgtgggaacataagatgtccttaaatagcacataactgtaatgtgttttttttaacatcttggttttttcagcagctatgttagtatccagcagataactggcactctggacatttgatggctgaaaatattcacggttcattcttttcttcgaatgagccccaataatcattgcctcctgaattcctctatcaatattttgtcctatcatttgacatttgcatatattgtctgtaatctcttctactaattataaaaccggtgaggctaccttattcttttttttatccctttgtgtttaaattgttgcacaggctgaattatgtgttattatcactatatataatgtaatgtatattattattctgtgttattattcttattttgcctgtgtatatgttcattgaagaccagctcatttgttctaattgaaattgcaagtttgcatgatgattgagagcatagactctggaaccagttgcttaaatttgaattatctggtgtatccgtggacaaattacttaacattagtatacctcagtttctttatacagtggagatttgaagcttgtataatttatgtaaggtggttaaaacaatgcttgacacatctcaagtgttatgtatgttatggaagtttcaagtagtattgattggaagaaagttgagtaacatcaattcttaatttactttacttgtgtttgtatttttttaaagatctgctcatcacttttcgttaaaatggccagtttctaaacgtatattttgtttccttaaagttttagttacctgctcttgaggcacactatcatggtaatgaatgagaatgagacctttgacaactgctcttactttatattttaatttgatataagttgggctctagcatccagggacactaatccaccatgtttgttaatacttataattgcaaaaagatatgagagacattggaaacactgacaaaattcactgcttgggcttattgacggctttcattgctttgtgccgcattgtactggcagtatgcattaatcagctgtcctgtgcagtttcttgccttgctgcttaatcacttgactaatgacatttttgacaaagaatacagctagtttcctacagctgaattacgtatttcagctgttgatataaatcactcttttaacagttgaaatgtttcaaaatgtgaaagaaaaatgcaatttatgtccccagaaacacgatttttcaaaagtatacttgtatgttgaaattaaaaacaaattctgtgaaattgaatttgtcatgcagtaaatttttataaatctcttgttttaattattactgctgacagtggatggcagaaatgaacgttgtatagcagtagtaagacttaaagtttgtttttgaatttaattgcataagcaacatttcagttaattagtttaccttttatttagtctcagcctaactagtcactgtttaacttttgaagtacttttgcttgggttatcagatttcataataaaagtagttgaaatatca

SEQ ID NO: 57143 - DNA, 1320 bp, Homo sapiens
ggtaatgaaaaagtgtttagggtgtggtcatggttgtgtgaagtggaagtgggcagaataaaagatctttggagaagaggaagtcaagaaaactgatagaccaggatattaatcatctatatatagttattaaaataattaacaattaggcaaggaataatttttaagaaaatgacagtgagctgaaagttagaatttccaagaactcgtgggttggtagaggagcatcaaggacacatattgggtggtatatgttacaggagattttgagctgggaggtttcagggagaagagagaaaaatgacgaagaagctatgtatagtaagcacactgaatttacttccaggcctatttgaacatggaatgtgggaagactttgaggaagcagtatattcaggggagagctgggtttcacttagaatgagaaagcaaggggagcatttagggaagaaattgcaattattaatggcttatctgggtggagagagatttagcttttacttaatagaaaagtgcacatattttttgacctagcacttcatattctaggtgtatttaagagtactcttgcttatgtgtcaattgacacatatagaaggggttttttttttccccagcattgtttaacagtgaaagactagaagtgaaatgttcctggttaaataatttgatacatccaggcaatgtaaatctgtgcaaccattggagacaaaaatgaggttgctctcatatgtgctgatatgaaatgatggtcaaaatactatggcatgagggggagaaaagcaagtgcaaatcagtatatatgatgtcatctcatatgtttaattgaaaaaaaccaaatacgtgtatgcgtgtttatgcataggaaactagtaagatgcacaagttgaaattattggttgcctacagagagggcaattgggtacttatttggcaagagtgggagggaggcttgctttttttctgtatactttttgaaccattgcctacataaatttttttaatgaaatatgttctaagaaaacactcaagccacattttgaaggatcttcagtaatagttggagtctgaattttacatagtagtaaatggggagaattatatgaatagagctgtgtgtttggaaatttatcctaattcagtctttaaaatcgattggaagagggaaatttcaggagtaggagtcttgataaggaggctgtttcagtagcccaggcccaatatatacttctgtgaatttctcaaatacagtcctgcattgcttaacgatggaaatacattctgaaaaatgtgtcattaggcaatttttgttgtgcaaac

SEQ ID NO: 57144 - DNA, 2068 bp, Homo sapiens
aaatattcttctaaactgtaaatttttgctccacgttagtccttggtaggattaaatggtttctttatatcatagttttaaggtttcctgatgaaacatcacagcagtgacattactgatttaatattgtgatcctattggttgctttgtaaatactaccagagaacacagaactgagaaattagatgtattttattttgcagtttcaaaagttaagaattgaaattttagcttcatatgattctctgttgagtctctgttgtacttttactaaacacacatttcaaagtgtttactaaaaacattttaaagaggacaaaatgtcgtagtaactttggggacaaaaatatattttctttttcagctcttgttattttctctactagatgttgttctgaatgaacaaaagttgatattaagtatattgattttaaagggcatctttaagtgctttaaggagaaagacattttatcacaaaataaacacttgatattcacaaaagtttttcagaatatagtctatcaggtagtgtatttatttgttttagctattcaatgatagccagagggaataagaaagtaaatttttttaaagtagttgttttaaagcaagatcttgaggttttatggaattcaaacaaaatgagccacctaataaaaataatagaataaaaatatgcatagactttaaaatgtggcttcaatttagtgcctatggaataaagtctgtccattaattcagaataaggtcagcaattatctagcaggttgctattaaaaaaacagtttaaggtcagcaaactaatacctgcgagtcaaatttcaactcattgcttgactttgtaacaactaagaatattttttacatttgcaaaggttgaaaaaaaatacaaaggataatactttgtgacatgtgaaaattcagattctagtgttcataaatgaagttttgttggaaccactgacgctgttctgacataaaattaatagatatcaatggctcacacctgtaatcctagcactttgggaggctgaggcaggtggatcacgaggtcaggagttcgagaccggcctgactaacatggtgaaaccccgtctctactaaaaatacaaaaataagccaggtgtggtggtgtgcacctataatctcagctactcaggaggctgaggcaggagaatcacttgaacccaggaggcagaggttgcagtgagctgagatcacaccatcacagtccagcctgggcaacagagtgagactctgtctcaaaaaaaaaagaaagaaaaaagattttgcaaactccctaactacaaatttttaaaaaattatagtgtcttaattctaatataaaggagaaataaaaggaaaataagatgattttaatttgtaaatacttacctattctgtatggttaaaataaggagatggtcaaataataatttaatgactcacttgttttattgccatacaaagataatttttttcttaggttcacaatgcttaagagggagagaataatgtgaacaagtttcatacagaatacacttgatagatgaattacattaaccacatagtgagtgagctccaaaattattaaagtctggttgctcaattaggatggaagcagggctctgtggaaagtaaagtttaattaaacattaaagtgtgcttttgtgtgagcacagctgagatctgcaaccacctgtaaggtcccttgaagttagagggcagtgctggtgttacaaagcaaggcttcaaagctccaatccatgtcacagtctgagcattcagtcttctgagaagtggctgacagagtgaaacttgacacagcctaagctctcaaagtgttgtcaagctcttaggtttatatatgtttgaagtccagtagttgaagtcagtaactcacatatgggatctgaggaggcgtgttaccacattccagaggggaggagaagtttcaggttcatatatgggatctgataagaggtcacattcttttttttttttttttttattgatcattcttgggtgtttctcgcagagggggatttggcagggtcataggacaat

SEQ ID NO: 57145 - DNA, 1103 bp, Homo sapiens
taaattgtgtaaactagtctttagtaaaatctttaaaaattgttttttgtatttagaatataaattttaatttgtggatgtggctctttgacttactttgcagttcaattcatctgttttgtcttttttttttttttttcatatagatgacagtcgaactgcaagccagttggatgaatttcaggaatgcttgtccaagtttactcgatataattcagtacgacctttagccacattgtcatatgctagtgatctctataatggttccagtatagtctctaggtaagtattggtcaaattactattttcttttgtaagaatgtctagaatctaattgaatttgagaagcacttataccattattattaaaagcgtgggttctgaagtagcctgccaattattagttctgtgattttaggcaagttcctgagcttctatatgccaaatttcttcgtctctaaagtggaataattgatagtatccttctcataaggttgtagcttgttttcttgtactatcattgtctagttttgatgacagtatgctcttctcataagtgcttccacctctgcattttctgtaagtttgtatagaattggtattatttcttccttaaatattttgtagaatttgccagtgaagcttccagaaaagaattttaactaccaattcaatttgcttaagagatttagggttaatcaggttatctatttcttcttgatttagcattataattagtttgtgtcttttaagacatttgtccgtctcatcagggctgttgaacttattggcgtacaattattcataatattgccttattattctcttaatatctttggattgtatgatgattttccctctttcatgcctgatagtggattttgtttcttcttacctttttcctgaagagtctagcttagaagattatcagttttattgatcttcccagagagccagctcttggttttactgataggctgtatttttttgttttctgttatcattaatctttgctcttaattatttttattcttctactttttgagggtttaatttgctcttatctgctaatttcttaagataaaaattgaggtcctttagtt

SEQ ID NO: 57146 - DNA, 1673 bp, Homo sapiens
atactgaaaaaactagttttattgttttctttatggtttctgttgaaagtagctattaatgagcttatatgatgggcagaaatccagttagcctagaacaggattattagcttagaacagaatacacaatattgaatgcttgtgagttttatgtacttaggaattgatatcaaaatgggaatgaataggataacattgaaacagtttttaaattaataaaaccaaccatctttccagtatgtagaatgttaaataactcacagtaataggattccatataaaaagaatcattaactattatatccagaccactctgcagtacagttgggatttttatttttgcaaataacccatgttttatttataatacgtggaatttcctgagaataatttttgtggagcaagagttttgtctcaataccgttatgatattgcctgttaggtaattccttttgctgtctttagaatggaagcacaactaagtggaccctttaaatctaggtgttttgatgaatttgcttagtgtttaaatctttaaaatttgtaaaatatcagggacaaaagctcactcagtttcctcaagtaatgttatttatttttcttctttcttttttcttttttcttttttttttgagatggagttttgctctcgttgcccaggctggaatgcagtggtgtgatcttggctcactgcaacctccacctcccgggttcaagctattctcctgcctagcctcccgagtagctaggattacaggcatgctccagcacacctggctaattttgtatttttagtagagacagggtttctccatgttagtcaggctggtctcgaactcccgacctcaggtgatccgcctgcctcggcctcccaaagtactgggattacaggtgtgagctgctgcacccggccctgttgtttatttttttcttataataattgttacataaatttcgtcatgcaaacagttattttcaagataacctaatatctccagataacataaattctttactgtgcattatattatctgcataactcttttgacttaataattcttgcatcttacttttattatgcttactatacttcagatggcatttaagaagggaaatcatgaacatttaccttgaaaaagttgtgtgtgtgtgtatgtatgggcttagaataaagaagctatgaaaatacagtggtataacaaacttgtctcagtttcagtctaggaaactaaagtgctcattgtttttttcattcttcagaaaggaaagtatatgttcaaacgacacagtgctgaaaagcaatgattttttaaatctatgcttttagtgtaggtctgcttctattaatagactggagaatagattcgttgtattctcaggtacttcgtaaactgatactatgttttaaattccacatgatttatcttccaatagtttactgaagtggactttacccaaggtttttgtatactgtaccactggatggaattattgtttttcatatttcagcaagagatttgaatgaatattttttcttgatgaaggcactttgagataaaaaggagcaatttcaaactttttttgtttgttttttagaattaatagttcataacattgcagttttctactgtcttcctgtaataggatttgaaacatttcagtatattatttga

SEQ ID NO: 57147 - DNA, 1075 bp, Homo sapiens
cccaaagtgctgggattacaggcgtgagcgaccgtgcctagcctaagcatgtttatagtagaaatagagaagaagaatttacaaaaagtaaataatcgtttatacggttggtatgtatgtcatgtgattttcagttgttgatagttttttatgtaaggcttatttaaagatgagagggagataggaatgatgaaatggtaagatagaaatgctaagatagaggaagtaaaagatagtctacacttctggaggtttttttagggttagatagaatgaatagaggatataaccaaataaaaagaaccaatggagaaagcagattatgtttgaccagagcagaggaaactagtatattggttttgggttacaaagacaagattattgttattttaccatttattttattcttttgatagttcagtttttcacatgaggtttgattataatattttgaagctgggagggactctagatgatatataaatagctagcctacatcacctcatttttacagatgaggaaacttgagtaattgattataagttaattgtccaagaacacatagctttttaatggcatagcagggtgtgttaaccatagattttgattgcatgcttgtgctcttttcccaatagtgtaaattttcttttccttaaagttctccaaaccttaacctgtctgaaaatgaaatataaacaagtaaatctatatagacatctgccttgtgattatcccctattgacattatttcttggtttatatgtttgaggtggtgggttgaagtggtaaattgcttaaatatttgctgatattttatgggttgtctatttgatgtctaatgattggcaataaatattttcttggcttagaaattagaaatactgggcttatatatgatatactttagatttactttttctgttgttaaaataatgtaaatactgaaatcacatttttttctcttcattttgcagtagtattattgattccacagaatacagccaacctccaggtttcagtggcagttctcaggtaaacgatatctttgtttgctttaatgataccatgagtataa

SEQ ID NO: 57148 - DNA, 1050 bp, Homo sapiens
gggcctctctcttgcccaggctggaatgcagcgatgcatagctcattgcagccttgaccatttgagattaagtgatcttcctacctcaccctcctgagtagctggaaccccaggcgtccaccaccacacacagctaattatatgtagaaaacggagtcttactattttgtccgggctggtcttaaactcctaggctccagtgaccctcccaccttggcctcccaaagtgctaggattataagcatgagccaccatgcctggcctcttctagctattttgaaatataaatacattgttgttaactatagtcactgtaatcttctgtcaaaccttagaacttctttctttcgtgtaattttatgtttgtacccattaactatgccttaaaaaaaaaagactgctgtgtagacagattcatatgatttatttttgaaaatgtgaagttttatgttaactaattttgttaataaaagaaactaaagtttattgaatgtttaccatattttggcatcatactgtgaacttcacatgcattatcttatttaaatctcatacttctctgatgtgtcttcatcatttaatagatggagaagctagagctcaaataagattaatcacttgcccagagtcaggttattcacttctatgggtaaaattcaaactgtgtactacttagagtacctcccatgctttaacctttgaggttctttcagtactaagtaattaatcattttgtatgtttacatatagaaccattctaattagtaatctcaattgcttaaattttatagggtagaaagaatataaacttttttgttggttttttgtttgtttgtttgtttgtttttcgagacagagtcttgctctgttgcccaggctggagtgcaatggtgtgatctcagctcactgcaacctccgtctcacaagttcaagtgattctcctgcctcagcctcccaagtagctaggattacaggagcttgccatcacacccagctaatttttttacttttagtagagacagggtttcaccatgttggtcaggctggtct

SEQ ID NO: 57149 - DNA, 1005 bp, Homo sapiens
tgaacctttgaatttttaattaattgtttttggaatgcttcttctaagtatttctggagtacttctgaggttatttcagataattgtttttttaaaccctgatggattgtatcaactatatcatctgataatttaaaatttctactgtgtgaattacaaataaattgtaatctactccaacttgttggaaagtagtagtagaatacaaactagtcaaataaaccacgttgtgtaatgaactgaaactttaacttattttgttggagtcaaatcagtcttgttggtcttattcctttgagcttatttttgtctatttttgacattctaccaaccgaagtagtttacttccaaaagtgataaagcaatagactcagacctgttccatcttttagaaattttccctcatgcttgctttttatatctgctagcagtaagtttctaaggaaactcctcttacaaaaaaaactttcaaatgagctgctcttttgctttcctttttcagtttcagaattattatgtaataaacattttaaaaggcggtataagtattaggttccatagtccctgtatgcattatgtaactgttactttttgtaaccatgtactaattaaaagaagacaagaggtgctggggaagtttttttctggagttctgaaacactgtgatagcgtctgttgtttgaagaataaattacccctatgtctttcctgtagaaatcatagataagtactctgtggcctagtacttctgttattgaactaaccttgcattccttaagtaaacctaaatttgtatgatatataagtttccaaaatttttttggaaatcttttgggtcagagtatagtcatattcctttcctgccttcaccgattttggaaaggtaacagagtacatatgccatgtatcgtataaaactgatggaagaataagagggactttcccatcaagcacattaatatttcagcgttaaaacatgatgtcagatgtgttcagaccaggttt

SEQ ID NO: 57150 - DNA, 1017 bp, Homo sapiens
aatagattatcacctgaattaatgatatgctagttcactattcacatagtataatgtacatgtcatttaaaatatttacatttacatttatctttttttgcatgtggtggcttcattaatgatgaacaatatttagtaaacaatttatagttctttaagattgtgtaccatggaaaaggcttgtctcttaacttttcacatgtccttgcttttgtattctgtggagaggaagccttcagaaatttgatattgagacaaacagggactgatgaaaacctgggaatagaaaggaatatatcatgcctctttttgatttatatatcttctatttgaaatatctactataattcaaataattttattttcaggaaatgagtggcttatactctcctgtcagtgaggatagcacagtgcctcaatttgaagctccttctccatcacacaggtacaagcttcacacttgcaattgattagaattcatattacaaagtatgcatatggtctagtcctttaggagccttttccatgcagtgtatgaaacccctgagaaattactttggtcatgatctagaaatgatattcatatggcccatctgtttccttaatgcgttggatttcatgccaggaagagttagcgagtagaatactataatgttatgaattcacagttggattaaaagtttgatgaatttcttaaagtaatgatagctttaaatatcttgtgaattaaagtcagatgacattcaaaaatctaaatttgagaacatgaagtggtaatattagggaaaaatgtgataaaataaaaccttggacttctccccctaacttgttaaattttattggacagatcacttttcccacatttaaaatgagggcagtagacagatctgttagtttagatttccttggtattttcttataactacttattattaattcttctatatgcgatattagtatagggttatatttgtcatgaccatttcccaagattttagaataaagcctggtttcatt

SEQ ID NO: 57151 - DNA, 1022 bp, Homo sapiens
ttttttaagccactgtcattcatctcatacttttattgtaaaatcaaactgttgtattaaagaagtacaacattgtgttttcacataattctctacctttgcattaaaaaatgggaacttctagctatattttgttgatggttatccctcctgttaatttgccattagtgccaagtttgatagaaattattttcctaatgtaaatttattttatgatcatggtgatgccattttggtttggcttaggcttttttttttttgtctttctctctctatttaatctgcagcaactggaacagatccagaaggagctaagtgttttggaagaggatattaagagagtggaagtaaggaatcaagaatttctcacatccttagcaatttttcaatttcatgaaattgtcacctttccattaagttgctgtgttaagtttatgggattggtcttaggaagaaagtaacagctgttactttcatttcaattgaggatgaatttttgtagaaaaaaacattctgaacacttgataaaatatagtctaaatttgttttacaatgttttattgccataatttttctcgattagactgacaaaaaaaatcgctcagttttcttggagtgccatcataacttaaaactgtcaattattaccactacaatgctttttttattaataacttttacatacctactctgtgcatttctaggagttaaggttaattaaaagagaaatataagaatacattaccaatattctgggaatttacagtttaatatagtttacctaaggaaatttatgggaggatccttgggagtcttatagggtattatgatttgaagtttttgcctttggctgtatttattaatttagtttgtgtttttagttatttatatgtattgtaatttttttttgctgatacatagaacatgtttaagattaatggatttaatatttagtggatgttcagtatcctctgtagcattcttaagttgttacacatttatgtcacttacctgactgtatg

SEQ ID NO: 57152 - DNA, 1173 bp, Homo sapiens
tgtttttgttttttcacttttcaataattgccattctgactggtgtgagatggtatctcattttggtttttgttaacatttatctgatgattagtgatgttgagcatttttttatgtgtgatggccacttgtatgttgccttttgggaattgtctgtttatgtctgtgcccattttttaatggggttatttgttttttgtttttcatttatttacgttccttgtagattctggatattagacttttgtcagatactcattcttctttttaaatgtattttttaaagcaattattctaaagacctcttatatatagtaaagcatttgtttaaataaaaatttcaagagtggaacattttaaggtagttaaatgaaaatgtttaagagattaccatgggagtgttttgctgaattagaggtcagcatcactggatgctggagttgaaaatgtccatgaacccaaaggcctcagtgatggtggagaataactgggatgtttattgatggctcaagtgggtggacagggatttggctgcttggtatgagctagacagagtggtttttatgttatggtggaaaactaattttagggtggaagactaattgttggaaatggccatggaatggagtagaaatagtgagttcctatctattaataagtcctgtaaactctggggctttagagactttatcaattgagcagtatcaattgagcagctgttatttgaaagagtttcaggacagacagtgtctttaagagtgagcagggtttcagttaaggtggcattgtgtgacatattttaaggcggcaggaagtttattaaagtagatagatgagttgaaagcttttgaaaatgctaatcactcttttaacccttgatttctccaatggtactgtcatttcccctggttttctggctgcgactttgcccttcttgattgttaatgctgcttcttcctttgcccatctctttaacattggtgttttctaccatttcagttttgcttttatctcttctgactatacttattgatgttaagcagttttatttattgccttactttcagatttattatttacctttctcatggcttttgtaccttcgcatatgttattatttactctgcttattctgtcatgcctcactgttttccacttggcagaattctgtta

SEQ ID NO: 57153 - DNA, 3524 bp, Homo sapiens
gtgggtctgtttctaggtcctcttttctgcttcactggtctttttcgcaataccaccttgtattaaatactagagctttgaattaagttgctgttcttctttaaagtctgggatattcctggctgtctgcatttcagtataaattttagaatcagctagtacgtttccatggtaaacttactgtgctttttattgggattaatttgactagataaatctgggagactgtgtatttacagtattcagtcttctaatctgtgaatgtggtacttccctctatatttagatctttaaaatagccttaaaatttttatatttttcagggtagtcttacacatctttattttagatttagtcatttttgatactattgtaaatgatgtctgtgtctctaactttagtttcttattattgctagtgtgtagaaatacaggtgggttttacatggagatttttaaaaatatccagcaacctggttaaactctcattaatcctaatttatttgtagattcttgtatgttttctatgtacacatcataatctgcaaataataacagtttagtttcattctttatgatccttatatcttttatttatttttcttgtcttactctgctggctaggacatccggtacaatgatgaatagaagtggtgatagcggggcatcctagtcttgatgctgatctcaaagtgaaagcattcaacgtgtcaccattaggtatgatgttttctgtaggttttttgtaggtactttttatcactcaaggtagtaaatttttacccagtttgctaagagaatttttaaaaaatttctgagtggggttgagtagtctccagaatttttgtgcatctgatgcaaccatatgatttttccttttcattctgttaatgtgaataattactttggtttagcattggggagtcaatcaactttgcatctagagtgaccaaccatcctgattggcccaggggtgtcttagttatatcttagttatatcactgaaggttctgcattctaggaaaccccaccaggacaattggtccccctacttgcaccccttatataaaccaaacttggccgttatgtatattctcttctatatggtttggtttgcttatattttgtttaggatttttgcatctatgttcatgagtgagattgttttttttcttacacatatcttgtccagttttgctataaagattatgctagctttatcaaatgtgttgggaaatgtatcctctttttaaattttctggaataattttgtgtagtctaagaacatcttttttgaatgtttaaagatcttactggagaagcagtctagacctgtgattgtttgcgggaagttttaagttattgaatctgttacttgaacagttacattcttattaaggtttttgttttagatgtcacttttcatttgttaaattttttctagtcattgtttatgtcatctcaattttcaaatttattggcgtaagattggtcttaatagagtcttaagtttttaatgtcaccagggttcattcctggcagtgtttattttgcttgttcctctctctctctctctctttctctcgctctctctctctctcgcttgttctgttggatcaattcttgccaggaatatatcaattatatgggtttttttctaataactaacttttgactttgtttttcctctctgttttgtttgttttctgttttatttatgttctttattatttccatcctgctttctttggttttacttttttgttccttcctaatctgttggcttgggtggatatgcatattattatgcagattattttttctaatgtaggcatttagggccatagtttcttattttttaatctgtacctaattcttttggcatcatattttgtttattattgttcaaaataatttctaattttcattatatttttttcttaggcctgtggcttatttagaaacaaatgtcttattacttgaacattgagattttgttttttttttgttctggatttctgttataattgcattgtagtcagaaagttgtgttttctttctttgaatataatatttgctgtaccaactggtaattggttaaattttgaaatacttgtgcttgaaaagaatgcattttctgcagttgcatgattcattgtaaagttgttaaatgtgtggtgagaatttcctgcattcataccaggtcttcctttccttgttatacctattactgtctcattatcttttaggtgaatttcttatagatagcatatggttggactatgctttgtaaatctactctgccagactcagttttttaattgtgtatttaggccatttatttaatataaatattatagcataagcctgtcattttattttttgttttatatttctttttttattattgttgcttttctgtttttctttccatgggtttttgaacagtttcttttcggaattccattttgatttatctataatgttttaaagtaaattttttgtatcattttttagtggttgctctctctgttacatcatgtatttgtaacttatcagcctactggtattgacatctgtttacatttgctcttaaataagccatcttattttgtcccctcactactctatcatttatttatttggttttgttcttgctttttctgttttcttctcagcttaaaacaaaatgttggctgggcacagtggctcatgcctgtaattctaacacgttggcgaaggtaggaggatcatttgagggccaggagttcaagaccagcctggacaatatagtgagactttgtctctacaaacaattaaaaaaaaattcgtggagcataggggcgtgtgcctgtagtccccgctacttgggaggctgaggtgagagaattgcttgagcctaggaggcagaggctgcagtgaactgagattgtgccactgcactccagcctgggtgacaaaatgagtccctgtcttaaaaaaaaaaaaagaaaagaaaaagtgctatgaaagggttaaatgaagtcttttaatcaggtctgccatttcaggaactagatatgaagtatgtgagtgtttgtggagtgatagtatgggatgacaagggttttggcttgctgtagtgtgcacttcatatggctaaatgctttgtttttgatagtaactctcttagaattagcatatattaagttttgctgctgtatgtatgtatgtatgtattttttgagatggagtcttgctctgttgcccaggctggagtgcagtggcactatctcgcctcactgcaacctgcacctcccgggttcaagagattctcctgcctcaccctcccaagtagctggtattacaggtgcctaccaccacgcctggctaatttttatatttttagtagagacagggtgtcaccttattggccaaactggtcttgaactctgaccttaggtgatctgcccgcctcagcctcccaaagtgttgggcttacaggcgtgagccaccgcacctagccttgctcgatttttaaaatca

SEQ ID NO: 57154 - DNA, 1459 bp, Homo sapiens
ttggccaagggagcagttatctcaaggtttgactgggataggaactttccaagctcactcatcagcttttggaaagagataacaatttttttgtcacaggggcttctccataggatagctcactacatggcagctggctgcctctcaaaaggaacaagtaagaaagcaagagaggatattgaagacagaagtcacatgttctttgtaacttcatcttggaaattatatcctaaaacttttgctgttttctgtttgttagaagcacatcattggttcattccacactcagaattgcacaagggtttgaatactaagaggcggggatctttggaggccatcttagaacttgcctattaacagcgtttgttagttatatatatttaaatgaacatgttagtcttccttcatggtcagattaaacaaaagggtgttgggttccatgtaaaagccagtcttctctgtgcaaatttgtaccagcatttgaatgattcccttctgtttcatttgatttaattttaaaatgtacttttggaaatttttgatacctattaaatttactgtaatataatcgttctgatgagtcttggtttccttttggttttacttggaattttagtgaattgaattttaaacgatttttatatgaaaaacacaaaaaagtatataaaccaaatttatagtttaaagaattacagtagagtgaccatttgtataaccaccattgtaagcacaatgcaatactgctagaacggctgaagcaccctgaccaccctttttggattgcagtcatcttccttgcccattaggtaaccaatattctgataattatggcagtcactttcttgcctttctttaatgttttgctgcctgagtatccataggtctctctgtttttgagcgttatttaagtgtgcttgtgcagtatgtaatcttttattcctatcttcttcggctgaatgttaagattcatccacatggttgtatatgactgtagttggttgatttttgttgttgtatagtattccattaagtgaatatgccccatttttgttgttggtcgtcatttgagttgttttcagtttggggctgttggcaaaaaaatactactatgttatatgtgtatccaggtttatgttagtatacatatttatatggaatgtatttagaagtggaattgatgagtcataggatatgtgtatcttcaaatttaatagataatgccaaaatattttttcaaaacaagttgtattagttattcttcctacaggcataggcattgtatgagcatttctgttgcactgtgttcttgccagtatgtgataccagtagattttttttccagtttagctaatcttggggtatatacactgttatatggttgtaatttgcattttccagatgacttatgaggttgagcacctagtactacattgattggccatttgggtttttttatgtt

SEQ ID NO: 57155 - DNA, 1777 bp, Homo sapiens
gcttacccttcaccatgaggagaaaacttaggaaaatttagataataaagccttaggtaggatatagtttttttcttatggtaaaaacatatgtaggcaaaaacaagtaaaaacatagctacctatttagaacttgggaggtctaactcatggaggatagttaaaaggcaattttgtatcaacagttttatagcgagcatgttctaatttaacatttataaaatttctcagtcatttcacactatacaaaatatgggaaaattaaatagtcaaaatcctgtgctctggatagcatgctaaaataactttgaaaactttttttttttttttaaatttctaactggctggaacctggtatgtttatgttaagaattgtctaattaggatactttttactcatttaaaaatgtgtaaattgtctgttatgtgctatgttctgggctatctttattctttttgacaataaatagataagagatgttttactggatgatgaagtgttgaatagctaaatattttttatgtggtttgtgactagatttttcttattctcaactgttgctaatttagttgtgattttaatattcctactaacaaacatctgttataaatttaagatttacttgtgtctcaggttttttttttgtggtaggaaagaagaagatgtccagtcattcatttgtttaaatgtctggtggtgcaatataaatggcaatgtgcatgaaagttgcctgttacggagcttgtggtgagccgagatcgcgccactgcactccagcctgggcaacagggcgagaatctgtcccaaaaaaagaaagttgcctgatgatcttgctaaaatgcatgttcagattaagggaggctctgttggagcctggcaatctgcatttctggagagataatggagaattcctttccaacattaattcttccgtgtgatcttcatttggcctttgatgtggtggcccatggcctcccacaacaccatctgtgatattgactttgattttatagctttggcatagtgtttttatatttccgttattaaacttctggatgaatcatgccgtagaactttttcgcttgattttggtttgaatctaagctaatgtttgtgattaatttttttttcttttctcttggaccatattttcttgtagtaggtgggttaaccaagaaacatactagttccaaatacttctggatatttgtgcctctagtgtacagtgattgtactgtcattaatacattttggttttcttgattttgatatatctgtgattgactttgagtattttagttttaattacacaagaaattctgaggagctaggtaacaaattgtaaacgtttatctactactttgattaaatttcttgaatttcacaataattggaattgggtactatagtgatttgtaattataataagctttagtctagaaaatatgttttagtgcagacagattgaagtgagtggttatattttcttcttccatgtaagtctatttgcgtgtttaatcttcaaaatgaatataattgttacaggtcttaggacctgtaatatggtttatatacttgaacttattcaagtaaaatacagatttaccaggaggcaaattgcttcttttgacattcaaactttgaaaattaacttcgtgatttcatttgtaacttttaattggagttctgttgagtgtagttttagacattgatatataccaatcagagaagttaaatatgctttttggatttaatgttaagattcatttaactcat

SEQ ID NO: 57156 - DNA, 1176 bp, Homo sapiens
gcttagtgagcccctgtgtgcctattatggcccatttctaatgttgccttctatatgaagtgtgcttgttaacattttgattgatctctgcgtgtatactttgtaaatctattttaatgatagtactgattatcacattatattacaagtactgtatcatatgcatctgtcttgctagtctgagttgcttgagaccttggattgtgtctttgaagcttggatccttatgagcttggtatctgtttgttgttttcaaaaatatttatacttgcattgtgatatactgggaagtatcagacagttgggtctatattctcagcattgtctcattgtatatgtcaccatgcataagttacttatgctctctgtgctaatacttcttcatctctaattggggaaaataatctgtaagatattgtctataaagtgccttcctagcctagtggtagtttccctttttaaaaaaaaaatcagttttttgtgtcagtttatatttgttggttgtagaaaaatagaaagatccaatttaaagtggttaaacattatggaaaatgtatcgattcacgggaaaagaatttctagaactagttatcagtggttcagtggtattgtcaggttctttctcttgttcttttcttccattgccagcatataccttggtcttttggctggctattcttgaggttgcaagatggctctaagcagttccagatatcatccccttatgaaggcatggtttttttctcctatcctttcctttctgaaagatagcacatctctctttggtcaaaattgggttacgtacttaaccccacatcaaccactggcaagggcatgaatgactagattgccttaggttagtcaaagtaatacatggggttggggtggaatctaacctctctgaaagttatatggcagtctgacacttggaaaaaagtcatgttattatcaagaaaaagagtaggatggtttttggatagttagctaaaagtgtcttccatggtatttttagaagaattacaaagaaaaagaacaaatgcaagtctttagtacttaactcatagtagatactcagttactcatgccttgttaccatatggggcatgtgatggtctcacatggtgaatgaggatttctctctcagcaagtgccaatagcgtcatcattgagaaacat

SEQ ID NO: 57157 - DNA, 1092 bp, Homo sapiens
tatatcagggacccctgggccatggactggtaccagtctgtggcctattaggaactgggctgcacagcaggaggtgaggggctggcaggtgagcgagcactactgcctgtgctctgtctcctgtcagatcagtgggtggcattagattctcagaggagtatgaacctgattgtgaactgcacatgcaagggatctaagttgcacgctccttatgagaatctgatgcctgataatctgaggtggaacagtttcatcctgaaaccatcccttccacctcccttcagtctggaagaattgttctctatgaaaccagtccctggtcccaaaaaggttggggactgctgatgtagatgacagactggatgtgaggtttaacaaaaatggcagcagttctgaacacctttaggtatccctgtgaagtgttatacatccctactgtttctgcttttgcggcagaagtgagaaagagtccatgggtctcgggaactcaggtttgttgaatattgagggcaaggggacaaaaaaacttgggtgtgatgcttgctgagttgggagtgaatgggtgaagagaatctgaactagggaggcaattaaaaattaagaacttgggaaggaatacatggaggagaacttttgagagaggagtggtaagaactagagaagagagacatgaatagggaatccttaagtataaatgataaatgatcggaaataataactagtcagaaccaactgtgaatatcagaaaaattctgcatgttaactaccctaagatattttaggaaacctttaatctgaatgttttgggaatgaataataagctaaagaataattttcaggtatgagtaggcatgaagtagggcactcttgggattatatatcaaaaaggtcaattctgcattttaaagactaatatgctcagagttagggtgtggtgactacttttgtattagattctgacctgctagtactttggtggcagtttgatttttagctcaaattgttgtttaaaataaattatgaatttgaacgtattcagctatggttttcctttttatctgctctaaaagtgccttagctacaatagttttt

SEQ ID NO: 57158 - DNA, 1063 bp, Homo sapiens
acgtgttttaaaccaactttgattatgttacagtcatattttttttcttgacatgtctttgtagatgtggcagtttaaggctgttaacataatggctggcgcataatttctgtcaaatgtttagatttagaataggccttactgatggatttgaaaacttctgcgtttattaattgttaataggaacttttcactcctgttcttagtgatgctggacaatcaggaccaaccatgaagcactaattactcacttgtggggataggttggagaacgcagtgaagcaggctaagaaggtcatggaaaaagaatacaggattaaaaagttctgtgttcttttctttaacactttgctcaatattaactttacattatatcatgccaggttaactcatacatcaaaaaaattttttaattttaaaatttacataataccgaatttatatattttatatatttttttctggttctttagtcttggaggaatttataattttaaccacagttatgtaaacagtgcagtagtgttaagtatgttcatattattgtacaattgatctctagaactttttgtgcaaaactgaaactcgtcactcattaaacaacaattccccatttccccttccctgtatcccctggcagccaccattctactttctgtttctattaatttaactattctagatacctcgaataagtagaagtatttgtctttttgtgactcgcttatttcacttagcataatgtcttcagtgttgtagcatgtgtcagaatttctttgctttgtaaggctgaataatactccattgtatatatatactacattttgtttattcatctatcagtatacactggggttgcttcttctaccttttggctgctatgaataatgctgctgtgaacatgggtgtacaaacatctctttaggactctgctttcaagtcttttgggtgtatactcagaagtggaattgctggatcatgtggtaattttgtttgtaattttttgagaaactgccatactgttttctataggggctgcactattttatgttctcaccaacag

SEQ ID NO: 57159 - DNA, 1036 bp, Homo sapiens
ggcaccatatgaagttcagtgcactgcaggctatgctatagggaattgggaactctttttttaaaagagtaaaaatttgtatttgagacggagtcttgctctgtcactcaggctggagtgcagtggcaccgtcttggctcactgccacccccgcctcccgggttcaagcaattctccagcctcagcctcccgagtagtagctgggattacaggcacctgccaccacacctgcctaattttttgtatttttaatggagacggggtttcaccatgttggccaggcaggtcttgaactcctgacctcaggtgatctgctcgcctcggcctcccaaggtgctgggagggattacaggtgtgagccaccgtggtcctgagtatttcactttctaagaatctcattagttaattatttctttttctggtgaggtttaatattcagaagaattaattaatgagaatctgatttaaaactcaagccaggtttgattttgtccagactcttggggtaggatgatatggattaggcaaggcccaaggaatcctttttttctttttttttccccccgtttggctgtgggtcttgtcttgtatgccccaaggtcaaactgtgaaccaattcaaattattctatgcttttatatttaaacgaagcccaagttcaaataatgataatttcttattcatttatgggacattttaaagatatgcttatgcttcacgttttattttatccttagaacaattctgtgatgttatatataacttatttttaatacaatactaattattttctcattgaggcacagagaagtaattttgtttgtcgttggacaggtaaggacaaaatgagaactcagatttcccagttctcaactttgtgttttctttgtgtgcaattagagagtttcagatctgtaagttcgagtacatgtatttagcccagtggttcttaaacggcacagattggaggagaagcagctgtttcataatcatatgagataaatgttttatccctcaccactcccttttcttacct

SEQ ID NO: 57160 - DNA, 1015 bp, Homo sapiens
agacatgctttttataataatgtaagtacctatcgtatgtatgtgtaaatatcttcttccatttcaaaggatgggccacttaggaatcggctgttgagacgactgtagtcaaagtctgttaacagatttttcacttctccaccaagtgtcttgaaaagagagaaccacgtttgttaaataacatccctgtgtcagatgtaactgtactatactggataacagagtatactggaacttctgacttgagaaatgctaggtatagacattttgtcgtcatagttggcatcttgaatgatacagagtaacatttagtcatgacatttgggatagagaggttagtcatatgaagtgaaaggtggtgttgattgtcttgcttgagagtgttttggaatttttattggattttagatattggtaggattatgagaagtaattgctgttagctagctgcttaagaagtggtagtgtttcgtactttcctttttgaggaaattgttgatcaaatattaggcatgtaggaagttggctgcttgcacagtcattatgagggaagttgattcagatcagggttgaagatggtctgagttggtgttattaaataagatagagctagaagttggaactgttaggaaagttattgattagacttacggtttctagttcctgcagaaaaatgatgtctttattcacctttctgcttttttgtacgttattctttatcagaattaatctgtttttcattgaacatttgggctgtaatatgattgttatttataaataagcagtttatggttggggctgagaagtgtttgcacttctacacagtcgatagtgcgagtagctaataagctaataaaacaaagtggggtgtgcataatttagttgtctttttagccactgtttgcattttaatttttagtatacttaacgaacacaaacatgttagcctccgtgtaagtacactaaaataaagtaaaagatgtgaggaataaggaatcgatcattgtcattcaag

SEQ ID NO: 57161 - DNA, 1083 bp, Homo sapiens
atggaacttgactttccagaatggcaagagccaatcctctgcctaatccttacaaagaacagacactgctttctccagaattcacttcacaatattggagctatggcacaagaacaaggtcaatgtcacactggaataatgaacatattaactaagaagttctgagttttatagtgagaatcaggaaatttcacacctacctctatggctatgttttaaatttttttatgattctaattaaccatctcttaaaatttttctgtgttaatgtgggagaaagaagaatggccacccaaagatgtctacttcctaatcactggaatctgtaaatatgttgtgttacatggcaaattatggaaagaaattatgttacatgagaattaagattgtaaatgggattaagattactgatcagctgatcttaaaatagggaagctatcctgtattatccaggtgagttcactgtaatcaaagggttctctaaagtggaagtgagtggcagaagatgcctcatcttcatcactgtcagagtgatgaaatataagaaagattcagccagtcaccatgggctttgatgatggatgaggttcacaagccaagggatgtcaacagtgtctggatggtggagtaggcaaaaaattgattctctcctagagtctccagaaggaacatagccctctgacacctttattttgacccagtgtaaaagtgagacctaccccaaacttctaacctgcagaattacaaggtaatatatttgtgtcattttaaaccacgaaatttgcagcaatttatttcagcagcaatagtcaagtaatacaatgtttattccccagtgtttaactatacagattactgggtgcatcatactcaggacatgaaccggttttattaactggaagaaaaacctacgacatggactctacaggcacctaatcatgttgtaccccttttcttcacacaaattaaatgttggaagtcctcttgataatcaagacacacaagtaacttggaagatccaataataggtcatgtttcaattagatgtgaagtaagttgtttgaaagaaaaacaacttagtct

SEQ ID NO: 57162 - DNA, 1048 bp, Homo sapiens
aaataggttgactgtaacccaaacacagaggttgccaaatctgtctagcttgcagcctggtaaaactgcctgtcagtactcctatggaagcttcattagacttactcgctaagccaacatgttggctaatgtgtataacaaattaggtcctatctcaagttccacttccaatagcattaggcaccccagttttattgaatgcaacagttgtttatatgactattggaatctttgaagcgcagccgcattttaggatgatacttctccaaatacaaaagttgcttgcttttaaaagctccactccgcttttgtcctatgaattgtactgcatcttcatgtttcattccaccttcaactgatgctagggcaacaagtactggagctttcccaaggcctacaatgcaattaacagcaatataacaaccaggttcttcacaaaacttaatttttacaaaatgtaaccaatcagcaacaatctggttggatggtggtgcaccatcaccaaaaggccaattgagaacatggataccttctttctccacaagagtagtgtcataagttgcttcacatactcttactattgtggtagctccatacttcttaagctcctctataaatttatttaaggtcacattggttggattgtgtgtaataggaaatctcatgttcttgtatgtgactttcacaggagctgggtggttcattcgaggtgtattaatttagttaaaaaatactcaatagggttatgaaataattaaaaaattgaatacagaaatgattcaaagaaactgaagtcgacttcaatatactccacttgaaattctcagtgctttgagtgtgaagttgtaagtaatgataaatgaaatgaacctcctaacaagaagcagcaattctgcaatccagtaatactgaggcaacaaacagacaagaagtgcactcaggtttaccccatccaggtcagaactcttataaaatgctctgtggatttcaattcaacacttttgtgtccaggataaccactcttataggggctttttggtggagtagt

SEQ ID NO: 57163 - DNA, 1077 bp, Homo sapiens
aggcacactatcttcctctctcctatctttccctcagtctcccaagttcctctaccttctttatctttgtcttttacttcttctttctgtgaccctccttttttggcctcctctttccccaagactttcttcctcctgtttctcgttgagttctccccactgaatgtgtgtatgtatgtacacacacacacacgtgtgcacacacaatgcacacaactcctatgactggctcctacttacattcaagttaaaaaggctgatatgaacagggcaggggaaaatcttaggatggttgtacaattgactggaggattttttccccttggaagacactattgatctcaacctgctgacttttcctaatgcttacctgaaggaacccatcctggctagaaagggtgatggtactggaccggtattcaaccttgagttttcaagctgccaaacaggtcttaagggaggtgcttatatcccaccaacactctcccagctcccatgtccccaagacctctggagtttcctcttgaatgtacatgaaccactgtaatagcattagacttttaattgagtgtgcaatcgttttccatggagtttggtccgttcattattttttagttaactacacttcttgatattcaaatgttctattaaaaaaactgagtatgaagaaaaacactttactactgcagaaggaagaaagaatataatatgaccatcttcaggtataacagtgttgtttaaaagagaattattgtatgattataaaagatgaaataattaactgaataataaaacaaagctattagtaagcattgggtatgtggatgttgtgtctttcagtaatctgagtgaactggttagactcatcagggaacttgttaaggttttaaaggttacacttcagattccagacataatgggccttatagtcatcattctaactggaaaaaaaaagaatcaaatatttcatagcaaattataaacttatcattaaataatagtagtgagtcccatcttctctctacaaccttctccaaataagtagccggtgaaatgtatttgttgcacagctgctat

SEQ ID NO: 57164 - DNA, 1046 bp, Homo sapiens
tagttatcataaaagatacttaacaatgtatattctcaaaattaaaactattatttcctcttcattacaaactatttattgaacatggaacaattagaaaaaagcagaaaaatatagagaagaatttttaaatcacccacaaatctattttctagaaacaaactataaacattattctgccaattttctatgcatatataatttctttttaaaaaactgagctcatattttgcacattttaaaaaagttttttaaaaaatcatttgactctattttgtgagtgatttgtcatgtcattaaatgttctttgaaacatgtgatggtttttggcatttagtattacgtagtattccatcatatgtgcataacatcatttatccatcccttctgctgagcatctaaatggattctagcatctgctagtttaacccaaagaggaacatttttaggctaattattttccacaataaatatatgtttaaactttaattgttgatgttgtttggtttatttgtttagtttgggattattgctattttttttcttcttcagaaacttgagtttatgtctaacactagttgacaatgagaagaaagttaaaaggtgaaaaaaggagttttttaaatggattcatgacactacagagaaagtgccactagagagacaagaaagaggaaagaagctcactagggaaaggcagcaggtgggggtgggtggtggggtggggagagagagggcttctctgctattataaaagaccaggacatccagcaattccaatagcgcagagaaatcctggatcagatcataattattgagtttgaagcactttttcctttctgagggcccacagggaacataaaatgggctctgcagacccctttccaggagcattgtggagagcttgaatgagaaccccatgaagagttcaacaacttaatttctaattttgaccttgccactaacccaatggacttggacatgtgtctaaactctgttatgtcatcctataatgaggaggttggtgtaggtctgtagttcccaca

SEQ ID NO: 57165 - DNA, 1041 bp, Homo sapiens
gcatataatcaaattttccttttaataaaatatatgatttttctccatagcttagaaagatagatgctcacacttctctgatgtcattgagctttttcatgggccttcttagataaacaagatgagaatgctcctactaagtagattaagaccaataggaagaatcctccagcttctcaatggcagtttctgtgggcttgctctctctttttagcaaagaaagtggagcacaggaggggaatatctgctaggcaactatattggcaaagtactgaattttccagacctcaaatatcttcttagtttttaatttttaatattaatatttattcattcagaaaaattcatcaagcaccagctataatgcaggcacttatgataagaaataggttaacagaagccctcacagtcaatgaatgcctgtggttatctcttatgtccaaaatcacaactgatctgatattttatgtgctttccctttctaaaattaaaaaaaaaggagctaggatatgttcattatagaaaatttcagacctgattttttaaccgcctgtacagatcataaaatataagcgaggactttaaaaaagattatgtattgatgtatttgtttttgccagcctgttttctctggaatataattatattaaaaagctggtaagaatgatgcttttggaggaaaaaagagagtacataaaaatcagctttggagtttcttcaacataatactttgtccttaatttttaattatagcagtataagagattatatccagtgtgttgagaattgatgttgcttaatgggaatgtatattcttccctagtagtatatgtattattcatagaaaaaaatggtctttatgaaaggacagctggtcctttaagagacagagcctcatgaattagagtagctgctgagagtagttttgatttgctgcctgcagtgcacttacaggctcatttcacattaatagaagatgatctgtgttccttcctgacctcttagaacctaaatcacagatggggttattgaagagatttg

SEQ ID NO: 57166 - DNA, 1085 bp, Homo sapiens
ggtgggtggactgtatcagtgtctatcacctggttgtaatattgtgctgttgttttgccatgtttccattgggaaaaatggggtaaaggatacatggtataattctacattactttttataactgcatataaatctataattatcttaaaattgtaacaatttaattaaaaaactatatatatatatatgtgcaccattcatgtcatgtgaaatccattgcccatgtggcttaggattctgctctaataggaaaaacaaatggttttaaaacaaatctattaagaaattattacatgttaggcactatgataactaggcacattacatatattattctcttttaatcagttcatcaaccttataatgggtatttttattatcctcctttgatgcataaggaaatggaggtttaataaacttaagtagcttactggtgcccacccagttagtaatttcaaagtgaggaagcaacccaggcagctgactccaaagcctgtgcatctagtcaatatgctgtactccctttgagctctgccaggcaacatgtttgccttgaatgatatttaagtcagacaggtagcagtgtcttgacttctcccagtcatcatttctttcatcctttgaagctcagtcccctatgagtttatctaactactacacttattatgagccagttttactattgctagtatatcaagtttactccctgctatgtagagacatatgtcttttaaaattgaactctttctcttaggtttctgtgggagactcctcactctctccatacccactaattaactatcaagattaggtagagcttctctccataagctgtttgtgcagggcatgtaactgactattgatgaatcctgtggcgagacttgggagactgcagcaaggttcggagggccccaaaactggcaatctgggcacagcccagcttctggaactggggcaatattttggtaagtccactgtaggtgagagcaaaaaggagggtgtgccaattaggtgcactggcagggggaagatagaacaagtaaagacaaaaatgagcccagctcaggcactgacacatctaaag

SEQ ID NO: 57167 - DNA, 1046 bp, Homo sapiens
ctttcctaaaacccttatctgtaagtacactccggcaagctcgaaagggacagcaggggagccatgtgtgcgtgcgcgtgtgcggagaaggaatggggagggacagttgcatttgcagaagcaatcctgtctggaactaagctgattagtcctggtgccgtccctccctccctgccccacccctcccatcctccctgccccacccctcccatcctcccttagctccctcactcagcctcactcagcccctgcagcaatccagagactgccctctttggcaactccccaccacctccatcaagataatatccttccctcagggcccttcacacctctcagtaacctgatcaactaatttgtgttaaggtattaatgactaataatgatttaatgtgctgccctcccaattaacactagaacatttcaaaagagaaattcacagattttaacccaagtgagacatggtgcttttccttgttgagaggaattgtaggcccttcaaaacgaaccatacagacagctgctgattctttacatacgctgcatcactcctgagcttagcaatgtttggaggctttatgcaaaggctcaagcagaatttcccaaagagggctgctctgagctacaacccttaaagaacgcaccagtacaggcttaatgaagaaaagaaacctggtgccgcaatatcatgtctttagaagtttcgatggtttttttttgctctcgtatgtgacgacatggtcattgagagaagaggctcaggcatggtgaacttgggttcaagtctttggcaggctctgctacgtaccatgtatttgatcttgccaagttactttactacattagcctcaggatgcacatctgtgaaatggatgtggtacaactcacagggttagagtatgaaatgaaataatgcagaattagtactcatcaagtctgatatgtagaatgctccataaatgacagttctttttcttaaacttaggggttttgttgttgttgttgttgtttttctttttttttcttttcttttttttctttttttg

SEQ ID NO: 57168 - DNA, 1038 bp, Homo sapiens
gggtctcctgtaaacctaatttcctctcgttacttttcatctttggtgggaatcttcatcaatctcctaaagttaagagtgttctgatttgaatctcctttaaatggaaagggttgactttttgtggtagagacaagagacccgggttttttagttgatggcccactgcatatctcatcatgtctctcagtgtaccaggtcatgcacacttctgctgtaggtgaatgggtctggtaattatcaaaggattagtctaagaaggaaattatttacagaaatataggtgtgagattagggaaacccactgtgaaagctgtttggtttccaactctgtctaacttatttttttccccttactactgcctggatctgtgcatacatgttggtttgtgggaggaaatgagcccatcctagctctagtcttattaagaacatcactcatctccctggtatagatgagtttcaacttttattactaccaatgaccaatggctacaccttaagcttaattttggattatttacagtgtgagtgagaaaatgaagaaatgtaactctcagaacatttaaaacttattttacccaaccctttctacaaatatctaattatgagtaatgaacaaaggcaaaatagatcaggttttatcctgctctgccaatatgcagaaatgaatacgcagtcaggtagttgaaaacataaagtagagaagccaatatctcaaataactaaaacacagactagatttaggagctatctaagattgaataacacaagaataactaagatttgactgaagtaggagccagcctgcaaagaccgtatggtgaatccattacactgaacataacaacctcacaatagcaaaccactacccatgaggggtagaggaacttcagaggaggaaacccacctgggttgtgaagcgtaaactgcttatggatccagttttgtgtctacaggcagtgtggtaaaaactggggcaggttctttcttctccctttctatctgttttaatgatgaggatctcattacaaacta

SEQ ID NO: 57169 - DNA, 1102 bp, Homo sapiens
tggtgattggctttcctagtatttgttccaacctcaaaaatgtggatttctggcatcctactctgaccaccacctcctcacttccagttcctccctctagaaccccaactctgaccatcatctggcctcaccaggttccctaatccatatactttttcgttgtccatcatgaccctcaggttccccttttatccttcctttcccagcctgagtccatggtccctgttcaactccctggctctcgtgtttctccgatgctttcccctggcaaaccccagacctgataaaaatctactcaccaattcaggtctgcatcctggcaccaaatctcagagtgtggctggataaaaatacatagctgacttactggtcttaattttatgcacagagtgcaagtggattctcagtggtgcctggcagtgctgcctcatttccctagttaattcactttcctattctttgagaggctattttacaccttctctctccaaaccaactccctctagtatctctgcctcctcactcttccaataggcacagctcatttctgcctccagacgtttgcacttacagtcactctgtcttctacatttccccctgccattcttgccacgaaaaacccctcaccggattcatttccacttctcaaagaagtattccctgacttctctgcctaaaatagcctcccatccgggccctgatgctctctatcctctgacccttccttatgcacttacccccgctggcattacatgatgggtttatttttgttctcttgtctccctccctccctccctggtgcctaggctccatgcaggcagcacccttctggtctatctgtttcacctctacacccactacaccagggacagtgcctggcacacagccagctctcagcgaatgaaccagtgaatggatgagcagaggaatgggtctatgttgtatatttttgaactgctgacttgggaggaagtataaacagggattaaaagttcaagctcttgattcatactagacctagactcaaagtctggttcttgagacggagtcttgctctgtcgcccagactggagtgcagtggcgcgatctcagctcactgcaa

SEQ ID NO: 57170 - DNA, 1071 bp, Homo sapiens
aatcccttcacctgtagtggggagaagggattagagaggaatggacagctaggagttcattaaagtccaaatgaaagatggttgtatcttggactaaggtggtggtgatggggaaggagagaaatggacagaaggcagagctatgcaggagatgaaagtgaaaggacttgatgttaaattgggtataggggtaaggaggaggaaaggagagggaaatgtcaagatgactcctagctcctagatgtttgagaagagggacatcaaaattgggttttggcagtggagatgggctatgatggggcaaaaggttaagttttgtaaatattgagatttacaggacatgttaaatacctgtctgggactcagaagagagatgtggcctggagatacaactttgggaatcatttgcatgagggtgatattgatgcctgtggtgtggctgagattatccatggagagtgtgtagggtgagaaaagaatagggtataggctagtcttgaacatgtttcctttcaatagaaccatgtaatatttcataactgtgctgtttaccactaaaagtcttagaaggggtagtttggtgatttaaaataagtgccaagtgaatataaggaaggatgcactgcacagttgcaaaagcaccgtcctcttaatgaagggccagggactgggactctaattccagctctttgatcttagtctagttacctttttactgttttcatgtgaaaaataaggatcacatgttttctctaccttgcatggttcatgtgagggtcaaatgagataatgtatgtaaaagtgctttgcaagttattttcataatagattacaaggttgacttttaccagtgtatttaaattcattgcagagttcaattcatttcattttattggagcaaaaaaatgtatattttttcagcatatgctgggctgacatggagcaaaagaattgtttgatttttaaaatgatccgtcaaatatttttacattttaactaaagccattgtgctcttttatacagaagaatagacagagtgatgggagcccaatgatctgatgtacttcaaag

SEQ ID NO: 57171 - DNA, 1034 bp, Homo sapiens
attttgtcttatcttttccaggtttttcttgatagtaggaaggatgttttcttttattaatcctgttgatacctaatgcttttgcagtacacaatttgtgtttaatgaatacacacgagataacttaaactctaatttttctttagaaattgaatttattatagtgccattgtggaaatgaatactagatctgtttggtgatgtggcaactgcactaagtttcttaaaggaaactgtggttccaggatgggcttggaagctgtagcccagaactatgtgggcaccgcatccctggtgggttggcaggaacaggaagcccgcagccagaaaaaacattgttccatggtgccctctagtgagccaaggcgccaccaggtcagaagtcagggccagaggccctccaacctcggcaggaagcaggatcatccggggagcctgacaaaactgtagatgtcagtgctccttcccagaatgccaagccagcagggagatcaagcccttcaatcagcatcttcagggatctgatgcacacagtcctcagatcacactttgtgaagtactgactaggtgatgctcatcagaaaaaaactctccagatacataatctgagaacacccacgcccattcttctgctcctagggatggatcactgacttcttgcttactactcaaggatggatttggatgagaaagacagagagaggagagagagagagagggaagaaacagtgtctacatctctggtatgaatccagtacacacaagaatattgagcagcaaaaaatggatggaaacactgagcgaatgttttagggaggattgtgtcaccctcttttgatacctatctccaatccaataaagcactaatgaagagcgctactttcctcattttgtacccttcctggcaacaagggtggggaggtgcctggcttttatcaagcaaaccatccacggccaccactatgtcagacttttaaagtatatcatctctagaagtccctggaatcatagagagtgaggcattctttgtacca

SEQ ID NO: 57172 - DNA, 1021 bp, Homo sapiens
ctctcaggccacagctccggccacagctctggctcctgctccgcggcggatcccacaaacccggcagccacggcggtggcggtggcggtggcggtggcggtggcggcggcggcggcggcggcagcggcaggcggcatcccagggtgataggctgaagcaatcgagggccgagagcccggccgcgtgtgcactcgagtaacgaagccggggagggactgcgccgcaggcaggaaaagtcggacaccgaattattcatccggcctgtcccgcctactttccaagtaccctcccagggatagccgggtattgagcggtccgggtctctgctgctcaaagtaaagaccgtttgagaaggcggggaggtaaaagggtgcgggaaatttaaacagaaaagaaaggagcttcccttccttctcacacctttcctatttatttgtttctttctttctttatgggccaacgtttctttcttattggacaaagagatcgaagaagctgctttatcttacagtcacccaagggggagcgccttcttccttcccagagtggagtggcagtgggtccgggattctgggatatgcacagggtctgcgccctgcgccctgtccgcgctgaagctgaacttgtcattggtttgcaacagcatggtgaagaagtgtggtgtggatggacggacgggcctctcaggcacatgaaatactcaaagcccagtattaaccaaacatgtttctctgttttgtctttgatctttgtgcagtgtgttggcttttttcctttaatgatgtcacttgtattttatttttggtttatttgtagactgtctccctccttggccatggctttacttttatgtccacccaaggagagtttcaccagtttaggtttaagaaattactgacaagttaacaataataatttcaaaattgaacagtaataacttaaaccgtgccttggacatagtagatctccaacagtttttcttgaatgtggctacctaatgtggaacaagatttttcataat

SEQ ID NO: 57173 - DNA, 1594 bp, Homo sapiens
aatgtttcatttgttttattccagtattataagttgtgcccatgccttgtcaagactataaaatttttgatatcagggagccttgtttatctttgtattcttatcttgccacccccttcattgtcaacttgtctgccagattggtaccttgctcatagtaagtcagtgtctgttgtatgttgatccgtttgtcctttgaccatccagatctcaacctgactgactgtatgggtggtagagtagcttaaacaaaggcatgccacaaacagctaaatatggatacagaatccaagagcatcaaatgcagaacatttttcagatatttatagcctcaaagcaaagtcaattggctgaaaaagctcagcagcatagcgaaaggaaacgggagtggcaaagccagcctcactgtctgtgctttctggtaaacaatgagaacattaaaattaaatactttaccatgaatggatggggagtgtaggacactctgggagaaatttaagatcccaatctctaggattgcctgcggtggagctctgcactcatcagtatgacaggtctgcaagtatgtgctcagatatgctcttggagagttagaagggaaatataatcagcacaagaaagggatcaacaagaaatcttgtacttttaaattttaatattatcagaaggaattaggtaaaatattctgttaagaaaatgaatagcatcaacattattaccattaagcttgtatacagctcattgtttattgataacaacatagggacctgctggaaaatttcaaagggctagtactatttaagcaaacagaagaaaaagggaattaatcatacttcattaagtaccttataattccagaaatgtggcagtgggaattcggtaagaattaatagaagttcatattcaagaagtgaatatgagctgatgagacagaagtcatatctggttgtattatatgatactgcttacgcctcaccaattaagacacaggatgagatttttaaaagttacgtttctagaggttatgtctctaaatttatttaaaatgttgcaactagtatggctagaagaaaatcagtgagtgtgtataaaatacatccccaaacatgttcatgttccttaaatgtcttaatttcctcaggtactgttaattgaatctttacacctgagtagtcatattttagaaatttttggaatcttaagcttgagttcaatacttaggatgtggcataggcttgttgatgtattagtttccaatgatttccaaatacattaaaacacattaagaatagacagtttttcattgaaatcagagagaacttctaagaatgcctaggcatgtactgtttaagtgactttaaatagcccccttttttcttcttttgagagaaaatttgtatgtcttatttaaattgtgtgctctattaatgtaggtgatagtttcatttataacatcttagtattgttctaccctctatcatgttggttcactgctatttgattttcaaacagtgaaaatatttttaaggaatagaattatacatccacaatctcttttccaaaaccatttggactagacagttatgttaatatt

SEQ ID NO: 57174 - DNA, 1019 bp, Homo sapiens
acttcttaaggctagcatgtagaaaacccttttgcaaatttcatgtagtttattttatagtgagagggcagcccatcaagaagtaatgtggttcacaagtagaagggaaaagagaagtcttgaggcccagtgcagtggtgttagtgagtatacagtaaacaaaagaaataaaaattgaacccttaaaggcataaaaacatttcatttgctagactatgatacagaagttatcactttcctaatctctacagctgggttcagatatgagctgtctgaattttaccttcccttaccaggtgttagtaacatcaattaattgtctttgttggctttgctcataagggttcagtttagatcctgattgtatttttacccctccataaattatcttcaacattgctcgagttccattcacattgtgtcacttgtagcagactttctaaaagtaccccttacctccatccctgagtctaagggattggtaatacttatagatattgattgagagagtgaaaatttagtgaggggaaaacattcaacatagataagataacaaaattcggaagagtagtctgaaaagttaaaatgaaaccttaaagtcaatagtttttgatatttttcaaagcaatcctttaggttttctcattgaagaaactggctcaggaagtttagcttattcccaaaattggagacagactccacagtttgtcaggattggaactcttaacctcagattccttagcctcctgatttagcttctagatcttgctgccttcccttagggagatggcctctcaaagctgaaggtcaggaaaactcgacagtgagaaataccagattgttagtttcacagtcttttaagggaaatgctggaaataccattacctaggtaacagaaaacaaaaatggacaaaacatccataaagtaggaggatgaaaataatttcatagtaatccttaagagatagaccagaggacagatgagattttttttttcatatttttcctaagcttattat

SEQ ID NO: 57175 - DNA, 1016 bp, Homo sapiens
tctagcttgataacatgattaagaaaaaatggtatcatatggtgatttctattgaaatagaaagataccccagatacagtcgatttcttcctgttttgttcaggtcagaaagtcttcagtcattcttttgcaagttcaaccaaaataagcttaagagaacattttcagttatttgcattttaggttgtagttttggtctatactgagattgtcatgccagagtgtcaccttgagagaggcttgactttgtaatatctattagctgatcatctttcttttcctgtagcttaactagcataataaatttcctcatatatatccagtaatattattctgtttacctgtgagcatattgtatgaaattatatgtttttacagagttgctttttccctacaatcttgaaaaaccttgcatttttttctgtcaacaaacttattaaacatgataagtcatttctccattttatcagggaaataattgtgaaaaagttagtgactcctaacgattcttggtgatgtgagatgattactatttgactcccaatccagtagtttcttttgaaatattaccctctattattgaagttcacatttactgttttaacatatttgtgttaaaatgtattacaagcatttttgtgcttttctaagttgtcttagaatttaacagtatgtcttatcctatcttctctgcctctttgagacccatgtggatagtaacagatattgagttctttggtgaactgcaggaataaaagtgaggatgctagatagagtaaccaataaattattttgtgttttttttattatggtaaatatagcaaattttcattttaagtttgctatatttaataagtatacaatttaatgatattaaatacattcataatgttgtgtaaccatcaccactacctataccccaaatgttttcatcatcttcaaacttcccattaaacaatgactctccctttcccctcctcttagcagctggtaacctctattctttctgtctccct

SEQ ID NO: 57176 - DNA, 1294 bp, Homo sapiens
tgaaatacacaaggttatagatgaagaaactgaggctaaaataggttgtgatttgctcagttagagactaatccagtggttgatttctcaacctctcttctaatagaaatcaagtatttctgctttctcttcatcattggttgttttctttttttttttgggatggagtctcactcttgcccaggctggagtgcagtggcgtgatcttggctcactgcaacctccatctcccgggttcaggtgattctcctgcctcagcctcctgagtagctgggattacaggtgcgcaccaccatgcctggctaagttttatatttttagtagagctggggttttgccgtgttagccaggctggtcttgaatttcctgacctcaggtgatctgcccagtcagcctcccaaagtgctgggattacaggcatgagccaccatgcccagcccatttgttgttgttatactcttttcccccaaccctgaacctctctgagtttctttcatgttactctgtgtatagcttaaaacaaaacaataacaaatagaaaaaaacctaaccccactttttttttctttgccatttttcactgacatcacctcatttttggctttagtcttcctgataactgttttctggttttttttctggaggcttttggaggctctttaagagctcagcctggctctaggaccaagtcattgttagactgcctcgtttttatttatggtattctgtatcttgaaaacaaaggacatgctgagtcttttcaaaggagcgtggaatccatggagctgactctcattgttactgctgaaatagtgactgaatgtaccaccagcctgagattcatgaaatgtgcattaaaatcggtttggtatgttaggtgaaatgtaaaaacatcagtgtgctttatcaccgatctgtttttgtctggtgtaagaaaaaatacgacaagtatgggattgtttatatgtcttataaagccaacactggagtgtaaaaaattgagtgtttggggatacacattaagtcaaaaagaaactaatgctgcctgctttgactgtgtttgggtcagaaatggagaagttgaaattgacatggccatttgctgaaatattttgaggtgttcagactatagtaggaatgcagtcataatgactggatttcagaaatgacactagaagtcatttatctatttgcatcctagaacatcaacttaatgtgtgtccaggaagaaaataaatgaagactgattcatgaactgactgtactatttgttagagccaagtatgtttgtggt

SEQ ID NO: 57177 - DNA, 1041 bp, Homo sapiens
tttttcacaagggaaagattaatggtttggatttgtcaaattttatagcctagctattcatcataaaatgaatctgtaatacttactttccatttttttttttttgctcacacactactttggatgattttaattgtatagtatttaaaattaatttttagatcttagatgagttgaccagagactagtgataataccaagtatggaatagtctagggatagaaaaggatagaatttcatgataacgctatataatgtgtgtgccaaattcagcatattgaccagtgttttacaaaatgagtttttcagatcatctatctaaaaatcacctggaatgcttgttaaaaattcggatccttggacccttccttcacccatctctcaccaatcagaatatctgggagctgcctaggaattgcatttaacaggcacccaggtaatttggatatacattaaaagtcgagatctcctgacatagaacattcaacatgttatacgtattgctcacctgtttaagatgattaaattatgagatctttgaaggctgagagagaacgagggtatctgttttcaatttatgaattgaatgaatttttggagttttaaaagctaacacataattatagcattcatttcatttattagtttctcctgaggacgaaacttggccttgaattttataattcagggctttgaacatctaatttttgtttaaccaaagtagaaagtactgtaatgcttctaaaaactacatttacagttcctgttgcgctaagtagatatagataagctacatgttcaaacttgctttgtggtccccacttcactgtcctctctcctagagctcttccagatgtcaggttttctgaaattgatcctgaatttaaaaatagagaagtgacagaaaaaaatgtgaggttttaaatttgatgttgtataaaaggtaatatttttgttttttctgtcacccaggcggaatgcagtggtacagccatggctcattgcagcctcaacctcctgggctcaattgatcctcctgcc

SEQ ID NO: 57178 - DNA, 1043 bp, Homo sapiens
acatttatttgtatttaatttttaatgtagttgaaaccattggagagtttaaatccacaagggctataattctgctttccaaaattttgagacagtaagctgcagttaacttccgtggaggaatttatttttctcttgttattcagagtcttagaatctaatgtttattagtttcaggattttattcttttttcaaaagccagagaataaacttgggtagaagggatccatgtagatctatgattcttctcagtaagaaacttaaaaataactgcagggtctgagacagaactttcccttctctgttttgcttctgctcgcagaattgaagttatattttcctctgtcctctttctcccaattactgcatttttaaggaagttggggattgagcatttgaagttagttctactgtctccctctgttgtttttctgtggagtgtggcaccgtttttactgtgctgaagcagattttctggaacatttctaaggcacatacaatcccagctgctttttttctgttggtgctaagagaagtctattgcctatgcttctgtcatctgaggtatatagtaggacataatattgggcactaatttattagcaaagctgttaacttttaaatgactttttaaaagttttggaatttcatttcacagaatgaaaaattttgtcagtggttttaggaagaaagcctcagatgcttactgacgctttcaaatggtcaacaaaaagtagagttaaagattttgtgaaatgatttgtttgtggccaaagaaatcatgattgtgactcagatgatttagttaaatgtataccaaataactttttttaaactgtggaagaatatataaagaatctaatgttggtactgtttttagtcgccatttctgcgtcatattttatagagattgttcttactctagtgagggtgatttaaagggcaggtgttctggattgccaaaggcattgtggaaacagagatgctctcacttctttcctgctcagtgctttccagaagctgtcaggagaagtgccacgtg

SEQ ID NO: 57179 - DNA, 1013 bp, Homo sapiens
ttattttctagtgtcttaaaaaataagggcttttaaggaaagagagtatttctcttaaagttaattttgatagatatttatctagatgctttcttttttcccttgccataatagctggcttgtagagagagttatgtttgaaaaggcttgccttttttccgttgctctgagcaggattatgttagggcccaaatagtgactttgacaaaaaaaaaaaaaaaagggggagtatattagttttaagtttgacagcataaaacaaaactcaaaaataaaagtggcttaaacaaaatagaagtttatgaaagaagactggagacaggtaggaacgggtagtcattaaggaccagtttcctcttcttcctatcatcatctggcatggccagttgactttatggacaactgtgcctacaggaccttctgccattgcatcagtatccttaggtagcagcaaagaggaagtggatcaatgactccacccttcagttaagccaactacctataagtgactttcccagaaagtcccacacatttgcacccattagccaaaactcacacacatagtcatacctagctataagggaaactggaaaactaacctagatgaattgctactccaaatcaaattggggatccattattgaggaaggaagagagtgtgtattggataggaaaatagcattctcttctatagtgagagaagtaatagtttttgtttctactgagatatgataggtaattctgcaaattttattgattattgcaaattttcagtatattttccattagcaaggtgtcttttataaattcctgttggaaaaaacacagacagttgccatggacttgtattcagagggctttaaaaaggtacttctggaaaataatacagattatactttgatttttcacaacagagaggaatggttgtccttatttacttgttatattcaagctctgtagtcctaagaggattttgagtttatcctttgcaaactgacgtaggcgaagccttg

SEQ ID NO: 57180 - DNA, 1020 bp, Homo sapiens
catatacacacaaatgcaaacacagtatgttttatttagaaacagtggacatggtgattgagttttttattgagtcaacttttagagccagagctgtgttttattcatctttatgttctaaaaattgatattcaatgaatgtttgagtttcagaactgaaaggaaccttacaagctaaagtagaccttactgctaattttacagataaagaagctgaggtccagagaaagttaatgtctcttgtccagagttgccctgctcactgtcttttaaccatgaccaacataaacctaatacttggtgggtggtgtattttaaaggctttagtcatagatgagtagatagcgggaattacatttataagctgcatttcccccccatctttgtacgtatgtgcacatacatactcaccaaacccactttacccaccttcactgctggtatcagcaaacccagtttccctgtaagtgttccctcatctcaccaaagccaaattgattgtttccggcttcctgaaagtaaaacgagacctgtcccttgtgctataaataagggaggtcagaggaattttttaaaatggattgtgtgtttgtggtcaatctcactgttgcaaaatgtgaaaataatagctgtgtaacacaatattaatgtgatcatttaacttaaaattcaaggcatgccatccaagtggcaacaattttcaggtgaaagttttctatgaaatgatagatatcctcatgggactaaaatcctcatggaactaatatctcttggcttgtacctcctcaaagggtaatgatctcttggactatttaatagttagcatccttatgatatacccaaaggtaagcaattagtgtcaattataatgattaaaaagaacatcttttaaaaataaacttatgtgagtaaatgaagccagttgaaaagtcaaccagatatattttgtatatcttatctaaaagagatgtaaaaataaatgaacacttcctcaaaatacaatcttctaataagtagtgt

SEQ ID NO: 57181 - DNA, 1006 bp, Homo sapiens
ggcattattgcgactctaaccacaatttttaattagcctctcagctagtagtatctagaatttttatgcacaaaatactataataatcctgaaaagttactttacttaaaaaaaaaaacccacaatttattctgtatacaaatagccaaagacataattgaagctggggagaagaaaccactgaaatttaattctgcttctcaggtttcatatcacataagaaacagatacacatttcttctaagttgttcgacctaatgacataatgctattcataacattttcttatccttttagtgtttatggaatctgtagtaatgtccccatttcatttatgatattgatactttgtagcttgtctcttttttccttgattaatctggctaaagatttttcagttttattaatcttttcaaagaaccagctttttgtgttactaacgtttttatgatatttaaaaataaatattaatgatagaatagtttttgatttatagaaaaatcaccaagatggtacagagttcccatatgcttcacacccaatttccctattacttatattaacatccttattaatatggtacattcatcatacttaatgaaacaatattaaccattattattaaataaatttcctacttgattcagaattttttttttttttgaggcagtgtctcactctgtcacccaggctggagtgcagtggcgcgatctcagctcactgcaagctctgcctcccagcttcacgccattctcctgcctcagcctgccgagtagctgggactacaggcacctgccaccgtgcccggctaattttttgtatttttagtagagacggggtttcaccgtcgttgatttagattatttttacctaacattctttttctgtttcaggatgccatctaggataccacatttaactttggttgtcatatcttctgagatccgatccatcttggcatcttggctgtgacagtctctcaggcgttctttattttttatgacct

SEQ ID NO: 57182 - DNA, 1069 bp, Homo sapiens
caaatgctgtcttgtcttcaaagctttccttgactttcccaagctgacttgggtaattcctagcctataatcttgctgtatccccaaagggcctctagtatagcaactgtgatatcaattcatttatttcatttaaagaaaatgtaaaaatagtccttaagacctagaaaggtttgtggcacacagacaataagtaaatgtttatttaatgaatgaaataaaaaacgaatgaattgtagcaaaatcctgaggctttaataacaacacacactggataaaggaaaacttcattttgcagaaagaaaagacagtttctcagtctcaaaagacttatgtgaatctaattattataaaaataacccttgatagacacctgaacacatgcatacatttcataactgtataacacagactgtggaggtgaaggagcatatggacctaaataaaaactcaagaccccttaagagaacttgctagcaatgctgatttaaataatttttaacagtgagggggtcggaggtggggatgggaaagggagttgaaaattaatgcccccagagtttcgtggtactctgtgctatcttttttcttttccctgtccctccaactgttaatatttggtatcttgttatactacttttatttcagtaaatatttgatgacagtctattatctactctgttaggcaccttggagagtacaaagagaaatgcatgaaattaactaaaagacaaaaaaatgcattaggtagaagtgcaatagcacatgaacgaagaacttttaaaaatatgaataaattattttaaaattaaaagtgttcaaatacagaatgcttttcaaatctgtgtttcttctgaggcagtctatggatatgcttaggacagctgttttagatgacacatctatataaatgtgaagtagatttattttctttaaacaaaccattagtgtatgtgtgtatatacacacacacatacatgtgatgttgaactagcttcatcaacttctcaataaatggacacatttagcttctaaaggtagaaacgagtctaaaagggaagaagatggt

SEQ ID NO: 57183 - DNA, 1780 bp, Homo sapiens
ttacttggtatagagaaaatgactccctgtagtgcatttaactgcttcctcacccatgatctgtattttgatgtaatcttcatggtatcagagataatgttaaactcaaataggtgcttactgactttctcattactagtctgaagttaggtagttttattttagatctctctctttttattaattaattcaacaaatatttattgtgtgcttacaatttgctaagcacttgagacactatggagaatcaaaacaaacatggatgttatagcctagtgggtaaaacaggcattgattgataatttcacgaggaaatatacaattacaacgccacagctgtgatggagagatgcattgggctgtaaaggcctgtaatagggagatttgacctggtcagaggggtcaggaaagacttccctgaggaagtgacacttgaactgaaatctgaagcatgataatgatggaaggaagatcgtataccatccagttgcagagaacaggatgagcaagagccctgtggtgggaaggagagtgacaggtgtgaagaactgaaagaattcaagtatgtctttatgagggagccttacaagggtagagtgggtatgagtaggctcataccaaaatcaagaattttgtcttgattgtaagtgggaaaccattgaatagttccagacaagatgaggtaaatttgtattttgaaaagattattctgactacagtaggaaaaatgttttttggtggtcatagtagatgtaggttgataaatttaggaggctcttgtaatccaggtgagagatgatggtagattcatttaggggagaatggtgagaagtagataggttggataatactcaggaggggaaatgagtaagattcattagatattggatattgaatggtgagagatggtgataactaaggtttggggcttgtatagctggatgaatgtggtcccatttattaggataaggaacactagaataagaccagattttaaaagaaagatcatagtgtaggttttatacgttttgaacttgagatagctattaagtgttaaattgaatatatgagtatgttgctcaaagaagacaaagtatgaactggagatataagtagatgtgttaattgtgaatgatgatatgcatggtgagaatatggacagaggatgtcaaggatccagctttcaaagtctcccaacacttagagactagatagaaaatattgaacctctgattgaaccagtcagaagtgtgatcagaggttaggggaaaactagaattttttttttttttttaatatttaaaggtgttcattatggttttaggagtttttgtttttgtttaaaaatgatttcttatttaaataaatcttttattccaacacttaaaaaatctttatttggcccttctagacgtatctttgtctcttaaatgagaagcggttgtgtacatgtcaggtgtgcctttcacttctgatacttagaagaaaggtagttttcactgcaggaagtgtttcattgggaagcatatgtgctccagtgataggaaatgggaagaggatgttttgttattaattatttagctttgtataaacaaggactttgtacttttgaaagatgtcatcttctggttaatataaatgagttctatttttaaagatttttatgagttgatctaagagctatgtagtcacttgttctagtaacagaattctagaactctctttgttaaccgtagcatctatcatgtattctaatacaaaagagcaagtgggatacata

SEQ ID NO: 57184 - DNA, 1635 bp, Homo sapiens
ttttccctacagtcttgacttttgttaagaattgtagagttctcattaacactattaggtgaatcgttcatacaaagtttttaaaaagtcttccaaataagaaaaaacaaattcacttacaggtaaaatatttcccattattttatttccttaagtcaaactctatatcctaaataactaacttcactaaaatatcaagagtattttataaaggacttgctggattaactgacatgattaattcccccaaatttctccactccttctgtgaaacctactgactgatgctaatggtgcattgaacatgttggagaggactgctcttcaacatgcccacttacttctgcacccatcagttgtaagcttatcataaatcagtgatttgttcccaaatttggcagtttgttcttgttattgtacttagactgatattcagtgtttaataaattgatgaactgtgaatgctaaatagaaattgttgttgttctataatcttggcgttagaacagtctgaatgtgagatgcagtaaggagaagagccagaaggtgtggaggtcattctattcatacagctccgagctccttgctgctgccatcattattaaacagctctttggaactctctaattttagtctctgtgaattctcccttttttccttgccagtttccaatctgtattttgagaaatacttgattaaaatatttatctcctaagtagaaaaataagaactctggaattgtccaaaccctcatgtttgtaactcatggaaaacaaataaatttgatgtgagcataatataaatatttaggcctacctctggataggtattagagaagagcttagctacagacgtttataacaacttagctctacatatctttttttgtatacctttataaagacatacaacctttttgacttttaacaataatataatcaccccatattccacctgtgtttttatgttgcagtagttactccagctaacacaaacaagtttatatactgaatttttatatgtgagttcaaggtgaatagtaagtaaagaaaagtaacttttccaggaaatgcacataagtgctctgtgttactaaaagagtacttcataacacagaggaacataactgtaaggattaattagaagtgttggatgggcgtggtgactcaacgcgtgtaatcccagcattttgggaggctggtggatcacgagatcaggagttaaagaccagcctggccaagatggtgaaaccccgtctctactaaaaatacaaaaaaagtagcctggtgtggtggtgggcgcctgtcatcccagctactcaggaggctgaggcagagaattgcttgaacctgggaggtggaggttgcagtgagttgagattgcaccactgtactccagcctgggtgacagagtgagactgtctcaaaaaaaaaaaaaaaagtgttgatgtgctttgcattacaaaaaatctatatcatgaagttttcttaaaggactccagcctagctagccttttgagagtctctctattaggggcctgctagggctatttaaattcttaatcctctttttttggtgtcattatattaagaatataaagacgaataattgaatgattgaggaatattccaagta

SEQ ID NO: 57185 - DNA, 1053 bp, Homo sapiens
tggagtgtgtctgtgtgtgtgttcctatactgaaatttccagctctatcatatcattcagtttgtcatttttgtcaagtaatatatcatgctatgatgctcctttctcccattacaaggaagggttaacacatgagagatctattgttattgttgttgtttccttgccaagtagtttctaaatttatattagcatttgcagttactgaatttatattagcatttgaaggagcccaaagtttgctttttagacttagtggcaggccaaatgacttagtattttgaatgctgttttgaaattatttggaaataatagattgcattgaatacttcaaataagcttcccttttaggttatctttcttccttttttgaaaaccatctatattggacttcctgttatatattatagttacataacctgctttattaacttttatcaatttgtatttttattagtgactcttttattctctcatctcttttgtgttattcatccaccacaaacaactagaaagttacctgtcctgttgattcctatttcaaaatctggctcacatggtctgtttgttaccattttcactataactgatctgtttcagaccctgaccatccctaaaccaggccattacatcagtctcccatacattgttaagacctctggtctttcccccactttcttcatcttgttacaaactagtattgccatattttcttagaatacctcattgactttctgttttctaagcagtggtttttagcatgtggtctgtggaatgctagatctccaggacccccccgatctgatagtttaaaactattttttatagtagaactataagactaattatggttattcagtcttggttatatggcagacattttctgaaaaaaggaagacataaacttatcacttcagggaaacaaccaagagtatttattgctaatgataaaatttaagactaaaagcaaaaattagaatgttagaaaatttgcatctgcaactttgagcttggcagcttcccagtagtacttgaagtcttttctgatgagat

SEQ ID NO: 57186 - DNA, 1036 bp, Homo sapiens
gtgtataggcagcaaggcatttaaaatgacacttttaaatgttttaaaacatttttcttttgaaagtgtttacactcagatatgttgatgaaaatatcagtctttgtgcaaatagctaaaaattaactggtatttattctggggtgagctacctatggcatatttcattcagaaccacttttaaattattcaatagatatataatatgcccttatatgttattcactgtgttaggagttacaaagcacaagacagatcttctttcctctttctcccccgtaacaaatttagtggtaaaaataagacaattttaaagtgacatttgataaataacacaagtaaatggatagaataagagagagaaatccattaattataaaaagaaccttagcctaactaaatatgtcattaagatgccactggcaatggggaattaccaaaggaaagcttaataaaagaagcaatttgatcaaagttaggtgttataaatattaatctgtaggacgtattggaagaacaagacacaggaaacagaacaattaggagactgccagtccttagatctaaaagcttgagtggcttctcagtgctccccatgcgtggtctggtattccagccctcctaacatgttcataatatattgttccatcccttttctccctattaagaggctctagccaaattggcctactccctattccaaaacaaaacaaaaaagtcatatacttaccagcttcctggctgatgttatgctttttcctttgcctaaaatggcccccatctctacctatcattcacttatttgtgaactattttaaggtttggggatttactggtaaagtacaagctgttaacttacgtggaattagttgcataaatgaataattataatttaacacagtaagtataatgacagagaaagatgtgttaccggagaactaaatggaagtgtaccttgaccttcccttaggggactgatagaggaggaagattcctgggaaatgcaaagcctgtcctaagcctcaggatgattagg

SEQ ID NO: 57187 - DNA, 1044 bp, Homo sapiens
ttcagaataaaggttatattatgttctttgtatcctgaatgagaagtaaaatgccctaacctttaaaagtgaaactttgaatacaaccttttatcatattttaagttttaatactgggaaataaagagtctacattaaaactttgagaaaataattgagtgaattttaggcccaaataaaaaatattgtatttattctctcctttgatatagcagagacaaaatatgtcctcatagaagacattcttactttatttggatatggcgtttataaatttgcatagaaaaaatatttcctcctaaaacaccataagaaactactactttttttctgcatggtttagacctttattatttaaaataataggcatttttagaactattatcaaatagttatgtttatttagattgaactatttcttcaaagaaccagactattttttccaaatttactgtcattcttcccacttttaaggcagatacaggatatgtttcgccttttttaataggagatagtcatttaaacctatcagtgatactcttttaattatttaagtagagataataaaatttccatcctgaaagggacagatgacttagattactgtttgtgaagttttatattacagagtacttttggaagacttcatgtctttattgatgctattttttggcctcagcttatttttgtaattttacatttcttctgcccttcaatttctcaatgtgcaaagagtaaccatagttatggtaataaggaaatgggagaattgggggtcctataaggagtatgaaaatttgaagtgcctatggaggcattaggaatttgctcctcggattctcagtaacagagagagagttttccttgccatcatctccttgacccaagtcacaggagttggattacggaagcaaagcagaaggcatgtacacttaagcctatacctgtcctacttttgctggatcaattgatgcaatacatgtccattataatcatttgaagaaataaatcattcattccccatctcttaaaaggagataataa

SEQ ID NO: 57188 - DNA, 2011 bp, Homo sapiens
attaagtggtttagatgtgtcttgttcaggtagctactggtgttgtcttatatgatgtaatattagatcaggctaatttagctaagttaatcttgcatgtctcataaaagtcatatgctggactatggttggagtgggtgacaaaagggagaaatcctacttccatttttccagtaaggttactaaagaaaccttacttccattgttatatactaaaggagttaatgtcaatatcaaagcagctagctcttctcccattccctaccaaatgtattctgttaaatgttttcatttttaataatggatatttaaataatcagactggtcaggtaattttaaaagaacataattaagattaaatagaaaaatgaagcaatttgaaaagtaggaattgttttggtgctttatattgttgtgttattatttgcttagtgaaccatagacttttgacatttgataagtagatgaaatcatttattgtctctatggtgatcagtatggataattctgtaattttgtttgtgttttctaaaatcatggtttggtttgggattttggagggggttgcctttttcttcatttctaagtggaacccagagcttttggctggaatttgaatccttttgggcagaatttgaatcttttatttttctttttattgtgtaatagttgttgctttcctagaaattagttgagttagcaagtacttttttccaaggagccaccttggagaagtcagatttttctctcatcttatttccactatacttctttaacatgtgttgaaaccagtttaggtgtgggcctaaattctactaaaaacctgtctgggtgtaaccattttatagcctatttatatttcacatccaagttctatgtaaattgaactggcttagagtcaccttctttcagttcctttgctttcattatttgcaatgatatgttgactgttgtctctctttttttttttctgagacagagacttgctgtgttgcccaggctggagtgcaatggcgtgatcttggctcactgcagcctccacctacttggttcaagcaattctcctgcctcagcctcccaagtagctgggattacaggcatgcaccaccatgcccggctaatttttgtatttttaatagagacagggtttcaccatgttggccaggctggtctcaaactcccgaccactgatgatctgccctcctcagcctcccaaagtgctaggaataaagcatgaaccactgcgcccagcctgactattgtctttaccaattttctaggaacctttcgctcttcaagttttgacccataaaagtcaatagattttgaggaagtacaactatagtctcaagaattattgcagtgttatagaagagagaactatataggaaattgttaaatatctacagtgttcgaggtactggccccaaaaacaaactaaaggtgacaaaagtgtctggtctagagccagtccttatcttttgtgcttaacaagaagtccagtagccattctgactcatggacagtccatgagcaaatgtcctaaatttgcactaaaagctatcctcgtaaatattatagggaaaaacactacttctagagccattcttccttacatgccagtctaatcttgaattagataattgttctgtttttttattgttatctccaagtgatttgtctttagccaaaatttctgctgtcaggtatttcattgaataattgctgtatatgtaacattctatgccagtcgctaagagtgaaaagaagtataagatttctgctcttagaacattttttttatgtagttagcaagataggatgaatatacatagaaactaaaatataagttagtgtacaaaaattgattgtctatatactagcaataaacaggaaacaaaaaaaattaaatatcctgtttaatatagcatcatgataacaaattcctaggggaaaagatctaataacagatgtgaaagacttctacatagagaactttaaaacataaaag

SEQ ID NO: 57189 - DNA, 1044 bp, Homo sapiens
tggattaatacacactgaggaaaagagcaatagcttctgataaacctaatttggaacaatatgcaagctcctttataaaattaatactattatagaaaatttggaaagtatagaaagctatgaagaggaaaaaaaaaaacccaaaatgccaattaaagataaatttggagtagtttagtataccatagtggttaagggaaagcactccaagagccagctaaagcatgaattctggctctaccactttgtgaccttgggcaagttactcacttaacttgtgtctccatttcctcatctgtaaaatgggcaaaatagtataatttacttcgtaggtttttatattttagaagtctgttttcctaggaaatcgctgttgtaattttcctttttcttcctttttttttttaatgcttgataacagtctttagagttctactggattttggtgtgcttcagttagttgtaaggaaataatggaaattggaaattggatgaagttaactgcctgcagtagtattttgaattatataatacatatgtatgtctttgtatcagtggtaagccaaagactgattgtaccataagatctatgctttttctaaatagattttatagaaacagtagcccatagttgcaaatattctttaaaacgaaggcaaaaccaaatgcctaatgatcgttatttctactgaaactgagtgttatctgcattatatgagaaaaatggactaatgctttagttgtgacagcacattagcttaataggaaatctgtaagcctaacataattatgtgtgtgtatgtatatgtataattatgtatgtgtatatataaaaatatatgtatgtatgtataactaaataaatatataaatatatttttaaatccactaaagaaaatgaatttgtttaaactccctttttaaatgaggaggtccaatattacaggcacgtccttggctctctgagcatattcagagatagtacccagtaatatccaacactatccgaaaatacttttagttgcttttcattgtttattcatg

SEQ ID NO: 57190 - DNA, 1034 bp, Homo sapiens
acctggcaccctgttcttgtctttcttggaacttatcacagtgatttagctatttttatactagatgactatgtgctcctcattttaatgtgtataatacatatctaatgtgtaagatatataatacatatatacataaatataaatgggtagatagatgatagatacagtgtatgtgtttccatcagctgttaaaaggtagatgatagattaatactgtgtcattttcatgtctcttctgttctactgctttaatgtggcaggtggagtccactgtgattcaaactatgaattttttcattgatcaattctgacatgctaacctcagcaactgagcacctgcataatatgttaggtcatcatattaataatgaagattacatagttgacttgcctttttattgggggaatatagaaaaaaaccctagaaatatgactgattttaaaacaaactaaaatgatgattgagaacagtaatactatctataatttcattgcatctagtagaaaattagctttggaaagccactcagtttataaaattgttttgattattctttatttaaaaaatgaagttctcagttttaatctcaacaggaaatctcttgattacagcagagcagatttttatctgtcaataagttaaaaaaattttgaggaggaaatcaggcatcagcttccaggggtctaataacttcctaacttaatgggacttgcctaacagtagatgaacttttcattttaagactttgcctttagtagtcaacactgtcctcagcacagctacagactatataatacagagtccatacaatacagggcatttctgtatgaataaagtattaaatattttttaaaaataacttttaaaaaatgaagttctagcctaagacctgaattaagggctttagggaaataaaaactttgttccttttctaaattttagatatttccgttatggtaagttaaactgatcggtttaagaaggtagtttaagatagtaatgtatatgtgttaacaggcttctatctctg

SEQ ID NO: 57191 - DNA, 1061 bp, Homo sapiens
aagaaagcccagtgagtgagtaaggaagggtggctattgtttagtgctctctagcaaaagaatgggattgggggcggggttggggcgaggattgagtttaactggcattggctctggcttttctgcattccaaactgtctgaggcacgaaatgagagcaaaaagggagagagcaggaaagcgagcacaggcgagtacagtatacaaagtgttttgagtttctgactggcgtgccggaaagatcatgttagcacacccagaaacttcacacgatgcagaccccaggtaagagtttgtagagtctgagaccgaaatgaaaagtcacgtatttaaggggaatgtggctttttaaaaattacacaaatgcagtgactatttacctttatgattattggctttaaaaaaataggttggtttttattgctgtgagttcacagaaatactgtgtggaagctgtctgttagcattccagtacaaaatccagcacaagaatagccatctaagaaactcagataaattaaaagaataatgaccatagcaaaatattaacactgcagcatgtacttgttctgttaataatatgaaatgggtccttattctggatctttcttaaaattctttatgaaatataaagatacctgggaacaggtaaagctcatttctctctgagtgagacagaatatattgaccatcaacaagatattaacagccttgcttgaatctcagtaacacataatctgtgtcattcaaaagtttaacaggtttgatccatagacagcagtaagagcattcaaatgagaactttgcttgttatttttgcccaaggtaggcttttaatatcctctgccaagatgacaggtaagaaagtttattgacttattgaaagttaaatctgaaagagacttggagattatctatagtctattctctccattttcaatgaaaattttgtggtctaaggtacttgcccaaggtcagaattaggaacagaattgaaatgaaaacccagatctccttattgtcagtttaacgtgtttttcatagaaccaattatatataggc

SEQ ID NO: 57192 - DNA, 1013 bp, Homo sapiens
acccaaatgtccattagtggaatattttcggccataaaaaggaatgaagtactcgctaaaacatggatgaacctaagtaaaagaaaccaggcataaaagaccacatattatatgatttcagttgtataaaatgtccagaataggcaaatgcatagagtcaaaacttagatgagtatttgttaggggattaggggctggggagtatacagagtgactgctaatggacacagagtttcttttacaggccatgaaaatgttctgtaattaaatagtagtaatggctacaaaaatgtgaatgtattaaaaatcactttaaaaggatgaattttatagtatgtgaattatatttcaataaagctcttattttaaaaaagtaaaaccttgcccatcactcttgcctcggagtcttcctgtctaattaaaggtaagtcaaagacccctaacattacatgatctggcttcctattactccacagtctgatctccttttactttttccctctcattccagtctagctgcagtgcctcctggctgttcttgcctctagtctttttattggtagttccttcttcctaaaacttaccacctttaacagtttagtcaaatgtcaacctctcagcaaggctttccctggctaccctctctgaaattgtaaacctcccccagattacctatttcccctttttgctttactcttctccttggtattatttaccatctaacacaatatatattttacttttttatcttactatttctcttccccataaaatataagctccctgaggacagagattttgttgcttttgttcacaactgtatgtgggggtctaaaatatgcttggcacatattagcactgatattgttgaatgaatgaatctgaaagtatgagtacaagcagctataatgaaaatcaggaatactaagtaattgaagaaagggctacatattttatgccctttattaaaataaaaattaagtatctcatgggaccatgaaactaaaggagta

SEQ ID NO: 57193 - DNA, 1047 bp, Homo sapiens
tttctgttattattaggttgtaatatataatgaaataattatgcaactcaccataatgtagaatcactgggaaccctgagtttgtttttctgcaactagacggtcccatctgggggtgatggtagacagtgacagatcctcacgcagtagattctcatcaggaacacacaacctagatccctcgcatgcgcagttcacaatagggtatgtgctcctatgagaatctaatgccaccgctgatctgacaggaggcagagctcaggctgcaagtcgatggggagcagctgtaaacacagatgatgttttactcgctcacctgctgctcacctcctgctgtgccgcccagttcctaacaggccacagaccagtactggtccatggccctggggttgaggacccctgatctataggagagtttcttccttctttcgctctcattccatatttcttcacacataccgtaattccaattgcaattatttgtttgtaggttctgtccctcattagacaacagataatctgttccgatcatctttataacaaccccagtgcctaacacagtacctcccacagagcaaacattcaacaaataattgttgaatagataaaatatgcatgaattatcaaagaccagaatcgaacgagtttatctcacacatattctcttggtattactgataatgtccctagtcaaatggaatattaaatatgtaattacatttaataaacatttaataagagatcatgtgggataagagcagaatggatggatttttttccttaaagagagattttaattaatatttgaaattcagaactatggtgttttagttatatagtgtatactttgtctacttatgttggtaactgaaactagatagaattctttattatttaatgatttgtttctgtggctatttcttggaaccttttaggtgttatacatatgtataaattcacaatgtttttgcacatctgagttttgactgttcttcaaaaacaactttagtcatttgacattttctcctcttttaaagatcatttttc

SEQ ID NO: 57194 - DNA, 1016 bp, Homo sapiens
tgtttttccaagttaaacaaagagatagaaagcttcacgtccactatttaataaagactagtaagtgtccattgtccaaactaggggttttcaactctggccatacatgaaaatcacctaaggaacttcaaaaaatatactgatgcttagactccacctcagaccagttaaatcaaaatctctagactagagcccagtcttctgtatttttttaaaggtcccagatgattctaatatgcagctagggttgtaagccatttgtctaaatgattgataaaatattaggaactcattttagtcagtgtgttacctgtgaatatgagtgctttctttcctaccttcaagtctgacataagaaactaagaagcagtattttctcagtggcctttgttactcacatactaattgctgagttgcctgttagttgcccttctgtgtttgccacaatcagttcagatgaccaatgtaaatttacaaaatacttgctttacctttgaccagcctaagaatctcagatttcagggtgaaatattgaaattcaattcatagcatccaagctacaatacagttccaactttcatattctcagcattactgtattccaagaggatacttaaaacttatttcccatgatgcttaaagactctctatccgtgtttcttccctcttttcactaaccatctgcatggagttaaaatccataataggatcgccctccagtgagacctcttttaatgaacagtatatatatatatatatatatttatttattcatatgtgtatgaatgtatagatatgagtatattcatatgtctatgaaaatgttattaccaaaggtagaaatcatatagcaatcatgggtatgtcagaaaactatagcctgtagatattaactatatctttaagtcattttgtaatcagaaagggcataattttaaaatcttctaatgataaatatcttagaaaatatataatttagaaccaaaggtctcagagcagagaaaaaaaaagaataa

SEQ ID NO: 57195 - DNA, 1026 bp, Homo sapiens
agctcactgcaacctctgcctcccatgttcaagtgattctcctgcctcagcttcccgagtaggtgggattacaagcacatgccaccacgcctggctaatttttctatttttagtagagacggagttttgccatgttggccaggctggtcttgaactcctgccctcaggtgatccacctaccttggcctcccaaggtgctggaattacaggcgtgagccaccccacccagccaatagtcaaaataatttagaaaccactcttctagaagacaagaactatatcttattcatctcataacttcagcactgaccttttatttttcctaatctgtttatgaaaactgatttaatatatgggtgatattcttgattacccaaagtatgcacgttgcaaagacattgacctcttatgccatagtttcttcatcattagttggtagtttttaattaatcaacattgtgtactggtttttataaagggtctacaataaatctattaagtgaaatagaattaagaagggtggaatttagtgagtaggaagaatttctgtggaagtcctgtgagaataatgatagagaaactcatggggagtatcttagtttgcttctcatttaaggtataattgaatgtgtaagaatgtgttctgcctgtcaactctttaaaagttccatggggctgggcctggtggtacatgccagtagttccaagctatttgggagcctgaggcaagaggttcacttgagcccaggagtttcaggccgtagtgcggatgattgttctgtgaatagccactgaactccagcttgggcaacgtagtgagaccccatctctaaaaaatactaatactaataataaataaattaaaggtaaatggggagaaaagacaatacagtcaacagaagtgaaggtgaaaacctgatgatctgtcctagctacctgggcttatatgttatgcagtcagtgagactgttactcggaaactttttcattaaaataaggtggttacagtttaaaaaggccctgagc

SEQ ID NO: 57196 - DNA, 1045 bp, Homo sapiens
taatttttatttcttgtgtttgctttggatttaatttgctcttttttttctagttttctaagatagacacttagtattgggtttagatctttcttcttttctagtatatgcattcaatgctataaattttcctctaagcactgtttttactgcataccacaaaatttagatgctatgttttcatttttatttcattcagttcaaagtgttttttaatttctcttgagatttcttctttgatccatgtgttgttcagaagtatgttgtttaatccccacatattttgggattttctagtcatctttctattactgatttctagtttaattccattatgatctaaaagaagacattgtatgatctctattcttttaaatttattaatatgtgttttatgcccagaatttgatctgtcttggtgaatgttccatatgagcttgaggaatctctattctgctgttgttggataaagtagtctatagatgtcaattatatccagttgattaaatggtgttttggagttcaactatgtcctcactgattttctgcctgctagatctgtccatttctgatagataggtgtgtagtcttcaactatatagatttatctgtttctcctagcaactcttaccagttttgcctcatgtctcttgacactctgttattaagcacatacacattaaggctgtattcttggaaaattgacccatttatcattatataatgccattctttatccttgttaagttttcttgctgtaatatctgctctgtctgaaattaatatagctatgcctgctttcttttgattagtgttggcatagtatattgtttccatccatttactattaatctttatgtgcctttatatttaaagtgagtttctggtagatgatatatagttgggttttgttttctgatctacactgacaatctcttttaattggggtatttagactattgacgttcgaagtgattattgacatagttgggtttctaaccatatttgttaactgttttctatttgttgcctttgttctgtgtcc

SEQ ID NO: 57197 - DNA, 1038 bp, Homo sapiens
gatacaaaatattgactcaaatacccaaccagtttaagaatgttataatattggagagtttgtggatacataaaaactaatttcagagtcagttaagctatttctgtagaatcaagttacagtggtcagaggtgtatcttttgtttggtttttggtagaatgactataaagaataatgattatgatagctaaacaattttagcactgtcgcaggatgcttcatacatgttatcttgtttcatctttataataaccgtatatgataaatactattattatcaccattttatagatgaggaatctgaagtacagagaggttaaataatcttgcccagggtcatacagctagtaaatagcaaaaatggtatttgaacttgggcagtttggctccagagtccatgctttttactgctatgttctgtatgtatagcatatgaaattggccttgttggtttgcaattacatctagaagacgtgctgaaaaggaagcctgggtggatttccataattaggactactagcttgagtacagctccctaaggataatatgcttcaaaaatcattgaatgtgtgctaacacatttttgacacatcatgtctcgataatgttcaaaattttggaaacagtgcttgtggtatcagcatcagcacatcatcaccaccacctatatttattaagtacctactgtgtgccatacgtgttaaatgtagtctctcatgtaatacaacaaccctagatactattattatcctcattttatagatgaggaactgaggcataaaaagtttgagaaacttgcccagggtcacacagctaataagtagtagagctaagatttgaactcaggtctgcctctcatatttgatactcttatttatgttttactttttttttccagtaagtgactttttttcacttatctacctagaaaacagaaataaaattatagatttgccaagcagatgattactgtctttattttgtaaatgaagggacttgatgagggactactgctttattagcccttcttgaaccac

SEQ ID NO: 57198 - DNA, 1032 bp, Homo sapiens
tcagcaataaaaagagtactggtacatgttgcaatgtgtatgcatgttttcaaccttgaaaacactgaagtgggaggatcactttaggccaggacgtcaaggctgcagtcagccgtgatcgtgccactgcactccagcctgggaaacaggagagactctgtctcaataatagtaataataataagccagtcagtcacaaagtaccacatattggatgattccatgtataagaaatgaaaatgccaagaataggtaaatcaatttatatcatcgtgacatatctgaatgctaaggtttaaaaaaaaattaaaattttctagaaagaaaaaataggttgcatacaaaggaatgttgggggtggggggatgacattggaattctcagtagaaacaatgaaaaccagacgttagtggagcaatgtcttgaaaattctgagcggaaattattttcaacccaatattccatacccagagcagatctcgaatgtcaaactgaggagtttggattttagcctataagaaacaaggagcctttaaacatttttgatcaagaaaatgacctaatcagagttttgctatggatggattaatccagcagtggaatttcaggtaacttagtttgcagatactaagtctgagagaccagttaacaaaaagctgtaagaagatataatgagggctccaaggcggatagtagcagtggaaatggagaggcagagacaagataggaggaacgttttagaggcaaaatcaataggatgtcacaaagtcatcattgttccaaagccatctaatcagataaaagccagtaaagcgatttcctagaatcaatattggcagcattttcacattaaagccatgtcatataggagggtgttgggacacaaaaagactctgtgatgtttctgcctttcattcaaatgcacttaaaactaggaaatgactgaaaacagtggtactgtattgtcaggcattccaagattccaaatgcctgttgccagccttgctttggaagtgctacttaaatttacca

SEQ ID NO: 57199 - DNA, 2644 bp, Homo sapiens
aaaatacctaattggaaaataataaaatccagggagcaagtaaagctacatttttcccaaagtgaaagctcaaattcaatttttaaaaaactgattagacactatataaacttgctggtagagtattagggtacccaattttgttaattactacctaggacatttttaaacaaagtgagtgccttagaaatgcatactggtgaatacaacagtatgttgctgcacccagcttactggctgagctatctcatcaggaattcactgaagcagtctggaatcacaactgccaagccaagcagaaactcacctgcactggagtccaggattttatgtggcaataagcatttttaattaaaagtttcccaattcctaaatttggaacttaatctgtaaacatgtagcagattgagctagcaccaccaagcctcattggagctgtgggggaaatgtggcattctgaaaaattggccagttaagctgagaaaatccagctgtgttttacttaaaattgcactaatcagtgttattttattcctctttttcttcaccagtgtatctgctgttatgtgaatgttggctccccatctcccagcccttcacttttatcttttaagactgatttcatatagggatgaggattcaagcaatataatactcattcactttagtgagtaatagaaagcctcacctggctagtagtttatttcttaaataagtcagaagcagcaggtaattttcatcagcaaagcaattagattttaaccattacctatcacattgctagaggtcttgaagtttacacagaaatcaagattgtctgctgaccttaagataaaaatataaagaatatggtgtgccttaattagaagtaaaattgcctctgggaagcagttttttatttaaatcaatacatagtctgttggagccctgaattattcttacatggtgttcaggatgatggggcagtatgggaagtagtcagggagagaacctggccagtagtcaagggattcacaaagtccactttcaaggatgggttagattttttgatgaaggccattgtcagattggactgggaatcattattttaaactcattattctcccaataaatccacattctgctttctgttagaggagtaaactctggtgccaaacagggctactaaaactctgtagttagtagatctaagaaaaatcaattcagaaggaggtaaacatgaattagaggaaacttggggttactaatgctattacattgaaatatttgtacaaataatgcctcccctgtcccaagccagtcccaggctgtttgatcttcctgtttactataatcttgcttctctgggaattacttctgtcttcttagagatactttcttcccaatacagggagggcttgcttatttattcaataataatgttgaatatattcgtgactttggttttcaattcagtacacacacacataaaaatgccaaaagatatgacattctgaactatgtattaattaaaatttcggtaactaggaagagtttggagttataattctaagtggcttagttttaaattctcttatggctacatttgaagttagacctgagtatcaaaatgaaacttgttcagcactggaaatacagtgaaaaaatagttttcaccatctttctgtaaaagaagaaaatatatgtaagccaggtaagtttcagtaaaataatacctagaaacattaaaccacggtaggcactgtaaaggaaacagaatacatgtgagagaaagctttgtacttgcaaggtgagatataggaaatagcttctagtaggggcatgggaattgtatatgaagcaagctaaagtttctcaagttagtccctagtagaggttttactttttattttttatttattttgtatttttggtagagttggagttttaccatgttgcccagactggtctcaaattgctaaactcaagtggtttgcccacctcagcctcccgaagtgctgggattacaggtgtgagccacctagtagaggttttaataagagattatctcccactcccagagttggcctcgtctcttttctattgccttttactgagaacttgttcatagaaatggatagaagcctcaccattccttcctttctgtcttaaagtagtcaactttgccatgtttgcagagcatgccccttgcgttattcaagccatagcttcttgctgccttccagctctaatctccttataggtgtagcaccatggcaacagacccagcctagagcccaggtgccttgtttgttacctgaggggctgggtgcagcctgaaggaatagaataaggaatattacctatcctacaaattgtttggatagatgaagtcttgatctgttgtttgtgtttctgttctgcttctatggaagacttgaaataacacctggaaaacatttattcaaagattttatcagtaaccaaaggcaacaaagaagccatcttctatttgttctcgtcttctaaacagagagttgttttctgacatatagttcagaaagtgacttgctataccgggacatgtggcaccgctatgatttggggttgcactgccaggtggctctaccattgcttcatgtaggtagacgtttattttgtttga

SEQ ID NO: 57200 - DNA, 1433 bp, Homo sapiens
tatatgatgttatcacattcaaactgaacaaccaacattgagctttactagaagttctttaagactgttgaggaatgaagcagctgtttctttgcacctttatttccccttatgctatccttctggattgatggatggatggacggatggatgggtgggcgggcagacagaaagatagcctagacaatgacttcaagtgatgagttcagtagattctacattgacactgtggaccgatttgtaagtattatatattgaacacctaatatatgccagaaactgttaggtgctggagatatggtggtaaacaaaaacagaaactggttttctggggaaaataaatattaatcaagtaattacagaaataaatatgattacagtgagaactacagaggataaaaagagagatgatactatgaaatggagcaaggggagctgactaatggagttcaggggcaatgttggtcagggacaccttcactgaggaaatgatgtgtgaactaaaatccaaaggatcccaggaatgagctacctgacagtgggagtggaagcaagggtgggagcagagcagaactgagaacagtatttggaaaaaaaaaaaaaaaggctttgtggtgaatagagaacattgtgtgtgttagaaagggcttggtgtattaaaggacctaaaaagaaaaggtacaaggcttgaaaggtagacagaaaccagaaaatatagggacttgtagactgcattcagaattatggcctttatcaaaagtgcaatggaaaatctttgagggaattttaaatgtaggggtaggaacacctaacattttatcctgattgctttttttcctttcagatgaatctgatagctttagttttaaagcagcatttccaggatgtctgatatttcaaaagtctcttctaatgtgtattatttattcagttgctttctgcctgattgaacattattctaccaggattttctgactgacttggtgatgtctgaggtggatcgttgtggagagcatgatgtcttgatcttcagagagaacactattgccaccaaatccattgaggaatacctcaagttggtgggacaacagtatcttcatgacgcactgggtatgaaagagaaaaacatctattttcttttatttacttttcagttttaagctatttcacccccatgagacgaattgagctcaaattctgcatgttatttagttctagctgactcaggtgttaaggtttgaatcatggctgtaagaagtctgcagtactcaccagtagagaaataataataaatgtagaaacagaaaccttgtcagcatacactgctaccccaggtccccagcttcatgattccaggatgcacagtaatatcagcagtgtccactgatagatctgaggtggtctgttttgcccaaagttttgggtgtttatat

SEQ ID NO: 57201 - DNA, 1023 bp, Homo sapiens
aaatgtacgtatccacataagaaccttcggaggagttcatatgcctgaattgaggcatcttagccatgttgaagttgtctcaagagaaattaagtgtcctttccttttccacagtgatttgcataaactaaaatctccaagccaggacaacacagacagctacttcagagggaaaacattattgctggttcagcaagcctcctctcagagcatgacttattctgaaaaggatgaaagggaaagtagccttcctaatggtcggagcgtctccctcatggacctccaggacactcatgctgctcaagtggagcatgcatctgtcatgcttgatgtgcctatacgcttgaccggaagccagctttccataacccaggtggccagcatcaaacagctgcgggaaacccagagcactccccaaagtgcaccccaagtgagaaggcccctgcacccagccttgaaccagccaggtggccttcagcccttgtcgttccagaaccctgtctatcacctcaataacccaattccagcaatgccaaaggcctctatagattccagtttggagaacctaagcactgccagttccagaagccaaagtaacagtgaagacttcaagctcagtggacccagcaatagcagcatggaagatttcactaaacgtagcactcagagtgaggacttctccaggcggcacacggtgccagatagacacatacctcttgctttgccacgacaaaatagtactgggcaggcccagatccgaaaagtggaccagggtgggttaggtgcccgagccaaagccccaccatccctgccacacagtgcttctttacgtagcaccgggagcatgtcagtggtgtccgcagccctggtggccgaacctgtgcagaatgggagccggtcccggcagcagtcctcttcctccagagagagccctgttcccaaagttagagcaatccagagacaacagacacagcaggtaggtgtgagtgctgaaggggcctggcttctacttggtccatctgt

SEQ ID NO: 57202 - DNA, 1030 bp, Homo sapiens
attggattatttatagaatccttggatacagaaatagaagaagggatgaaaagcatgactaacttaagctgtttctggaagcagacttcctgggctaaacctcctagttggtcattttttactgagtaataaagtttttctacagtcttaaatttttcatttttattttgttatatttcccaaaattttaccaaatcatttgatttagtaagcatttttatttgaagaaaaggaaaaatagatatcttttatatgtatcatatgtattttttatatataaatgtgtatgtgtatataagcataaaatgtatgtgttagaaggctatcagtcattcctaccttattgtgaagtagtttcctcacatcacttttgtgctagattctagttgcgatcaactactttcagagaattaagatgtttattgggaggagaaaggaaaaaatacataattttagaaatcagaatactgtgtagaagcaaatatctactcagggacttagggcagcacaagggcactgaagataaaataggattagcgaagagcatgagatctggcagagagggacaggacagggaaagtgtcctccacctgcttttcaaaagtgtacttaggcccagccctgtacagaaaaggaaaataaagattcttttttttttcttttgcttaccctttccttctgtatcatggagggcctatgactcaggctggttgtttattaatattataaattaaatagccttttttgtgctcatctggaaccagttgtcatttataacattttttctttaggaaaatacaatacctatcgcataagcacataatacatgtttctgtgggttatgattagagggctgcctggatggatgggaggtaggaaatgcatacagtctccaaacaaccaatataaaaattagtttttgtgtcacagccattaatgagtcaccaaatatattttttggcatgaagtggggtacaggcacagtgagatgtccaggtacagctttgaatattaatctttgtttatactt

SEQ ID NO: 57203 - DNA, 1025 bp, Homo sapiens
acagctttatctcaaagggaagatattcctaatgggaattcctgctcctttttctttttgtctttttcattatctttgatgatcatgttgaaagtcagtggatataaattctctttctaaggccattcctaagcaagatggaatctgaaccacttactaacctcctccctcaattttttggactataaactagagatattttttgctatttatccagcttataaggagatggaacaatcattgaaaagaagcctttggtgcccttccaaaggattaggggaaaaacatagaatattctctaagtaataaattatattttagtaatgaattctaaagataatccagaataataaatgaataatattttattgagcatctgttgtgtatttaactagtcagtatcatttaaaagaactgtatgatatgatgcccattagattgactaattggaaaataagagcaacgcttataagaccaagaatatataaaagatagtatatagttttttcatttgaagaacatactacaacaaaaaaattcatgaaacaaaaatcacctctgtttcctttcaatctagcacaataactattttttatttattctatatttctagcctttttacaattttgtgaaggctttatcattaatagaaggaatagttaggattgatctattttgtcacttttatttttattattttgaccacctactgtatgccaagcaaagtgctaggatatattaggaagtggctgaaaataagatttgaccaacaaaatagtagaaatttctagaagttcattcacaattgcttagtgtgtacgggtctatttatataaactatgcacatccatcctcaggcatgaagctatttttattgatatataactataatctgtaaatcgactaaaccagatctttcttcacacctttaagaaatgtccctatgttacttttgcatgtgtaagttttaaagtctctcccaacccatctctgatagccttttagtctctgcaatcagtttttta

SEQ ID NO: 57204 - DNA, 1339 bp, Homo sapiens
ccagactgatgagcgcgctgacccaagtgaaggagcggtacagcatgcaggtccgcaatggcatctcccccaccaaccccaccaagctttccatcacggagaatggtgaattcaaaaacagcagctgctgacgggctttgtctgtggaaggagacagaaggaaattgacccactctcctatctccagacctttacctagcccctccaggtttacagaatgttgctacttcacaatggcgatgtggtgagaaactcctgaatgaagaaaggaaccttgtctttcagggcataaggcggcgacttccaaggtcaatgcttttcccccacatctctatgtacatagggaacttagttctgggccatgtacagaaaatatcactgtaatataccaaaaggaagttaataatgtagattacctttttgattattgctatttttattattgttttcctcttgttgaaagcactgcagttgttacaggaagtaaagtaggaactgttgtgtgagcgagacatgagcctgtaggttcagtaggtagagaccaagcatctatctgatagaagcacatggagtgcaataggacattgtgagaaggaatttttcagggattcatctactagtttaaaaaccccactctggccctcttgtcctttcagaaaacatgcaaataccaagatccatacaaaacaataatttattccactgatcaaccaagactggttctggttggacagctaatctgatttggggattcactgtttcagaggacacagacaaaagctgttgcatcaaaactggactttaggagtaatttctattgaactcctgtcaatatgtttatttcctctgtctacagcagatgggagtcttctcttttagacaggggctttttgtttttaaccccaattgtaataaagggtgttctttttcctctttagagtttacaaaactataaatatttgtgtctccacataccatcttcatcttcacacattcactgtgctttcctccccatagtgggagctgtcatcaccaacagggtttactctcccctggagaggttatttaaatagctgtccataagccatccagatcaacaccctttcttccatacagaaaagggctaaccataccacagctggaatctctgaatatttcctattaaaaattttttctatgtgttgttataatttttgtttgggataaagactctatccattgtactagcaaatctatggggggtaattttatctccatctttaacttttaaagtacttcttccccttatcccctcaataaagaaaggaaatccaaatttgaagcatcactctcttaaaag

SEQ ID NO: 57205 - DNA, 1080 bp, Homo sapiens
atctcttctatcagtgccactccctacactggccacagctacaggaggggaaaataaaagatttattgcaaatacaaccaggagtaaggtggcctgatattggtgactgcccctgagctaaaagacaggcaaggacagccactgctaggcacacagttgctgcagaagccagcgatgtgggaagctcaattcctgccaatccctgactcacccctacaggctcttttaacccagcacttgagttgctacaccatcatctttcagaaagcccccctggcagcaggacctgtggggcttgggcaatgttaggaggtttttcctcatcaaattttttttgttcagtagcctgtgctccaaagggcctaatgtccttattttgtctgccagctacacaaagcccccaccatggcacccagggaccctcaatatcgccatctccatcccaaaccaagttcaggctctcccccagcaccccctctcttcctgtatggctggccatgcccggaggcgctccagccagagaccctggtgtcctcagcggctcccttgctccatctcacctgctctcatgttcagtcaccaaagtcctgtcagtgccttgcagatgtcttattttttcaaatatggaaataatccttttatttggaatatattattgtaaaatatgtaagcaaatttgtcccctccccaacccagggacacccatgattaacactttgctgtagaaggtccttcacactctcgaatttgttaatttgaatgtgtaaagatctcccttgttctctttaaaggctgcatagtagtatttcactgaatgtaccataacttatttaaccgatctgctttcagtggacattacgttgtttccaccttttcactgtaataaacaatgccgcaacaaacaaccgtgtgtgtggaaggtgcatatatatgtgtgtacctcatattactatttccttaatcaatttctaagggtagaatttctgtacgaaagattatgcacatgttaaaactgacacaaattctgataccagagtggtagccccagtcggcatacctactgtgccaagatcactgttt

SEQ ID NO: 57206 - DNA, 1055 bp, Homo sapiens
aaaaaaaagtaagcatctttataaactttgcatttgtgtgattcagtgaacaaagctgagcattttttaaaatgtatttgtattggtacttcagttaacgtcacttgtgaacaatgtaaaatcaattcgctgtcatgtcccttcccactccagtgctccagaacaggcctgggttccacccacccagactgtgcaatattctttccccacacacacgtttcctgtctctccttttctgattggccaccccttcaaaggcctctttccccacccaaagcatcataaatttctttaataaagtggataaatgtgtaaaattcagaaacacagaagaggaggaaacatctgtattttcatcccctgaatatagtcactgttaacattgtcacacatctccttccagacttgattcctaagcattgctatttcctttcagccttgttgtgactgtattatgtacataacattgataatgcttttttcatttagcaccctaatacaagcattgtcctacatcatcctaaccaccttgcttctggaaactacagatctgagcattttgctcacctgctgtaaacctctgatggctccattggctgggggatcaagtccttcagattttgcccccagtgtacccctttctcctcatcccctgccactcccttccccactatgtggcctacaccagtcgcatcaaactgcttgtcattcccaagcaaaccatacagtttgacatctgtctttacccatgctattccttctgccaggaagaactttctgtacttttctgccagatgaaatcctccattgttacaccttctatcctattaccaccttccaggcagaaggaaatgaattgctttcctgccacagctcttggttcacacttctggtgcagcattttccaaaccgtcctgactgtctccgttagttcctatgagaccatgtgcttctaaaaacaggaaacagccctgctcatcttggtatccacagttcaatgccttcttcaaaacaagtactcaggaaattatcgtccaattaaatcatctaccaat

SEQ ID NO: 57207 - DNA, 1058 bp, Homo sapiens
tcaccatagaagcagaagaagggcagcagggaagagcagttcactgagtacacttttggggagtaggtcatatagatgccaagagctgtgcacagtcctctcaccatcatcggcacctgcagccaggaggggatgctggcccccaggtcactggaccagctcagagatccggagtttgcattgaggtagaggccaatccaggcttcagtctcactcatgatggatctcaaggcctccttgcctgtctcatccgtcaccatctgcaggtcggccagatccgtgtggtggctgcggcagtacagcagggccgaggaccatgtcatcacttggtcaaatcgcatgaaggtctgaccactgatctggaccacagctggggtcaaagaatgtggagatcactggcctgagggcctgggtctctgacagcccagccttcatcacccttggggatagaattttggtctgacatgggcccttgtccctggtccttgagtattagatttgatcaaaacaacagttttataggtagactaaataccaggatggaagaatggatgagatagtatagcagcaggtgggggaaacattagggaaagcagagcttaagagttcttgtagctatatggcctcacaagttcagtttaagtcctaatttcttcatctatacaatgggaaaataatagtacctaaggtcaggattacatgaaatcacatatgcaaatggtttagcacagtgatatattaatagtaagcacttggcaagatggtagtgaccatttcgggggagattatgaggaagacagaacaatcttggtttggggccaccctccagtgtgatttctaggggcggtgcctgcccccactggctctcgggcgaatccagggctgagcagaatagatgaactgtgcgatgttcctagactcaccgtgcctggagagccagggagaagaggccagcctggagggatgggcctggtggacaggaggcagagcaggctcagtggccttgccttctggggagcccagacagactgagatgctatcctcccacaaccaccact

SEQ ID NO: 57208 - DNA, 1027 bp, Homo sapiens
tctctactaaaaatacaaaaaattagctgggcatggtggcatgtgcctgtagtaccagctactcaggaggctgaggcaggaggatcagccaccgggaatgtcgggtgagctgtgagtgtgccactgtactccagcctgggagacagagtgagaccatccgtgtcttaaaaaaataaaaaataaaaaataaaaataaggacattgattctccccatggggttcagccagggggcagcaaattctggaaatccctcccggacagccaggcagaaatcaggggaacagaggggacgcgggggtggagatcctgctggctggtcttggtggagagatccaaggcaaaacaagccaaattcccagaaaagggaatggggagcaggtatgtacctggctttggagaggtggtcaggctgagagagggcttcgtggagatgaggtgcccgacgtcagggtctgtaaaacagaaacagaccacgagttatggggaggcccaggatcctctgcaggcaggagctgtccggttatagccgggaaaacctagctcaggggcagacaggctggtccatccctttccacatcgattcaatccattcaataaatactgggcacctattgtgtcgcagatgctattctacaccctgggaaaaaatggcagaaataagacaagcggagtccttgctcttgaagagaatatgagaaggagcaaatcttgtagagagctgggaggagctgcccaagcacagccacgacaaaggttctgcagtgagaaggagccaaaggaattcatgtggctgggacaggagtaggagatgaggccgaagaggggaggcgaggcctgatggctaaaggaggacaggattctaagtgctgccaggtcctcctgattcttttgtttacagggaagtgacctgatttacctttttaaaagctcactctgtgtagagaacagattttaggggtcaagggcagacccagaggagagacagcgctgacttgaccccacatgctagcagcagaggtgcagagc

SEQ ID NO: 57209 - DNA, 1052 bp, Homo sapiens
tgctcaggagatgaagtgacgggtcaagagggaggaagggtgggacgtccagaggaacagcaggatgaaggccaggtaaggttattgcatcagtgagaggagtctcatggacaccaggccagcacttcacagtgtccttcctgtggacttctgtggctcccattttctttttttgtttgtttttttgtttttgagacagagtctcactctgttgccaaggctggagtgtagtggtgcaatctcagcttactgcaacctccgcctcctggattcaagcaattctcctgcctcagcctcctgagtagctggattacaggtgcatgcctccatgcccagctaatttttgtatttttagtagagatggggttttgccatgttggccaggctggtctcaaactcctgacctcaggtgatccacccgcctcggcctcccaaagtgctgggattacaagtgtgacccactgtgcccggccggctcccatttttcttattctctgagcactgacagctgaaggagacaatactcagaacccaagggctgctgcgtttatgaatagcccatcatttcctgaggcaggaatgataggacctccaaaaacaagaatatgttagctgcccagacccccatgtggtgaaatgtcagtctgacacacacagctcagagaacaccttgttgttcaacagtcttagaggatgtgtagatttccgtccagtccaaactgctgtgtgcagtgacaaggccaggcaaaggtgctcttgggccagtggagcagacagagggctgatttggtatgcagcatgcctgctgggacaggtgagcatggtctctgctagaagaaagagccatttgatatgacaggggcacactgcccccccagggcccagcatggacaggagctccccatgatgagcggagggggtgtgccgtcttcagaggctcaggcaggcaatgggactggcaaagcctggcattcagtggccctgcctggctcctgcagtggattcagagaagctaggattcagaggagctaggattcagaggagctaggatt

SEQ ID NO: 57210 - DNA, 1041 bp, Homo sapiens
ccttatttgagttcctttcttgtttttttccaaaaactgcatatctcaccaagtacgaattatttaaaagaaaacaataaagaactaagattttcacctttggctgagttggaagtaaaggttcacactgggaatgggagaaaataagaggaatttgcaggggcaaatgctaggattttaatatctcccacatcccgtgatgcatattgtgcctgatatctaaaacaaaaccaaatttaaaaacagctatttgggtgaggttagagagacaatgtattgcacaccagcaaaatgagggtgatgtgagcatgagcctgcaagttgcatcgttgtcttggaggtcctcacatacacaaagatgttctgttttcactttgcttgtccatctcccacacatatacaacttgaaattcatttttaataagacttcagtcccagtggtaggcagataggagagacattaaagagaagaaacttcatattgagagtagggcattggtcagttattagcatttattaggctgggtccctgcattgtagcaggttcattatgtctgttgattaaattaacgcaggacactatactgtaatagcaagtggagatggatttgattcctttcctaagagagtcaatttgctggtactccccaatcatgccgtagaaccagttgcccatccatagagactgccatagaatatatgtttgaataattaagttgtagttttatagttaaatcctttttaaacctacttcctcattctcattagaaacactgtactgatccatgttcttttcttctgcttcattacctaagatttttggaatttatctgctttttatttattttttaaaattaattaatatttttttgagatggagtcccattctgttgctcaggctggagtgcagtggcgtgatctcagctcagtgcaacctcggtcgcccaggtttaagtgattctcatgcctcagcctcccgagtagctgggactgcaggcatgtgccacagcacctggctaatttttgtatttctagtagagg

SEQ ID NO: 57211 - DNA, 1038 bp, Homo sapiens
aaaataaaagaagaagaaagaaagagagaacgagaaaggagaagggagggaggcaggaaggaaggaaggaaggagagagagagagagaaactgccctttgggtagcatggcatatgccgcttctcctgttcgcagtcagatcttcctccctttatgtaaagagtctattcttaccactgctgacatctaaagagcacagaagcaagaattacagcttagagaagttctgcaagatagaagtaacaagggaagacagaagattgtctactctggggagttttctgctttagtgttcacaaaacatttcataatctgcagataaatgtgcaggctctgcaaaatagaacatgcaaatagttcttggtaaaatctatggatcaaagctatttctctttgcccttcaaatgatctagtttgctttttaaatatttgaacattttcctacaagttgtgacaatgacacaagtttaaacacaccatgccttttataaatagatcctaacctgaaaaagcttccaccctgactgactcttgtctgaggtttgagaggaaaagagagatttaaagggaagctaattaatacaaatcttctaaaacatacatgaggctaggaatatattaagtgcttaattaaaaaacaatgtaatcccagcactttgggaggccgaggcgggcggatcacgaggtcaggagatcgagaccatcctggcgaacacggtgaaaccccgtctctactaaaaatacaaaaaaaatttagccgggcgtggtggcaggcgcctgtagtcccagctactcgggaggctgaggcaggagaatggtgtgaacccggggggcggagcttgcggtgagccgtgaccgcgccactgcactcctgcctgggagacagcgagactccatctcaaaaaaaaaaaaaaaaaaaatgttctattgggtttaacacctaagtcaatgaagtcgtatcagttgaggaaatagtcacaaaagaggttttgtaaatggcagaattgatgagtgctacagttcacaaattttctacca

SEQ ID NO: 57212 - DNA, 1104 bp, Homo sapiens
aaaagaagaaaaaaagcgttcccccccacccaatatttcaaatgacaagagtccaaaaaagaaaagaaaaaggaagatgattggtaaaaaggagggaagtgcattatgtatacagaaagttttcgcatagatgttagttgcttcaagtcccaaataaacaacaactaaatgaattagcacttggaggaaaaaccccttccagttattgagttgggtaaatgtttagtcttcttaaagtgttactaagagattaaggaaaatgtcgttggctatatgccaacaataatacatgcaacatacataccattatcacacataattaactgctcttaagaaatatgaaaactgaggaacggaactcttatgttgttaaatgtcatacaattacttgaaacttgaattagggtttcatagatataaatgaggcagggtccctacatctgccaataattttcacagcttattgtaaaagcagtgaagttttcacttggactttgaaaagaaaaaaacatatgactcatgagcaaggccatggatacactaaattcttatgcctactgaatttgagtttgaataattaccccaaatctgtttctcacattgataacttataaaacaatacttttattaaccttaagagttgtgttaagttcaaatttgtgaacttggtaagattaagaatttgtatataggccgggcgtggtggctcacacttgtaatcccaacactttgggaggctgaggcaggcagatcacctgaggtcaggagtgcaagaccagcctgaccaacatggtgaagctggtcgctactaaaaatacaaaaaaattagccgggcgtggttgtgggcacctgtaattccagctactcaggaggctgaggctggggaatcacttgaacccaggaggcagtggttgcagtgagccaagatcgcaccactgcactccagcctgggcgacagagggagatactatctcaaaagaaaaaaagaatttgtatataaaaatagagaaaaaagtttgtcctcaatatcttttataaaataagtgtcccttcccattccttgataaatgaaagcagtggctttttataccaaattttctttac

SEQ ID NO: 57213 - DNA, 1316 bp, Homo sapiens
gtctcctctgtcccccaggctggagagcagtgatatgatcttggctcagtgcaccctccacctcctgggttcaagtgatcctcctgcctcagcctcctaagtagctgggattacaagcatgcgccaccacacccagctaatttttgtatttttggtagagatggtgtttcaccatgttggccagaccagtctcaaactcctgacctcaagtgatccgcctacctcggcctctcagagtgctgggattacaggtgtgagccactgtgcctggcctgattttctagtttgaagtggttgttgaaaagtcttatgccattcaaaatcttcatccttcatatgtgacctggccctacgatcttttgtcttcagtatatctgctatgtccctgatattttatgtatcttgtattgactttactttatttcttctacactgaatttagtgggcgctttcaaccagcagtgtccatgattatatggagaggagatatgatctagtttagaggtcagcagactttttctttgaaggttaggtagtattttaggcattttgggcaatacaatccattactgctactcagctttgctgttgtctagtgaaatcaagcataagcagtgtgggactgtggtttgctgacacctgatcttatacaagcagaaggattagcctttgcttcaccaggagtagggagagttactatagaaataggagagaagacaaagtatatggatagacacatgatggtggtagcttgagaacgttctcatgagtgtttcaatttacctttgtgtatagaggccaagctcatcatctgagagtaaggaagaatgggaatatgtattagaggtttgagaaggaataatacatgacatagtcacttgtcaaagagtaaaaaagtgaatagaagagggagagtatgattgccaggcagcagtaagggctcacttgagatacatggttctgaattttatgttcctgatttattttatttatttatttatttatttgagacagagtctcactctgtcgcctaggctggagtgcagtggcgcgatctcggctcactgcaacttccatctcctgggttcaggtggttctcctgcctcagcctcccaagtagctgggactacagttgcgtgccaccacatccggctaattttttgtttttttagtagagacagggtttcaccatgttagccaggatggtctcagatctcctgacctcgtgatctgcccatcttggcctcccaaagtgctgggattacaggcgtgagccaccacactcggccatgttcctgattttaataggagtacct

SEQ ID NO: 57214 - DNA, 1009 bp, Homo sapiens
aaaatagatacaattttagttctttcgggaacaaaatatagtgtattcattgtgctatatacaagtctgtagtggccctgaacactgtaatgactatgagtttccatttatgtcctacatgatgtaggtagtattagtcctgtgattttcaagtaagttacttcctgtcttagtatctcaaattcgatacctataaatgaaggggtgggccgaaatgatcgtcagttcccatcatttccacaattctgtgttttcctaacttttcccccatacctcagagggctctctaagtagaaccattggattagcaatagaagaagaacaatgtattctataaataaagcacaagaagaaaatggcttttgtatttaaatggcaaaaagaaaaaaccagaaatacttatttcttctcctccctgaaaaaaaaaatcaaaaaaatgaaattctttatgcaaattacgtttttgacctaaaattcacctgtcttcttcttaggtgtattttttccttttgaatgaactgcaacagttgtattgctgctttatatgagatcagtgctgtctagcagaaatatagtataagccatttatataactttgttttctggtagccacattataaggtaaaaagaaagatgaaattgattttaatgattttatgtaacctgctacatacaaaatattatcgtttcaacttgtaatcagtgtaaaaaattattgagatatcttacattcttttttctccgctaagccttcaaatccaacatatacaacaattgcagtacatctttatttggagtagctatatttcaagtgcttagtagccattggtggctaggagcttggatattgaagatccagataatactacttgaagacatagacttcacatctatgggaaatttttattcccttggggcatctgatagtactttgtgaaacttagaaataaaccttaaaattcccttgacctttactccatttatctaatccctttgatttttttaacct

SEQ ID NO: 57215 - DNA, 1164 bp, Homo sapiens
gcatcacccttagaacattccttttaagagtattggaacctacaagatgaaatttagatcaagaatttctttgcagaacaaacctacaagatataaggaagctctgacttctgtgaattcagtaattctttcatagggtaggtggtcatcagttgtgggattttgccctccctgtgcttccaaaataaatgcaagtgaaaattgggcttagtagtttcatagtttaaaattaatcaatgaatattctttcaaatacacttataatgactgttaagaaattgcctttatatatgatttactatttgaagatttctctttactacgtgattttaaaattgcaagttaaatccattgtaacaaattttaaggggtatcaaggctgctaaatttcatttagcctttgctaaaatggaggcttatttacatagtatactcaaaacagttttattcctaagtcatacccttgaaaaaagcatcctttgagttgttgagtttacttcaaccttttgatgttcatatgagatattttagtatagactaattcttgaccaggctgaactgtcaatatgcaagatggcatctgtggcataatttatttcctggattgtattctagtgtgacttggaggaagatcttagaatctgaaacagaaagagatagagacaaagggaaaagcaatttttttttttttaatcacagagaaatttagcagctcttgagaggtagaggtggggcagggcaaaattcctttaatgccaggtaaccataaatgcatgtcaaagtttaagaagaaatagtgggttagttcttgggagtcccggtgcaattttagcttcataattcattatgtagttttgtttttattgctgttttttaactttttattttgacataatagattcacaggaagttgcaacaaaatagtacagagataattagaggcccataggcagttataaaagtagtccagaaaagtcccatttacttactcttcattcagttttcctcagcagttacatcttacataactatagtacaatatcaaaaccaagaaattgatatttttataatacgtgtctgtataaatctgtgatttttgtcatatatgtagatttatctaaccactacctcagtcaagattcagaactattgcatcaccacaaa

SEQ ID NO: 57216 - DNA, 1415 bp, Homo sapiens
aaaaatgtaaggaattaaaggattttacagttattaggactagccatgactagatttatcaagaaaaagtgttaatcgcaaaatttggtgtttatttcttaacattatgcaagaatgatgtttatctttgaggtggcaagggacagttcattaaaatacttggacatttgagctaaatatgaatgcataattttctaaaattaggaaggtgattaataaaaattgattaatttaaaatagtaaacacgaaaatgttataatttattacttagttaattttatgaacatacaaaggatatcttataaataatgaatttggattattaatagacaaatctgattttgtcttatttatatactaccaagatataattaaagaagatataactttgaaattaaaatccatattcacagtaaatacaacttcagttcaggtctttgctacaataaaatgagatttgtaaataacttaggtttttctgtttgttttttagttattaagtcgaaaagacaaaactacctttgaaaaattagaatatgtaatgagtaaagaagataactacaaaagactcagagactatataagtagcttaaagatgacaccttgcattccctatttaggtgagttatgtcactgtgtgttttttgtttctagttgttactcttccttactcagtaatttatgtgaaattcaaggtattttttaaatgtttgtatcttttaaataaattacttcaagattggtaagctgaaaaaaatgactaaagatagttgttaccctgttacctggaatgtattttcatattagattagccttttgccctcaaggtttttcttagactattatgttttcttagagtaggaccatatagtaaaacaatatttttagctgttttagtaatgcttttaaagaatataatagttcgtaatgatgtttaatacattaaggaaattgatcaaagtccttatatagtgaggagatattttagtgtgaattctgaagtagtctcagtgcatattggtattgttgtttacctgaatgaaatgagttgattcactgtggcaatttagcttcgtgctgagacagttctgtatttcgcatctcatctaattaagaatttatctctttattatatatcttgtagtgcttataaattcaagaagtatttaaccagtaatattataagattatttttaacaaaatatgaataatgctttgttaggtgtttgaatgaaaagaagacccaaataagttgttcttttaaataggtatgtaaatcaaacataaggaaaatacatgatacatacctagcatacattaaaatgaattgatttgatcctatgtagagagtaatcaaatgatgaagatttggtgctttctggtcctccccaccccccagattttgtgtttgatg

SEQ ID NO: 57217 - DNA, 1061 bp, Homo sapiens
gtcctgtttctttgataaacagcttaggatcatagtaagcatgactcttatcagagaggctctaagctggatattaggagaaagacattctgtatgtgctttacatttttaggttgttgctgtcattgtttgttttgttttgttttgtttgttttttgagacagcctcgctctgtttcctaggctggagctcagaagtgcgatcgctgcttgctgcagcctctgccttccaagttcaagtgattctcctgcttcagcctcccaagtagctgggattacaggcaagcaccaccacgcccagctaatttttgtatttttagtagagacagggtttcgccatgttggccaggctggtcttgaactcctggcctcaagtgatccgcccatctcagtctcccaaagtgctgggattgtaggcatgagccatcacacccagcgtggtgctctgtgttttaccatagccttggctgtgcccatacttgcaaatataatttgaggagagaaggaatagggaatttttcaaaaataataccttcacaattcagaagaatgtgtactttttatagtatgaagaacattagactgagaattggcaatcctcaattccacaatgactctacagtccttatttttcaagtcattgaattttcttctttgagccttgttctctttacctagaaatagcatgcataggactagaatcatgttctccttaaggctggatgggagcattgtgatatcttctttcttttcttttttttttttttttttgcgacagagtctcgctctgttgtccaggctagagtgcagtggcacagtctcagctcactgcaacctccgcctcctgggttcaagtgattctcctgcctcagcctcccaggtagctgggattacaggcatgcaccaccatgcccagctaatttttgtatttttagtcgagatggggtttcaccatattggccaggctagtcttgaattcctgacctcaagttgtccgcccacctcagcctcccaaattgctgggattataggcatgagtgatggcacccagctgtagtgatg

SEQ ID NO: 57218 - DNA, 1086 bp, Homo sapiens
acattcatgcactctcatgcacacacagagagaaagttggggaagaaagcactagccaagttggagtttagtagaatcaggaaaggttttctagtggagaatatacctcttctgtctcagcccccgacctgaaacaaagagtaatcatacctacgggttaaagcaaatgcggaaaatgttgaggtacagatgttaattttgagaaaatattacaagcattgtttttctcgtatcttccatttttcccatcatctccaatgactccttctttttttcagttccctttcattttatatgttctcatgatgtaggatcttacgtttcactctcaccgtgtagttctgcttcactttatacttaagccaatttaaaagtatctcattcttgttgtcacctttttctccatcttcactctctagaaattttcctaataaggtcaccagtgacttcctggttgaaacattttatagatgtttctcaagccccatcttaattgtgtgagggttggtgtcaattatttctcctccttgaaattctccacaagtagcaccagtctttcttggtttcccttctacatttctggcttttattagctgctcttactctacctttgtctcttaaatgtattcttgagaggtctcagtccacttcttttctttctttcttttttttatttttatttttcagagacagggtctcactctgtcatccaggctggtgtgcagtggcatgatcagctcactgcagcttcaaacttctggactcaagcgatcctcccaccttagcctctgcagtagctgagactacaggtgtgcaccaccaagcacagctaattttaaaattttttttgtagagacaggatctcgccatgttgcccaggctgatctcaaactcctggcctcaagcagtcttcctgcttcagcctcccaaagtgctgggattacaggtgtgagccactgggctcagccagtccacttcttttcttactctatataatcggagtggtctcattcaggttttttctgtatattgcctgatcttccaaatctagactgaatctgtctaactttgtatatcactgtatat

SEQ ID NO: 57219 - DNA, 1032 bp, Homo sapiens
tatagtgcatagaaaaaaggtaaccgctaatgatttcttaacatgaggtatatggtccaaactaatagttttttctcccctaaaaatgagaaccaaaacctaccaatttttgtgaagcttgtaaaagggagtagagtcctatatgctggtaaaactcttattttgataccaccaaatttatctgtagttcaatgtggattaaattataagaagtagaaatgttttctcggctctcaactcatcatcccttgaaaaattgtctcttctgttggtttgcattcaaggtaaaaattagtcagcttggacaatatcgtgaaaaattcttagaataaggatataatttgtctagagaggaatagttggcaaatctgaaggaaaaaattgctttataagagaattattgcttttaaatctgaaagtcattaacaacacttatttgttcttgtcattggagaacagtcttaaggggcttgttgaagaatttggcatggtaagttttattttgctgacgagagcaaactagaatattgtgaaaaaaataatttagttatatgaaacatcataaatattctttaatgtgctttttctaagcctcatttctactttatgtactacaaagatgcagtagctcgaccaagaaagcatattttggctaggtgcggtggttcatgcctgtcatcctagcactttgggaggctgaggcaggtggatcacctgaggtcaggagttcgagaccagcctggccaacatggcaaaaccacgtctctactaaaaaatacaaaaaattagctgggtgtggtggcacacgcctgtattcccactccagcttgggtgacagagcaagactccatctcaaaaaaaaaaaaaaaaccatattttttgaactgtggaaatcagtaaattgttgcagtactctgtactgcttcctattaagtagaagcagaatgtaacagaaaagtttttgtaaaatctctagccctctgtagaatgtgagtatactcttttggtggatctagatatgactcctttttc

SEQ ID NO: 57220 - DNA, 1043 bp, Homo sapiens
aggttttcatgatagtacttttttgttagaagagaaatacttttcttataaccctctgtaatatagtgttccttgcctactgctctctgaaaagcaccctgtttatgatattttcattaatctgtctcctcctcaacagaatgtaagcccctatttgtcttggtttaagggtttatccttacagcatctagaacaaaagtagtcatataataaatgtttcttggttcaactaattatccctttctagctcttcccattgtttcagtgattttgatttaatttctgtttaaacaataaatgtatttgtgtggcatatttgcatgggtcaactccttacccacccctgattttttttgttgttgttattttgttttgtttttggtgcctcagctggcacctagtatttacttagcactgtgcttggtgctaaatatatagcaagagattacaatgggctttgtccctgcctttatagaacttaatatctctggaattacaaaggtccaggatatcattaacctcatgaataatctctcctcttttctatatcctggaagagatgcatatcattgccttgtgccttacattgttagtggtgtccttatcatagttaatgacatttttaaagcatacctaaaatgataagaatcttaccgatttggttttcagtcgtttttgcatatattgaattgttaaatattcagtagaatatagttatttagttttagaaatttctaactcatgtaaaaatgttttcaagaataatagttttgtattcatatttctattcagataatttcaacaaagtccaagtctttttgctgatctgtaggaattaaaaggagatttttcctctcgtttgatagaatttttcttcaatatgtaaggctctgacactgatctcagaaatgcctgttggtcaataaatgtcattggcttttaatatttcaagttttattccattttcctttctttagtttgatttgtcaataatatacattatggattaccttaccctattcttttaattatatgttgttata

SEQ ID NO: 57221 - DNA, 1449 bp, Homo sapiens
ttaaattggcgagtgtctctcttcagtcaataggcttgatcatcatctgaactgctcttaaggagtatgacccgcctctgtattcggcccagaaaattccatcttggtgcttgcttctgtaatggcctcctctgtaccatactccatttaggttagaatgtgcacaggcattgtaccaccagcctcctttatgaaagtgggcgcagtttcctttgaggaaaaaatacagatataaatgtaaaagtttcttctaggtgtggtactctgcaatcataaaaaacttattctacctttaatttgaacttcccttactaatcccagttacctttatctcagcagttttaaatgccttcacttacttgatggctgttgcatcaactgcttgaaaaatcacttgaattgcctttttttaactctttgcttgcttacaatgtacttttttaaaaagggggatttaattttctagttagcagagtagatgcaagcagtgtttatatgtgaaagagttacagagggagaaattgggaaggaaagatacagaagaagataaaagtctgaggaaaattgaattgtcaaaataaaatagcaaaaaataatacaaagtaaaataaaaccagcagtcaaatgggtttctgtaaataagacatatgttatggtctatctctcctcttttctcgtttaccagtgtaaaattggttaaaatagagacctgtgtgctgtttgccaaaatacagctggagagaaaaaccagtttgggacagggatgggggagaattgttgggtggaggggaggaggggatctctgtatcaggacgagaagaaacctgggttaaaaagtcaaaagcatatgaaaactaaatttgaaattatgtggatggtctagttgtttctttctaatgaaaatattaatttcccctttgaatcaagcttttttgttattcctatgccacatgtcacagtcatcttggttttccccctcaaagaaatgctcttacaccatgtatccaaatggcttgcatccttcatttcttgcgactctttattcaaatgttgctttctcacagcagattttcctggcgaacccatataaaatagctgccatcccaggccttgctgcccaccactttctattttcttactcagttttatttttgagagtacttattcccacctaacaaattgttttgtctctcctccagtgagtaagctccaaagggcgggaactttgttcactgttatatccctagcacctacaacagtgcctggcacgtggtaggtgttcagttagtatttgttatgaattgtaggcacttgcattttatttccagattaatgtgtttctgttttgctttgtgtttttttcccagaactttgtttttcacatagatcacactttgggattgccttatagaagaaatcctaaaagctatttctttcagtaggttggtt

SEQ ID NO: 57222 - DNA, 1868 bp, Homo sapiens
aataaaagactaacccaaaatgcaggcaccaaataacattaatagttaagaatttcattgattgcagcttgtcaggtgtattattacattctcaaacattttgtttttaaggtagagaagaaggtaatgtgtttgaaaaatgttttttatctaaatactattttttataacttcatgggttttttgaggtagatttttcttataaccatttttaaagaaaataaaagattgtcataacatcttttataaaatgtgatatgcataattactgtcttcaccatttttaaatgtacagtttattggcattaagaacatttatattgtacagccatcaccaccatccttctccagaactcttcatcttgcaaaactgtaactattaaataaccattaaacaactccccattcaccctccgcctaacatctggcagccacaattctactttctgtctatgaatttgaccactctaaatacttcatataagtagagtctcatacagtgtttatcttttgtaactggctaaacacctcttaaaatatacattgttgtatattttcaccttatgcatgtggagactttagaatgaccatgtacctccatgtaaagtacagtaataggaatttcttggtgccagagcatacataagtacaccagtagccatccatctttaccctttttgtgcaagcacctaaacagcctgagacatttttttccagacagatgtaaaaataacataagtgaataattgagcacattgtgtaaggaaaatagccagcctatttgttgttgcttgtagtaatttaatttagtaagcatcacagaatattagaatttgaaaaggatattagaataatccagtccagcactctcattatacaaatgagaaaacacaaactggcagtgacttacccaaggtcacataacaaaggtagtggtagaaccaggtgttcttaattccatgctctttcccttatatgttcattaatgtactaattagtatagtaattcttatggtctagcagattatccctttgaatttaagagatccacatttatagaataaaataagtaaaaagttaatgtttacataaaacaaataatgaataacagaaaaagttatctgcccttaatttttgtgttaaagaaagtttcactggggataggtacaccatgttttcattaaaacaaaatgtgtttaagaggacttttgacatactaaatccctaatatgaggtttaattctgtagcattcgtgggtttttttttttgtactaatgctaagtgtataataaaacatagaattggtatgtttcattttgtataaacattttcttagaaaagtttgtcagtgtttaaaaatgtgaatagtgatttctgctagaattggttataccatccactcaagcttcagggatcacatagaatactccatggcagttgtcttcatacttacataattgtatacctcatcagttaaaaaaattcacacagctcaattatgtttatttataacttacgtatacaaactactgataaattatataaaagcttacataaaacaaaatttttaaaggatatcaaaagcaattttttttctgttttttatttctatacccagtgggtcactttatacactgcattttcctttggaaatcaaagggattgaggtttgtttgttgttgttgtagttgttgttgttgtttgagtctcactctgttgcccaggctggagtgcagtggtgcgatctcggctcactgcaacctccgccccccaggttcaagtgattctcctgcctcagcctcctgaatagctaggattacaggcacgcaccaccatgcccaatacttttttgtatttttagtagaga

SEQ ID NO: 57223 - DNA, 1828 bp, Homo sapiens
caaaattatttctacctaaaatattacatatttttggccttttagtcatgaatttaattacatcttctgggttcttattttctattgttaataccacttacataatgcttttgtgtgtatatcaataacttagcttttccaagtgattccatttgtagcaagtttaatttctgtcatccaaattaaattactattacatgtaagcctggaaagctatttaaaattttgagttggaacaagaaatgccatagattaatcttaaatctgtacaagaatttctgcttaatatttggttatactgtaattgagattttgttgcaaagactttcaactatttttgtatcttagctttgttttatgactacactgagaaatccaacagtttatgtatatcttcagcacacacactgtggctgcaggaagagaaactaattgtgttcacgactatttagtttgtattcctttgtttttaatcattgtgctgtaagccttatacatttaatctgttacttgttaaaatttctttctactgtcactaaagcacttgttttcagaaacccagcatggcatgcatgtatcagtctgtaatcatatacactaaacatcattaaattgaacctcaaataatgcattaaccattgcacagtacttaatgtttttatgtcaagttgcaagataaaacctttttcagatgagataaactgtagtatattccaaaggtctttgtttagtaaaagattctgaaatttctactacaaatataaaatagttatgcatttgctatacataatatttttaaataaaagaaatattaaatacctttttgtgtctgttgattcagtgaatccagaaacttgctgcccttattcttgattttaaaaatcagtgtagaagtttgttcatctgtgactttaatggcagctgcatttttgttttggaccgttgaatccaagctgtaagaaggaacttctttttccttttacaatactaatcaattgaatttgacaagccacctatgtaattttaagtagtatagtggaagttctggtctgtgggccgtctttaatccagcagagaaagcgttgtggctttgctctgtctgccacatggagaaatgcagtaaccagctgcagctgacccagattgtatatacagtacccctgaatagtgattccctctttctcagtagactcaagttcagcccacatattacatcaccaaaaattgctggagactgggggcgggaatctccttaggatttcctctttgtagccttaaataggggggtgggatcagcaggaggttgaatagttttgaacaaggagagattgtgtgcaggttgaaggaagggcaccatctggaaacaaactatcatagttcagcgggcaattataaaacaaacattttagtctgctggccagagatcttttaagttgaataccgaaaaaaaaaatagtgctccacttcacttagaagtagttgcaggctgatgagtttggtttttgttaacaaagaacaagagctagactttgtcaggaggcagccacctaaataatgtaataaatactctttatagcctagaagaatttgtaaacattttactaagttgctaatgaaggttttaaacttacaagaaacttgatgttgttgtagtatgttatgtcttactgtgtaatgtgtcttaagataaaacagcctttatatataattaccaaacataagtgaaattctttcagatgcttaagacttttaaatattacattctggtgttacataatgtcatatcctcctattctacaaaatgacctctcctctctgtaaaaggtca

SEQ ID NO: 57224 - DNA, 1173 bp, Homo sapiens
aatacagaattagccgggcatggtgcatgcctgtaatcccagctgcttgggaggctgaggcaggagaatcacttgaacacaggaggcagaggttgcagtgagccgagagtgcaccattgcactccagcctgggcaaaaagagcaaaactccgtctaaaaaaaaaaaaaaaaaaaaagattgtttgaaatcatttttaaaatagctgatatccatttttatctccttatatccacagtatttcccaaagatgggagaggaaatttttaaattattaaccctttcatctttcgttgatacagtttacatcaaaactgctgggtttttttttaaggtaggaggataaagagcttatttctcttgaagcttcactcttttcttttagcttcatttgttactttttttaaaaagtttatttagctttattatcccatttgttcgcaagctttcaaattgaattttgcactttcacaaatattttttccaataaaaggtcgtgtttcaaaaatttatcgaagtgaaagactagattatttttcagtgttaatgcattacatagaaatattttttatcttcctttggtaatgattattaacttcctttttccagattttgacagtttttaaaaaattttgtagaacagaattagtcccagtaaatggctatagaaattctggaaaacatctaggaataatttttctaaatgcatctaaaattttactgatgtttgaaaatgcctttattgccatcttctctctcacaccataatagcaacactgtatttctgtaccaattttcagtctacaaaaagtttctacatggttacttacttgaaaatgtatgaagtcaatgaagaagctttttaagactggagttgtttcacaaatctgttgccctaggttgtttttcaagtttgatggtctgtgtcttatacttaccactatttttcccttctctctaattactgacatagaactcctacctaataaatacttaagttttgtccagtgagatgtagaacagatatcttaaaattcaaaatgtgagtaagtagctattagtcatttatctggctcaagaaacttactgaatttaaaagaatttaaagtttattagattgaaatgtaatctaagaaaattttgcacagtttatagaggatggcaaattttttgtg

SEQ ID NO: 57225 - DNA, 1054 bp, Homo sapiens
atagggccaggtttcctaaaacattttccctaaactgttcatttgaggcttttatggtaagatctgagtatgacagttaggtaaatcttttatgtcctaaatctttatataaagagcagtttttaaattagtaacaataataaaagatatgaacttttttttctgtttctagtttcattcataaaatgaacacagcagaatttaagagtgcaacgtttccaaatgcaggaccaagacatctgttagatgatagcgtcatggagccccatgcgccatctcgaggccaagctgaaagttctactctttctagtggaatatcaataggtgagaaatacttctctgagagggttgcaatttaactttaaataaaaatgttaataaaacttggctggaaaaaaaccccacccacacacagagaaaatttggttaaaaaaacaaagtagcagttaaatatgggatgaagttaataatttgtgatggttttaaaagtgcttgctgtttttaactccagaaggggaagcatttgaagaaggtggaaaaagaacatatgggctggttgaattagttaactgcatgtgatttggatatggggaggaggaagagtgtggagtcaagaatgacttccggttatttgggttaaacaagtataatagttagatgatgatgctattaccaaggtagagaagacagagtaataatctgtgggcagtgaagcgtttgtgaatttggggaatcaggtgtgttttggacatgtttagtccctatggagatgtcaggtaggttgttgaatatgtgaatctggagctcggggataaggtcagatctgaagatatacgagaggtagcatatttataagccatgattggttgagggtacctaaagagagagtgtacataaataaaaaaacattctcacatttagaagtctgattattttttaaaagaaggatgagtcatcaaaggaaactaaaaaggagagatcagtgaagtaaggggaaaaaaacaaaagcccagtagatgaagtatctcaaggaggaggaaagtactgaatgtgt

SEQ ID NO: 57226 - DNA, 1039 bp, Homo sapiens
ttttgctttataacaggtgttttgctttgcagacatgtgtggctaaaaaaagctacttttcttatgccaagtttaaaatagtgggctcttagaacattttgagaacagtgaaatgaatgctgcccagcaagattcagacatgaaataatagaaagtgaataaagaactaggatataaagtactactcatggatagtgaacttgaaaaatgtactctgaatgttgacataccattttctgttcttattttctagacagacatcaaatacattgtcttattttctagacagaaatcaaatacattgttgtctttttttctagacagacatcaaatacattgtttaagttgctaaaataatgcttttcctttaaaacatcatttatcaacagtgctttcgggttttcctaggcaaagaagtatcagtatttttatgtgtctgtttttattttttttgtttttaactattatgtgccattttggataagtattaactcatcatttttatcatttattggctttgtcagttaatgtagaaataatataacgcctatattactcagttcatttcttttatttactataaaggataaagaggaaaataaagttttcctcatgagtttacaagccacattgcttttaggtgtcttcatagggacatataataaaaatgaattacttatataaatccgggcatcatatttaaactagaatccaagaagtggtatagaaacgtaagaatttttgaagtatttttgaggttttttttttattatttggctataaatagctctttaattcttttagcagatttgtgaaagtgaatgtatatgtaaatatatggtgtgtactaaatacctctaagtatttctagagtcaatagtagaagaaaaaattttttgaaatctatgctgcatgctttaaaaaagaaagaggaacaatcacatactatccttttgtaagatttagaaagctatattacaagaagaaactattatactgttctaggtattgataatgactgtgtgaataaaagtatatg

SEQ ID NO: 57227 - DNA, 1058 bp, Homo sapiens
acaccatttaaatgttattaaaatgtattgcagaaagctagtttttaaaatatattattattgactttattacttctttctgctattttagaattaaattaagcatgttttctttttttttttttgagcttgtatttttattttcagttttatatatacttaaatacttttaacaaatagaatcctcatttttcctaccaggacttaaagtttctatgtggaaaataaggttgcaacagtgatgcagtgtggcatgttaagaagaagaaaacaaatcttaaatttttaatttaatatttactaaagtgaattactgcattctttctaaattatactgttcaaatatgtaataaagtgtgttttttaaccatctgctgactttaataactttctaatcaactttttgtacagcttataaatttcaagattaataaacctttagaattgtcagtgtcttctcagctctgaataaagtaacaaacttttaaaattaagaataattacattttatttaagtacctacttgatgactattgtagacaaaagctcttatgtgttcttttcttcgttattatagttctgcagaatcagaagatttggcagtacatttatatccaggagctgttactattcaaggtgttctcaggagaaaaactttgttaaaagaaggcaaaaagcctacagtaagatttcatcatattatattttaatacacctctaaaaatatgcaaatttataagactctgtaaaagtactaaaacaattaaaataaaacctgattatagtagacttgaaataatattaaataaggtcctcccctcttatccttgggtcatccattccaagatcccccggggatgactgaaacctcagatagtaccaaaccaaattaccatcatttggaacatgtttctgttcatgtcttccattcacaaatataataccttttctatcttaactaagcacttaagcccacacagtaaccgtaacttttgcagtttgcgatgctatagcaaaactagcatgaatttctttttccttcttcacaatttcacaga

SEQ ID NO: 57228 - DNA, 1032 bp, Homo sapiens
acggtgttacttgactaaacatttggtgaagaaacaattacttcagaaagtgaaaaagttattttgagtgttagaatctcaaggaaaagctgaataatgcttaaatatagttaggctcttgagccattgaatgcagttattaaggaaagaatagaattcagcacaaattgtgaaataaaaagaacttaggtcaatgaaaaaaggaaataaagcttaatttagagcagcctatagtacatggatcctttcttttctcaatttgttttctcaccttaatacatataaccatttaaaatatcctcattatatgtcagtcttgaattaaagtcaatatagaaattacaaaatacacacagcacaaatgaatatctaatttcttaaaagagagaaagttgcctcctagactttccccaagagccctcaacagaactggaaatctgtaataatattgacaaatatcttgtaactaaagactaaaagcatagtctatcaatgttatatgactaatccttaattatactgaatagctagtgtttaagtattaaacatattgaagcattctggcatgttaaaacttaacattaacatctactaatatttaggccaggtgtgggggctcatgcctgcaatcccagcactttgggaagccaaggcaggcacatcacttgaggtcaggagttcgagaccagcctagccaacatggtgaaaccccgtctctactaaaaatacaaaaaacttagctgggcatggtggtgcacacctgtaatcccagcttattgggaggccgagacacgagaatctcataaagctgggaggcagaggttgcaatgagctgagattgtgccactgcactccagcctgggcgacagagcgagactccatctcaaaaaaaaaaaaatctaatatttagatcatctaagtagtaagtattcagaaccaatattctgcagtcttatccacacagatctagagatgccacacagttattttatgtaggtgtatttcattctaaagaatatttaaggagacaaa

SEQ ID NO: 57229 - DNA, 1678 bp, Homo sapiens
atacttactcttgctctcatttattcattcagtaaacgtctactgagccccctgtgttagacaagaaagatattgtctctaccccttctcctgtatagatgtcattttactagaaagagtattaactcattttggtgattttctctcaaaaatgttctagcatgttaattattcataaactattgaagctccttatatcaagttccttttaaaagatacttaagtagaaagattgggcttgcctaaataacaaggaaagataagaaatactcctttgaaaaacaacttttaaactcagtttttaatgcttatattttttaggttcctacaaacttgatgacttttgagtagaagcctgagaaaaaaagagaggtgaactgttgcttctacgtgagcatgaggacctgataaaagagcgccagctataaaccatcctgtgccaggaagagcccagaggctctgtctcagtcgttggagttctcaaccaaaaaagcactaatttcagggaatgatttgagatattcccagagaacaaattggagttgcaaaacaaactgccatgaaccatgcttcttatctcagaactgacctgtggaaaccactgccttaaaagaatgaaaggaaaaccaacatgaaacaccaaatagtgtgtgtgaatcttctggcggtgctgtgcttggaatagatcgtagctaatttgcatttcttttaactttgtaataattttagaggggggaattgccttttttagatatgctttaaaaaggaaaaacatactcttgtggattccatcaggagctggttttgaaccgaggtgaagagacttagcagggattgtaccagcagcccacctgcaaggtttgttctccctctagtagtctgcaacctcactggctttctcacagcaagagtgtaggaatgagaaatgttagtcatgtgagttcttgggtttgtttgggattgggtgggggtgtttgttttgttttggatgaggggagaatttttttaaacactaaacttctgaaatgtagtactgtaaggggaacattatttcctgcaggaggtacaaaggctgtgtgttcatttgccagacgctttttttttaaataggttccagaaaacatggttgtttctaactagggttaaagtttagctttctatatgaattcattgttggaccacagatctgcttaagtaaagagctataatcccaacctaaacttttctgagattttacaataattagatctttttccaagttaattgggttttcccttctcccagtcataggtggtttttatcatcaagacagactgatattttgtcaggatattttcttttacagtgtttgatgtgcataatgccagagttatttttttattattcattttctctctttttgttcaatatgagattcaggatcatatttgtttaaaaggtaacacatagagatgtatgtatatattttgttataagacatacaaaataattttaagagggataaaggtgaaaatatcagattctggaaattttaagtatctaaactttatacttgtatgatttaccataaacataccaaaacatttttctgaaaatttactgtcggtctctgacatgaaaccgtattttgtcagtagttgaccaagcagttttatgagaactcttctatgcaatgatg

SEQ ID NO: 57230 - DNA, 1026 bp, Homo sapiens
tgatatctactaatagacttctgttactttgggcctcacataaaatttctcacattcgtattcttagagaattttatacttttttattataagtattttgcccttgagtccatgaaacttcaatagaaaatattgcttatacaataattagcttaaaatccatccaaaggaaaagagaagagctttttttgagtgttaagttttttaatttagtattctgtttggaaaagatgttaagagttcaaatatgcttcttatgtaacagaaataccattatttctggggtttagtgacacaggctggagaggacaaaagtttcctgtcctgaatgatttttcaattaatgctctaagcttaacccatgttgggtaatagaaagacatagccagcagtattactacgtagaccttgcacatcttacttttgttttgcatttttaaaaatttcttaatttgtttatttctcttcagaaatagcgtttttaacagtgtatgtgcttttttaaaaagtattgtgaatgagaaccctgtggattttttttatttcatttgtttgtcataataagctaacgtagaaatgttgtaggttaaccatatctgtggaaatatgcagttggaagtcagagcctgacatcacatagttttgccaaagggagagagctaagctggaagatgtttttgatactttcggctctaaacattaatggatgtttgcgtagagtaagatagcgttcaaatttggttaatagtttatagatagacttgtggcctctgactgactaaatttcttaacagcacagaagtcgttgtttttctgtctttaaaatttattcattcagaaaattagtcattgctttttaagattattttagcatttgaagcaaattgaaaacagaaaagtgacttaaaatagtgtaggtgaattttttatctataatttaccaaataatacctgataataattcaaagaaaatatgttaccaaaatatattaaatatataggtagttcattcgtgggaagatgaat

SEQ ID NO: 57231 - DNA, 1116 bp, Homo sapiens
aaatagctgataataagtcagactctcaagagtttctgtaccttgattattgacaaattcattgttttacatcctactaaagaacatgtgtgtggggagggggtggggaactggttcacaacataatctgaaggagatcaaacatctgtaaggacaggtacccagtgatgataatatatctgaaaacacaagccatttttattctttatcccaattaacttgaggtactctaatgatgaagcactcgattgcactatgacctccttgagtgatgtgcagcttggttcctctctcactttttgtttctttttaatatgcaaatgtgagtgtgcgatcttcagtgtgtctgcataagctaacttaagatgaatttaagtacagttttctgaaatatttctattgaaataaattacttaaaattatagattgggtgaggatgtttttgttactgtatttgcatttttatcatgaacttttaaggtgcaaataaactttaagttgatttttttcccctttctaaggtagtcaacaaggctattgttggtgcagggaaagctctgaaaaaactttagtcactcttctctagcccaagacaagaatgtgccacctcgcatgtggacaaatggggttgtggggaatagagagtaagggcataacatttccaactacatctcccactctgagtatgtgatacgataggagtagtccccaaagaggctctctttgctaatacataacatttttttctttttaccatttctgaaaacaatccatattcgagaccatggagctttaaattggaagaagtacagaaatacctgtgtggagtctcctgtaggctattgtctgggtgttggttatgcttgagaattccacgttagcttagcctctgcatggtttaggaacccccagccaggaaaagcccaatattttggcaaattataattcagttttcagcagttttctcacctccatagtgccctttgaaacttctcactgtccctttacttgaaccaaaagagaagaatgacacttatttgttggggccaacctgtcattacctcatatagtaccacctttgtcatacatcagtttcccatatatgcagaattttct

SEQ ID NO: 57232 - DNA, 1123 bp, Homo sapiens
tgcaacctccgcctcccaggttcaagcgattctcctgactcagcctcctgagcagctgggattacaggcattcaccaccacacccaggtaattttggtgttttttagtagagatggggtttcgccatgttggccaggctgttctcgaactaccgacctcaggtgatccacccatcttggcctgccaaagtgctgggattacaggtgtgagccaccgtgcctggccagcaaaagttttaattacacatttttcttcatttcttcaggtcagtctaataaacattttagtagacatttattaagcaccaactatgtgcttaacactgtgctggcaatacaaagacagtccttgccttccagaaaactaccttttatctgtactaaaactacatcaaaagccctttagtggggcaaaaatgacagcttccatgttttattcttagaatgattggtgacgtagatagagaattctagtttccttctctacctcatcttcattccatctaccggcaattcatgctaatccacagttgtttgcagggttgacagagaaggtgactatagcagaatcaggcttgctaatgggtgtattctaccacttgtgctgtcacctgttactggtgtaatccacgtatacatctgtgcttcccattcactttgcaggtatagccgagaccatgtggtggaaggggaaccgtatgctggttatgatagacacaatgcagaggtagcagcctttcacttggacaggtgcgtatgatcacagcagcttatgttcattttgtttgctttcaaaaatctttcttggagaggactcgtggactccttcagaaggatgcaacactaataaataacttgttatcgattttagatagctaattgactagttccattaaacttgtatgagtctcataatttggttggcaccaggaatactgaagtattttacttccatgcttctttaggtcatttcatttctggcctgctctgttattatcatcagtgaagatattcttggtaaataaactttgaacttaaatctctgaattgaactggtcgttaattgggtctagccatcctgttgttttgttatgtatttgttttaagtaagtaatgctgactta

SEQ ID NO: 57233 - DNA, 1041 bp, Homo sapiens
cagagatcaaacctgtcgccacagagcagctgttgagcaccttcctaactgtaggtaagaagattgtagaggacatttatataggggaatgattaataagttaaaatggggcattgttgagcaagctggctcatgacttttaggaattgaagaactcagtggaatacaaaagcaaatcagacaaccagctctcaggttatttgggaaaatgaatctaaaggagatggcaggaaattgaaattttcctgtatactttgtgttgtctgtgacatagggagtgaggtcatttagtgatggtgaaagcaggtgattatttccttctgctttctcttagagctattagtaagtctcaaactcagaatttggcctaaattggttattgtttgtatatcattggctcagttgtttttacatatataatatgtttcctcaggaactgtctcccatctccttagaattgaggaaatcttaaggcaactctttaggaggctcagaaattattttgtaaggttgtatttggacctggaagatcaacaggcctactccttctgcaagggttaacctataactcattgtgcctggaactggctatgttgcccctggcctctgttttccattatcttaactctgaggtaagagatctgagctaaaattctcactcctgttgttgtgagcaagatgagaatgggaagaattcaaaagtgcggtggtttcttgtttccacctcttcaccttgactctttttcagtgatacagtgctctgcattagggcatgactgttgaaacagacattgcaagatgaacttcaccttgcttttttttgctagagtgagtggatttacatttaaaatgaggaaaaactgaatatttaaaggacttatgacagattcatcattcagaatttcaacttataaggcttgggctatacttttcttatagataaccaaaagcatacaatgttagatattgtatcagatatttgtttcagatattttctaatcacctttggttgttcagttttatgtttagcaagcatgaatt

SEQ ID NO: 57234 - DNA, 1070 bp, Homo sapiens
taacattttttgtgctatagatacctttggcagtctggaaaagcttacagatcctttctaaaaataaaggttttaaatacatacagaaattaaaatacatagacttataaatgaaaccaataatattgaagtataatttcagtatcaaaaattttaaaaagcaaatttagatacagtaatatgtgctttgttatttaacacattaaataagatctatcagattagtcactactgtgatttcaaactatgattataaatagtattttgaggttatctgcaacaatgctagtatgatatgaaaaatccgtgatttcttgtagagacaaagtcacatgtaatacaaatatgacggtttgctccctgccatcataatagaaggaaatgctaatttttagtagaggttagtgaaaataaagatgtaattttgttcccatccagcttacagaccctatgagttgaccctgttccaggtagaggacagagcctggacaagggtgatgagcaatgagagaagagcaacaagctcaggagactgtgctgtttagctgaaggaaaggatgtgtgggggctggccagtgaggaagacagctggtcaggacagtgtcactgaagggcctgtgtaccatgcttaggagtagagactttctctttaggcactagaaagccattaaaagagtttgaatatggaaaaatcagatttgaatttcaagagcgaattgtggcagcattgtcaagggtgcattgggaaggggagaatcaagagctgagagcactctgggagtgttgtgaattcatatgtaataagagaactaaagcagggacagggaatagaaagatttaagggctattcaagagttggaatggaaagaatttggtgaacatttgggctgggagagcaattgagagagaagaaaaaattaagaatgactcctaggtttctggattggatgacaaatgattagtggagctgttaactattttaggaatgtagggagaggagcatatttagggaggtggagcagagaaagataatgaatttaatcttggatattttgtttccttcacaggca

SEQ ID NO: 57235 - DNA, 1547 bp, Homo sapiens
gccgtggctcatgcctgtcatcccagcatttgggaggctgaggcaggcagatcacctgaggccaggagttcgagaccagcctggctggctagcatggtgagaccgtctctactaaaaatgcaaaaattaacagggcacggtggcatgcgcctgtagtcccagctactcgggaggctgaggcaggagaatcacttgaatccaggaggcgaaggttgcagtgagctgagattgtgctgctgcactccagcctgggagacagagcgagactctgtcttaaaaaaaaaaaaaggaggtgaatttttttttaagttttgtaacactgtcctactttatttattagaatctaaggctgttacaatcaagtcgttgcagggtttggatcagctgtaagttaggtatgcctaccaaacatccaaaggtagacgtggagacattttaatactacaaaactaggaaaatcagaactcatggccatttcctgccctcctccaacttgttaaaacatgtttattctaaagttcgaatggataaatttgagtataaaggttttgttataaaactgttctttagtgtaaggctgcattgtgggtttgggggaaatgtaaataattttctgtgtaaaacaaattcataggatctgatttgctcagagtattattcaagaatgtattaataaggcattgccccctgtttgcactcagggttaatatgtcaaatgaaatttaagaaggaaatggaagaattcaggtacattaattgcatattattttgggaaagatgagtcctatacgtggcaatttttcaatgtcatctgaagccagcattatcttccaaagaaatcgatcttttttttctaaaaaaaaaaaatgcttttgccttcccttcccttcccatccgccatatttcttcagcctttcttctcgatcacccgtgtattctttgaccagtaaatgaccacacctcaatgatggtaaaacagcatcatcagtaagctatcttatatgcctcatcctgtgagtttgagcttcaggaaacatgagtaaaagtatatgtaatgtatatagtcgtatatgtattctagcaagaaaaacatatttattttgacaaaggggaacactgactttctgaaggattcagaaagaaccttagtgaaaggttctcagtctctgagagtggaccctaattaacataaagaccattcatcagcgaataactactgagcaactctagtgtgccagcacaggccagacatactagtgagccaggcacatctggccttgggaaactcatcctacaggggaaggccagtttttttcccttcaattcctcaagtctgggtggtgacaaggtaggggctaggtactggactaccacaggtttttaggaactaaggtgtttctcataaacacaaaatgttgggtgaaactgggaacaactactcagaagctcatttatttgcttaaatggaaagtgtgggagccactaccctctcttttgatctgccaaggatttcctctcagagctgttgcacagacagagattgtact

SEQ ID NO: 57236 - DNA, 1053 bp, Homo sapiens
ccatttcaaagcctgagttcaccttctttgcaaccacaatcacgacccagaataaactgcttcctggaagccggctagttgcacctggcctgaagtcagtctcgggactgcctctcaggaccccagacagggtttcgggttcccgcctgggtcacgtgtacggaggctgccagtgcgcactcagcccggcccgccggtcgccacagcaacaccaatcccgggttcaagcccgcctaggaagtgcggtccccgcctgaccgccccgggcttaagggagcctggctaggccggcagccggatggtcccgcagctcggggccggccatgcttcgcggtccgtggcgccagctttggctctttttcctgctgctgctcccgggcgcgcctgagccccgcggcgcctccaggccgtgggagggaaccgacgagccgggctcggcctgggcctggccgggcttccagcgcctgcaggagcagctcagggcggcgggtgccctctccaagcggtactggacgctcttcagctgccaggtgtggcccgacgactgtgacgaggacgaggaggcagccacggggcccctgggtaagaccccgtccccacggtccgccgttcgctgcggagcagagtgcgatccgggcgcggctgtggtcgcctcgctcctgtccggggcgacatctgggcccgcagtcctgctctgctcagccgccggtaccggctgtgggcgggggcagcctccgcggagcagggagccccatcaccgcccttgccccacccgcgtcccctgcgcacccccctggcgcccggcttcccgtcccccgcctcccctgatccctgcgctttccagattctctcgcaccgcctgtgccatctcccagcccaccctggcgttattcgaaggtgttgctcttgacagctctagggaacgtccgctgtggacatgcctggtgactgccgtctcccttgctgcttttggacgcagggcttgaggaccgacagtgggccgagtcggggctgggagttagaatctgagttctgggtgtccctctgtccctg

SEQ ID NO: 57237 - DNA, 1039 bp, Homo sapiens
ctgcctcagcctcccgagtagctgcgactataggtgcatgccacctcacctggttaatttttgtttaatagagacggggtttcaccacgttagccaggctggtcttgaactcctgatgtcaggtaatgtgaggaaggcttaaattaagaaaggacgtgagatgatgacaaatagaaaagacagaaaaggctaggcatagtggctcacgcctataatcccaacactttgggaggctgaggcaggaagatagcttgagcccaggagttccagaccagcctgggcaacatagtgacaccctgactctatatgtgtgtataattaatatataaaaaacatagggaaaaaagacctgtgttattccagaggcatgggagaagaaccaagaaaaggggaaaggcacataatgaacactgtgtctaggcacagtgctacatgtctacacggtgccatttaatcctcagaatgactgcttttctttttatagctgagagtacaggagtgaacattttcatatataagagcaatgtgctatgggagtctcttcagtaggaggttggcatgacttggcttcactgatgtggtcccaaagcaaacagactagacaggcagaccagtcacataccctgccagctccgtgtgtgccagcatctgccctgtctctgccaggccttatcaggattacccagtgtttgtttgaaattttgctaggtctcagaaacagaaagtacgccaaggattttaggaaaatcaaaaattttaatcttatcatctttacatacaacaaacatgtcaagaccccctattgtctttgaaaaggtcccccctcccccgccaaaatctgtagaccataagtcttggcctacactgacctggtttgtaaaatatcttcctctgtgtacttttcccttcagcctcaggctcttggctgattcgctcacaacagaagcagcttggctttcctctggaagtaccaatttgaaagcccaccagcctgcaaacctagagtgtattctccacccctgggtcacagaacttcgtt

SEQ ID NO: 57238 - DNA, 1004 bp, Homo sapiens
gaagacacacaaacaaacacattacccaccttatgcacagcagcctggactccagatgatgccttttgttcacttccaaaaatgtaatccatcaaaggatgagtattcacccccgcagaggacattctaaagaatgtgccaggctgggtgcggtggctcacacctgtaatcccagcactttgggaggcagaggtgggtggatcatgaggtcaggagatcgagaccatcctggctaacatggtgaaaccccgtctctactaaaaatacaaaaactaagccgggcgtggtggcgggcgcctgtagtcccagctactcgggaggctgaggcaggagaatggtgtgaacccagggggcggagcttgcagtgagccgagatcacaccactgcactccagcctgggcgacagagcgagactcagtctcaaaaaaaaaaagaatgtgccagagggatgcttgctaaaatcagcttctttaccttatagacatctgcattacagagagagaaagaaatgctgcttagactccctgtcaactaaaatcatgggagaaacactccaatctccagcctactttgccaataaaatattgcaacctttatttaaaacagaacacaacttggcaaaccttgtgagaagacagagaaagcagtccctttcaagggcctcatttatttacatcaagtttaacactgttagcagttcacagtcagacaacagacggagagaattaaattagaaaaacaactgaaaatatattacaataacaattaagaacaaatacctgacaacactggtaatgtgacacacaattgatgtgtttttagttaaatcccacattgtctcactatgtccccttagcaatgcacacagtgcccgatgctccaaacctcaccctctgtgcaccacatacacacctgcggggcgggacctttggtataaacgttcaacgagttttaaagaattgaatccgcatgtttggggacaaagttctgtcaaccaccatgaa

SEQ ID NO: 57239 - DNA, 2872 bp, Homo sapiens
tttggctgggcacagtggctcgtgcctgtaatcccagcactttgggagaccaagatgggcggatcacttgaggtcaggagtttgagaccagcctggccaacatggtgaaaccccgtctctactaaaaatataaaaattagccgggcgtagtacatgcctgtaatcccagctactcccgaggctgaggcagaattgcttgaacccaggaggcggaggttgcagtgagctgagatcgcgccgctgcactccagcctaagtgacagagtgagacacgttaagaagaaaaaaaaaaaaaaggataccttcatttctgactcaatatcctagatccaaaggacaggaaattagggaaggcttcaccctgtgggatcaagataagaagatcccatacttcttcccaggtaaggaggcctgtggcaggtcatgattcaaagctgacttggaatggcagaaactgctgagaggccacccttggagatttgtgccttcaaagatgggtttcatgagtctcagagaggaaaagacttgtcagctgggttgattttgcatgattattgaactagagctggtagacacgagcttctcagatggcagtggccagatcctccatctgtgagaatccgccacttgaagtggtttcctgagagtgttcacttggcagttgctgcgtttctcaagcccacctggcgaggtctcgccggacccttccctccaagtgcacttacttcttcatccccatgtacatctctaactttgaaattgtttacctctcctacaaaaatcttaccttttgacctgagcagagtagcaaagccctgttcactctgagggagcagctggcgtgttgaaggggaaaggccaggcacagcactgtcctcagaccacaccatatttggagcagaattgtgatacatgtcatctgtgtctattctggaaggttctttgttcatcactgtactcgcatcagcaaattttcagggtcctacctgtcactccaggctactgagctgaaccctcagaagctgaggtctccgagcatgctaagtaaccttttagaaaagctggaggcaaactgtcgaatgctagcaggctttatgaaaggaaacataaggagtttgtgtagtcagaacttgcttaaatttgcttcggaattaggcaccataaactttagttggagaatgggacttaaattttcacatatatgtatacttaattttcagcaattatgacacaataaaaagaatatgcaaatttattgttgtttcagaaggttttgcaggactgggaacgctttagtgtcatcaacagtaaacctcagatactgttctgcacagttcagaagtaccataccaggtattgtgagtggcaagaacgccaggggacagagatgcttctggtagatgagggccagagaaaccagctctcctccattttgacagcaatttctcactgtggccatttggcctccattatgttttgagaggaatttcttgagatcttgagaaatcaccatgattaggccaattgtcaatcagtattcagaaactagaaaggaacaatgagatacttgtttatggttctttagggcatatgtttgaaaaccctctcatctcagatctgtatagctggtgtgtgtttgtgtccataaatacacgtgcattgctgtcgtgcccattaagaaagggggagtaagtaaaagaggaatcgctcagatctttccttggatgaacagcagtggcgtggttggtgtgttgactgtgaacaggctgacttagctgttgatgtatactcagaacctccatctcctcccagaccctgcacttttccttctctgcagtctgattctctaatgactgtcactggacaaaccccagttttatgctcgcttagtaaaaataagtttaaacatttcatggtggttgacagaactttgtccccaaacatgcggattcaattctttaaaactcgttgaacgtttataccaaaggtcccgccccgcaggtgtgtatgtggtgcacagagggtgaggtttggagcatcgggcactgtgtgcattgctaaggggacatagtgagacaatgtgggatttaactaaaaacacatcaattgtgtgtcacattaccagtgttgtcaggtatttgttcttaattgttattgtaatatattttcagttgtttttctaatttaattctctccgtctgttgtctgactgtgaactgctaacagtgttaaacttgatgtaaataaatgaggcccttgaaagggactgctttctctgtcttctcacaaggtttgccaagttgtgttctgttttaaataaaggttgcaatattttattggcaaagtaggctggagattggagtgtttctcccatgattttagttgacagggagtctaagcagcatttctttctctctctgtaatgcagatgtctataaggtaaagaagctgattttagcaagcatccctctggcacattctttttttttttgagactgagtctcgctctgtcgcccaggctggagtgcagtggtgtgatctcggctcactgcaagctccgccccctgggttcacaccattctcctgcctcagcctcccgagtagctgggactacaggcgcccgccaccacgcccggcttagtttttgtatttttagtagagacggggtttcaccatgttagccaggatggtctcgatctcctgacctcatgatccacccacctctgcctcccaaagtgctgggattacaggtgtgagccaccgcacccagcctggcacattctttagaatgtcctctgcgggggtgaatactcatcctttgatggattacatttttggaagtgaacaaaaggcatcatctggagtccaggct

SEQ ID NO: 57240 - DNA, 1975 bp, Homo sapiens
aggtgtttgaaacacccagtgctatctgaaaactatcagtaccccaaccctttggtttatagattaagaaactagcagaagatggttaaattacttgcctattgtctcagaacggttaattagtggcggagccaaggctagaattcaagtctcttgactttatggttgtggggtctttccaccatacctgctgccatgtgagacactgcaaaaaagtggctcagaccgacaatcagcctgtgtggtgctgcacactttctaaagcacatgctcctgacactttgaccttaaggggcttgaatgtggagtaatgggaacacaagccaagcaagcactcagtagaattcagtcatttaaaaaattcaatggggtcattcttttggacagacctcagcaacacagcaatgtgcactttgtagtaaagaaataccaacttgagtttttaaaaaacctagttagtcctacattcccttttctttaaaaaaactttattgttcacattattttaatgactatgagataatgtatatgacagcactttgagaaaatatcaactgtaatataactataaggttgtagtattgtctgtttaaaagataagacagttgattcaatgtggatggaccctgtggggtacctgaaaatgtagatacgtaagaatcacctctgtcatttatcacatttagaaatatgaaactgcttaacaggtatgagcaggtatagcaagtgtttgctaaagttgtagttcagagctgaattacttcaggaaactagggaccaactttttggtttaattccgatctttaaaaagtaagaatgtgtactcactccagaacacagaagctcttccaaggaccttgactcaagaaggatgaggtcctcttactcttctccatttatccactatatgcttggccatttatcctaaatgtggtgggaacagacttgttatctgttgatgttgacagtgtcttttttaacctatgtcctgcatagttttgttaggtttacagggggaggtggatggccataaaaccagtgcactttgggaattacttttctaggatttcctaccagttataaatgacattgacatttgtcatcttttttttctttttctaaaaagaatagctgaatttaattcacctattataaaatactcaaaagtaaattgccttggtggccacttctgaattatagctacatttcattatgaccccttctgctcccttccattttgctactgatgtcattcttgttatcaggctgtgcccctaccaggagttcatattgggttgacagggttatctatatttttgttcttgatttttgagtttcatcatcttgcattaaattgttccacctggatttggggttcatctctgtgccctaaggatctgctatgaccaatcctctttttgtaggtgggtctctggcttaagtattgataggcttcagcggtttgtgtctctgtcttagcttgtatcaagccagtagtagctcacttcctttgtaaattcctgcttcagtctgggatccgtaggagtatgtgagaacttctgaaacgtctccaactcttaacagtcaagatatctatatcatttggatagagttctggttttccaactactagacttaaagaaattctggccgggtgcggtggctcacgcctgtaatcccagcactttggggggctgaggcgggtggatcacgaggtcaggagattgagaccatcctggctaacacggtgaaaccccacctctactaaaaatacaaaaacttagctgggcgtggtggcgggcgcctgtagtcccagctactggggaggctgaggcaggagaatggcgtgaacccaggaggcggagcttgcagtgagcccagatcgcgccactgcactccagcctgggtgacagtgagactccgtctcaaaaaaaaaaaaaaaaaaaaaaaaaaaaaaaaaaagaaattctaatgc

SEQ ID NO: 57241 - DNA, 1988 bp, Homo sapiens
tgggaacctaatgacttaatccttaaatatgttttgcccttgaaaaataggccttttccttccttccttagttataattgtggaagctaattaggatggcatggaagtgaatctaatgagttaggtattattaatgttcttggtatcgggtctaattccagttactgcttcattctctttttaaagctttatgaatacttcccccatcctccccaaggagagctcaatacacacatatttttattttattctctcaaaggaatattagcttaggaagataggaattcaacattgagcactgagttttcttctggctctgtcattgatacactgtcaaaccacagcctcatctcttaatctatttaattaaggtaacagtacatgttctcaagggtgttgcaagtaagtgtgcagctatcccttggagagcctctctggaaagctcttttagtgcagtgttgttatgctgaattgttttccattatcttatttgctgagtagaaaatattaatgaaattaagaattgttgagattatatgaattgggctagaatactaaggggaaaactatgttttgaatagagtttggcatttttgaccaagaacaaaattgagttttcattggaaagaaaggaaaccttgattcttaccattgctgctccaaaggaggcccaggttaagaggattagaggagacacgcggtgctgggcattcctggcaggtgttgggtgatccccgcagtatgtcacctgcagttgcagcacaggcagctagtgattgggttcatctcctcctagtggttggaagagaactcagatgtaaaaaccagcggtccttctcccaccttctttcctgccattcttgctcatcatacatgtccgtaaacttgaagaactcgttttagcagctagccttttaaggtcgaggatgggaaagctaaaactgtagaatattattatgctgctttttaggtttatccctgttgttgtgggatgcaagttaagggattgtaattgtttttcagggtttttttgttttttgttttttaagcaagggctctattttcccttgagagttctggaactaagccttggagaaacactactgagtgtatttaggctccctggttttcttgcccaacaacaatctgaagggtagggggtgggggctgtgtcttactcaggggcagcacctagctgtcttgcctacagtgggtgcacgatatataaatggaattgatttttgtcaacactgtcaagagtggcattgactattggagcataccccgtccacatgatgcttgaactatgtaacttcaggggttgagggctcaaggttcaggttaaagaggcactgtcaacttactatacaagcataatttaggtttttcctttttctacttgaaaaggaccagcttaaacacaaacccttatgtaaattaaaaggtttgaatccaaagcagagagaactgcttctggaaaagtgtagtttaattttaactattctaaaagcaatgagcaaaggcccttgtccaaggcgttgacagttttctaaagtggttatgctgtatatctggatgcatgcctttgggctgccactgcttgattcctttcatgtacagataatattacttcagtttagatttcccactttaaaatgcagtgatttgtgttgaatacatcttgattgtgctttacctaaagtattttcttaaaaggctttgtgtaaaatttaaatgtatatattttcctgtagacttccatcatgattttcagagattagccttaaaaaatttggccctaagaaattcattcagtgtttttctagatgacctctgtacatagaggtcattatagtggagaccctttaccagcagcattttaagatttaaattagatagaaagtttcttaggattcaactgaaaattggctagtaaaatatgtcccaggtaataaagcatgctgactttgctaaggcactgcccattt

SEQ ID NO: 57242 - DNA, 1528 bp, Homo sapiens
caggacagtccacatcagaaacacaggaaggaggaaagaaggcagctctgggcgcagtgcccatcagtgggaaagctgggaggccagtgatgcctccacctcaagtgcctctgcccacatcttccatctcgccagccaaaatggccaatggcacagcaggtactaaagtggctctgagaaaaaccaaacaggccgctgagaaaatctcagcagacaaaatcagcaaagaggccctgctggaatgtgctgacctactgtccagtgcactcacggaacctgtgcccaacagccagctggtagacactggacaccagctgcttgactactgctcaggctatgtggactgcatccctcaaactcgcaacaaatttgccttccgagaggctgtgagcaaactggaactcagcctgcaggagctacaggtttcttcagcagctgctggtgtgcccgggacaaaccctgtccttaataacttattgtcatgtgtacaggaaatcagtgatgtggtgcagaggtagccactgttagcctggtgggaaaatgcacacatttctgaggggagagggaaaaggacttgttttcctgtgttcttgttttcagaaaatgaaagactcatacttgagtgtgtttatgtgaagtacctcagatccctgagttctcacgtttacagtttcatctcaaaaataagaagcaaaccacataagtataggagaggtaaattaagtgggggcaaggcagtagtggacagggttggaaactgcactggaaaatagggaacatgtgtatgtcataaggaaggcaatgcagcccatccctacctggaatgctgggaagtgctaggcagggctgctctcagcaagactgcagcagctgcacccagacctggggctctggtaggtactaatggtgattatgctccaatttacctaatgaatttggtgggacagcagaaaagaaagctgggaatgtaccaagagaaatttttgttcagggctgttggaagtagctgttagccttgcttccacaaggccattgctgctgtaataagaactgcaaatcagagtgctacaacataaaactgggaaatatggccctatctgaatgcctctgtcctattttccgctggtgtatcagttagtgcaggaagtaaagaatgctggaaagttgaatcagaaattgaaaaccttctaaaatcttacacagattagcagaagtcacttctcccagtctggtatattatttcataatggaccaggatcggcttcctgcctgttggtggctatctgtaaaccataagtacaggggtctccctagtggttcttctctgtcttttgctgggcaggctgtcttcctttattcctggtagcattcagagcattaaccagtgttgattttgaaaatagtagtccctacaggttctcacaaaggaatgaatcctgttctgatacagttcccctgcatactgacatactggccaaggacttgagcagctgtgtatttttctttatcaactaaaataccagggaga

SEQ ID NO: 57243 - DNA, 1050 bp, Homo sapiens
gtaaccacagctttcatgcaaaatagtatcgctatttggggacaggttggcagggcctaataaacctgaatacacgtataccctgtgatccaccagttctcctacattgtgccaatcagacgtgcataacattgtgaaccaaaagacacagagcaggatgatgctagcaacgtattcatagtaactccaaactggaaacaacctaaacatccatcaagaggagaacaggtggattgtggtatattcacacgttggcatgctacacagcaatgagaacccctgccacatgcagcagcgtggacgaatctacacacatgatactgggcgaaagaagccagacaaaagagtacatactttatgattccgtgtatgtattttagtactctacttgccagttctttctcagttgtgtgccttttctgaaaagaactccctttttctgctatgaaattgttctttttattggtccccttgtcttcctcacagaggtagctgaggagcttgggagagccgcctcctcgtcatctgttgttccatacctgccccggctacctatacttccttccaagactcggacactgaagaaacaggtggagaacaaggagaacattgaaggggcacaagatgccacagaaaattctgcttccagtttagcaccaggtatgggtcccttagcaggtagaatcaaaatagaaactgccttgtttaaagaagcatggggtgtgaggcttttatgtccactttcatgcccgtcctccctggggaaagcatggcgtctcttttacccacccatgaagcccttggctatccatccaacatacaactctggctccagtttcatctccgtacccctgggttcccaagtatgtatcatctttacagttccatcaaaaacttcgctgaacccgatagaggagaagaggttgcgcagtggtttttaaagaaaggatgagtgttgaggtaataaccagcaggttatctcctcccccattttttttttctttttttttttttgagacggagtctcactgtgtcgcccaggctggagta

SEQ ID NO: 57244 - DNA, 1033 bp, Homo sapiens
gagtagctgaaactgtgggaagtgaaaccatggataaggggtgactactgtatatcaaaaacttttctaagaatagttggattatgcctcagacttcttaaatggtcatagtttattttccctcattacagtaaaggaaatctaaataaaaattgggaaatttaaataaaactgtcttgagattatctgcagcattcctgttgcaaatattttagaaggacaaatcatgctgtaagaattgataaaagagtatattatatattaatgttgttgtaacagtgtgtgaatgttacctaaaatatgaaagagaatcacctaattatgtaaaataaataatcggagaagaaacactaagtgctttttttaattccttatgcagcttttggggtattgttgtgggaaattgctacctatggaatgtcaccatatccaggtattgacctgtctcaggtctatgacctactagaaaaaggatatcgaatggaacagcctgagggatgcccccctaaggtttatgaacttatgagagcatgtgagtatttttgcatgttttaattttgaaggcataagctagcagttcagaatagttaacaaaattagaaacatttctcctctcagtgttgttagattgaatccagcctcatgacatttaaagagtttatcattgatcagccagttgtcatatcatataccattgaatcttattggaatcctaagcatagttgttatggcccaaatattgacccagtttctcagagacatttgcatatttaataagataagaaattgagtttagagattaaggtggggagggccgttttcaactagataaaaatgattgctaaagactatgaagaatgcataaaaataacctctgtgtagataaacagaagcatccgattgcttgcagatgaaaaagtaggaaagtgaatagtggattaaattgcagggttttgtttgtttgtttatttgtgttgttgtttttcaaacactcttgctttgttgcccaggctggagtgcagtgacgtgattt

SEQ ID NO: 57245 - DNA, 1035 bp, Homo sapiens
caaaactctgtctcaaacaaaaaaaaaaaagaaagaagaaagttttaaaaaagaagtccctgccttcagagagctcacagtctagatctcttattgcattggagtgctaatgatcctccctctgtaaagcatcctatttccacattaggttttttgtttttatttttgagacagagccttgctctgttgtccaggctggagtgcagtggcacaatctcagctcactgcaacctcccatctcccgggttcaagcgattctcctgcctcagcctccagagttgctgggactacaggcatgcatcaccatgcccggctaatttttgtcatagtagtagagatgaggttttgccatgttggccaggctggtctcgaactcctgacctcaaatgatccacctgccttggcctcccaaagtgttgggattacaggcatgagccactgtgctcagcctcacattaggttttatcactcatttgcagagtactgtgacacagagcttttttttttttcgagggaagtgtgatgaggtttcctctagaatttgtcctaattgatctggtttctactgctctgagaggtaatatgatttggttgaagcttagtagactgaacaatctggaaatttggattgtggaccaatagaaatagtcataggattctaagtcattttttactggaaatctcaaactcaaataactgagacaaaatcaaacaaatttttttctgctctgaattttatctgattttaaatgaatccatttttattttactcctcttgtattagctgactttaaaactgttatgcttcttagatacagtggttctcctttatcctcaggagaatacattctaagaccccccccttggatgcctgaaaccaaggatagtgtcaagccctggatatataatctttttttgatctgataaccgagaggtcttctcagtgactaaggggtgggtagcatctacggtgtggatatgttgagtaaaaggatgatttatgtgcgaggcgggaaggagaagcatggcttgaga

SEQ ID NO: 57246 - DNA, 1082 bp, Homo sapiens
gtttcgccatgttgccccggctggtcctgaactcttgagctcaggagatacacccaccttggcctcccaaagtgctaggattacaggcgtgagccaccacacctggcctagtggctgaatttttaaaatagttttctgcattagtaaataacttagtcttgtagaaaagcatctattgctcacctatcccagtgtacttataaatagggacccattttataaagcctgctttattccgcatcttgatgagtgctctacagtgacatatcattagtggctttctaaggtgttagtgattatcagaagatactaccatatttgtcagcacttacttaactctgcctataacacaaaaccaagaatagagtgttcatgaccattttcctcaccatctgaatggaatcacattagggttctctttcccacagagatcttgcagctcgtaactgcctagtgggagaaaaccatgtggtaaaagtggctgactttggcttaagtagattgatgactggagacacttatactgctcatgctggagccaaatttcctattaagtggacagcaccagagagtcttgcctacaataccttctcaattaaatctgacgtctggggtaaggttgaaagggacttttttctgtgtcattttatttttttttttataaatgccttgattctttagagcttctcttacgatgttcagtatcctctacctttacctgccattcttcttcagttattcagcaagcatttgttaaatacctcctatctgccaggactgtgttaagaactttgcataaacagaagtataggcctggtgtggtggctcacgtttgtaattacagcactttgggccgagatgggtggatcacttgaggtcaagagttcgagaccagcctggccaacatggtgaactcccatctctactaactacaaaaattagccaggcgtggtggcatgcgccagtaatcccagctattcaagaggctgaaggctgaggcaggggagttgcttgagcctggagggcagaggttgcagtgagccaagatggcgccactgcactccagcctgggcaatagagcg

SEQ ID NO: 57247 - DNA, 2297 bp, Homo sapiens
gaggcggagcttgcagtgagccgagatcgcgccagtgcactccagcctgggtgacagaacaagactccatctcaaaaaaaaaaaaaaaaaaaaaaaaaaaattcttaatctcttttcaagttgtttagcttttctccttttcttaccaggtgtatgtgactgctgagagccgcttcagcaccttggcagagcttgtacaccatcactccacagtggctgatgggctggtgacaacattacactacccagcacccaagtgtaataagcctacagtctatggtgtgtcccccatccacgacaaatgggaaatggagcgaacagatattaccatgaagcacaaacttgggggcggtcagtatggagaggtttacgttggcgtctggaagaaatacagccttacagttgctgtgaaaacattgaaggtgggttgctgagaattacagttttcaggcatctttttcttttgtgctcaatcacttggaaatatcagcatgcccttctttaactttggaacactttccacccactagtgccaagcacatcagcaaattgagatgattaaccctagtgccattgctgacaatgcagaggtagattattcactgcaatgcagtgaaacccacatgtgggaaaggtctgtctctggaggctgttgatgtagatcttagtgggaggttagaagcaaattaaaagttataaaagcaaaataagctcttttgcttcctgagaacgacccctgctggacagaattcttgtctgagagtcatgggcctctttcttgttctgtcctttctctcccttgttcttgttcctcctgtctctttgcagttagatcacttcttaatattaacagaaatctttttcgtagtactactatatgtctcctttaaacatcccagtatcaaattataaggttttcactcacttgattctcccagagcctcagtaactgtctctggtgtatcacttataagggctattctttagctattaagtagtagtcagttctgtttcttaagcatattctgagtgtgaagcaatatataaggccttgctctctaagaagattatgatctaagcaagaagataagtatgtaagcagctaagtgctctgtctcgtcattcaaagcctgagatatctggagaagtaaactatgagagaactgaactatccaatacagggctcctgtgtttcagttgattataggacacgattgctgaattttgctcctcctgctaatttttactccagggcatttttctttctaagttggacttcttaaaataataattatttcagctgggcgtggtggctcacacctgtaatcccagcaatttggggagctcaggtgggcgaatcacctgaggtcaggagagcatcctggccaacattgcaaaaccccgtctctactaaaaatacaaaaagtagccaggcatggtcgtgcatgcctgtaatcccagctacttgggaggctgagccaggagaatcgcttgagcccaggaagcggaggttgcagtgagatcacaccacttcaccccaacctgggtaacagagcgagaccgtgtctcaaaaaaataaattaaattaaaataataattatatcttgtaatatgctaaaatattcaaaagatagtttttacttttaaagctgaagctttatgattgtgagatgaatgaaatgattttaagttgagggtttgtccctctcgttttcttctttcttacctttccctttttctaggaagataccatggaggtagaagaattcctgaaagaagctgcagtaatgaaggaaatcaagcatcctaatctggtacaacttttaggtgaggaaccttgcctgaaccatagatttcctccaaaaatgcttgccctttaaccccttgttatctccaaatgctttttttttttctttttaaatatagagacagggtctcgctctgttgtccaggctgctgttgacgtgatacttccgcctgggcctttcaatatgttgggattacaggcatgagccaccatgccccgccttttttcctcccccaaacctttctttttagtcaccatggtggaagctgcaggtttgaatccacttcaataaatagttattttaatcagtaggttctgtgtttaaaaatagcccaagaaacagtggcctggattgattttggtgtataaaactgctcagtttgtactaattgccccagattcaaagttcagaagtgttcaaaatggtactgaaccaaaaactcatgaaatgtttttgcaaaataaagagacattaaacaaaggactgttg

SEQ ID NO: 57248 - DNA, 1528 bp, Homo sapiens
tcctgtctctactaaaaatacagaaaaattagctgggtatggtggcaggcgcctgtaatcccagctacttgggaggctgaggcaggagaatcacgcttgaactcgggaggcagaggtttcagtaagccgagatcacgccattgcactccagcctgggcaacaagagcgaaactccatctcaaaataataatgataataataataataatcataataatcataagtggaggaagagagacataaaagtgttgttatatgacatagacatttggatagtttgcctttgtagacaggcactaaaaatagtctgatcaagaaaattgatactggaaaaactgttttttgtataatcgatctgggctgtgagaagcaggtgatctttaagatggtatagggatcacctgtgctatgtactatgaataaatttagaaactgtaaaggcttaaggaaaaaacaggtcgtaaaaggcttggaccactttgagtagaaactcaataaatgcccgatgatagtaatgttttctaggctcttcaattaagttattgatatttacaaaaaatcactgctcaggaaaacaaaatagagtttaaaagtcattcaggccgggtgcggccacatttcttttgtttttttaaaacgaaaaaaagattattttttgccatgttggccaaaaaaagatatttttctaaaagcactttttaaataattttttctatacttaaatagagggcctggatttatacagtattacctaattctgaaaaataatccctgttgtcttttctacagtttgttttctgtggagagagaaaggaataagggtagtttgagtggacttgtaagaaacttacaatcatttcttccttaaaactacaaccactactacaacaaaatatcctctatgttttataaagctagtaaccatttctctttgagattcttttttccattttgagaaaactgcgtttcctattagtttatgtctgattttggtgagtgcatataaatcacggctaaactctcattttgtggtcttttctctgactaccttgttttacattttcaacaagtaaattgcttcctcatgcttaggagacacagtgcctatttgctaattcttcataacactttatactgtacagttctttcctactctggagccagcagctgaaatactgtgtatataatgaattcaaacaaatgtttcgctgttgaactcaccgtgaattcccttcccttcttatgtctttcagaagctttgcatcgtccctatggttgtgatgttgaaccccaggcactaaatgaggctatcaggtggagctccaaggagaacttgctcggagccactgagagtgaccctaatctcttcgttgcactttatgattttgtagcaagtggtgataacacactcagcatcactaaaggtgaggcttctatgtagcatcctttcacttttcagttttcattaatgattaagagataaaggggcctggccaggcacagtggctcacacctataatctcagcac

SEQ ID NO: 57249 - DNA, 1150 bp, Homo sapiens
gaacatgttatgatgtttggggaacaaacatacgtagaatgtattattaatatagagataaagatagagtattaatgcagcaactgtgatgcttttgagagtacagatgggaggtgcagtagcccccattatccagttttgctttatacagtttcagttactggcactccaccccagtcagaaagtattaagatattttgagggaaaaagagagataccacattcacataaattttattacaatatattgttataattgttcattgtattattgttaatctctttctgagcctaatttataaattaaattgtatcatggttatgtatgtgtaggaaaaacgtagtatatagtggatttggtactatcctgattgattttaagcatccactgggggtcttggaacatattcctcatggataagggggactactatatattggagctgagtattacaagtagaaatcagccagtcaaaagaaaagtggggtgagaacccattccagttagtctggactgtgtgaaccaaggccagaagatgggaagcagcatggtgtatattaaagtttacaatttgaggtatggagtagggagaggcgaagctggagaagtaggtagagacctgatcatgaaaggcctttgaatgccatgaaaaggagactttagcttgatgttaaactattgaagaagcttaagaaaagtgacgtggtcaatttttttcttaaatagatcactttgccagctgtgtggaggatggatttgagggagacaagactggaggcagtagtccaggtgagagatgttgagatgttgcagatttgaactaaggcattggcagtagagatggagaacagggaatggatttgaaaataaatggaaccacaaattcaagggtttttcctttcatatatgataaaactatttttatattaaaaataagttggcctggctgggtgtggtggctcacgtttgtaatcccagcactttgggaggccaaggcgggcagatcacaaggtcaggagttcaagaccagcctggccaacatggtgaaacttcgtctctactgaaaatacaaaatttagctgggcttggtggcgtgcacctgtaatcccacctactcgggaggctgaggcagtagaattgcttgaacct

SEQ ID NO: 57250 - DNA, 1026 bp, Homo sapiens
cggtgggctggcactgctgggggacccagtagatcctccacagccgctggcccaggtgctaagtccctcattgcccggggctgacagggctggctggctgctccgagtgtgagtgcggggcccgccaagcccacgcccacccggaactccagctggcccgcaagcgcggcaggcagccccggttcctgctggcgcctctccctccacacctccctgcaagcttgagggagtgggctccggccttggccagcccagaaaggggctcccacagtgcagcggtgcgctgaagggctcctcaagtgccaccaaagtgggagcccaggcagaggaggcaccgagagcgagcgagggctgtgaggactgccagcacactgtcacctctcagagccatgaaggattccatggtttttggcctcaacatttgaaaagatggaattgccattaactgaaatggggaattcagtgagagaaacaaatttggagggaaggatggatgatagttttgcatattgagtcccaatggtgttattagtgatttctcatctttatattctgaagcccagcacagtgccttgcatgtggtattcactcaaattactagggatttctttttccccaataaacatttaaaataattaaacaggctgggcgcggtggctcgtgcttgtaatcgcagtactttgggaggccaaggcaggtggatcgcttgagctcaggagtttgagaccagcctggacaacacggcaagaccttgtctcaataataataattaaacaatatctgacagccactggaaaactctcctaaactggcagcattttggagcttgaaaagatccctgggtcattctctggagctgtaatcaaagtaactgagttatcagcatgattaatatccaggcagggggcaggtttcatagtgaggtttaatgctgtgtgcttaaaacaccccagctgttttcagaaatacaagaaatcttaagttgcactgtagattccctgagcgtccatcctgagagcttgggct

SEQ ID NO: 57251 - DNA, 1002 bp, Homo sapiens
aggtttttaaattttctttaactttgttcctgtttattaacaaagattgggctttttgctttaaaaacttttaacactcaggctgggcatggtggctcatgcctgtaatcctagcactttgggaggctgaggcaggtggatcacgaggtcaggagtttgagaccagcctggccaacatagtgaaaccccgtctcttctaaaaatacaaaaaattagctgggcgtggtggcgggcgcctgtaatcgcagtcacctgggaggctgaggcaggataatcacttgaacccgtgaggtagaggttgcagtgagccgagatcgcgccactgccttccagcctgggcgacagagcgagactccgtctcaaaaaataaataagtaaataaaaataaataagtaaataaacttttaacactcaaaagttttcaacactatattgccatgtttttaacctttattaagctatagagccagattgttagcaaaggcagttatttcttggcttctgtgctcatgaatcagatcacagctatttctttgactttggctttgtggtttcttgaactatttaagtgatgtaaaagatgagtcttgttaggcgtttcctttcttttaaaagtgtatttcgtgttttattgtaaacagattttctccaaggaaacttttctctctagtctcacctcatcatctccctataaaatagagatatattaacttctacattgttttattattaggctatttgttatacatatatatgttggtttttattttacttacattttaaaagtgttctcagagattttgaagtaactccattctgactcagtcttttgcggattgctggaaattttcctttaggtcactctccacccactttgggaattgtgaatgctcaccattttattggttccctctggccactgagtacatgagtaaatgtcacatgcatgtggtattgcttgtcagagaatggaattctaagacttcctctttacacagaaca

SEQ ID NO: 57252 - DNA, 1040 bp, Homo sapiens
tatgctcttgaccaccatgctctactgctgatttatactcataatataacagctgccatgcagctattattataattaaattaatttcatattgcctcacacttcacatgtgttaggtactcaataaatgggagatgatattatattctcattaagtacaactagaaagttctacaaggcatgactcttttctgttaatatgctgtattatatattgatttccatatgttgaactaaccttgcactctagggacaaatcatagttggtatagtaaaataatcttattatcctgctagatttggtttgctagtattaaataatttattgaggacttttgcatctatattcataaggaatgttctttttgtgtgtgtgcgctacccatgtctggctttatgttttcttaaattcattcttcaccatccactccctcatcatggaaaaggacttacgttagtcactggtttctagccttaggtcagaggccagtttcactacgtaagtgcagaaagacaatcaggtggttgtgggggtcccttaaactttctggttgtgatagtccaagaaaattgatctctgaaccaggaggcagaattccaaatcctattccagaattgtatctctacatcttaccacatggtctgttcatctgtgaaatgggataatataatatttttagcagagttaacatgagggttcattataatatatgtaaagcacctggtttatataaccaagtattcaacacctgttatgtattatttctctcccattctctatcttctaaattgctcttggatattgtgatgctcaaaagtccagaatttaatttttcctgttgtggagttagtatttcattgcttttctctaccttttgcctattctttcctgtccccaatcctagtcctcacaatctggctcagcattcaggaagaaatttgatgtctgatttgtattctttccttgactctcctatggtctccttttatttgtgaacaccgtattccacccttctgccatcaagatagaatcagtggaa

SEQ ID NO: 57253 - DNA, 1012 bp, Homo sapiens
attctgagcagaaggtaattatatctaaaataagtgtggaaatttaaaattcaagtgaagctgcaaaattctcatctgtagttattcaataataactatgtgtcctatgatatgacattcatggcatgactttttattatttacatataactggcatgaaaatgtgcttcaacacattttctgctttttttctcttaatttaaaaaatcgtcacacagtaaaatggattttgttggtttattgtacggttctgtgaattttaacacatgtaaattcgcataaccccacaaacagcggaacagtttcatcaccccaaaagactgtctcatgcaatccctctgtagtcacatattccccccctttaatccctggcagccactgatgtgttctccaccactagagttttgtctttcagcagtgtcatagagctagaatcatatagtatgagatcttttgagattggcttctgtgggagactcagcaaaatgcctttgagattcatccaacttgtgtctatcaatacttcattcctttgtattgttgagtggtattccatagtatggatgtgtaccacaccttgtttatcccttcattcactgaaggacatttaagttgctttcagtttgggacaattttcttttctttttttgtttttttgagacggagtctcactctgtcatccagactggagtgcggtggcgcgatcacagctcactgcaacctccgcctcctgggttcaagcgattctcctgcctcagcctctcaagtcactgggattacaggtacctgccacaatgcccagctaatttttgtatttttagtagagacagggtttcaccatgttagccaggctgttctcgaactcctgaccgcaagtgatccacccgcctcatcctcccaaagtgctggggttacaggtgttagccactgcgcctggcccagtttgggacaattttcaatagagctgccataaacatttgtgttcaggtttttgtgtgaacttaagtttcca

SEQ ID NO: 57254 - DNA, 1051 bp, Homo sapiens
caatgatctagtgtgtgtttttgttatttccctggcataactgtcccctcccccataatccagaaaagtaaaagtatgtatttatctagaagaagcactcttgtaaattgttactgttatgttaatggcttctcaatgccaacaaaataaatctgaacttcgtagtgtgacattcaaggccatctaagatctggtccttgcttacctcctctactttaatattcttagcacatcatttctatgcacacataccctctgcacaaaaagcaaatggaaaatctggggctgtactagtttttttttttaatttccaaaacgtattatggagttttgttgtcatcagtcaccctctacctggaatgccttcttcctcattcactttacctgcttcaaatggttgatataaaaatgacttgctagtgcctttaaactggaggtggtacatggggacacagatctcatccttccagtttattggtatatacctggttcctgttacagtagttggcacatagcaggtgtttactaaatatttgagtaattaatacattgataaattatagttatgcatttataacttttacatgctgtgtcacaatgtctgcatcattcacctcacttcatctcatcatgtagctattttatcatctcacattatcactggaagaagggtgagtacagcacaagatacatttgagacatagatcacattcacctaacttctactacaatataaattgtaattattatatttattctattttattgttcatctcttgccttacctaatttatgaattaaactttatcataggcttatttgtgtaggaaaaaagcatagtatatatagggtttggtactatccaaggtttcaggaatccactggcggtcttggaatgtatctcatgagagcaaggtgagactactctacacagatacattcatatatatttcatgcatagaaactatagtgtatgagtaagcagttgttgcatgcttccatagtctcaagggaaacagctgactgcttgggttacaaaggattgtattgt

SEQ ID NO: 57255 - DNA, 1168 bp, Homo sapiens
gggagatctggtggggtcacaagattatatgaattcgtgtattagaaagaatgagctggaaatataaaacatggtattcaaaaagagttgcatgaaattgagattattgacagggtgcattagagtgtgctgagttagggttacatttagctctttgcttttcacagcagcaccatgatatagatagtgtaagcatcattaagcatgtttcataaatgagaaaactgaagctcagcgaggttgggcagttttcccaaggtcacaaagctgctgataggctagttatttaggactcagatcccattactctgattctcaatactcactcctctaccatactatatcagttttctgaaagttagtaacttatttccctatctttgcacctagattgcaatctcaagttgaaacttttgacaaatatacattaccaaaattattttcctcttcagaaatcttcagactctaatcttagggcaatgttggaggggtttactgccactatttttacctagctgatcttattgaaaacacacatatattagaggcttaaatatgatagttttgtttaaactccgtttcataatggggcttaaggtgggtggaagatggaacaagaaggaatgtactgttctttcagcagcatgcctggacagacagctgtactgttagaatgtgtccaaatccatgtgtgttctttttggtggcagtttgcaccattgcaagtctaaaggatagttggttattggatgttgtccatttgggatatgattctcttctttcccccaatgaaataattatcacgctttttgcatttttgcacatttagctttgtggtagggggcggacttggaagaattctttaaatgtgaaggaagaatgggggaattattattaagtatactctgaactgatctttatcattttaaatgacagaatagaaaaatgtttcacctaaatttcagatggtttttttcttttaaaaattattttaaattgtgataaaataaacacaacataaaatttactttgttatcagatgttttaatatcctctattattttgttggtataatgttctgtttaaaatatgaatagttccctggaggtgacccttatgcaccttggccacgggaactctctttcttctctgttacttttctgtttcc

SEQ ID NO: 57256 - DNA, 1040 bp, Homo sapiens
gtgatgtgattgtacagtttttctgcatgccatgtgtttcattcttttatgtctggcacataagtaattaaaggttaagtcaattgtcagatttaactcaacctgcttgagttaatttacttgatttttctggtacttacaggtacaacaaatgggtgaattggtgtgccattatgataacatgacttggaaaatggaaattcaggcagtgtgggacaagaacaaggatatttatttgtccagtgagaataaaagtggtctaggatttattgagagtttgttgtaattcgagcttgagtgataattttataggatgttatggagataacagtgttggtggaagggtttgacattccacatttgacattctcttatcatattttttggtttgtctctgtctccctaatgaaatgaaataggaaacagctagagagtggtgggatatgagtagttgtgcatttggatagattgactagcatgctcaagatgccagccatatctacctttggtagagtgagagccaaggtattcctgtggattgtttttcgtaactaaatctgtaactactgagtatagagtccctgctatatacgtgactaaccaaggagtgaaatatgattggttcaaatattttgttatattttgactgtaggggaatggtaaaatgtcaccaagtataagttactcttctgctttatactttgtttgcaattaaatgtatttttcttaaagagaatataaaagcaaaggaaaaaccatttgtaatgcttttgcttaggtccaaccttaatttttatatgacagtttccaattgattgtcagattttctgtctcatttcaattgagtaattgttccatctgtcatttaacatgacacagactgtttcttagtaattgttttgaaaactctttagtgatttttaaaaacctttacagagtgttgattatttaaatgatagcagaatatgtatatatgaagtaatttcagaggccggacaaggtggctcatgcctgtaatcccagcactttgggaggccgaa

SEQ ID NO: 57257 - DNA, 1066 bp, Homo sapiens
gaggggcactggatgttccccttggagagggaatcaccttggattactatctttaaatcttaaagggatttttctcatagatattctacttaagtatagacaaataatttaatcatcccataatgtatccaccatatttgtggcttgtaaaagttttaaaagttgggcataagtagctgataagttacaaaaagatacaaatttcaataaggtaattttagttaaagtgacaggaaatgggggtgcattttgaatagaaaaacacagaactccaaaaacaagacaaaaaaccatgttatttccaaagagaacatctcagttgtgcagaaagaattaacatagcaggcctgattgagactgatatgcttagcgaggtctgcttgcaaggttggcccttggctggcatctaggaacttagatttggggagggttcctacatttccagaaccaaaaagagtggcccattgtgcctaagctgtttgtataaacaatgtggtttatagagaacacctttctttctgggagtctggaattttgctgtgtagtaggcagagggtgcttatgtgatcaccccctaagaagaaccttggagacagcattttacacatgttgttttaattcattgctggaggaagtaagtatgtcttgtgtgactccactgggagaagacttggacacttgcgcctggttttctctggacattgccccatgtacctttttcctttgctgattttgctttatatccctttgctgtgataaagcacggccatgagtacaactatgtgctgagttttctgagtcctcctagtgaatcatcaaatctgagggtgttcttgaagatttccaatacaatagtggatcagataagtttataattggaatctccatgttcatacaaaatctctacatggaagctttcaatgggtaggtagcattttttgggtttaagttgtgcccaaatggggtgggagatagaatatgcgaaactaaaagtttgggatctgaaggagagaaaaaaaggctcttaatttgtgactgaaaaacttctgtttaacttttatctttg

SEQ ID NO: 57258 - DNA, 2053 bp, Homo sapiens
gaatggggggggcaagggttgaaaaacctgttgggcaccgtgcttactacctgagtgacaggattattcgtaccccaaaccttagtgacacacaatttacccatgtgacaaatctgcacatgtaccccctgaacttaaaagttgaaaaaatatatatataacatatacaattcactttattaaaggttaataaatataactgatttatttttaggctagtcttcgtgtactatttttgtgcctttctcagatattttgtggacttgagtctgaagtaaatatttataaagggaaagtagataactgctattaccaggaaaatacttattcaaaaaaaaaggatatttaagagataattagaatgactttactgaccttgttttcttacactaataattcatgaagcatttagattttctgattgagtgttttctgtgacaatatcagtcagagatgtaatcatttataaacatgctgttaatggcatggactctggtgtcagtctgtgtgggtttagatcctctgttaaatttctgattttggtagcttgacataggtataaaaaaatttacaacctgaagagaccttagaaataatgtattcctgggcaagttattcattcgctatgtgtcccttttctcaccagtaaaataggtatgctaataatacctacctcatagagttatgagaattaaggaattattacatgtaaaattctcagctagtgcatgattaatggtaagtactcaaaaagttatagctgttattgttttttaaacattattttttaacatttttattggttgaaataggtttcagacaattgtaaataaattttaaaaaattaaaaaatgttaaggctgagagaattttgagaccttaatacaaggtagtatattgtatcaggcttgttctgtgcctaggcttaattaccagatttctgtgcttctggacttataatgtatagttgtcgttttaatgctaacattctgattggatacgtccagcacttcacttgggtaaatcacaatctttctttcctccctcacaaaggacactttgaaatgatcctaaaataccttcttattcagatagatagaacagctagtggtagaggccctaacaaaaaaaaaaaaaagaaagaaaagaatggagaatcagaggagctgacttcagaaggtaatggaagggactgttgttatgtgggcatactggggatcacgacactccatggacaggcatcactgtacagctgtgcctgttggaaactggagctggcaagctattagaaattaagactgcatattctgtctctctctttcaggaactgcaaggtttggcatctctttttcgctctgtacatctgttcagttttcctttcttccagctggctttctcagtttcagcttgtatgtggagtgtaatggctgctcagctcctttatcaagagaattctcaatctatcctttcggcatttatccctgctgctaaatggctgagttttttaaaaaaatttaaatcatttgtttgtttattgaagggtcagtacatttatgtggttcaaaattcaagagatacagtttgaagtcttcctgccactccttttcttcagccacccaaattttggcaatccaaatcaccagttcgttgtatatactttcagagatatattatgcatgtgtacctgtatccgtgtatattctccccattctttttttttccccctagatggatgctattatatagcttatgttggacattctttcatgtcagtaaataaagaacttgcttttttttttttttttaaatggatgcatagcatttcattgtgtggatgaattatataattactttgttttcagttttttgctgttgtaaacagtgtcctagtacaaaccctaatatgtgtcattttagacatgtgctagtatggctatagaataaatgccttgaatttggaattgcttatagaaagggggtggggatttcagaataaccatgtgttgaataagcttttatccacctttttgtatgctaaatcctgtgtgcattt

SEQ ID NO: 57259 - DNA, 1671 bp, Homo sapiens
agctgggaccacaggtgcatgccatcacactcggctaatttttgtgtttttagtagagatggggtttcaccatgttggccaggctagtcttgaactcctgacctcaggtgactcatccaccttggcctcccaaagtgctgggattacaggtgtgagccaccacacctgactgagccacaggccgagcggctctttttttttgagatggagtctggctctgtcacccaggctggagtgcaatggtgccatcttggctcactgcaacctcggcctcttgggttcaacctcggccttctgagttcaagcgattttcctgcttcagcctcctgtgtagctgggattacaggtgcacgccaccacacccagctaatttttgtatttttagtagagacggtttcaccacgttggccaggctggtcttgaactcctgacctcaagtgatccgcctgccttggcctcccaaagtgttggtattacaggcgtgagctcccacgcctggcctccaatcatcttatattagaatctatgtaactggccgggtgaggtggctcatgcctgcaatcccagcactatgggtggccagggcaggcagatcatgaggtcaggacttcaagaccagcctggccaatgtggtgaaaccccacctctactaaaaatacaaaaattagccgggcatggtggcgtgcgcctgtagttgcagctactcgggaggctgaggcagaagaattgcttgaacccgggaggtggaggttgcaggcccagatcacgccactgcagtccagccaaaaaaaaaaaagaatctgtgtaaccacatgatatatttagcttattattgcaatatgcaacttataaagaccttttcccccaggtgataatggcaggagaatttttaaaaaattttagcttaacactccagagcattttctatttttttattcatttattctgtactaattgcctatgttgatggctctgagagaatttttagatacaatttagacagaactgctatctaaaagaatgttgctgatcaaatagatgttgatgaacatccttacgaaacaactaaaaagagatgtgtgtgtctgtgtttgtgaggatattttgtacaaaaactcttggttgcctttttggattgagtgcataatttcagtatgtaaatttgttgtcattatactaattagaacattttgtcagtattttcaaatgaaattcactcaaattcatggataaatacacattaaatatattactatccaacgtttaaacttagttgcttaaaaatatgaaaacagcacttagcttttttcccacttgctggttgctgtaaatgtgctgattctgccgtggtagaactgccggcttctctatagtgaactctgccattattggcttttgatccagcagaacgctaaagctgggcaggcccaggccatttgtattctcgggtttgctttctagggagaagaagtgttcaaaaacctttcacttcatgtggacaaggtcaaaaaaatattctggagcttagtataatacataatatgtacacatgtaattttgttaacatgtttctctctgtgtgctaattccagcaaattaaaaaaacagtactgagttaggactgaagattaccacttagcattttgtttctaggtaattgctaagaaaaca

SEQ ID NO: 57260 - DNA, 1058 bp, Homo sapiens
atttgtaaagtggtgataataatagtacctagtattaaatgaatagtggctgggcacatagtatgagctaaatgtgtgtagctgctgccattactaatactactgttattattaaaaacaggagtaattcggccaggtgcggtggctcacgcctgtaatcccagcactgtgggaggccgaggtgggcagatcatgaggtcaggagttcgagaccagcctgagcaacatggtgaaacctcgtctgtactaaaaatagaaaaattagctgggcatggtggcacgcgcctgtagtcctagctactcaggaggctgagacaggagaatcgcttgaacccgggaggtggaggttgcagtgagccaagatcgcgccactccagcctgggtgacagagcgagactctgtctcaaaaaaaaaaaaaaaaaaaaagtagggataattcaaagatgacaccaggatttagaacctggctaactgggatgatgaagattctattgacaagtttggaagttagaagctgattgaaaaaatgggaataggtcgagtttattgccaaagactagtatgaaaagaaaggaattagcaaataatataggaaacaaaggtgcagtgagtactgttttttagacagatgggtttaaaaagtttttttctgtacatcatagtttctttttttttttttttttttttttttttgaggcggagtctcactctgtcgcccaggctggagtgcagtggcgcgatctcggctcactgcaagctccgcctcccgggttcacgccattctcctgcctcagcctcccgagcagctgggactacaggcacctgccaccacgcccggctaatttttttttgtatttttagtagagacagggtttcaccgtgttagccaagatggtcttgatctcctgacctcatgatccgccctcttcggcctcccaaagtgctgggattacaggcatgagccaccgcttccggccacgtcatagtttcttaacctcggcggcattgatattttgggctggctaattctgtgttttggggggctgtcctgtgcattg

SEQ ID NO: 57261 - DNA, 1286 bp, Homo sapiens
gcctgggctgggagggagagaccggagcagcgccaggagcccgaggccggagccgaggaggaatgtgaccaggggtcggcgggggcgcgggagtacgcgagagcagggatggggcagcaggtgggccgcgtcggggaagctccggggctccagcagcctcagccccgcgggatccggggcagcagtgcagccaggccctccggccgcaggcgggacccggcggggcgcaccacagagaccggcttcaatatcttcacccagcatggtgagtgtgtctgggagccggcatgagagcgtgggggaggccgggggtggggtcggggcggggtgggtggcggacgggctgcccgaggggtcggagggtggaaggtgcctgagagtgggggcggaatccgctgccatctggtccagtcctgggaggcgagtcacacccctcccccctcgcgtctctagcctggctggcagatcccgggggcggagaaggaaagagaagtgggtttggggaccctggatggtctgtcctctactctgggacgggactatgcggctgcagaaagaaagtgaatggcagcttcaggagagggaaggatgaagggcagtattagctcagtcccagaggtgggagcataaacccgtcgttagtgaaggggaaatgggttgtatcctaagggattgggaaatgggaactgaatttcaggagattgtggagtacaaggtatgtgtttacgttaggtgatgagcagtgtcaggatagtgaactgtggacagtgtcaaatgcttttctgtagggaagatgaagttagcatcatcttatcacttttgacatgcttttgtggtttattttgttttgtatttcgtttttactagaaatgaaaggctttgccaaagcctctgtactatgcttcagagtaggacacacaattctgagattgctggcaagggctagaggttggtgggcatggttaggacgtcagtcaggatatgaacaagttttcctttgtagtgtgtgcgtgtgcccatatacatacatacatgtatgtatgctccctgtagtctgaaacctattattttgatctcattgtcaatgtatttttagaatagttgtctccaaactttttttgtcttgtttttttgttttgtttttgtttttgttttttttgagacagagtctcgctttggtccccatgatggagtgcaatggcgggatgtcggctcactgcaatctctgcctcccgggttcaagtgattctcctgcctcagcctcccgagtagctggaactgcaggt

SEQ ID NO: 57262 - DNA, 1042 bp, Homo sapiens
gagaatgtatcatcacatttcacctctcctaaatatagtggtattgtgaaattcacgtaagccagatgcttagttcaaagctgatatattggtttgcttctgtgtccccacacaaatctcatctctaactgtaatcaccacgtgtctagggagggaactggtgggaggtgattggatcatgggggcagtttcccccatgctgttctcgtgatagtgagggagttctcatgagagctgatggttttaaatgtggcacttccttgctctgtctctcctgccgccacgtaagacatgccttgcctccccttggtcttctgccatgattgtaagtttcctgaggcctttccagccatgcggaactgtgagacagttaaacctctttcctttataaattacccagtctcaggtagtgtatagcagtgtgaaaacggactaatacgaaagctttttacaccttctttcctagacaatacaatggtgggtgaagagaagatgtctctaagaaaccggctgtcaaagtccagggaaaatcctgaggaagatgaagaccagagaaaccctgcaaaggagtccctagagacacctagtaatggtgaggcttaattttttttttttaggtgaattagtgaaatagagaacaaatacagtgttatagaataagtattgccatctctttaattctttattgtaaatgggtattgatagagttttatatgtctagtaacaaagcaattagacaataagtcctttctcgttaattaatttggtggtcatctattggtatctgctgtgttttagagaccattcattcagtcacgtaacctaccaataattgctgaggtcccccgctggatgctggggctatagcagtgatcagtacggatttgtttgccattatggagctccaagttaagtgaatgacaaaacctccaaaatcatacacataactagatttatcacagtgtaatattcttgtaattaactactttcataatagatgtaatgagtaaaatgtgagtaattagcagggtgcctaacccag

SEQ ID NO: 57263 - DNA, 1035 bp, Homo sapiens
gcatcttagtggtctcaactgtggaatctgttcagggaatctaatttcccatgctgtcagaatcagatctatagcattgcataattaacatcgttgtaattactgtgtgtacatttactagttttgttcttagtattttcatgtataaatttccttctagttattttgaccatgctgtcgtgttttatggttgcaccacagtttacgcagttacctttgtatttgtttgttttcaactttatgatttagacagtgctactaggtagctgtatccatcaacttaaaagtcatgtttttttcttcccgtaggtcgaattgacataaaacagttgatagcaaagaagataaagttgacagcagaggcagaggcaagtaactccctcttctagaaacaaaaatgtagagttttagatagaattttgtttggtaacatttttaatgctaaattgctcagataattatttaagccattcatcagttgctgttatcctgtggaacaagaaaataagatctgctgacttgtcatcctgcgtaaggatccagattgcctttttctctcccatctcatctatcactggcattttctgtctcttaccagcaaatcttggttttagtgacccacgttaacagttgatagcgttgaatgtctgtatgagtgctttgtgaaagtatctgtcatgattcatagtaaatagcagctctccaataaatgttgaatctgaatctagaagtagattccctgtcaaggaagtagaaataacaactcgaaaaaaaatcatgaaatcatttcaagtggggataaatagttctacaaaccagaattcttcagtaccctcaggaaattgtggagggcgaagaacacttttttaaaaaaacattataatccaatacctgggtgtaagttgacttaaaatccaaagcaaactcctgttttcccaaggagaagatcacttccaaaatttgttggccagtttgactatataaacatccggtgatgaagatgaagtagccctgttttatttatttagttacatg

SEQ ID NO: 57264 - DNA, 1080 bp, Homo sapiens
gattggcctctgctcaggaatgagcaaggatggccagcctgtgaggctagaagcatgatggagtcagacatggtagacgtttctcactgtcgtagtctttgcaaaggcagtttcacattcataggctgtggtcctccttattgcccacatggctctagtcattttgtctgagttccaagtggccaaattgagggaaggaaaggagtgggggtaaggaacaggtatctgtgtctgttaaggaaattttctgtggactttgacaaatcatttccacctgtatctcattggctacctaggtgcaaagagagactgggaaacttatttactctaagcagtcatgtgcccagatagaaatcagggattctagtactaagaaagggggtaggcactgatagggttgacaaataacagtttctactatggctgtccatttttctttgctgtcccaatctactggtcaaatttcacctttttgctatgcaagtgtgactatacatttttctgatattttcctttctgccttttctcatttaaatgcacgagtgtaagaatctctagtctattttgaataattttgtgaaagtcagtttattgtgctttatgatttcatcacttacaaaaggtagacaggtacctgtcctgttgccctcgaatgtttagcagttcaatttaatgaatgcctgcttggtttctttgtctatcaggtactacattaagtgctgggattttaaagaagttgtgttttctgttctcatgctaactgagaacactatatgcaaaatgcatgagcaaggggaacagtgacttaattagataccttaaaaatgttctttggccaggcacagtggctcacgcctgtaaacccagcactttgggaggccaaggcaggcagatcatttgaggccaggagttcgagaccagcctgggcaacactgtgaaaccccgtctctactaaaaatacaaaattatcagttaacaaaaagatacatcgtttaaaatcagttgggtggggggcagacagtgagatgccaaagagcatatacacttgaatatatagaatttcaagtaagtgcaatgaag

SEQ ID NO: 57265 - DNA, 1072 bp, Homo sapiens
gcgaccttgccattctctacaagaaggaaaagtgattgccaaagtccataggggctgggtgtggcgagctttcccttcttaagagttgtgtatgtacctgcctcacagagagggtaaatgaagtaacatacataaaactgtaacacaatatttggatctgttttagctgggcatggtggcgggcatctgtaatcctagtagtgaaaaggtcattggtcaattaatgttagatggtgttattggtatattctcttgtctgtgggattagatttcttataatacttgaagtacttatatcttgttttaatttttcctcttctcagggatttgagagcacctccagaacaaggaaagatttttattgcaaggcgctctctcttagagtgagtatttttagttgtttttaaatatgtttgatttttaaaaaactattctgatagaatcattgcttagtatatggacatgtaatgagttctgtatctgtataaatcattagtgggtttttttcttctatgctctctcttgctcctttctgatcttttggttctgtatctagtttcaaaagaggagttagggataagaatggttatctgggcttggcactgtgactcacacctgtaatcctagcactttgggaggctgagacaggcagatcgcttgagtccaggagttcaagaccagtttgggcaacacggcaagtctctctctacaaaaaatacaaaaaattagccaggcttggtggtgcatgcctgtaatcccagctactcaagagtctgagacaggaggatcgcttgagcccggaagggtggaggttgccatgggctgagattgtgcccctgcactccagcctgagcaccaggtgcaacacccagcaactccagcctgggtgacagagcaaggctgtctcaataaaaaaaagtgtacttttctttaaaaagacatcttatgcttatcaaaagttactttctgtgagtcaagttgatgtttactacttcccctagataagaaggccggttttctaagcatgtaatgtgctgttcagtgttttctaagcatgtaatgtatagtgtta

SEQ ID NO: 57266 - DNA, 1359 bp, Homo sapiens
attctcctgcatcagcctcctgagtagctgggattacaggtgcccaccactgcgcctggctaatttttgtatttttagtacagatggggtttcaccatgttggccaggctggtctcgaactctgacctcaagtcatccacccgcctcagcctcccaaagtgctgggattacaagcgtgagccactgtgcccggccatgttacgggttttaagcagcaggaaaacaggttccaagagtaagctcttctaaaaatatcatttggtaaagggttaggaaaagtgatggtagaaactaggcttgagtaatctccctgaaggattatagcagtcttctatactagtgttaaatggaatacatatgcgaacattactgtaagggtcacatctgtactttcttttggagagaaaaaaatcgccttccatcttattaagccatcgttattataattctgtctctgttatgttccaggtctttggttgctttttctatgtgtactacatctttgaaaggctttgtgcccccttgtttcggaatatcaaacaggagcccttcagcgctcgtgttctggtcctatgtgtatttaactccatcttgccaggtaacatgggtacttgttaatttggtcatgcataaattcacgaggtaaatagaaagctattgcctatgagcacctttgctttgcctactttttcatctaaacttctatacatctatgcccatcttgacctcttttgcatctactttataaatgaagtatccttcatccagtctcaggtcagtctttcatcttatggctttcactcaagttgtgcctttctctgacagtggacagtccacattcatgctgtgtcttcctgttcgctattaagttcattgtaatcttgctcctgattccaccaagccacttaaatgccccttgttgaaattactagtaacttgtagaaattacttgtagaaattactagtaatccatattctaatccagtggatggattaagatgtactttaccccttatccaagttgacctccatgaagcattgggtgctgctgaccacatttttaaatctctcttgtcactgttttcttgccttttttttttttgaaatcgggtctctctttgtcacccagtctgaatgcagtggtgtcatcatggcttactagcctcgacctctggggctcgagtgatcctctcgcctcagtagctgggactacaggtgcatgccaccatgcctggctaagtttttattttttggagagacggggtctccctatgttgcccaggccattctcaaactcctgggctcaagttatcctcctgtctcagcctctcaaagtgctggggttacaggcttgagcca

SEQ ID NO: 57267 - DNA, 1019 bp, Homo sapiens
tctctactaaaaatacaaaaaattagccagatgtggtggtacatgcctgtagttccagctacttgggaggctgaggcaggagaattgcttgaaccctggaggcagaggttgcagtgagccgagatcgcgccactgcactccagcctgggtgacagagcaggactctgtctcaaaaaagaaaaaaaaaaaccagactgggtaatgtcatttgttgaacccactttgaaggaagttactgttttaaaattaagataattaactccaaaagtatatcatctctggaatgggtaaactggaataataacttatattttacaaaataatcccagctaaataaaatgatgtgatataattagttgcttggtatgtgagctatttggaaagactgttaatattgttaatcttatttttaggtgtgctgattctcttccttactttttttgcctttttgcactgctggctcaatgcctttgctgagatgttacgctttggtgacaggatgttctataaggtagtatatacttagacttagctttctttttacattttattaacttcttcattattagtattttgacattgttggctaatgtcaccagcctttcacacaaacattgtgaaataattttcttttctacaagttttgccagtattttctgaaattcggttacagatataactagcataaccttgtgttttcttctgtctctaatatctgctcccttaacataagcacatggtttctgctggatcctgcaaggatatattggtgattccagtaggaaactgtttgttcagagcacaccatgagacttccctgagtgttcattcatttgaaatggaccgtctagttctgtaggaatgacctcagcaaattattccatttaagacaattgagcagttcatgagggaaataacttttccctctttagttttgaaaggtgttaattttgcttcagatagtatccttatgcttctaaagttggaattaagctatagaattagagtcagaatggctc

SEQ ID NO: 57268 - DNA, 1070 bp, Homo sapiens
tattgggagcaagaagcatatatagggataccaggactttgaggtagccaccatctcaccctggataattttgccatttatggtaaccaccaaacagctctctagtgttagcactctctctggtcttcatgaccatagaattttctcatgacattctagtagggtaaggggggtggggcttactgattgctgtttagatgaacattagatttaaatgattctatgtgttccgtatgaacctaggaactaaatcatatatagtatgagaattcatgtcatattcaacactaataaccaaaatgcctttgaagatttttctgtcaccagtgtatgaaccaacagtttatcacagtataatttgatttttctgttacatatgttctttgggaagtcaggggggtttgctttcgggtgggatgtgtgtgtgtgtgtgtgtgtgtgtgtgtgtgtgtgtgtgtgtgtgtgtgtgtgtagttttatacctttactttttccctcaggattggtggaactccacgtcatactccaactattatagaacctggaatgtggtggtccatgactggctatattactatgcttacaaggactttctctgggtaagtagcaaggtttaagttgatattatttatgaaatggagattctttttcagaaagtatgagtattatacagctggaagaagttatatttaattgctcatgaggaaagggtgatagtatcttttcagttttcttttgagaaatttacatctagaaacctgctttgaatggtactgcttagaaaccactgtgtgtacactagtaggtctaatactgtgtcttttgctctgaattttatcttacataacaaagtaagaatgcatggaggttgttggagttgaaatgatccaccaataatggatagtttcttatgagtcttgttgccaacaaataatctccctttggtctttttcattcgtttttcatggttaaaggtagagaaacactttttttttttttttttgagagagtttcgctcttgttgcccaggctggagtgcagtggcatgttgtcggctcactgcaacctcc

SEQ ID NO: 57269 - DNA, 1050 bp, Homo sapiens
taaaaaaatatataaacagttgttgctcactgtgattattaaataacagcagatacctgaggtccctcatcttctgataaattatgttttgatacctgtatatttctttctttttttttttttttttttttttttttttttttttttttgagacagagtttcactcctgtgacccaggctggagagcagtggtatgatctcagctcactgcaacctctgcctccctgcttcaagtgattctcctgcctcagcctcccgagtggctgggattacaggcacacaccaccacgcctggctaatttttgtatttttaatagagatggggtttcaccatgttggccaggctggtctcgaacttctgacctctgataactgtatatttctttgttgccttcctatttttagtggctttcaacttcattgtcaatgatagtcggaaaaagccgatttggaatgttctgatgtggacttctcttttcttgggcaatggagtcttactctgcttttattctcaagaatggtatgcacgtcagcactgtcctctgaaaaatgtgagtcaccaacctggttggagtgcaaaagaacctgtttattctctgtttgtgagagttggtgggcaatgttgaggagcacagtagtggagattatgatgaattagtgttaaagagagggaaatgaggagtaaaagcattagtttatcatctgatcttattgtacttgaagtttttccttttgtttagttttcttcacatttaactctcctagcttttggttttcttcttttactgccttttcttcagccccttctaattttttttttttttttgagacagagtctcactctgtcgcccaggctggagtgcagtggtgcaatctcagctcactgcaacctctgcctcccggattcaagtgattctccttcctcagcctcccgagtagctgggattgcaggagcatgccaccatgcccgctaaatttttgtatttttagtagagatggggtttcaccatgttagccaggatggtcttgatctcctgacctcatgatccg

SEQ ID NO: 57270 - DNA, 2576 bp, Homo sapiens
ttagtcatttatatatgtgtatatataatatatatttatatttatatatttatttatatattatatattaactaatatatactaatatttagtaccttaaaatctaaatggtggttatatataaatatatatatatatatctatttgtcgtccttaaccaccatttagattttaaggtactaaaagtagggctgtgctaaaataaagatacagaaagaaatagtgcctatttagaaactggtcaaagtccacacaattgtgtatagtttactggactttaaaagctttatgtgaagcacctaattgaataaatctgtgttatagataaaagtactgaacatcttttgaattagtgagctgcttataccttgagggttgttgaaatggtgggaggcattttagagatgtacaatgtatcatattaacatccctgcctatctccacacctcctctactctgtacacaaattatttttccattcttatttttccccactgcagcccacatttttggattatgtccggccacgttcctggacttgtcgttacgtgttttagaagcttggactttgtttcctccttgtcactgaagattgggtagctccctgatttggagccagctgtttccagttgttactgaagttatctgtgttatttggaccactccaggctttacagatgactcactccattcctaggtcacttgaagccaaactgttggaagttcactggagtcttgtacacttaagcagagcagaactttttttgtggggctgggtggggggagaagaccgactaacagctgaagtaatgacagattgttgctgggtcatatcagctttatcccttggtaattatatctgttttgtttcttgactctgtccaatcagagaataaacatcatagtttcttggccactgaattagccaaaacacttaggaagaaatcacttaaatacctctggcttagaaattttttcatgcacactgttggaatgtatgctaattgaacatgcaattggggaagaaaaaatgtagaatgatttttgctatttctagtagaaagaaaatgtctgttttccaaagataatgttatacatcctattttgtaatttttttgaaaaaagttcaatgttcagttttccttagtttttaccttgttttctctataggtcatgatttctgtgaagcaaaaagatgccttttaccatgaattcttgagtttacatcaataatattgtatattaaggggatcagaagtaggaaggaaaaaataagagatagcagaggaaaaagaaaaacatttcctcttataacttctgaagtaatttgtaaaaaagatttgtagagtcaatcatgtgtttaaattattttatcacaaacttaacatggaagatattcctttttaactttgtggtaacttctttgaagttatttagaaatatcctttggaacaattattttattgtctaataaatattgacttctcttgaattattttgcagactagtgagtctgtaccataagtattaatcacctccactcatattaaagtgatcattaagaatccagaagctggcttctgcatttgctcagttatacttttaatggtagtatgtttttaggtggaataaattaatatgtgattggtttcaaggaaatgtactctattatgtaatacttccattttataagatgcccatttctaatacaatgtgtgtaggaattatttgtatgtatgaggtatgattgtaaagattgagcattggaaggggtatcagagaccatgtagttcaactttccactcaaagtaagatttatgaattatttaaatgatagttgttacttggaacagccacttgagaggctctcttggtattgtttggaattgttttaaagtcagtttgagtctcacaagaaggtaagtagagtttcttaatagtcacaacttaatttgaaccacaagtatccagcttaatcacgtatcttactcacgataccactggtccagatgagtttaggtaattttcaaacattaaatccaacttcaacggaaacaaatacactcaagggaagttatttttaaaaaggtactctgcatgttcccgcagtaatgttctgcacaacagtattgtaattgtaatggaatcataacctgctaactagtttgctttaatatggcttgtaattcttgacatttttcttaaaattaaaacgaatttttattttgaatttataactgcattttaaatatattggggacagattgcgctgagacctggttatgagcaagccaatcttttgaatctagagaatggaattcttaggtttatatttctgttaagaaatactataaatatgactcttatgagaagactttgttgctctgtagtgtttctgaatactgtatttgttggattgatcaaggctatttttcaaaaagctctctgcttcctgtttgtttgtttgtttgtttttgagacagagtcttgctctgtcgccggggctggagtgcaatggcgtgaactcagctcactgcaacctctgcctccctggttcaagctattctcctgcctca

SEQ ID NO: 57271 - DNA, 1030 bp, Homo sapiens
ctgaaaagtaataagcttaaagtttttgtttctgtaagatgtaatgatagtaactattattttgggcatattaaccaacagaacaattatgtagtatgtatatcactttctcattagatctctaacttgaccttctagtacctttatgtgtgaggataaatttgttagatccttttattctcaatcttggataatgatgcaaaatggaattttgttttgtttgttggtagattcacatactaaaactttgcaggtaaagttgcttgcctcatgttagaatttaattagaaaactgaggctgcctttttttttttttttttttttttttaagacagagtcttgttctgtcgcccaggccagttttttttttcttgtacagatggggttttaccatgttgctcaggctggtctcaaactcctggagtcaagggatctatttgcctcagcctctcaaagtgctgggattacaggtgtgagccacggctcctggctccttgctccagaatcagttttttaatggaagatagctcatactttgtttttgtttttaaagagacagggtctcactctgttgcccaggctggtagtagcgtgatcatagctcactgcagtctcaaactcctggactcaaatagtgctctggagtacctagaactacaagtgcctaccaccacacccagctaatttatttgtttttttttttttagagatggggggggtctccctatgttgcccaggctggtctcaaactcttcacctcaagcaaaactcccactgcagaaagctttgggattacaggcatgagccaccatgccaagcccatacttattgttaataaagtttcagtgacttgcttactaatcttatgcaaaatttcatgtaatttatgtaatactacataacaatgctacatatggtatgtatacatacactgtatacacacaaaggtctgttctgggtattttatgtatcttatctctaggctttatggctctgaaatggagggaactggacataaatgtttcaagga

SEQ ID NO: 57272 - DNA, 1082 bp, Homo sapiens
atgggttaatttcacgagtgcatatcacttttgactatattagtcaagcatattattaaagtttaaaaaactctaaaacttctgtactgtttttttcttaagtgctctcttccttatttctacattactacattcacatttctgctgtcaataagccctaatggagtgataaactttaagctagtagatactgcaccatgtcttgtggtggtgttttcttaatgaaatggaagctgtacttcctgtttgtttttaaatacttttgaaacagacagttcatgtaccccatcatttagagatgcagtttgaatttccatggaaaaaggtgccaattttggattgggaaaggagctgaagccccagtcaagactttgccatttggggtaatgcagcagattcctgtgtctgtatctttccagtgtgtgtgttaatccatagtgttctgagcaccagaagggtcatgtaaatctgaagttgttattaaaggtttttctatagtgaaagatgtcttttctgattcattcttgtatgttactttcctgaattgctattccctctgccccctgcaagtccttgtctgatcactggtaccaatactttgtttagtatgagttgtattagcattaacttaaaaatttttaggccgggcgcagtagctcacgcctgtaatcccagcactttgggaggttgaggtgggtggatcacaaggtcaggagttcgagaccagcctggccaatatggtgaaacctcgtctttactaaaaatacaaaaaaattagccaggcatggtggcacatatctgtaatcccagctacttgggaggctgaggcaggagaattgcttgaatccgggaggcagaggttgcattgagccgagatcgcgccactgcactccagcctgggtaacagagcgagattccatctcaaaaaaaaatttttttttaacttaaaaatatacaaaaaaggcaaaatactgcacatgtaaatgtgataaatatatttggaagaaacctagtctattttttatttttttatgtctttgagacagtctcattctgttgcctaggccagagtacagtggtgt

SEQ ID NO: 57273 - DNA, 1050 bp, Homo sapiens
ccctaacatatgagaattttggttctgatcaagatctttcacagctcttcttccctctaaggaatagaatcatccactcagcattttgcgtcatgtttttagcaggtgattttataaaggaaagaatgggtttcaggtagaagctccctgccacttcctgaggcatatcctcaggttcatctgcttctgtgctcacccttttccctcccctccagtctcagtctttccatttaaggttatttcttccttcgagcacttaatcccatgtccaatgtcttctctgttttgcctctttaatatcttctctaattgttccattttatcaatctaaaagcaatctaaaacatggtcatttctcccatcctaagaaggatgtcccttgaccttgtctctctgctacttctttctctctttccattccatcataatcaatttgtttaaaactctagaactactataaggtcaccagtgattccttattgccaaatccaagtatcttcaattttgtatttaacctggcttctgtgtagcatttggctctcttaaccattcactccttttacaatgtcctggtttttctcctacttctttatttcacccttgttttagagtttcacccttttctgcctcttaaatgttgatattctgtccttggcttgctttcacttctcatttgtacacactacctattactgtgtttcctgtggttttcattgccacctgcttaccgagaatctcaaatcagtgactatcatgtgccatcacaaactcaactcttgtttgtatttcagcctctttgaaggcgttctcctccagtaaattctgaagaagctcccattgttatcagagtcatactatacaggtatgatctgatggcctatatgtcagtgtcttgggtctgagaaagaaggggaaggttctatctacacatttatgaaactttttttttacatttaaacactgaagaaatatcatctttctaaattattcacctttaacaaatgtgctgtctagatcttggcaagaattattgtgaaataaccactgaat

SEQ ID NO: 57274 - DNA, 1014 bp, Homo sapiens
atctatacatgaacagcagaatgtataagctagcatttactagcatgtctctgatgcttttgttcatttctgttaatcgtcatttctgtcccctctgcatggaattttatacttgtctagggtaagagtttgtagactctttcagcagaacagattttaataaccaatttatttgttttattttaaaaatttatttttgaataaccaatttaatagtaaattttatatgaacatttggcataactttaccagtttatttctatgcagtgatggaacattatgtaatgcagctcatttcttgaccaactagttatagaagtaccattaggttaaaaattagagaaatctaagagatgttatacttagtgagaggaagcagaaatggtgggtagattctcagaggttttgatgttcagtactgacggaccatgttctgtgattgtaagaaagattgaaaacagtttgtatggagatagagttgattagcatttgagctctgaaagcagaactctagtaaaatgatctcgacctaacaaagggtctgttccattatatagactattaccataatcctggattatttcaactgggttttggcctctccattatatgagatcatatgtatatagctaagaagtctgattaaagtatggaaagattttaggaaacactaagaagatacagggatctttactgatacctaaaaagattacaattgagtaattgctcaattgagtgtaggggcatacctgaaggaagaatttgcatttgggacttcgaaggaagcttccaagagatttgggaagagacctgaacaaaaagttaaagcatggtgaatgtgatatcactgtcaatccagtataaaagcagaggaagttgaaggaaaatctgtatcccatatgcacattttttctgtctttttagatcttagatgctagcgttacatccacaaaaccagtgttgccttgtataactattatattggcctgctgacctgtgctacctcagatctgt

SEQ ID NO: 57275 - DNA, 1480 bp, Homo sapiens
ccaccatcatatttacagcagctcgggagggaagagagaccctgaagtgcctgagccaccatgttgcagatgcctacacctcttcccagaaagtctctcccattcagattgatggggctggaaggacctggcaggacagtgacacggtcaagctgttggttgacctggagctgagctatgggtttgagaatggccagaaggctgctgtggtacaccacttcgaatccttccctgccggctccactttgatcttctataagtattgtgatcatgagaatgctgcctttaaagatgtggccctggtcctgactgttctgctagaggaggaaacattagaagcaagtgtaggcccaagggaaacggaagaaaaagtgagagacttactctgggccaagtttaccaactctgacactcccacctccttcaaccacatggactcagacaaattgagtgggctgtggagccgaatttcacacctggtactgccagtccagccagtgagtagcatagaagaacaggggtgccttttctaaagctaagcacagagttggttacagaaggtatatgtttatgaaaaagtttgtttaaagaccttccatttatatggaaggaggttgataaaatagcttgaggaaatagcctgaaaaacaaagatgagcttattttagaaacaagtttttattttttattccttgtaaaatctttctaatctaagccttgacaaagctaaaaattaacctgactttttttctttggaccaaatcaggtttgaaatatcgatgatatatatgagaattttttttaaattctaaaatatagcaacattgcacaggaagatactcttacttcttagagtaactacagagtgattttttttttttcttgagtgagactctgaagaaccttttcgataatgtttggacttggactaaagcaattagaattatgaagcaatgataacctttagaaaatttttctatcacatgttgaatattttcaaaccttactttaataatctaaagttacgggattatatcttatattaattttgcagttttgagtagtatgataaaagaaataagaattcaaaccattaagtacctacctaaatactacatgtaaggcactgtgcttttatttcattcagctgaggtataagcagctgtactcaaatgttcttaaaaatgagaaccagtggggaaattgtttataatcattggaaatgaagaaattccaattggctatatctttacttcagcttttcttgaacaatttacagcattgattttcaaactgtgtctactggcacccttcccctttgtatcagagcagttctgcttttaactgttttatatgttggggttctctatgagatttcattggaacaaagagtttcactgatattcgagtttgaaaaccattgattaagtgaaaaaacatcttagaagataggaaatatgtttaaaaaatgaatgtatta

SEQ ID NO: 57276 - DNA, 1050 bp, Homo sapiens
taagtagaataaaagtaatagtcttaaagaaaagacaggaaaaatgttaactttggttttttttttttttttttctgagatggagtcttgctctgtcccccaggctggagtgcagtggcacgatgtcggctcactgcaacctccacctcccaggttcaagcgattctcctgcctcagcctcccacgtagctgggattacaggcgcccgccatcatgcccgataatttttgtatttttagtagagacagggtttcaccttgttggccatgctggtctcaaactcctgaccccaagtgagccacctgtttcagcctcccaaagtgctgggattacaggcatgagccaccgtacctggccaaggtatagaaagccttttagtcaaatcattctttggtttggtgagagatataaaggtatacatactgtcattagtgtactgcctaaaaataatattgattcttttcctctccagaggctggaagtcatccacaacaaacacaaaaattggaagaaattaaagagaatgcacaggacaccatgagacagattaataaaaagggtttttggagctatggtgagaacaaacctggttttactgcagtgttgattcactttcagaaatcctcagtgaaaatgcctagaaaactagcagatttaaacagttttaacattgtgtttatatatacttatttaatgattggtagtgagacatagtaaaatagtacactagagttttagggatttttcccttacgggtgctggctgatattttgctgtgcttaacaaaatggaatttctcacaataggaaaggcttttcctaaacaagaaacaaaaactgcctttctaattagagaatattaatttttcaagtgcactttaaagttatgactcctaaaaaaatggtcggctataggtagtaggtgcattgagaagatgaaaaaaaatcttgatcactcatgtctaaattacatcattagttataataacaaatacatagactcagcttttaccttttatttttaaaaattttttaccgagtacttaactct

SEQ ID NO: 57277 - DNA, 1315 bp, Homo sapiens
gttcagcagttgtcagtctggctcatccactataaaagtccctatcagccttttgcataaggttttgctaccattgatgagcattgcctttcattagggaagaggatatatttaatatagccaaaagtttgttctgtcatataatttgttttatattagtgtcattttatatttattaacatgataagattttttttgttgttgttttaattgcctttagtgggagccaagagaaataatgtttaggaagtgtcttgtaaaccatgaaaatctatgtaaatattattattaaacagggaccttgttaaaatataaatttatggggaattttttccaataaaaattataaacttttatctcaatagactctcaaaaggatttggaaaatgatccatcagtaaattctcaggcgcaggagaccacaatcatagcaagtaatgctgaagaagctgagatcctacactctgcctgtggtcttagcaaagaccaccaagaggtagagacagaaggtccagaaagtgcagatacaggtgataaatcagaaagtccagatgaagcaaatgtggggaaacatccaaaggataaaacagaagatgagaacaagcagagttttctggatggcggaaaagggcatcacctcccttcagaaaatctgggtaaagaacccttggatccagatcccagccattctccaagtgacaaggtaggaagagcagatgcacacttagggagcagctctgtggccctccctaaggaagcgagtgacggaactggagcatctcaggaaccacctactacagactcccaggaggcccagagtcctggtcattccagtgcagggcaagagggtgaggatacactgaggaggcgactgctggccccaggtaagagaaccccctgaactactctcctgttttgtactgctctgttaactgagaacacagcagaagtcagaggccttctttccagagaacttttgtcatctttcataggagtaaggcctttgggccttgcccaagctcacaccaagccatgactgagttgattttagaatgaggtttctcatctaggctagctcattccactatattaagttgcttcctacacataaactgcatttctaagcatgtttttattaactgtttatattaatgtgatatgacaaaaaggggcatgacttttaaaaaattcgcttctggttttttatttcttatgagaatatttcgacttacaatttttaaaatcttttactttttgggaaactaaatgttacataaatcaagagatgggtatatttaaaaatgagcattaatgg

SEQ ID NO: 57278 - DNA, 1035 bp, Homo sapiens
ccaggaaatctgcagtgattgtttcagcaatgacttaaatttctactcttagatttattttttattttaattcaagctagtctgttgaagattctggtcacttgatcttactttttatactctttcaactatgctggaatatattagattatgaaattcatgaaagattaataatctggagcttttttcagtagtctaggatttggaatatgattctcatgaaaggaaattttcttcacgaaaaaagtttcacagaggaaatagtactcaagctacacatatttaataaataaagctgatacttgcatttctcccttgtatggataaaaagtcatttaattttttttcattttgttttagtcactgtatatatgccttatttcctgggtccatgggaagcatgagtctgttgggacttgggacaagaagaaaacaagacatcttcacaaggaaaaccaagtactaaaaaaagtatcctcccaactctgaagagatagaacacaaacatggccgacagtggacttagggaacctcaagagggtaagactgatttgtctggcactgaggttgctgctgtaggaaaccaggggtgtgcagagagagaaaatctctgatgactaaaatctgaggttttgaagtaaaaaagctaattcagtgggttcatttgttttgattatacttattctttcaaatttactgaattttactataatgcgagaccctaattataatataaggaagataaatgttttagagactccaatagtaaggacttatagtaatggaaaaatacaatgcttctttaaaaaatgatggtagacaaatctttagagttatatatatcctgtgatgtgctatatttagaaggtatctttcttcttcctcttcttctccttttttttttttttatgttacccaggctggagtgcagtggcgtgatctcagctcactgcaacctccgcctcccgggctcgagtgattctcatgcttcagcctccagaatagctgagattacaggcgcctgccaccacaccc

SEQ ID NO: 57279 - DNA, 1018 bp, Homo sapiens
aaatcatacttgctacatgttgtgaaacctgaagttatttgttagtctgtatgaagaatgtaccccagagatgcaccctgtatctgccttatgtctcttacaatggaggttctctcctgttatattgctgaataaactatgtgaactgctaaattgactgaagactagttagtttatcactaactctttaatgaagaatttcactatcctacaactcctcctaaaaagtgaaaatttactttgagagagtgctttcgagaatagtattatgatcagtattattgcccctaaattttttaattattagagaatgcttatgttacaaggacatatactaagaaacattctacaaatgtgaaaatttaaatatcagcaaaatagagaaaaggtttttgtttttgttttagtcaatatctccattaaatagtaagatcagattaaaaggatttatatcattgatttctcaaatcaatacctaagcagtacctgtgagagcttgtttaaaaatggagatttcttggtctgctttagaaattttgattcctcaggttgcttgtagggcccaggaatctgcatattataaataacacctcatgccgggtgccatggcatgtacctgttaccacagctacttcagaggttgaggcagcaggatcacttgagcccaggagttcaagaccagcctgggcaagatagtcagaccactgtctctttcaagaaaaaaaaacaacataaaagatataaatagtacctttggagattctgatgcaggtgctctctagaccatactttgagaaatgctgtagtaatatgtccatagtgtttacttatctggcttaaaaggatgggagcagaatactcatagtactgcaagatagtaccatttatttggtaatactggctatgtaaaaagagatttcatgtcagactgaagatcactgttaataatttaggtcataactcagccacatttttctcattaattaaactaatcaggaatgtttcagtcttcttcaca

SEQ ID NO: 57280 - DNA, 3800 bp, Homo sapiens
attgtgggagttttattcgtcatctctctgtaccatgactagagacccaagatttaattcagtagctgaagctttcactggtagctcttgtcagcagaccctcagggaaatctattatgccctgtgctatcagcaccaagtatctagtcattgagtcggaaaccaagccttttgtccactctgcctgaggaactgaattagtagccctcacccgtacattgttacctaacctcagaaaacacatcagtatgtctacttgactctatttcacccgctctgggacttccatcaaaatatgggccccatgttgtcgtagcactatcagagcctcttcattcgccttttaaatttaccattttaaaatctgagaatcacagctattacttctgtaaggagagtgctttggcttaccacaactaaggctataattccttctatttttcaggccagatctttatattttaactcatgccctccccagcgtctcttattactctcataggatcaagtctcagaatttacaaaaagaacattggagaaaggcatggtatatatagtattctgattctgtgataccctctaggtggccttctagttgctccatacatcctactgtcccaccttatttacatgctacatccagtgtcatgaaggaatgcaaagatgatgataacatctgcaaattccaacttatttactatgcattttccaagaatagctcaggactattgctcagggctgtgccttacttgccttctcagaatgacacggtgtataaaccaataaaactaggtggtgggcacccgggcacggtggctcactcctgtaatcccggcactttgggaaaccaaggtgggcggatcacctgaggtcgggagttcgagaccagcctgaccaacatggagaaagcccgtctctactaaaaatacaaaattagccgggcatggtggcacatacctgtaatacttgggaggctgaagcaggagaatcgcttgaacccaggaggcggagattgcagtaagccaagattgtgccattgcactccagcctgggcaacaagaatgaaactctgtctcaaaaagaaaaaaaaacaaacaagaataacaaacaactagatggtgagcaattagacttgcccctcttgatttttgacttttttttagccttcaaaaggatttcattcaactttctatggttagcttttaagaatattatctaaaaactgtgtaagctttttttttttttggatggattgaaacctattatggaaaggctgtcatcattaatgttatcccatacattatggggataccatatgtggcacccatttcacagaagagacgtacaagagatcgctaagttttaccaggttagacgtgattatacagaccttattattcccaaggcacacatggagtaaagaagaaatatagtcctaagaaattaagctagtcctagtataaatgatccagaattcttcctagtgccaacatatcagttggtttgaacccatgttaaatagtcatgggaaaacccatgagacatttcttatctgccttaactaacctgaataatttccaaatgcatgtttctaataataatgtgaacaactgcaaaacccatgagtcgtctgaagttttatcatttacaggtatgtgacgcattcccagactcttcagccaactgagcatcagcttcttcacagcaattgggtcctgattaatgtcctcccaagacagacttcattggatccacgatcaagaggactctgccaggtttttctgacccctctacattgctataaagtgccaaggccttaagacttgggtacgtgtgttacaacggcaagagtgccagcgccaacaaaagacccattggacctgtcagctcctctgtttcaccaagcagacacaataaccttaccaacaaagcagagtaagccaagtgcctctgtgtgacaccaccagcagctgatgacgcataagaaaaatataactaatttagactagagccctatctcttcttgagaagctgggatttgaaggagctatcctgagatctgtactgctagtaagtgactgataacattataaactggatcggtccctgagttcagagactgagttgcaattgagtgaaaaatagacaacgaaatcttgaagaattgcacggaggtgcaagccaagtttatttggctctccaaataatattggttgaactaagaaattggtaaacgaaacctgtaataggactggtgtttgggcgtctctctctgtcactgttgtctcttgctgtcacattgctgtctgtgttgtctttctaggtccagatgttttcagataattcacattgccctgattgtggacaacagtggttccctagtttagaactaggccactggttgtaccaaactgaacttgttgaaaatgaatgttaccaggtattcttagaccgtattaacagagctgattattgtcctgagtgttatcctgataatcctgctaatagaagccttgttcttccttggtctttcccacttgagtgggctccccagaatctcaccagatggacctttgagaaagcttgccatccatttcttctgggtcctccactggttagaaaaagaatacatgactctcgagtagctggttttaaccctgcattacagttaatcttgaccagaacagataaaaccttaaacaaaaaactgggccaaaacaaatagcttctataatagtcaaaattgtcaagtctagaggcttttgtgtaggtagcccaaggaagatggaaaaataattcatttctaagtctgacccagattgtcactactttgggaactgcttaaattgttggatctgcttccgtggcctatacatattttattcacatgaatttagttagtattccagccagcctgttcatctagactgaggctaatctgttcatctagactgaggctaatccgtatttcctataaactgttttggaactaacttaccactcctaaaaaaatttctgcaacctaatgagtgtcatatgacaaagtagtcctagaggggaagtcctatactgtgtgcttcatagtggtatttctaatgataacttttgtgggaaagcagcctcgttatagctggatcctagattagtccagtgaattttaataagaaattacactgttgtaaactcacctcttatgcattggtcagtgatgagatatatatataaatagatagatagataaaatttgctcttatatagccatttattcatcattggccctgtttggcccatcctcagtgtggctgtgagattattgataactggtcactgtcagataaatcacattctattaggaaacacctatataggttatgcagaaacatgcagaaatgccacctgtccatacttacgtggctttacataaacaaaagactgtcttgtctttgtggtgactgaatttacaacgtcctcccctggaaatggaaaagtacctatcaggagatgtatgacaaaagaaattatcaagcctgacttcatatatattatgaacagtctagaggaagcatctttcttagaactaaggaggtctgctgaacattggccacattctggactttcatgaaaatcatggacccagagttggggttaagccacttagaaaaagctgttgaaaacatctcaaaggccactgaacaatttttaaattacacttaacatgccaggtatctaggtatctagtgcttttagcaatattatcaatattatcaaggtcccagcttctttgtgtccttcccccttgc

SEQ ID NO: 57281 - DNA, 2014 bp, Homo sapiens
gtcagaaatcttagcaaactcttagatccttcgtgcatagcttaatacctctacgtggtcaaccgaaactagagatacaagtcaaaggagttgggagggagtatgaaaaagggtaagtaggaaaggaaggctttctgcactcagaaaatatctgtagaatttgatctgcgccaggcattcaattcctgtgtaaaaaacaattccctaaggaagtagagtgctttttgttccgaggctagtactttttcaaacttctttcaaaaatctagaataagtcaccagttagtgaaaatacagagaaacgaaaaattgtgaaaataataatgctgggatattatgacagtggatatggtacagaggagtgggcaagacttagaaatttagttttagacagacaataaatagctagcacaagttatagaaatacctaagcttggcaccagatctgactgttgaaagttgtgtattagccttaaaggtttggctgctggtgttttgaagtgaaattgtagacagaatttggaccatgggcttttggagcattagagcaacatagatagaaatgtaccagtaggtttccaaaccagttgttctcctttatggccatgcccctcaaaaagtatggtagcaatgcatacacacctgtttcgtttgtcagttcctggggcaagagagaggagaacattctgcagctattttctaaccttgggtaatattttttatttggcttctctgttctaaagagggaacagtgtgtgtactaaatagtactgaagattgtcatccatatgccttctctcagtgatctcaagattgccaaattaaaagtagtttctcacaaaacaagttgacttttttccaggagcattttattttcaacaaaaaattattttagattatatgaattcaaaaagaagaatgattccttttttcatactccttaatctctcattatctaaggtagttgtgaaataggaaactcttaagatttcactttgtgtatgaaacttattggagaaaccatctcatacaaaaaaagttatgattattgattagccttgactgtagtaccccctagaagaaaatatttaaaatgggaattcaagagagtttaaagcatttatactttttctatgtgcctatcttgattttatgtatcatatgaggaattggttgaggctgaagtctaagggataaattgcctggaaaagtcattccaatccagactcagtctgaaacttaattattatgctaccacaaaaaagaataagggaatttttatctattgaaggcagatttgaacttactaacatacattcaggaaatagcaaagaacaagatagactatttagagaagttaattaaaaagttgccatggttagttgatgtaaatttcagtggattaaatagaactacattttctattttggtgtgaaagtactattttcttttctaaattttcttttaataaagtttcaggaaggatcttaaatttattttagtttacatacacaaaacccctgatttgtattttcttttgtatagcatttgtgcagtagagaagctcctcaaattttgtttttttgctcactgtttttagtgaaggaggtttgaaaatacaagcatcccagcttttgctgtgggcctccctaaatttcctgtgatctctacaggggatctttttatatccctctaagagcccttagcctacaggggatctttttatatccctctaagagcccttagccttcacctaaatcactggttccagtctggattccctagacatctagaagtcctgaatgattttctttctgtatccatagtacttggcattgggcctagcacatggtgcgctcctcaaataagtgaaacaattatgtttaacaatcataaagtaatggtagttctcaaggtatttttatttagcatttctaaaaacctaatgatagtcatatacttaccttaaatcagctgcttaggacttaagctaatgaagttgagaaaggaagcc

SEQ ID NO: 57282 - DNA, 2481 bp, Homo sapiens
taaaagacaaaaaatgtttcctgccttcttggagattatattctatgggaggagtcgggcaaaaatcaaaataagtaaaatagtgtgttggtcaggactgttatgggaaaaaaaagaggaaaggggaagggagttttacatgaatagatttcttcttgaaatttggttagatttgtcctgaattgctgtaggtcaagaacaggaattttagacttacttcatttttcccccaacaaattgtatgttcttgggtaaattgctcgccatctcttaattttcacatttataaaattagtagatcaaaacagctattttttgtcactactgtcatttaacagaaatgctgcatacgtcatctaatctactaataacaaacttatgaggtaagtaacgttgtccccatttgacacacgagcaaactgaggtttagattaggcaactcattggattacatgctcctcttaatggcacagagggtgtgttccaggacatggtgcttgccattatcatttggtactgctgctcactgtgttggtcctatgagtttcttcagtctatgaatttcaggtcagggtggtcgacgtcttacagagatgcctgtaatcctgtcagcatgagattgcatgggacctctgcggtttggtcgcgcatttaccgcgcctgtcgctgggtcagacgacctggcagtagagggtgaaggatggagaaggcagaaggcagggcacggagactactagtcccaggattccacgggcgccttccggcggaaagtgtttgtcatatgggcggggaccctggacgacattcgggccgcggcggccgctgggtgcagccgagcggtgtggagcggagagaatactcgaagggctctcctgatactaacagttttacgatttaaaacttcgccagaatttgtaagtaaacaaaatgactatgcagcttttccatgttttagtattgaaactgatatcttgaatttttgaaaaggactttcagaaacggtccctccccacccccaccttcgtaccgcacaaatggtatttttatttttattgtttttgagacaggtacttgccctgtcaccgaggctagagtacagtggcgtgatcatagctcaccacagcctcatacttctgggctcaagggatcctcccgcctcagcctcccaagtagctggaactacaggcccgcaccaccatgccctactaattactttattttttatttttatagcgacagggtctcactgtattgcccaggttggtctcgaactcctggcttcaagcgattctcccacctcagcctcccaaagtgctgggattacaggcgtgagccaccacgcctggcctcactcaaacagtaaacgaggtaggttgggggtatatttttgttttgggataaaaagaaactgaatcttataaatattaaatgggttaagatgtgagtaaatttttgggtttagactttaaggtgagaagccgaattattttagggttcgaaatgtgagtgggaaatttgcctactagtgtaggcggcgattactccattcccaacatgcctaggttctcgacattcataatcttaatcctgaaaagataatacttaaaaaaaaaaaaaattggtgctaaaaagggcaaagttgaagttttagtaagacctcctaccattttgcttacatattatatatgtaccattctcccaattgtatttaatacctgatgaaaaagtttgtgccttttccttcttttaacaaatttcatagtactctctactttatgagtaatgcttaattatcagactttatactgttacacagatccagaaatgagttacatagattaaacatactggctttgttttacctgtctttaggttttaacacattttattttggatctgtatgagagatcctttctttgttttaagctgtggcagttatccatgttttttgagcttttttttttgagcacaagatgaggatataaaaggccagtggaaacatttaataaaaaaaggaacttcatggtagagtaactacagatgtttttggaagactttgtgtggattagaatagtttgaaaaactaacatttgttatgaaaactgagtgcctgtcttcagtaatgtttattatgctgaacgtgcagtccacaacttgattacctgtttttctgctggtttgttacgcaaccttgcgtgactcatttaagaactattttatctagtttctttcctaatgtagaggtaatgctagcttgagagcttcaataatttataaataaattaacttcagaatgtagctaattatttgaggattattgggtgttttaataatgtattgtatcttgtatataacttatttttgcctaagaagtaatttctgtattccattcatttccatggaacacagaagtcaaaattctattccaggaaagtccacacttctttgaagtgccacttgaatttcctgaaggaatgtttg

SEQ ID NO: 57283 - DNA, 1137 bp, Homo sapiens
tccttgaaacattttaccaagacagatgactatgtagaaactgggatactagcttataaaacttggatacaggcttgtaaaacttaggtttgagggacaaattaaaaaagagacaagagattctacatattgaacaatcagaggagaggttctgcatattattgaataatcagaatatgcatattttgtaattaaaactgcttgtaaaggcttaggaatggcctttcaactaaattaatgagacacttactgtaaaattagaggtatggtaactttaatgctaacacacacacacacacacacacacacacacacatatatatatgcatcggattttccctctcatctaggttgtaagcataaggaaacctacctctactgtgactgcctccttcacctagaaaccttacagatacgaaactttcatcactagctctgaggcaaagctaaactgttatgaaactagatactctgctgtagctattatccagactataagagtggctgaaaagaggtgacattacagtgacagtagagtcatagccaatattataagggatgcgctgggccactaaaaaaggatgcctcagctctggatattaaagttactttgggaatttgagaaatctggaggaattcagtgacccaaaaaagaagaccggtaagaaaagaaatgattaaaacaaagaatacacttaataattcatttacttatcaaacgtgtgccagcaatgaggaagactatctttagggaatttgtcatttattgggaacgacagaaacacgaaaaattacaattcagattaaatggcattaattcacacacttaactattagggctaggtctggaaatcctgtgctcttgagactgggttcctaaatcagttattttatttcatttttaattaatttatttatttagagacggagtctcgctctttcgcctaggctggagtgcagtggtgcaatctcggcttactgcagcctcccccaactccaggttcaagtgatcctcctgcctcagcctcccgagtagctgggattacaggtgcctgccaccatgcccagctaatttttgtatttttagtagacatggattttgccatgttggcaaggctggtcttgaactcctgacct

SEQ ID NO: 57284 - DNA, 2047 bp, Homo sapiens
gtctggcaaatcagactgacaaagtaacctgaaaaacaagactattaattagagttttcgtctaaatggacaaaagggatgctgacaaagtgagtgtatagtgttaggtaagtcataggtgaatcagtttccttaatctatcctctcccaccctgccccccccattttaggacctaacactgagtcacagatgaagtttcatgttaatcccatgtaaggcacctgtgaggtaaaaatcagcggacctgagtcacaatgggatgacatagtttgtggtagactattgataggcggaggagtgggttttcagcttagagcacggtgataggctgcaagtttacctgctgactcgtgaaggtactgacagatttgaagacttgattttggaaactttatgttaaagttatgtcagttatttttgggtgtagcaactgaagacagtttagcccatatatgtgttagttttatctcttttaagattacaaagtttttgcagacaaggagcctataatatatttgatagtaatttaagtacttggtttaattcagtatttttcagtacctggaagaatgctttgtacatggtaggcaaaaaatatgttacattgtattgagttccacagagcctagtgcagttatacaggctaacttttttttaacaagtaaagaatttacccctattttattaaatctttaaggatctaaacatttttcactcttctgctttcttccacatcatttgtgactctctaccccatctttttgattttctgaagtaatatatttttgtaaaacaacaatggcaaatattattatattctgttgaattcattgtattctgtctcaagaggagttctgactggtatatttcctaagttttggtaaacctaaccacctgtttctaaagaaacgaatttcttgaatttttgcttatgtattgttacaaaaatgcataatctgtgccatgatctcccaggtcatatattctgaattttaactcttgttatgtctgttttttagaggatgaagcatcttcccaaactgatttaagccaaacgatctcaaagaaaactgtcaggagcatacaagaggctccaggtaagaatagttaactttttgtttttctccttacctaccaactttttaaatgttcattgaattaaacaatgtaagtatgtgtaaagaaaagacaagggcagacacgtgagtactcaagagtaccagccacccatataaccttgtaagataggtattataccaatttcatagaagagaaaactgaaacacagagaagctaagacaattctgtaagatcacatatgtgactgagccaaaattcaaacccaggtttgtcttctccagagcccttttactttccccccaagtgcctcactatcattctctcatgtcataactagctactcagtaaaatttgttcaatgtcaaatgaatgaatatgttatactgccctgtgtttaaaatggattaacttttcttcatggtaaaatcttgacacagtgtgatcagtcttttcagtttaatactgtggtttatcaaatcttaagatgctatcgactataagaaacaccatcattgttttatgtaccacctagcaagggaaaatgctgccaattttttggtaatttgtagtaatatgccataattatatgatgcatcccaatttcaaagatgttaaagtgtttaaaaaaattgtcagaatcaatgtaacatggaagtaggctacatttaatagttcacttaagttttaaaagctgattaaaatattttaaaaagctggagaagggatcaagtccagttattaatgctttgggttttagttccatttaattttcaatttgctttttttgatattaggaaagtctcacaataataaacaatcatagctgttaaaactgataatccttggtttttagtacccagatcctgacttatttacctgtttctaataagattatgctttataatgtgagctattgtattctaaacttagaataagtatgtctggttcaagttgagtttcaaataa

SEQ ID NO: 57285 - DNA, 1047 bp, Homo sapiens
aaaaaaacaaaaacaaaaaacaaaatctaatgctttaactttcgacatgtagcagccaagtttaaaatagaggtaggtgaaaaacaaaagagggaaatgaaattaaagcttatgtagtcatggctactgattcatcatcagatcgcacttaaatatttatttccattctttgcagcttgggtaaaaaggtggaatgtttaaaaccttgcaggtatctaattattaagcactaatttcagactttttaagttgctaagtaacgttaatcatagtatgagaaatattagcaaaaatctggacttaacatctttattctataatcataaaatctattttattcatggaacaaactttttttatttttattttttttgagacagggtctcactctgtcacccaggctggagtgcaggagcgtgatctcggctcactgcaacctccgcctcaaagtgctgggattacaaggcatgagccaccatgcccagccaaacatttttaaacaccttctttatgtcagtgaccgacctaagtgctaggatcataaatagccattcaggttttttttttttcctacctcttagatgtacgtgatgtaatggaagagaaaaacaagtttacaaatcttttttttttttaagtgctgaaatagtgacatatgtctgcgggatcctagacgagaagcaccctactcagtggaagaggttgaggcggttttatgagttggaaatgacatttggattgaattttgagggatgaatagcaggcagaatgaggacggagacttgcaaatactacagtttgctttataatagacattttacctttagagagcatgcaatatgagaaattaaagtcttttatattacagacaatactctcacactagccataattctttatctgagacgttaaataatgtttagaatgacattcgaaatcatagcaggcttgggtttcttgagctttgtttaccagaatgaaaaccttgttttaaaatgtatctgtagccaagacagtagataacctgattcaataatgattgattgt

SEQ ID NO: 57286 - DNA, 1049 bp, Homo sapiens
tttattcacagataatttggggaaagatttaaaaggctttatgttttggaagttgtcagtattttcctctgccttttaaatgcagctcaacatgctaagtaatatttagctaatgtcacaagatatgaattggaatttgcctggattttaaatattcagatagaaagttgcacataggcatagattttaatgttttaatgcagtagcaaatccttcatatgggaaaaaacaggttgtcagaaatagtgatcaatatccatgtactccacctgattgttttgttttgatggtgatccttgttttgaatttggggaagtcgttattgttgccatgttaacgatacctcctgccctgtatttgaagagttttaaaagaaagactatctttggcagagctagtaacaatctgaaaagttctgtagaaacaatgataaaatactaaaagttgccctccattctgaaaatttcttcgtttaatatattgtttttaaacaaggaaatgcactgctaatgacatggaattgtgactttgagggattgttagacccatgctggaagttgcttcaaagccatgggcgtataataattagtttcggtgtgctaaattgacaaattttatttaatgtaatgaaataaatctgaatcatttgaactgtcagtgcattaaatttaagatactgtaatctgaaaataaacttcaagctagaatacattgtatatgtggataaatacatgtgtatctctgtatctcttcatcctcagtagcaaaattttgtgtatgtagagatggcaagttgtatatgtaaaaaatttcatacgtatgtgaacatatttctttgattttctgagataaattggtgtgtgtgtcatgtaagagcgttaatacttaaacagccaaccttctgtggggcaatcaatttatgaattataaagtttttggattttttccttctgcttctgattgtcagtcttttgcccattttataacacttctaccatatatgagcagaagaaaggagatgaagtactgctataatcaattttatttgt

SEQ ID NO: 57287 - DNA, 1016 bp, Homo sapiens
gctcactggaacctctgcttcctgggttcaagcgattcttgtgtctcagcctccttagtagctgggattataggcaccctccacacacctggctaattttttgtatttttagtacagacagggttttgccatgttggccaggctggtttgtgccttagttcttgaggtttaggaatcattatttggtacttaactttcaaagcattttacatttatttcagatgtgtgggtaaatcaagatataaacaaatggttaactgacttggggaggttagggtttaaaaatatcattatattgtaaatcttttgaccttgacagatgaacataagattaataataaaacctgtatggttgagtagatacacttcttacaattaaaatttaagttttaatttcagtgccatgtatttttttaggtagtagtcatcttataagtacatcttcttggcgagatggacaaaaattagtaaagaagattctgggacctgctcccagaatggagccaaaagagcaaagaacagcatcaagtgacagaggtggaagagaaagaactgctaaatctggtaagtagctataattaaaatagttgagaaaacaattaaaaattgctattaagtacttagagaaggaaaaagtactcttaagaatgtgttaggactttgctttataattttgaatgtagctcaaaaaagaaaaaaatgttctattgggcttggttatggataatatctgcatataggtgttatgttcatctttatgaaaaattgtttatgttgtgttaattacatttagctgtcattgtgaatatgaaagcattattgtaatgaaatcatattagacttttagggaccttagagagaatcaggtccaacctggttcatcccaacatattcaagcaaacacggacaaacattcacaaggttggattttttttatttgacagattaggaaacaggctctgaaagagaagtgatttttcccaagggttatgtagtcagtgggtgtcagatttggt

SEQ ID NO: 57288 - DNA, 1315 bp, Homo sapiens
attcataacaaccataagagctatcttttttgtccagaaatatttcaaactgtatttaaaaacaaaccaaggaaatatagtttttcagaagattgagattcttcttttactgctaaaaagggaggcttttctttccttttataattttcttcagaagactgtaagatatttgaatttgagtttaagtaagataaaatgaaattctctaattttcttgttaatgcagttaaatcttaggaatgagtatagaatttcggtatatcactaacagttcatactttgcagggggtcacattggaagagcagaatctgatcccaggttggacgttttacatagacatcttcaaagaaactcagaacgttcgagaagtaaatctcggtctgaaaataatataaagaaactagcttcatctcttccagataataagcaggaggaaaatactgccttaaataaggactttttacctattgaaattcgtggcattcttgatgacctacagctggattctacagctcacactgcaaagcaagatactgtagagttacagaaccagaagtcatcagcaccagtacatgctcctaggagtcacagcccagtaaaaagaaaacctgacaaaataacagctaatgaagatccccctgttatttccaaaaggcgccactatgacacagatgaggtacgacagtacattgttaggcagcaggaggaaaggaagagaaagcaaaatgaagagaagaaggctcaaaaggaggctacagaacagaaaaacaaacgattacaagagctctaccggaagcagaaggaagcctttactaaagtaaaaaatgtccctccttctgagccatcagcaactaggcgactacaggaaacttactccaaattgctactagaaaagaccttgcttgaagagccatctcatcaacatgttacgcaggaaacacaggtaatagtagtgacatatacaaaggagagtcattcatggttaggaaatgcttatttgctatactatttaaaaattacccatcattcctagtatgctcagataatacttataataatcatggccttcatgaaatatattaaatatgaggagtaatgtgataaatgtgatggaaaataaaagctgaattaagaatttcctacagtgattgttactgatttattttcctctcatcattgctattagttacatccctgcatagttttcattgtagtactgaacaagtacagttgacctttgaacgatgtgggggttggggtgccaacccctttgcagttgaaaatccacatataacttttgattctccaaaaact

SEQ ID NO: 57289 - DNA, 1865 bp, Homo sapiens
ggcatcttagttgaaaaaagcagcttgcaaaacagtatatatggtaaaatcccatttttgtacaaacaataccaccaaaacataatgtacaaatagaaaaatgtttggaaggatataattctaaatgaaatattaacagtgcctcttttttattgttttgctgagtgatctttatcttttttatattttttatctgtcctttttttgttgcagtgcatcctcattactcttataatcagataaaaaaaaaacttttttaaaatggtggtttagttaactaacatattgtgactttcatttccagaaaagacttgatggaatctacatggatgcagcctgaaagattgagcccacaagttcaccattctcaaccacagccttttgctggaacagctggaagtttactctcccatctcttgagtttagagcatgtaggaattttgcataaggattttgaatctattttaccaaccaggaagaatcataatatggcttcaaggccattaacttttacacctcaaccatatgtgacctcaccagctgcttatacagatgccttgttaaaacctagtgccagccaatataagagtaaactggatcgtattgaagccttgaaagcaacagctgcttctttgtccagcagaattgaaagtgaagccaagaaattagctggggccagcattaactatgggtcagcatggaacactgagtatgatgtgcagcaggcacctcaagaagatggaccttggaccaaggctgtaactccacctgtgaaagatgataatgaagatgttttctctgccagaattcagaagatgctgggaagctgtgtatctcatgcaacttttgatgatgatcttcctggtgtaggcaatcttagtgaatttaaaaagcttcctgagatgataagaccacagagtgccatatcaagctttagagtgagatcccctggtcccaaaccagaagggctactggcacagttatgtaaaaggcagactgactcttctagctctgatatgcaagcctgttctcaagacaaagccaaaatatctcttggttccagcatagattcagtcagtgaagggcctcttcttagtgaggggagtctctctgaagaagagggagaccaggatggacagccccttttgaaagtagcagaaattttaaaagaaaaggaattttgtcctggagaaagaaatagttatgaacccatcaaagagtttcagaaagaagctgaaaaattcttgccactttttgggcacataggtggtacacaaagcaaaggaccatgggaagaattggcaaagggaagtccacatagcgtcattaatatttttacaaaatcctatcagttatatggaaaaggtgagaaaaataaatatagcttgtactgtttgtatattaagatgaattattttataatttctgtatgagatatgtactttagtacacatttttcgttgagtggataatggagacttattactgtccgtattagtcatcttctaaatttcctgcaagccttaagtaagagtattagtaatttaatctttaaaatttcattttaaaattgttattatcataaaataatagttgagactggtagctttagaaatttttatctagttcagagaaattcatagatgatgttcaggattggatatatatcacgtatatactacattttctgtgaccatagttatgtacttcagtagaaactaagtataaaccaggcgcggtggctcatgcctataatcccaggactttcagagtccaaggcgggcggatcacttgaggttaggagttcaagaccagcctggccaacatggtgaaaccccaccattactaaaaatacaaaaaatatt

SEQ ID NO: 57290 - DNA, 1140 bp, Homo sapiens
ttgatttgaaagttattttgatttcttttgatgaaagtaaaatgcttaaatcaacatcatttttaataagaaaattgtttcttcttaaattctgttaaattttcattaagattttatagttaaactgaaatatttagagatgaaatgagaatgaaatgttgtctggaatttgctttaaaatagtctggggggtgggagatgaaggtagtaggaggtttatttgaaactagattggtgatgtattggtcattgttgaagcaggatgatgaatactttggtttcattatactagtctccctgttttctgtatgttttaaaattttcctaattaaaagctttaaaaaagtatcattggatataaaggtaaatagaaaagaggcactattaaaggaaactaaaatgtccctaagcccatattgctaatctccatgtatgggatgcttttcttacagtttcttgattttcgtttttaaccatgtttcaattattacttttgtcagggtttgaagacaagttggacagaggaacatcaacatcacggcctttgaatgccaccgcaactcctctaagtggtgtttcatatgaagatgattttgtctcctctccagggactgggacttcgacagaaaaaaaatcaactcttgaacctcagtaagatatattggcaatatggaataaactctgaagagtgagaaaaatgtacaaatgagaactctggtctgaatattagccaagttttgctcatttaaaaatacatatagaggctgcacatcatagtggagatccagagcatgggctctggatccagactgcctttgtttaaatccaggctctcctggttattggttgtttgtatttatacatattacttagccttcctatgcttctgcttccttctctgtaaaatggggacattaatagtacctgcctgcctcatagagttgttatgagtattaaatgaaatatagggaggctgaggcacgaaaatcgcttgaacctgggaggtggaagttgcagtgagccgagattgcaccactgcactccagcctgggtgacaaagctgaccctatctcaaaaaaagaaagaaaaaaaaatcacttacttagaacagggcctggcacatagtaagcagagtatagg

SEQ ID NO: 57291 - DNA, 1594 bp, Homo sapiens
tgctccagagaaatcttttgtgaaagcaagagtcaatcgatgcagtaaacttcattattgtcttattttaagaagttgccacagtcactccaacctttagcaaccaccatgatcagtcagtagctatcaacattgaggtacgaccttccaccagcaaaaagattaggacttgctgaaggctaagatgatcattagcatttttttagcaatacagtatttttaaattaaagtatgtactttttttagacataatgctattgcacacttactagactacagtatagtgcaaatataactcttatatgcactggtaaaccaaaaaatttgtgtgacttgctttattctgttatttactttattcctttggtctggaactgaacctgcagtatctccaaggtattctgtactgagtcccagttttttctacaaaggaaagcaaagttgattttggctcttaaaatgacagattttagaaatctgagtgtaatttcatgttaacttttccatttgaccattgtcatgccttccaggttctaagcgcttttctcctgctggcctccatcatcgtatggcagcagaactcagttatctgaacgccattgaggagtcggtgcgccaactgtcagatgtagaaagagttagaggcatttcacttgctcagcaggagagtgtgtctctagctcagataataaaggtatttttggagttttttagctttctgtggtttttcttttttcttcgctatttaaaatggtcttaatgatgacttaaactactgtgtcaaatagaaaaaaatagtctgccatatagcacctataaataaatagtcctgggaaaaatctgtcgggacactaaaaagatacagtgtttggcagcagaacaataataaaatcattctctctcaaatactttgttttccatgttttctgctttgtttagttgacagtataaaaatcatctagtcaaacattcttaatattttctcctttcattgataggtgagagaatactgagggtttttttttttttttttaagttctatttgtaccaaaaagagaagtttctgagatccgggtgtttgataaagccaggataatgtggacttttccttagcaaacaaaaatccagagatggtctaagcgctcttcccttagtggagatgctttaaacaacaacagcaacaaaaaaacccctgagttattattcacatagtataaaatacacagattttaagtgtacaattttgatgagtttatttatttatttatttttttgagttagagtctcaccgttgcccaggctggagtgcagtggcacgatctcggctcactgcaagctccgcttcccaggttcacgccattctcctggctcagcctcccaagtagctgggactacaggtgcccgccacagtgcccggctaattttttgtatttttactagagacagggtttcaccatgttagccaggatggtctcaatctcctgacctcgtgaaccacctgcctcggcctcccaaagtgctgggattacaggtgtgagccaccgcgcctggcccagttttggtgagttttgaccagtgtatatacctatgtaag

SEQ ID NO: 57292 - DNA, 1050 bp, Homo sapiens
atagcatatttaagaaaagaaataaagaccattgtggctggaggcagagagcaaagaaaatggtatgagatgatgcagggatcagatcaaggtataggaccttgcagacttaggattttggagtttattctaggagcaatgaagtcattaaagagattatttttggcgggactgggtgacattaccatatttgtgtgtgtgtgtgtgtgtgtgtgtgtgtgtgttttcttaatcatattttgactgtctctaattcatagattttaagtctctgtttacattcattgatactaggagtgatttgtgtttacttccttagtaaaacagaagatattctttaatgtgttgtaagttattttataatatctatttgttcaagattttatctcatattactattaagcaatacttaaaatctttctgttattagagactttgaatgtttaatcagtttttattttatttgtaggaaaagtccatctgtttcactctctcagagtaaagaagggacccttgactcaaagcatcagaagtattctgcttcatatgatagttattctgagtcttcaggatacaagaatcatgatagaaggtgaagacaatttgatttctttgtcagtacagtttagtagattgtgataaatggcttaaacattgctttctttgatttcttaatcttgtttatttaaatagaacagtgtgtgcccttcaaagtgctggcttccctaattagccaatttacaaaatagttggtccatgtaataatgtaactactgttccttgagaacctacattgtacaagcattgtataaattgttcttcctgcatttaatattcacagcagccttccaaggcagatggtattatccttataggttagaaaactgaggctcatggagatgttactatgcagccataaaaaatgatgagttcctgtcctttgtagggacatggatgaaactggaaaccatcattctcagcaaactatcacaaggacaaaaaaccaaacaccgcatgttctcactcataggtgggaattgaacaatgaga

SEQ ID NO: 57293 - DNA, 1311 bp, Homo sapiens
tcctcaaaaaaaaaaaaaaaaaaaaagaaaagaaaaggaccaaaacagaaccatcaattttaaggaaagacagaaaaatttaaagcaaatgaaagaaacaaggaaagcttgttagagagatgggaaaagcaggtgagagtaaaatcataggatataagaagggagggctcttttatttaacatttaattttgacatgatttcaagcttatagaaaagttgcaagaataatagaaagtcctcaaatatctttcatccagattattctaacattttactacattttatttagcaagtagagcttttaaagaaggagatatggtcaacatctaatattgcaaagcaataaattatgtattggatttggcaattcaaagtatagattaagcttatttagaacagttttagtagagcagttggggtggaagcagattgtgataaatcgtgatgttaatgaaaagtaaagaagtggaaacagtgagtagtagctccctttcccagaagtttgattttgaaatgaaaggaaaaaagggagtgataacctaacaacactgcctattattattatttaaaagtgaaaccttcctctctcctactcatctttctcatcttttccaatatattctcagacttatgttacttagctttttctgttttatattacatctttcttcatttttatcttgactataaagtacagtcatttggccaaataagtttactttgaagctataatccttattttgttaattttgttgttgttgtttccatgtatccataaaaagaagtagcagtggtagcagccgccaagaaagtccttcagttccatcttgtaaggaaaatgagaagaaacttaatggtgaaaagatagagagttccattgatgaacaggttcagactgctgcagatgattctctacgaagtgatagtgttccatctcttcctgatgaaaaaggtaactttctttgcaaataaatgtgtaatcatttgttcagaaaccagaggaaaggtgatccttgttataaagtggcaaataagctggatgtggtggctcatgccagtaattccagcactttgggaggctgagctgggagaattgcttgagcctaggagtttgaaaccagccagggaaacatagggagacctctgtcgctacaaaaaaattaaaaattagccaggcttggtggcacagcctatggtcctagtacgtgggaggctaagatgggaggatcactttagcctaggatatcaagtctacagtgagctatgattgagacatagcactgcagctttggcgacagagcaagaacctg

SEQ ID NO: 57294 - DNA, 1164 bp, Homo sapiens
taatcccagcactttgagaagctgaggcaggaggatcatctgagcccaggaattcaagaccagcctgggcaacgtagtgagaccccgtctttaaaaaaaaaaaattagctgggcatggtgccatgtgggaggctgaggtgggaggatcctttgagcctaggagatcaaggctgcagtgagctatgattgtgccactgcactccagccagggtgacagagctagaccctgtccccccccaaaaaaaaagtatctgcacatgtacccataacaaagttttcccttcttttattgaaagaaaggcatttctttcaataaaatttctataaaattttaattttatagaaattaaagaaattttcaataaaatttctttctactaatttggggaagcaactaatggtatatcctgacgtttcatcctgtgactctctggcatctctcaggcttattcaaatagatgaaattttaacctggtgagtaggtatgagttccttagctgaaagcagaaaggctgaaattttccaggaatgttgatttgaaagtcttaacattcttctaaaatagttctaagaattattttgtaaagactcttaaagaaagctactccaacttagatatagctcagttgtacatcattgttgaccatataaaatgaaatttatgtgagactttactctttggggtgtatatttaattaaatacggttaaaaattagctgcttgtggactctattcttgcctctgtaacctccaccccatatctagcttcctcgaaacccattaaatatggaagagactcattagaaatttttgctgactaccattttaaattcgcaatttgaactactgcagattgaatttaagttttaacttgataacctttggcagtataccacacatcaccaaatttaataatgctctatgtttatatgttaaatcaatctgtgatttagtttgttttgcaacagtcaagagttgtaagttaaatccttactttctgtaggtgcagttctatattggcacttcattgcaagaacggcatttcataacttaaaaatacctaaattgattatgaaaataagtcttgaaaatacagtttttaaaaattaaaaatataagaggtgaaaccaaatattgacaaatatatgaatgaatgttcctttt

SEQ ID NO: 57295 - DNA, 1050 bp, Homo sapiens
ctccttatataaggatgtatttatatttaataaggaacatgtttatggaaagaagttctaactttaagttaaacttttcttactctgttttttaaactattttcattttctattagttatttcgttcctcattcctaaactagagctttggaatatgcttaatctttaatagaggaaaattattggtctctgtgttgggctagagaaaaaatttaaattgtctatttttaaagtttatttcacgtgttccaatattattttactttttgtactaggtcatgcatgcatttagcagttatacacttaagagggtgggtgatatttgaatgttatgaatagattttttgagccttttgccaagtgcctttgttttgcataatattttgataattggcatcaaaataagtttattgtacgttcataaagaatggcaaggaagattgtaatgtcttaacttgaaatttagcaaaactgtttttcttgaatttcagtgcagaaaatcaaggcaatccagatatgaatatgtgtgtttttgcgtgtgtgtatgtgtgtgtaagtgaaggggaaatgaaatactaagttatatgtgaggaaacagacattaaaatagtctgttgtctaaaaatacacataggcaagattatacataattttacaaatccaagtgaatggctggatttatacctagattttctcacttctatgacatactgatattactccttgcccttccaaggcaataaatgttgccttgatctacaagttattgtcatgtgcatgtgaacaggagcatgctctgtcaaagagaattaacctttccaaaggtactactagactttttaatccatacacacacgcacggatctatttattattacaaaagaagaaaatatgttttttcctgcttttataactgtaaaatggaatgttcttcttacctttaaccttatgattgagctgtccatatcaggtttttttttctactgactatttattgggactagctcactttattaattatgcatcctgatatcttatagaatggatagt

SEQ ID NO: 57296 - DNA, 1061 bp, Homo sapiens
gcaatttgaagtggtaaaactctagtttgattttaatatgacttaaaaactattaaattatgtattaataactaaggcaaaagacagttaaatatgattatcttgttaccagaagtaatttcttgcagaatatccaaatttcatcaatctaaaaatttctcaacttccagctgcatgtcttaccaagacagcgtatctcaagatttatttataatttcaagtagtacaattagaaagtgaaaataaataggaggaaccaagccaaaaataaagtgtatgtggcgggcggcggggagggtgggaattatagggatacattttagtaataaatcttcttccgaagctcatattttaattattagattggctttatttaaatggaatattacattacagctttttattagtagttactgagttaacattattcttaagtcaaaattataaataaaagattttgtatctctttcagaaactacatctgaccagagtgatattgaaggtaggatcagagctctgaaggatgagttgcggaaaagaaaatcagttgtgaaccagctgaagaaggaacagaaaaaaaggcaaaaggaaagactgaaagcccaagaagccagtctgatcaagcagttagaggttagacataggaagaagggggtttagtatcaaggctaatgtgtatgtgacgtctaaaatgtttttaatgttgttaataaagtaatggattaggattcttcattattagtgtggtgccacattttattctcttaaaaaaaatctgagggtatccaaggacattcttgcttaaaacattaaattttattttatttatttatttttgagatggaatctcgctctgtcgcctaggctggagtgcagtggcgcgatctctgctcactgcaagatccgccccctgggttcacgccattctcctgcctcagccccctgagtagctgggactacaggcgtccgccactacgcccggctaattttttgtatatttagtagagacagtgtttcactgtgttagcgaggatggtctcgatctcctgacctcgtgatcc

SEQ ID NO: 57297 - DNA, 1655 bp, Homo sapiens
gacagtcgaacagaagattttcagaccccatctccagttctcagatcatcaaggaaaatcagagaagaatctggagattctctagaaaatgtacctgcattacatcttctcaaagaattaaatgccactagtagaattcttgatatgtcagatggcaaggttggagaatctagtaaaaaatcagaaataaaagaaatagagtatacaaaattgaagaagagtaagattgaagatgccttttctaaagaaggtaaatctgatgtcttactgaaattagtcctagaacagggagattcatctgaaattctttcaaagaaagatcttcctttagattctgaaaatgttcagaaagacctagttggattagctattgaaaatctccataaaagtgaggaaatgttgaaagagagacagtcagatcaagatatgaatcatagtccaaacatccaatcaggaaaagacattcacgaacaaaagaacacaaaggaaaaagatttgtcttggtcagaacatctttttgctcctaaagagataccatactctgaagattttgaagtgtcttctttcaagaaagaaatttcagctgaattgtacaaagatgattttgaggtgtcatctttgctgtcactcaggaaagactctcagtcttgcagagataagccacagccaatgaggagctctacaagtggagccactagctttggtagtaatgaggaaatcagtgagtgcctaagtgagaaaagcctttctatccatagcaatgttcattctgacaggctgttggaactcaagtcccctactgagctgatgaaaagtaaggagcgcagtgatgtggagcatgaacagcaagttactgaatccccttccttggcttcagttcctactgcagacgagttatttgatttccacattggtgatagggtgttgattggaaatgttcagccaggaattcttcgattcaaaggtgagactagttttgctaaaggattttgggccggagtggagttagataaacctgaaggaaataacaatggaacatatgatggtattgcatattttgagtgcaaagaaaagcatggtatttttgctcctcctcaaaaaatatctcacattccagaaaactttgatgactatgtagacattaatgaagatgaagactgttactcagatgaacgatatcagtgctataatcaagagcaaaatgatacagagggtccaaaagacagagaaaaggatgtcagtgaatatttttatgagaaatccctacctagtgtgaatgatatagaagcctcagttaatagaagtagaagccttaaaatagaaacagacaatgtacaggacatttctggggtacttgaagcccatgttcaccagcagtcttcagtggattcacagatttcttcaaaggaaaacaaagacctcatttctgatgccacagaaaaggtttccatcgctgcagaagatgacactttagacaataccttttccgaagaattggagaagcaacagcagtttacagaagaggaagacaacctatatgctgaagcttcagaaaagctttgtacaccacttctggatcttttaacaagagaaaaaaaccaactggaagcccagctgaagtcatcactaaatgaggaaaaaaagtcaaaacaaca

SEQ ID NO: 57298 - DNA, 1011 bp, Homo sapiens
atgactttgagtaacttgagccagatggtcaccagaggtgagaaattttatatcccatttccatatcccatagacagttctttagaaacagaataatgataatacaaaaagcggggagagccctaatcaataaacattttataaaaattcagttatatgcaaggtttatataagtagaattgagggaacaggataactttttcttagattgtttattagtagccaccatattgttttttattctgcttacttatagagaaatattagatatataaataatgcatttactctgtctttttttaaaaaaaaatgatatgaggtccctaaatggtgctctgtttgaatggttccatttctataggagagcccagtatttggtgccagtgggcaggaagaacttgctaagagacttgctgaacttgaactcagccgggagttcctgagcgcgttaggagatgatcaagactggtttgatgaagactttggtttgagctcttctcacaagatccaaaaaaataaggcagaagaaaccattgtacctctaatggcagaacctaaaagagtaacccaacaaccatgtgaaacattattggcagtcccccatactgcagaagaagtagagattcttgtacataatgcagcagaagaactttggaaatggaaagaattaggccacgatcttcatagcatcagtattcctacaaaactgcttggctgtgccagtaaaggtctagatatagaaagcactagtaaaagggtctacaaacaggtaggtgaaataaaaggataattttagtttttaaacttttctcccattgtctgaaatttggattcttagccattttgttttgttttgttttgtttttctctatcaaggcggtttttgatttaacaaaagagatttttgaggaaatatttgctgaggatcccaacttaaatcaacctgtctggatgaagccatgtagaatcaactctagttatttccgacgagtgaaaaatccaaataacctt

SEQ ID NO: 57299 - DNA, 1115 bp, Homo sapiens
gctttgtcacctaggctggagtgcagtggtgcaatctcagctcactgcagtctggacctcctgggctcaatcagttctcccacctcaccctcctgagtagccagaactacagtcatgtaccaccatgcccagctaattttatatattttttgtagagatgaggtctctcactatgttgctcaggctggtctcaaactcctgggctcaagtgattctcctgccttggcttcagagagtgctgggattacagacgtgagtcaccgtgcccagctaggttttacttttatatgttgcgtaagtgaataaagtctcagcatttggaatgcttttcccttcaaattgctatgtggaactgtaagtggaagaaatttgtatgataattttattgtaaatattatattcttatcgtgaatctgtttactgcattgtaaacacatgaaactcaggaatttctgttgtttgtgtttcgtgtatttgtcttgtttccacagagcttcatagcaagtgaagtactcaagttgttcagtcttaaaaaggagccaaaccacaaaacagattggcagaaaatgatgaaatttggaagaaagaaaagagaccgagtggatcatatcctggtcagtgtatacaaccaaactgtttttattttgaccatatcttttaaactcagaatgcagttagattctaaaaggaaaagggatagacttattcttaaatctatggtattaaaatcttaaagcctttacttgctgcatttctacccctcagttttgttaactattttcttttgtactcagtagatgaacatttaacttgatcaatagtattttatgtagaacttgagaaatttactcaaatggaagcaaagtttaaggtagtgaattgaaaagagaccagtgtggactctggagcctgactgcccatgtttaaatctcttgatgtgtaatcttggacaaatttgtctaacatttttgtgcaaagtgaaggtaacaataatagtacttacctgataaaattattaagaaaattaaataagtatatgtgtaaagcacttagaatagttcctcatatacaactcagtaaataatagctgttacctcatcatcatcactattatc

SEQ ID NO: 57300 - DNA, 4773 bp, Homo sapiens
ctctgagcatgtttcagatggactaggctaagctatatgttcagtaagttaggtgtattcactgcatttttgacttaatgatattttcaatttactgcgaatttattggacataactccattgtaagtagaggaacatttctgtctaatattttgtgttttcctcccattaaattccttattctcttatgttatggaattccttatggaatacatattcccttacgttgacattgacaacatactggtaatctttaatatatatgaaatacttgaatattgtcaaatgttatttttgaagtcattttgatatttggcaattgaggttttttcaactttttgcaattttaaaaggggtattgatatcatatgaattatcttttttctctggtttatttccttgggctgtattcctatggataggactacaaagtcagcaattatattttctagcttttgtatgacaggaattttctaaccttattgtcttctaaatcctaggttcaggagctccatgaggaggaggcacagtgggtgaactatgatgaggatgagttgtgtgtgaaaatgcagctagccgacgggatctttgagaccctgatcaaagatactattgatgttctgaatcagatcagtgaaaagcaggggagaatgctacttgtgtgacatcttgcaaataaatcgaacgctgagtgctaatgtgagtcctgggcctttctgcctcctgatgtacacccatcgccatcatagcaagagtgcttctggaccttgtacttattcttaaagactaccagtatggagttcataggacaatgtggtacacctggtattacagcctttgcctttcgagactatccactggattaatgggttattttcagtgggcagggttgcacagtgtaatcctacaccttttgctaacacccctactaggtcccagagggccagaaacacctgacttacctctgagtttagactagggtatcacttctttgagtctgaagtcaagtgagagaggtatagataaatgcatcacatcacttttgaaatgtaattctggtctataccatggaagtcataaatggacattatagtctctaaacagtattaaacccttaaccacttctaaaataggcaagctcaataatgtctgccaacttcacattctggagtttatttcatttctttttgaagaccattttcttccattattgtagttgagcagcaccaagtggactgtcaggctaacaggaataagtggtagccttgctttctgagcaccatctaaagaattttaaacctctgcattatgtttagtgttctctgtgtgggcatgaaaacaaagaaatgcccctactgaagactgggctcaaaggaccaatgcagggctggttcttttaccccttggtttactcctgcacttgtcttactcattctgaatctctaccagctgctcccagaatcacagatactcaggaccatctcaggcatccaggcatggcaaagtggaaataattcattttggcctgcaaaccttcaactcccatctttccccaagaagtcagagatgctgttacttgaatgatttaggaaatgagtgtgtgcaccaaagacaaaaagatattgtctattgtttgtgtgcttgttttgcgctatggaacattttttaatttattttaagataaattattaagttgaaaatgtgtgtccctattcagaagtgaaagattcatcttgtaatagttaaacctccatcttgaagcttctatggttcatagtctttgcacaggaacctgtggttttaacaaaccaatacacatattgaagaagtcattttaattcagtgaaacgaagatgggcttttccagatcacctgcaatagcagcagtgggataaaatgatttaaaaacactgtacaatttaactctgcctctcttgcagcattgcttctcacaactattacctgcatctgaaaaaaaatctatagactccagctgctacattagagcataagagatgctctcctgggacctcagtaccctgccttcttgactggtttccgttcatcagtcctgtccctcttcaagtaatctagaagaatgtggatactcttaggcgtgaatgtaaatgccttaatattgaaggtcctggttagaagcatgatacaagacatctactggattcatatttacaaatatcctggaatgttatagcttcaaagtatattagaaaaaccccaaagatggtataatctttaagtgtgcacgttcgtttatttctgcatcttccctccaaacttgcctttgcatcttaaatatttcactatgcacactcccattcctcttgggtttcatcttgtcgtttaagaaatgtactgaaataatcattggaatatttgcattttgcacaatgactggtatgatagctcttgacaaataaggaaagcactgaaatgttgtgattgggtctcgggaaatgctcagattgatgtcttaccagcatttcttctgggcttgtgatgttgagctgtagtcttgtagccataatgagcaaattgactaagagaagcaaaggtttcttggggttattaaccagtagtgtggaaatactagttttatgtggccaaggaaaagcaaaggcttttcttttcagtttgtgttatttggaagacagaaaaacatcttgtctacatcctttggctgtttgtaggatcacgttgtccttacgatactgaaactttacagctgctgtaaattttttataaatgaatttcaaaatgttataatgggactgtaggttgtttttctacatcttcattatttggacctaaaaccagtttttaataagaaagtttatctttactctttctgaaattatgactccagaaaaagaaaaaaaaaatacaagtcatggaatcagcaatctggtaagaaatgctgccaagaatgtggcagtagctgtcctgacagactccaactgtctttactatctgaagaatcctaggctccacatgagaggcagaaatggatcagtcttattcttttctagaaatggttatctgtagtttggtagcaaaaaaaaagaaaaaagaatccataattagcagatttcttattaactatttggatctaattgaaatggctttattcttaggattaagaaagatagatgtggatacccagccactcgttccatattggtatctttttaaatcagctctgcctcttaatcaagaacctaaatattccctctttctaatctttgttccttctccctacaccctcatcctctttcactcttccttcataattcctctaagaaaaatatctttgcatcagcagtaatatcttttagaatagcactatcagaatttagcagtaaaccaacatacaggcttcagatttacttctgagtccaaaacaatttgtgctatccagggtagttaactctgggttaaacaagtacagggtatagattccctcttcaggtctacacaggaatttttaccatagggaaaagtggggagagctcaaacgtagttaataaggaaggtaatttgtttttcttttacctaaaagaaaagaaaattccttctgtgactacaggtctctgagaaattatctttcaaaagagatttcattgctcataagagtgttgtggcctattgataaaaacaattttgttcagtttcttgtcttgaaaaaaaagtggccttagctttttgcaatacttgaataaagtgtgtactcgcaaaagaatttctgtagcacagcattagagactcataacttttctgcaagaaatacaaacttacatcttccttttactaccttaagaatactagtgaataaaacattaattcaaagagcaaattatagaaactacaatgacatttaatgcaaattgtaggaatttacatgtttacaaatcatcttcaactggttgtgcagcaattcaataaaatatctttgtattataaaaatgtgaagaaaaaatgtaaactgatgtaaaggaggtactgtcattttaattaacctatgtttaatagcttttccttctggactttgcaaagccttcttggcaaacacattgcaaagcattctctgggaggttcagcctccttgtgtgtactgtactgtgcagacatgaaaaaataaacccgtttactgtgtgcgtgtaaatagcctggtcatcaggccattttcagccaatagtcacatccagtgcaattttgcaccgaacacttaagggtgtggtttgtaagtacgatctgtaaaataactgggatgaattcccatgtatacctgtgtaaatagatttgttaactgaaatatactttaagaaagataaaatctgtaaataaactgatttataaattaatttcatgtcaggtctccattttttccctcctgagccaacttcagaaaattagtccccataaaatacatctgattgcttatttagtcatagggtgctgatgcttggacagtacaatcaggtaagctgtggataagagctatttacctgcacataaatgccatcagcacatacatttgagcagcctgggctttgctcccacactcattgattcagcagatagccactgagcaactttgtgttctgagtactgtgctgagtgctggaaacatagcaaaaaagacagacatggtccctgatctcaagaaacttaatgtctaatgaaagccaccaaaagatattttgaaaacctgtgtgacaagttctaacaagtgctgcacaggaagcatacataaga

SEQ ID NO: 57301 - DNA, 1117 bp, Homo sapiens
ccctggccccgattagtaatggagaaacagataccattatgaggcagtatgacttatgctaatcatccaaaacacaggttcccttttgtgagacgctagaaatgcagaccaactggaatatctcagaggtccttttccaaggaaggtgtgacctttgtcataagagctttgggatcaggtgctttgaggttggcaggggtgaggcattgcattaggggagatgggcgggcagagggggtaccagcccctcttatttacccctgggttttttgtcctttcagcctggaggccggccctgtatctcgccgccctggactgtgctgaggagaccaacagtgcagtctgcagagacttcaacatccctggcttcccgactgtgagggtgtgtgactgacaggaggggaaggcaggctgggcctgctttgtttccctttataagggaaagggaccatgtgggatgtgtcgggatgggcagatttcagctgctctgatttgagctgggaggtgatcatcacttgggctggtgagagctcccacctcccaaggtcctcttcaattgctctccctcttgacctccaagccttaagaggtctgatctaactctataaaaccaggattcaggctctgacccacctgtgggcagggtcagactctagaagcctagtggtcccccacaaagggaccccagacactctggcaagcctcagcctcctcaggcaaaaatgccttgaaccacaggtagctaagaagggacctgtcagggtagcctcaccccactgtcagaatgtcagtgcctcaggcagcagggatccccggcacgggagttatcacacccaaggcatgagggctttgtcacccccgctctggtggaaagtggcacgagatctctgatgatgccttacctgccagcctgcccagtgcagggcatcaacagcttaattaacgtctgaacagcttccaaggctctcaaataggaggccctggatagcccagggcagcaaggctgctgcagttatggtgagggccctcccctgggctcaggcctggctccaatccaattagttttcttccagattagagaagccaaattcaaatctctgtctctgtagcaccagct

SEQ ID NO: 57302 - DNA, 1046 bp, Homo sapiens
tcagaggaggggagggagctgtcaactttatggatgtttgtttttctgagataataaactagtcccaggtgactaaaatatgagatttaaccccaaagttcttgcctgggctctccattgctgtgcagaagccatctgttgaaatctatttaccattttaatggtctctcttgctctttttttttaactgcttatttccaactccaaatgtgtgccaagaccacttttttgggtctatattttatctttcagaaagcaattcccagcctttcccaaatccccaacccctcccagccaacaggagatcctggtccagggttggcaagcaagagaaagataaatcattaatttttttaaaaaagcctctcctacaactctagaggcagctcagcctctatgagccttgtaagttctgaccagttcagggacaccctgtaacttgcccaatttaattacagaataacataccagtttgtgtgtaatacttttattcaatttttgtgtttttggagatggctaaaggaaaaatcaccaaaaagaaagggttctaaaggaaaatcctgaaatcacaatggcaaaaatgacagaagaaaatgaattaaaaaatcaaaagagacagatgttacatgcagaagcccacgtctgctttctctgagaggatgtgatatactcttccccgggcaggagctgatcatttaaaagacctttatttaatagtttcggatggtttatttgtattactccttttagaaggatgataataaaatttcccttttcctaatgatttggccccattttataaacattgattttttttttctccctcctaactcaatacttctccacagtagtggctgaactatgtacttccctgtggcagtcatgagacaaataatcatccatacagagcttgatcagtgctccctgcacagccaggcaaaggggctttatgaagaaaggcactaggaattctgaataaaaatgaaatagcattcttctaagcaagtgtggcaaaggacacactttcagactgtaaaggacaattt

SEQ ID NO: 57303 - DNA, 1054 bp, Homo sapiens
attggttgtttacatatttacaatccattctgaatagcaggaatcttacctgtattcctgactggactggtacagtatgtgctcaataaaatggctatagggccgggtgcagtggtgtatgcctgtaatcccagcactttgggaggccaaggcgggaggattgcctgagcctagtagtttgagaccagcctgggcaacaaagtgagactcccaaagtgagagccaagcatggtagcacacacctatatagttataactactcaggaagctgaggtgggaggatttgcttgagcccagaaggtcaaggctgcagtgagccatgatctcgccactgcactccaggttgggagacagagccagaccctgtctcaaaaagtccgtgaaattcagctccataccctttctcttgaaacaaatgagcaacaacaacaacaaaaacccacacactgtgttgtgtgataatcatgctgcaaaagagtatataaaatgtatatgaagaatttaaacaaagcttttaaaaatttacccactacttagcttaagaaatagaacatcaccaatatctttgaacctcctgtgcatgcctctcaatcatatggccttccctagtggtaatctttgagagattaccactatcccaaattttatattaattaatgatttcctttgtagtttcagtacatatttgtatgtctgaatcatattctttagttttaccggtttgcaaaattttgtttaaatgaaatgatatcatatgtattcttctcacttgtttttttcccttcaacattatgttttggagataaacccatgttgtgtgaagctatagttcattagtttccagtgttctacaggatttcattgtacaagtgatcaatactttatttatatgttaccattaatgagcgtttgggctgtttacatttggggtctgctgtgtacatgcttgcaaatatctcctggagaacatatgcaaaagtatataactagaagtagaattactaggttggagggtatatgtgtgtttaggtttaacctgtaatgctctagtgtt

SEQ ID NO: 57304 - DNA, 1040 bp, Homo sapiens
gctggatcgtatagtagcctattttcagttctttgaggaacctccaaactgttctccatagtgattgtactaatttacattcccaccaatggtgtacaagggctcccttttctccacatcctcgccagcatttgttattggttgtcttttggataaaagccaagttcagtatttttaatagttccagaaggagagattgcaaaaaattaatatttgaagatatacttactaataattcctagaattgatttaaacattgggaccttcagattcagaaattatgagctctggttagtaataatctgtgatgttcatctgctagaatactatacagcagtgagaatgagctacatctacatgcaataatgtaaatgaatcttacacatgctactgagctgagatgccagacacaaaagagtacatacagtatggtttccatttatataaaggccaaaaatgggaaaaacttctctctagcattagtaaaggggataatgattaccttgggtgaagtaaggaggtagcaggcaactagaaggggttaacagggcacgcgtgcttctgagagtctaataatgacctgattgttgatatgtgctagttacatggataaatttccttaagaaaatttatatacagttgacccttgaacaacataggtgtgaactgtgtgtgtccacttatatgcagggtttttttgttttgtttggtttggttggttttgtttgttttttttttattattatactttaagttttagggtacatgtgcacaacgtgcagtttagttacatatgtatacatgtgccatgttggtgtgctgcacccatcaactcatcatttaacattaggtatatctcctaatgctatccctcccccctccccccaccccacaacagtccccggggtgtgatgttccccttcctgtgtccacgtgttctcattgttcaattcccacctatgagtgagaatatgcggtgtttggttttttgtccttgcgatagtttgctgcgaatggtggtttccagcttcatccatgtc

SEQ ID NO: 57305 - DNA, 1027 bp, Homo sapiens
tgatttgattttgttattaaaattgtttttcttttggggttttttttggggtttctgtatgatattgctaatgttacttttttttttaaggataaccaaagttaatatgacttattttagaatacatgctaaaatgctgtgaggttttttttttttgttgttgttgttgttgtttttgagacggagtcttgctctgttgcccaggctgaagtgcaatggcacaatctcggctcaccgcaacccccgcctcctgggttcaagcaattctcctgcctcagccaactgagtagctgggattacaggcatgcgccaccatgcccagctaatgtttgtatttttagtagagacagggtttcaccatgttgatcaggctggtcttgaactcctgacctcatgatccgcccacctcggcctcccaaagtgctgggattacaggcgtgagccaccgcactcggccctaaagtgctgtttttgtattacatgatagaagtctaaagttgcagacatgtagaatgtgaaaacctctttgttaaaaacaacatgactttcaaggaatttttctttttaatggctaccatactttccagcattgttaggcaactttatccctgaccaaagtatccagaacaatgatttctgtatgcccaatttatgttattgagggctataaaattttaccccaaattcaagagttaacacaatatgaacgaccaaagaattacaagagcttatgaaataagctctgctggcaagagcatcaagtctctagcaccatgaaagtcttgccaagtctttcacctgtagggaagcagttctgcttcttcatgcacactgttgctccttctttcatatactgagaagaggaagactttgaggatcatcttcctgaaggtcttccagcttctagggaacctctactgagacctgtcttgatgtgtgctggtgatagaatgtgtttgtgatatttgtatcttcaaaacacttgttttagatcatttaatcttagtataaagttaccttttttgat

SEQ ID NO: 57306 - DNA, 1031 bp, Homo sapiens
attgtagcattgttttaaatatttgccatccctttttttaaaaaggtaaagaaaaagcaggaaaaaaggcttagacacatcttgtattcttgttggtatcatggcatttgtcagtgtgttcatactttttaattttctagtacttgccgacttaatcccatgagcttacttctaatatcagtaaagggtatgagctgtctatgtggttcaagctgccacttgagggtttctccattttgtggagctttctaatggaattcaaggttctctctaaggatgagcattacaaagccttccctggctgctgtgggaggaggaagtgcaccataggttcaaggacacatgtgaagtttaatgtgcacaagcatgctcccgctcctgctcctgctcctgctcctgctcctgcttactctgattggcaaggttaactctgagaagctgctgcttttttaagtgatttgattagacccatcacttcattcctttcagtcctccctcccaaggaccaaaccaccactgtctttgcagtctttgctttgcccgttacattttctctccttttttcctgctttttcatcaacttttaacatttcgtaaaacaaaataaggaactcaaaagtaaactaacttgcctcactgaaagctttgacatgaaaaatttccatacttttgttttctacacttgtaaattacaaaacttttatttcattttcacttagctcataaggaaaaatagaattattattcacattagttcacttagataattccacagtcctctatcaaaatttattttgtacataatgaattctttcctcacaatcgttttaaaaataaccttttaattacaaaaacttcaacgaggtacaaaaataaagagaatatctagtttcagcaattaccaatttgtggccaatcctgtttaatctgtactgctatctcacaacagtggtctttaaccattttaggaagaatatgaggaaagttatgaacaccagagaaaaaggacctacatgttaaatttttgcaaa

SEQ ID NO: 57307 - DNA, 1031 bp, Homo sapiens
atatgtttgaggtttttagatctctaatttctatacttcaatataattcttacaccatttatatgatgttaagtcattgtctatatttcaaatattttatctgtaagtgaaggtgtaaatatgtttcctgttttccgtcacatagtgtctttgtgattttaattcaagagtcttttgaaaagtctgggctaatgtgttaagtcacctgttgattttctaaagaattactttaattccacttaagaataggcaggtcaggtgtgaaaacagaagctctttaccaaaaacacaatacattttgtcagttgatcttctttttctgctgagtggataattgtgaaaacactcttagccttcaaattattttcttaatccttgattctctcacacattgtaaacagtctctccatatcagttttacttccttcctagattactactatgtttcaggtactgaggaagaaatgtttactagcacttgagtgtagcacctttccatagtaaaatactaaactcttctctaaaatgagtgaaagttttacatactctgcagcgagtgtgcatgtgagtgtaaggggggagaggggcatgtggagattaaatccagttgctgtacttaaaaaatatgtaatggtttatttttcattatgggaatcactttcatgcatgccagtttcttttctacaaaattatttgatgagaaaacttccatttttagtggtttgataaaacactgatttattatgttgtggcatatctttttgcactaaggatgtgccttccaaatatacttgtaattcttgccaatttaagggcagagtttatgtgttaattttgcattgcttttaatattgaaatcactacctgggcattctaattaaatattttctttatgttacctggagccaatcaaaaattagaatttcaataaataaataagtaaaagggtttttactacatcaaaaatatcaattgataatgtatatggctttaggattttctttacactttctaaaaattttataatttca

SEQ ID NO: 57308 - DNA, 1052 bp, Homo sapiens
ctaaattaaaacaacaaagaaaaaaaaaaaaactggccagatgtgatggctcatgcctgtaattctagcactttagggggctgagtcaggaggatcacttgaggccaggagtttgagaccagcctgggcaacatagtgagaccccatctccacacatttttttttaattagatgtagtggtgggtgcctgtagtcctaactactctggaggctgtggtgggaggatcacttgagcccaggagtttgaggttacagtgaactatgattgtgccactgcattccatcctgggtgacagagcataagaccctgtctctaaaaaacaacaaaacagttttttgaaccaaacacattgtttggaggtattgtatatggaaatatccccaagttaggcattgcctgaggtttttgccttgcggatttcttacgttctatttgtttggatagtgtgagacaaacaatccaaaaactataggtggctttatagaacattctttactaaacactaagctttaatgcaaagtaaaagttccgtgtaggtttttaggacggatctgttagaattatatgcctgccacaatgttttcctttgtattcacatgaccattgtgtgtagccaccagctttgattctcttttgacagtcataatctatacaatctaactttagttaatgggttgcttttggcttttccagtttgagttgctaacatgcttcgaagtcagagggcttctggagattagcgctcagaataactcttttgcttgtaatatcttctttggttttgttattgaaaacgcttttcaaatatagacaatacaaacataataaatggaaggaaaggttcatctcctcatgactctatatttcttaaacaacattattattgactggcctattggttgccaaaaaggaaaatcaattttattggaagtatttgcttggccacagatcttggtactaactcagcacagacagtctgatgttatcagctatctgaagactaatttttaccattagtctgaaacgaagcagtaattagagatatgtcaaa

SEQ ID NO: 57309 - DNA, 1016 bp, Homo sapiens
tgttgtagtttttgagatggagttttgccctgtcacccaggctggagtgcagtggtacaatctcggcccactgcaacctccgcctcccgagttcaagcgattctcctgcctcatcctcccaagtagctgggattacaagcacccatcaccatgcccagctaatttttgtatttttagcagagacagggtttcaccatgttggccaggctggtctcgaactcttgacctcaagtgatccacccacctcggcctttcaaagtgctgggattacaggcatgagccaccatgccctgccccattgattgtttattgctttttccatagtgcattttttatatcaatcattcttagaataattaacccataattttttatatttccttgtctttcttaaaacattatatcttttacatggctccacaactgagataacaaattcatttatcttctgtgtttttagggtagggctctacttcactgggcctgtgatcgaggacataaggaactagtcacagtgttgctgcaacatagagctgacattaactgtcaggtaagagtgataaagaagagcttttattttttaaattgaagtataattcgcataacataaaatttaccagattaactcttttgaaatgtgcaattcagtggcgtttagtacatttcacaatgttgtgtaatcattgctactatatagttccgtaatactgttgtcaccgcaaaagaaaaccctgttcccactaagcagtcactttttaacattttttttatttctccccttgccccagaccttggcaaccactaatctgctttctgtttctatagatttgcctattctggatattttatataaatgggaatcttaaaatttatggttgtgtttgacttcttttacttagcataaagttttgaaggtgtatctatattgtaacatgtaacaatacctcattcctttttatggctgaattttttggatatcccaaatgttgtttatccattaatcaattgatgggcag

SEQ ID NO: 57310 - DNA, 1062 bp, Homo sapiens
aggagttcgagaccagcctggccaacatggtgaaaccccatctctactaaaaagaaatacaaaaattagctgggcatggtggcgggtccctgtaatcccagctatttgggaggctgaggcagaactgcttgaaaccggaaggcagaggttgcagtaagcggagatcccgccactgcactccagcctcagcaaaagagcaaaactccgtctcaaaataaataaataaataaataaaaaataactcctagtgggctctgaacaaggcaaaataaattttttttattttgatactacaataaattgtgaatgatttgaccacactttttctctgctttcccccctcttaggattttgtgtaagcttattagaaaacagatatttacaggtaaataaaagtaaatcaagcaaatgaaagcaaaagaagaagacaatttgtagggaagaagttttcctactttgttttttgtttaaagaatagatcctagtttaattatttgaaataataggtatgtgaagaaagtctgaatgataaaaagaatgtaggcagttttagaaaagctatttcttgaaaggtgctttttactttaaatcaatccttgccctagcttatatctatttaaatcttttctaaaatcacataaagtagggatgtcaacttaatgtggaaaaacattccattctttataaatgacaacatcatcaccatcctcagaaagtagtaagccatgcatcactcatttattcagaaaagcccttagcttttggggttttgtttattcttttgaaccaagtaggctttttttcattaactaaaacaagattttctggcagtagagaatagaaataacacacgtaatagtaactgtgagtctttggtagacaagtgttaaaattaatatttcatatttagtactttatctcctaatatttagtcatccattctcttttacaagtggctttcacagtcaactgtttggtgatagacactgatagattgtactagtgtttttgaggtatttcagagtgtaaacttgcaatagtaaggagaaatgcttattttca

SEQ ID NO: 57311 - DNA, 1027 bp, Homo sapiens
ccctctctctctctgaccctcctaacgtaattatatcacaacttttttattttattttattattattatactttaagttttagggtacatgtgcacaatgtgcaggttagttacatatgtatacatgtgccatgctggtgtgctgctcccattaactcatcatttagcattaggtatatctcctaatgctatctgtccccctcccctcaccccacaacagtccccagagtgtgatgttccccttcctatgtccatgtgttctcattgttcaattcccacctatgagtgagaacatgcagtgtttgattttttgtctttgcgatagtttactgagaatgatgatttccaatttcatccatgtccctacaaaggacatgaactcatcattttttatggctgcatagtattccatggtgtatatgatatcacaacttttaatttcagctttctgattgaatctctgttgaatcaatattaatattattatgactatgtaaatactcattgctaagctgtggattgtacttgtgtgtatcagtcagcttttgctgtggcacaacccccaaatttcagttgcttacagcaacaaacatttgtttttttgcttatatcactgtctcatgagatgagtgacaccatctcatttatatattctgataatgctcttacttgatttctttatgtttatctgatatttcaaaagggttttggatcagttgagacagtctgtatattttatctacttttattattaatagtatgagtgaaggatgatgataatataacaaatcaataagtaggccacttaacttttcaaagtcacagttttttcactggaagtatcttgtgtgtactatatggtgcctgttaatatttatctttcaaataacacataatactttatacaatgcatgtgatagtttacagagtactttcacttattactatattatctctacaacagttctctaaggcagatattgtccttgttttacagacaggaactgaagttcagagacctacattt

SEQ ID NO: 57312 - DNA, 1043 bp, Homo sapiens
aggcattttgttcttttttctaccatgtattaaggtattattgatactagtcagtcatttatttcacacattagttttatacttactgtgtgcaagttgtagttctaggggctggggatttagcactgaacacagcagaacaacccctgctcttaggaagcttacagtcggacagagataagtaataaagtaaatattatagtaaatattaataatgtattagtaaagttgtagtgtcttagaaagtgattagcactgtggagagaaagcagggaagaaggatagggcacacaggaggcaggggtaccttcttaatttaaaataagatggtcaggagaggctcactgaaaaggtaacattgagcatagattgaaattaagtgaaagaatgagccatacagggggaagaacattctgtatagaggaaacagctagtgcaagtctctaaagtaggatcatgcctgacgtactctagaaactgcaataaggactgaatgtatatgagaacgaggggtggagaaatagaaaatgaggcagagttgggcacatggtaatatagcctgctgtaataaggattgtggcttttactctgagaagcgaaatatactgattgtaaacttgtaaaaagacttaggtattcctccacattgtccactaaatgatattttcatgaaaataatagaggcttatggaaacaaaaattcaaacagtgtggaagagtataaaatgaaacttttagaacaagtaccttgccccacacactcacacactttcagtcccattccctagaagtatcttttcacttgtgactgtttctgtaatcctcagagctacctccgtaacactgagctctaaattcttcttttaaaaaagttttctttgaaaattgaacgtttgtctgatatatagatgaaggttaacttagtttctgcaattccacttctcttttgtcctcttcctccgtttctactcgcatctagtaaaacctttagtgaccaccagagggagcaaagttcaacataaataagatgcgtttttattctc

SEQ ID NO: 57313 - DNA, 1009 bp, Homo sapiens
catatgtagtggttatagtttttgtaaacacgttgtaatcaactattctgctttgataataagactctttttactgattgcatgaagtctacagagtaataacatctttgtttttgcctcttgttttggaatggagggaagagaaaggagagaagagaattattaacatttttttattttctgctaagtttttgctagctggggagaaaattagtatattgtaaacaatataccttacctgtgtattacagaaatcatgctccccattccctcccaatttctgtgctaacactgctggaaggtatttaatagataataaggaaccttacattaataaagggaaaaataaagataatgaacccatttatatgttcagaagacaagatacctaagaggctttaagcattgcaataggttattctcagtagctggcaattcagctcctggatagagaaagacagacttatctgtaacctccaggaattcacatctgttttgtgtgcaggaacaaagaatataaaatcaatatgaacacacataacttagctagattttatgaattaaactattttagttctccatttaatttttatataagtttagtgataggaggtttgggcaatagcagtgagtgtatttattcatatagccattgtaataattgaagaagacagggaaagagatgcaggtaggttaaacggaatcttgaatattgtgaaataaattcacttgcaacctagagtatttcattattgctagaaatgaaaggcctataattattaatgctttattgtcactcaatttcttacagtattttgtggccatgttttgtaagaatgagtgaaataagggactaacatttcagcctgcagagttgatttattgtttctaataacatttagttttaaaaccttggctagaatccaagtgatggtttttattgaaagaagggtattggtctttcatctttctagtagtaattttcagcaccactgccagttcttcacag

SEQ ID NO: 57314 - DNA, 1065 bp, Homo sapiens
tgaaaagagttctggagaatggttgcacaacaatgtgaatgtacttaacactattgaactgtacatttaaatatagttaaaatggtgaattttatgttacatgtaccttactacaattttaaaaagatacttgtatccagttcctgatagtttcttatgcagtctactagtttttttctctaggacttttgttctgttttcttcagtgttttttcttagtcaagagagtttataatctctcaggtgatttttcatccttttccagctgttccttaattttaaagtatacaagttagccctcatcttaaaaattggacaatactggattgatgtgaagttataatgtttggattttagtttataaatgttaattgaagtatttatcaatttagggagctatgagtggtcattgaatattgaaaaagaactgtttagcttcagatacattcagtataaagcttactcatgatttcatatattgtttttctttctttctaataggctttcaaggatatgctgtattcagctcaggaccaggcaccttctgtggaaggtaagatgaattaacccttaagtttagtcacagaaaacctctttttaaggaaagatattttgtactgcagagtataaaactaatatgataacctgtcctattatataggtctttttttcccttttaataatatatattatgattattttatattttattctaaatttttctcttgtctagctcacctttaccctatgacggatcttttactatgtctttgtgtcaccttaggactgtgaatcgtatatattggtttagtcagaagtttttctgtgtaatgcttccttgccttccctcccctcccctccttcctccgtccataaattacacaacatagcttttcctttctatttatgtcatgcctttagagtgggaccagtaaaacaatggagaatgtttacaatggatgtgtgtgtgtgtgcgtgtgtgtgtgtgtgtgtgtaagcatgtttatgtatacatgtgtacatgttctcgtgtcagtaaataggagctaattcaacaactattct

SEQ ID NO: 57315 - DNA, 1046 bp, Homo sapiens
attgggggtgggggatctacctgtattgattaaaatttcattttcttattgaaggttgaaaggtgaaagattgtttgtcaccttcgaaacagagtgccaattcgtgtttcctgatgagaaattgaccagctatgtgtttactgtaagaggtgcaatcagtgaaattggaaaaggaaattgaatttatattggtgtattatcccatgcagttaattttgcaaataccctaatgcacatgaattttatttgaggttgagatgcctatatttactctgaaacaaagtgttggaaatgtagtgtgattaaatacatttcaaattttctcttgttccacaattgctgtgcagttccaaaatatgttcttattaggttcctcacaaaggaatcttttggccattacaacaagaaaatgagatagttaattttaaaggatacatcaaaataagataatttacattgtaagatttattattttcacgttcctgttttttctgtatgggatcctctaacatgttagcaaaacaatatgtcgtctttctataagactataatttccacttaaggaaaactatgatatgattcactcttgacatggcaaaaaaaagttaggttaataaatttacagcaaagaagaatttttaacaatacaaaagtaacacaatatattaggtagatatcctcagaagcagtttattcgcaatggccatgaaagaatcttcctaaaagtagtagtaagagaatgactaatggagaaaaagggatttgaactggatcttgaagcatggttaacatttagatagccttaggagagggccttctaagcacagagaagcaacaagacgaaaccaaaagaatgcacatttctaagacattcagggaagatttagtagaacacttaaaatgaagcatggagggttatcactggagaatagttagctgtatggataaagccagcttcccaaggagcttaaataatttaaaaagttggactttatttggtagactagtgtattctaagatttggagttactagtttaatgcagact

SEQ ID NO: 57316 - DNA, 1050 bp, Homo sapiens
cattgggataataaatagcttggattgtattgtatctagtgccagtgagattgatttttttctcaattacatgtcactgttataagtgaaaagacttttttgtgtgtgttctaccaagaatattttaaacacatttagttaaacctcacctgataaaaccttaagatagactcagatcagaaaatcttgtgtagggactacttaagcctagttatattcagaatcattttgcagaaattagcagttttagttagaaatttgcaattaggaaaagacttagagattacctattcaaatgcccttatttttcaaagtgaaaacaggcctagagtgttacttgctcaagctaatataggtagttggcaacagaaccatatctagtctgcactaaaacctactgattttacctccagaatatcttttgaattttttcacttctctgtctccagtgccctcaccctagttgaggctattgtgatctctcccgtggtatctactgtactacgtctcactggtctcccgacaaccttatttagaaagcatatttgatcatactattctctctgcttaaaatccttcaaaaatgtctcattggtctcaggaagaaggctagtcctttattctaccctttgtatatttgtgagattatttgattaaagtttttttcctcagatagactgtagactgtaatgtcaaagggcagaatttatgtttattttgcttatcgctgtatccctacccctgccacattgcctggtacataggagggacttggtacttgttgaatgaatgactcctgatttagctctatttctactacaccagtgattttagagtaacattttttatctttgaaatctttgccatatgctttatataattcatctacccatctgttgatgtaatagcatctggaaaaaaagaatttcaagttagttattctcagtttataaatcacactcttaaaaaaacacacacctttttttggtacaagcatgaaacagtagtgctaaatattctttctatatttgatggagcatggtcatatat

SEQ ID NO: 57317 - DNA, 1054 bp, Homo sapiens
tatttttatttttggtagagatggggtttcaccatgttggccagggtggtctcgaactcctgacctcaggtgattcacccaccttggtctcccaaagtgcttggattacagacatgtagatactttattttgagttatagtaaaaaaaaatgtacattatgacccagcacacatatacagataaatgtttgttttatatatgtttgtatgcatctatatgtgtgtgactacacaatatatttaaataatttaagatattttttcatgaaacagtacatctttagtacttgtagtatattgttttctatatttttctattctatttgattttttaaatgctaattatgatccactaaattggttttatgacctcatattgggttgcaaccttcagtttgaaacatgatttctttaagttaggtcgcttctcaaaaataattttaggctagctactattaaaaattttggtgctgtaatttgatgacttcctgttttgtgtgtgtattggcagggccagtgaggcacgtctcttgatgtcctcactggtacaaattggtagtctctagagtgactcctgccagatcaggaagtggtaggtaatacgaagaaatgattcacagaaatagaatttgtttctggtcctcaacagtatcttttttccctcatttagccaccttctccccagaagattgtagactgcagttgtcagacactagggcacaagaaaaactataaacaatatggggtgagttgagcttaataactcacctccacccacttatatctcacacattaaatagctaaaaatgctccatttttaagtgagatatttttgactaaaacctttcaatgtccctaaacaaattgctatattttattttgtctgtttctagtcatatcaaaaaggccaaacaatcaaaatatagcatgaatgctgctaaaatttggaatttttttcttgccgatgctatttactgtttaaccttcctaggcttccacacacttgcttataaaacaaacagattgattcccaaccctctagggttccacatgt

SEQ ID NO: 57318 - DNA, 1054 bp, Homo sapiens
ctagggataaccatgatcaattaaccacagccaaaatctctgtgtgcaaaaacatctgtcctgttgccttttatggtaaatgcacccaccttgttttgatagttaagtgctgccatctggcctttctgttccaaggatcattgaatgtgcattgcaatcagggaacccatctcaatagatacatctctcatggccattcctggccttcactggggagtaaacatagagctttttaaggatgcaggtgctctcctcactaacgtaattctggatgccttaatgaagggagtattttctgggccccctcagggggatgtgattggtgttggagaggcgtaagagtggtccctaggagctaaaagcaggtcccagatgggttgacccacataaatggatgaaatttatttggaaagaggaatggaaacatgatttttgttttgaatacagtcttagatcataggaaatacaagaagatataaatagattataaaagttaagaaaatgaaggtcatgtaaaggattaagaatagagatgaatcttggaaacatcctatagaaggaaattctctaggagaaagagagagtgaatcattaagcagtgccagacaggacaaaaatactaaagattgattgaagacaacagcaagacagtatagcagtagataaagcaaggaataggagaattatgagaaagcataagttgtaaataattctttgttattattatataatttttatcattatttattgagtgctatgtcccttggcatttttttttttttgagacagtgtctcactctgtcacccaggctggagtgcagtggcacaatctcggctcactgcagcctctgctcactgcaacctctgcctcccgaattcaagcaattctcttgcctcagcctcccaagtagctgggattacaggaatgcaccaccacgcccggctaattttgtatttttagtagagacagggtttcaccatgttggccaggctggtctcgaaatcctgacctcaggtgatccacctgcctcagcctcccaaagtgctgggatta

SEQ ID NO: 57319 - DNA, 1461 bp, Homo sapiens
catgtacttttgttgtgatacctaagaatctattgccaaattcaaggtcatgaagatttatcattatgttttctttggagttttatggtttgaattcctatattgaagtcatcaatgagttttgaattaatctttgtgtatgctgtgagacaagggaccaacttcacttttttgcatgtgaatatccagttgtcacaggactaagctgttgaagagaatattcttttccactgaatggtgttggcactcatgttgaaaatcaatcagccatcgatgtataggtttatctctggattctcagtgctattccattcatctatatgtctgttttcataccagtgccacaatgttttgattactatagctttgtagtaagttttaaaatgacaaagtatgagtccctaactttgttcttttttcattattgttttagctatttgggacctcttggaattccatatgaatttaaggattgactttttcagttctgaaaaaaagccattggaattttgatagggattgcattaaatctgtagattgctttgggtagtattgccgtcttaacaatattaaatctttaaatccatgaacacaggattcttttctactttaatttctttcagcagtgttttgagtttgtagtatacaggtctttcacttacttggtaaaagttatttctagatgttttattcttttgaatgctattgtagttagaattattttcttaatttcattttcagattgctcattgccgatgtatgcaaacacaagtgaattttgtgtgttgatcttgtactctacaactgtgatgaatttactaattctagtagttttattgtggattctttgggatttgtgttatttttgtttcctgactgttgtaatgcatctgtggtctttgcttaggaatcaggatgtaaaactatatatcattttccatttataacttcctaactaatcttgcctttgtacttgttcccttgtagtctgttcacttaacagctagagtagccctttaaaataattcatgaggtcatgccgtgtatgtacaaaaccttctacaggcttgtacatcagagtaaaagcttaagtcttgacaaagtactgaagagctctgtctgatctactgctgaccagttctttaccactatacctttgtttgttccaatcatagtaacttggctttcttcctagagcaatctatcttaaggccctttgtactttccctctctacaaggagccgtcttcccccaaacatcccaatgctttgttctctatttccttaaggtcatctccttaagtgtcatctcctgagagtcttccctgaccgccctacctaaaataacacctaacatcattctttatctccttactgtagttttccttcaaaccccttatctgactttatgcagaacagaaatttcctgaagataggtattttgtccgttgttcatcactga

SEQ ID NO: 57320 - DNA, 1029 bp, Homo sapiens
atgcctgtaatcccaacactttgggaggccaaggtgggtggatcacgaggtcaggagatgaagacaatcctggccaacatggtgaaaccctgtctgtactaaaaatacaacaattagctgggcgtggtggtgcgtgcctgtaatcccagttactcgggagactgaggcaggagaatcgcttgaaccagggagtcggaggttgcagtgagccgagatcacgccattgcactccagcctggcaacagggtgagactgtctcaaaaaaataaataggtagatagatagatagatagatgatagataatctaggtttaggttttatttatgaaaaatttctatgccagggctatatcattgagaatgaagacaaaagattattaattcaagggaagttatgaattttataactgaccaatatcttaatattctttcagctgtatttaaacttgaaacagatagaagtatatggcccttgataagaatctatcggggtggctttcttctgattgaattcctttttctactgggcatcaacacgtatggttggagacaggctggagtaaaccatgtactcatctttgaacttaatccgagaagcaatttgtctcatcaacatctctttgaggtaatcaaagcaagacataacacctcatgaatatagtttgcattagctatatagctatctggtttagtgggtacttaaatccatcctctacttgaagaggattattagcttaataactaatcatgtttcttacttttgttttattaaagatattttaagtaatggtaaaagtaaaaataacaatttttctctatctttctgtcttccccatcctttactagattgctggattcctcgggatattgtggtgcctgagccttctggcatgcttctttgctccaattagtgtcatccccacatatgtgtatccacttgccctttatggatttatggttttcttccttatcaaccccaccaaaactttctactataaatcccggttttggctgcttaaactgctggta

SEQ ID NO: 57321 - DNA, 2073 bp, Homo sapiens
tggctcacgcctgtcgtcccagcactttgggaggccgaggtgggtggatcacctgaagtccggagttcaagaccagcctggctaacatggcaaaaccccatctctaccaaaaatataaaaattagccgagtgaggtggcacgtgcctgtaatcccagctactcaggaggctgaggcaggagaatcgcttgaacccaggaagtggaagttgcagtgagccaagatggtgctgctgcactccagcctggacgacagagtgagactccttctcaaaaaaaaaaaaaaaaaaaaaaaagggggtctcctttgttgcccaggcttgtctcaaacctcctggcttcaagtgttcctcccgccttggcctcccaaagtgctgggattacaggcatgagccactgtgcctggccataaaattatttttaaatgagactttggaagattcagaaaactcaggttttactatgattacgtaattacagtaacaggataatatagttgtgtacattgtgtgctaagtgggcatttccccagtgtatcctttgtttaaatagcaagctgtgattcatgcatgactagttactcctattagcagaatgattgcccattgagtagatatttatttgtgcatctgctgtgtttttgctaataaatgaggacttgttgatggaataggttgacaatggtataagcagtaatagaataataaaatgtactatcagatacactgaaatatagaaggaataatttccttctatatttgtggtttgttgtttttgtagtaactgttataaacagaacagtgttatcatttgtagataattttagtattaattgacctgctgacttattttaatttaaatctcactgggaaaacttacccttagactgattcctagtgaattaacaagaatgtgttcactctagttatgtttttctgataccgctttttaaaagcttcatcctaaagtaaaagtacatttctttctttttttctttaattttttttttttttgagacagggtctggctctattgcccaggctgaagtgcagtggcgtgatctcagctcactgcaacctccacctcccaggttcaagtgatcctcccacctcaacctctccagtagttaggaccacaggtgtgtgccaacgtgcctggccaattttttgtatttttggtagagatggggttttgccatgttgcccagctggtctcgaattcctgggctcaagtcatctgcctgccttgcctcccaaagtgctgggattacaagtgtgagccaccacacccatccttttctttaatttttagtgagaaaagcacataggtcataatggtaggcactgggtgccatttatatccatatttatattggaatctatggaattgatatatgctatgctcctaaaaacaaagctaaaaaaatttataagaaattgatttattttgatatgaatattgtatgtcaaattagtatagattatttacatccattaggttatactttctctccttaaatctatatttacctcaatcagaaatctaattaggtagcataaacagtgcctcagattttctaaacaaaaatataaattttaactcactatattaaaagtaagctaattaaaaattttaaattatagtcctttgttacataatttagacatcagtttttaccaacagtctctttagttctatagtaaaaattttacacatttctattataagaatagagaggtgttgtcatttagtaactactttatgtattttaattttaaaaataacccacaagttggagctgctattaatccctattttataaatgaagaaacctacattcagagaagttaattaacttgcctaaggtcacatagccagtgaagtgatgaagatgagttatgaacccaggcagtcgtttataatctgtactcttaaacactaacatttaacacttagccctattagtcacttatgttagatgtttaactttgatctagtggatcaaactagtagaatataaaaatcaaatttgaggccaggcacagtagctcatgcctgtaatcctagcactttga

SEQ ID NO: 57322 - DNA, 1041 bp, Homo sapiens
cgctttccttcaccaagtagtaagaattgtttccagcccatttaactgcaaattgagttctctgattcctctagtttctcatctccatggcaacgtattattacttgagactgctcttctgttgagaagagaaaaggcttttaagttctgagccacatgcagccactccttttgaatttttaacctttttccaagaactgtcagtcaacaatctcacttccttttagtaaaatgcgttccatctttgtctttttaagtcaacatcaaccaacaccttagatgctgcactttttcatctgtaggttgtaaagagatgttactaattgaaattaatagttatttttaaatactttgcaaaattttttttcagtgatttttttttcttaattgagagactatattttaggagctttggccagtgctacaaaattgctgtcaatctaaagtgtgtctaacggtcataaaagatcagaacattgcttcaataaaccttgagatttgatgcagcagatgatatttataatataattccactttttgcagtagattctgtggttggagtaggattgataaatgtagccaataattttaccaccatgtaggcattcttgttaaatgatataatttaagtatgtcagtgaaggaaacacatccccaaagttcccataattttaactcatactgtggaatgctgttgttaagtccaggcatatatcataattcaggaggttgttactagagaatttataaattgggcaactgatttaatacatggtatttatgactccatttactaagttataaagaaccctttacttttcttccatcccaggtaaaaatgagtactgttttttggtcgaatattttagaacataatatacctttaactgcagttgacgcctgaacagcttggagattaggggcaccaacctctcacacagttgaaaatccacagataacttttaactcccaaaagcactactaatagttaccattgcctggaagccgtactgataaagtaaatggtctattaacacatat

SEQ ID NO: 57323 - DNA, 1407 bp, Homo sapiens
actggtaatcctgaatgtgaatgtaaattctaatcccagctctttcactaactagctatataattgtctgcaaccagactatagtggattcttgtttatgaggtaagtatgttaaactagattatctcttgatcttttcccagtctaaaattctgtgatggagagggaagtgtagattaggtcactaacattttctactctatcagcatgtcactagaaccttaaaattgtatttggaaaagtgtatggatgtgtaatattcaattggtaagtagggaaggccattttcaggtgtgaggaatggtgaattcaaagaatgatatgtagagtaacttcagatgaacaaataaaggggaaaaggggagagttgttgacagtgatcttttttacctaaactatagcaatacccccaatgtgagaaattagaatatatgaccaagatattagacatatttttataaatctaatttgaaaagaaaattaataatcagagagtagataggagctcagttaaaaatggcccttttgtgctcaccaaatatgtgtgttttatttctgtttacattgttcttgccctctgagagctataaaacatttgtttctttttttttttttttgagacagagtcttgctctgtcacccaggctagagtgcagtggcacgatctcggctcactgccagctccacctcccaggttcacaccattctcctacctcagcctcccaagtagctaggactacaggcgcccgccaccacgtccggttaattttttgtagttttagtagagacggggtttcaccgtgttagccaggatggtctcagtctcctgacctcatgatccgcctgcctcggcctcccaaaacatttgtttcttattatgataattgcttagataaattgtttgtatctttatataaatgttgatccattcccgcttttacatagttctaacatagtgatttctaggtaataaaattagtgaatataatttttcacttagtttctttgctgttacatattttcatgactctaaaaaacaaaataaatactttcctacattataatttgcaaacttataagaaagatgttctgctggatcaccacattcctttaattttaaaaaatactggccagacgtggtggctcacacctgtaatcccagcactttgggaggccaggacagaagaattgcttgagttccagaccagcctaggcatcatagtgtgagacactgactctactaaaataaaatgaaataaaaataactggatatggtggcacacgcctgtagccccagctactcgggatgctgaggcaggaggatcacttgagccctggagttcaagactgcagtgggctatgttcatgccactgtactccagcctgggcgatggagcaagaccctgt

SEQ ID NO: 57324 - DNA, 1036 bp, Homo sapiens
aaccagtcttaatgatggcatactctattcccttgtcctgctttattttcttcacagtagttatcattagccgattgattgtttacttgctcattgtctgtctccaccactagaaattacaccccataagggcaaaaaggctttgagtcattctgtgcctttactgccttatggcagacattcagtaaatatttgtcaaataagttgaaagaatgagcactctaaaactgcattgcataagtccctccctttttcatagtctagtcttgtttcccttacccccccaccaccacctccccgcaacaccatctttccctattttaatattcaagcccttaattctttgtttttgtttccatgagtggaaacttgatacactgggaggtttacaggtagcagaagtatgttacaatttcataagtactttgatctaccccattttgctaaggcgatttgtgtggaacttcttccgcctggagaatgaacatctgaataactgtggtgaattccgtgctgtgcgggacatctctgtggcccccctgaacgcagatgatcagactctcctagaacagatgatggaccaggatgatggggtacgaaaccgccagaagaatcggtcatggaagtacaaccagagcatatccctgcgccggcctcgcctcgcttctcagtatgtatggcttctacttctgtgaggcatatttcctttgagttttagcattgggtagcatgtaagctaaaaagctatcaggttgaaccaaatgaaattgccaatactcagccatttttcacctacaaaaaaacagtaataagcagcaattccatatgatacaacctatgactgtctaaatgagcacatagagtaaatgtcatcagtgcataacctagtaatttggcactaaagatccactgtctggaggaaaaggttgttggagagtgatttattaatacttgactcttctgtgtgttgtgtatgcaaataatttttatgttataaactttaggaatcctgccatctatgccttgaccaaatgac

SEQ ID NO: 57325 - DNA, 2519 bp, Homo sapiens
aacagaaaaaagtaaagtagtattgagtcatgcaggtatcagattaacagacattcattgaagataagtgaaataactttggagatagcagagaagagcaagaagatgttggacgttggcagtaagccgcagcaaggcagttaggaaagtacgtgagcctgatgacgcgaaggtgatgcctccatctgtccgcttagtggttattaaattgctgggaaagacctgcctttattttcctatcatcttttccccattactttgcattattcaggaaataattatttattcccaaatgcagttttctaagcagtgaccacaaaaatttcttattctaaggaaaataattaagaaaataaccctatctgtggcattgttttaaaatgtgggatacaaatctggtaagcagatttcaggtcattattgttttcttttaatggtttacatgaaattttcctctcaaaaaacaagtacctcttactgtataacatttgagtttttaaaattgagatagcttctgagagaaaaaaagaaagttgaatttgtagctctctcaactacaaaatcaccacacttttctcaaatctaataggaattcagtgtcattacagatacggtctctagtgaccaggtgaagacaattgaagctttggtagaacttctgcaaaagttaggtaaagaagaataaatccaatttatcagctttgttcatattctttttctgagtgatctaaatttttcttgcttgtgatcattagctaagacaaggagtgttaaaggttttctaaatgcaaacacatacgtttctgcatttcagaagtcagtcttgatagtaaatcctacaaactctcaactttctgcattgtattttaagtctatacaatgttagagcacatggtaatgtgggacagagttgattatatgatagcatgagaaatttgcactggttggtgttacaaaccaatgatctaaccagcatactctccaaatatgaaaaagtaaaaacatctcattaggtttggaagagcctaaggtagtccatacaggaagtttgcctgagaacagagaggagcctgttgattggcatggctcatgatgcctttcttgtatgaattatcaaaactgatactgagttgcccctagaaaacagccttccagaatatgtttgcttatttatggtggaagaggaagtgagaacaagatgagagtttcccttaaagtgaggagaatcattatacaactttgcaactgaagtatgtttccttgtagcaaacctttggtttattttatcgtcaaatcaaagccaccctcagttttttgtatggtgccatcaacctaaggaggacaatcaaataacctattgtttgccttggattcagtatatctactaagtacacagtctcgtataccttcaaaccagttacttgactaaacttccaccatattaccttagttcttcctatgccctttcctctgtgccaccacaaatcagagggaaagactgcagtacttctagaaagttgtggacttctaagaaagagccaggcttccatctcactatcccttgatcattatctctgaagtccctacctgcacttccctgattgccctgtagcaacaccagcatggtgggaattggagggaaagattgtggaaaatccctaaagggtcattgttcatgacgttattttgaattgtaaaattgtgagccactcacatttcaattacaaaaagaacagaactcttaatcacgttgtgaagattaatttcttgccattttctggattagcacagaagcttgtatcaatgaagagtatttaggaggggaatagggggaaaattgtatttttctgttcaaactctctccttctatttgtgtttccttcacccctctccctccaccacactgtgttggtcaaatgatactattctatgaaaccctgagctatagttgtcaaaagtaactatggattgtgattagtcctctgtgggtgcttccttccctcttttttctccctcactctctttctcagtctccactctggtaaatggaaaaggtgatgtcgaagaattgatgcttgcttggactcatgttgtatctgtgactatgctattagctgtctcctttttccttcctatatgggtagaattcttatgacttatgaagttcccttcttgataagtaggttaaatgcacaatgtggtactgttttatagtttctagatggttgtataaagcaaaaagttaatgtggttatgtgtttttaaagaaaataagtgattggtcactaaactctgtccttttttcattattacaatttctctctgttttccaacagtttgctgactcctttgtcactggtgaatggtttgtgtgactgtttttctctcttggtttcttgaattcctgaacatagttccccttaggactaattttcatatggggttagggcaaacagactacagtggtgaaatttttaaactatcctactaagttaaaagaagtttaaatggcttttatc

SEQ ID NO: 57326 - DNA, 1047 bp, Homo sapiens
gcgcagtggctcatgcctgtaatcccagaactttgggaggccgaggcgcctggatcacctgaggtcaggagttcgagaccagtctggcccacatggtgaaacccatgtctactaaaaatacaaaattagctgggcgtggtggcgcatgcctataatcccagctacttgggaggctgaggcaggagaattgcttgaacccgggaggtagaggttgcagtgagccgagattgcgccattgcactccagcctgggcaacaagagcaaaacttcatctcaaaggaaaaaaaaaaagaaataaataaattagaattttgaaggccatctttgcagaggagagccagagggaaactgtctgtgcctgctggttctcagcagtccctttgatgtggctgcgttgaaacggttcctttcctccggctgtggagtatgtctgggcacgtggagcatgcctgtctgtctctgcatcccgtccctccctcaggcctgtgcccgatgattatgttcagatgaatcctggctgcaggcctctgactggggtgtgctctgggtctcaattcaacccaggcaatggcagggagaagtcctggacatcattctgcactctgaccagttctcagttccaccccatccatgagtctttcagggcaacgtgacttgcaaaagcccacgcccaaggtctgtggtccagaatgcatctcaagggcccataaaagacattccccagaggatcagggaaggaagacacgtatgtgagggtggggaaggaggggaggggaaggaaggagagagaaagggagagacagatacagaaagacgaacacagaagcctgctgcggccgggctctgccgatggggggttgagtcctgtgctttgatctcctagctcaatgctgtttagcctggaaaaaagtctgcctgctaccacatttgcagaccacagcatgagttctcatgtctgttccatcattgtttcagcaaatatatactaagcacctactatgtgttatagatacgggggatacagcagtaaatggaacagaccaaatc

SEQ ID NO: 57327 - DNA, 1018 bp, Homo sapiens
gacagaagtcaggcgttttaaagcctgcctctgaagtgtgggtttgaaagagcactgatcttcaccgaagtacctgaaagtctgtggctctgaatttagtaaatccaatctttgtacacattccccctccctggtctgaggtgtagaatcccttttgttgcttcttggccaagccgagccttttctgtggggctgtcttccctgacagagtacatctgccatcctgactgtacaaggcgttttccctcagccctgtcttttacctcctctagatggacctttcactgcttgccctccctgtctacgggttggtggcacggggagggggcaggtaagaaggggcccctggggcaaacccagagaagtgtctgatgtgctgtgggagttgcaggtggggactaatgataaaccctgaaagaatgctgccagagctaggccagacactgacgtcacgcctgccattttggggagactcgggtaggtttcgcaactgaaattcgtgacacaaatatgacagcctgctgtcataggcatttattgtctgctggaaatggcctttgttgaggatgtgtgatctctatgttgtatccaattagaagcagaaggcaaagcctgctgttctcacaggctcatatagagtcggatgtgaaagccagcaagttaataccagcatcctgccggttcagtgcggggcgcaagccagccctcctcacagccccttggagcctggaagaagcgaccctctgctgttggaggatggcctgggacacggaggccccagcactcgccaggcttcatgtgcgtggggacccctgtgtgccatccagcgcccatgatggcagcaggaccagggagtgcctgggcacaacggggagctggcaccaactcaggcgagggtgccgggggccctgggtcactagagacccctgcccatcagagctccctgacgggtgacagggaggggctcccactgcctacaagggagcaaaaagggactctgggggagggtgggcggcag

SEQ ID NO: 57328 - DNA, 1059 bp, Homo sapiens
taaaaaaaaatatgcttatacttaaaatagtgaggtcttattcttgtggggctcacattggtctgctgtatgtaaacaggatgccattctcacctgtttatttggcaattaattaagggctcacggggaaactgtgctctctggtgttgaatccagaacagtaagagagttttgagtagaggagaatgatccctcagccctgaacagcattgctatgaatctcatgacggaagcccatgcttggtaacccagggtggaggtgaaactccaaaacagctgacttctgtagttatcatctttaagggcagactcagagggacttgggatcatttagctcagacccttattaaccatgaaaacaattacagctcaccccaacatacatggtagccatttggtgcaatgcattttggacttggccattaggaactgcaccttctctgggacgaccctaaggtacttacctgggggcagactgatgctaacttgtcatgcgtcctcctcaccactggcgacttgaagtgttttgccttttgcaaacactgaagctctgaaagttatagtggcaccttggtcaggttgttgcaatctagataaatttgggagttctttattatattaaagtctctttattaatacagattgaggggaaggggaagaggaagaaagaagcagcttggtttttctctgccataaacaaacatgttggtgctgttttccttcagacatgccctttgtgcagagctgcccttccctggggctgtgtgggcgttaactgtgcttagacagcgattgttccagctgcctgccctactgcttgggtttcacatgaacatttcatgcagtgcacctggtttgccaactgcagccagactttgtgcgaaattgtattttaccactttttaaaaggttatgagctgtcaaacctggaggccacttggttattcaggggtatgtttggactaagaccacccgggtttgttctttgctgaccaaggccctgttccctggcgttcgtggcaacccagcactccgctccagccaagctttctgtcagcc

SEQ ID NO: 57329 - DNA, 1040 bp, Homo sapiens
gtctcgatctcctgacctcgtgatctgcccgcctcggcctcccaaagtgctgggattacaggtgtgagacaccgcgcctggccagtctagggtcttatgtgaccagctgcagagtaagtacctctaagctatccatggtccctgccaggtctatagactctacagagagcaccgctctcatgggttcatgtgtacctgtctggtggccttgttccgtgtgtttagcctctgcccaaggcatggatgagttacatgcagttagtggtgagatcctcatgctgaagccagcctctgtgccccaagaagtcatgggctatgatccaagaatctgggaagtagaggtcttaccctcaggcttgggtggctctttgttgcattttgtgttattctgctatatgatcattctagtaattcagtccttttcaagttgaattcttttcaggttgttttattttccttttccggagacttttgtacatactgttgtcctgagtaacagtatctctaagctgagttactctgatcggagctactgaaaggtacctgctttcagcaaattctggtttggttttattttttaatcaaaaaaaaaaaaaggagagaaagaaaagaaagaccaccccctattagaagcaaaggccctgggaggagtaaggcctgtcactggggcaggggcactgtcctcaggggcggactttgctcagggatggcgcacagtgactgcgggggcttaagtccggtaaccctttggttttatttctttttattcttgatgggcaaaaagcctcctttaaaaaacattattcttaagaaacctgggagagaaaaaaatgccagtgagaggaagacaaagaaaaattagaggcagtacattccatatttcagaactttagctttccagacagtccaattttgttttgtttacaaattcatcttgcagtacaaggtgaagccaaatggtacaaagtccacagaattgaaaagccattcatatttatcattcaattttttgatcttcaaatgttatgaattctccaaaa

SEQ ID NO: 57330 - DNA, 1140 bp, Homo sapiens
tccagttcggaggagaactagctgctgccttgccttccgggacctcgtttgctgaggagggacttacagactccactggtgttttgctgttgctcattccatgcatctttggcagctcttttcttctgctcagacccttccccgtgctcagacagtgcaccgctgtcccatctaaagaaacctgtcaggaatacgagcttctgggtatgtttcgtttcccattgctgtagcatttcttatcccctgagagctgatgattattgaggacagaaggctcagaaacagtttgtgacagaaaatgcagtgtttcatttttcagggataaatgctaagataaaattgcttttccaggtcatttttttttgtggtaagaataactaatggaaaataatgaaacaccctggggtttgggggtgctaacaacttgtggctttaactgacaggagcaattaaaaagagcaagagggttctgcattggcatagcttagggaagggttaatgatgtcgccacaggtcagctcctgatccttgccgacttgatgttgctgtaccagggcttcctccccagaggtgcagcttgcgttttgagggtgattgctacatatgttgttgctaaacagctcagtaacacacttgaatgaatttggataccagattgtcctcattacagttcttttactcttagggcactctacactgggggttggggttgggagtggttagtacatttattacatttattaagaaacgtaatgacataaaaggttagctctgggccagacttctcttactctgtgggtaatggcaaggatgtgtaggtaaacttggttcttttttttccctaagatgacagcttgattttatcatctgcagtcaaataactgagccaatccaaatttaaatgatagatgctttaattgagtttaagtagctgaaactgctgagacactaaactttaaccttctgatgactttttaaaatgcctcaaatgtgcacatgtatataggatatttttataacttccctgatgaataatctgatattaaagtagtatttggacccagagccagaactcggtggtggaggctgctggtctctcctcaccaccttcttttgcacttggaaagaacagcaacatct

SEQ ID NO: 57331 - DNA, 1150 bp, Homo sapiens
atttggtggcagttctcttgtccagttctaagactttgatatccataatatttaaaataattttaagtacatgttttgccttgtggagagtttagcagtttattttcatagattgagatctttttgcaacgtgattctcaataactatagtgtgctaaaatcagtgggctttcaaagaaactttagtgaatcaatatgtctttatatttctatttaaatggaactcttattcctagtggttgtactgcattttcatacgctagtgaattctgttatcagtcgggccctttgtggaagatgccaaaactcatcagtggaaggactgctcattttttctacatgtctccaaattaaggaagcatcctgatgttgacagcatcctctgtgccctaggtttgggtattgcacagtgtgtgtatgacagggttgtgttgtttaattctcacaacagccctgcggggcagctgttgtagagttgggaccacaggattgtgagctgcagcagggctcccccagggcctgtctgggcccttctgtctcacagggcctccctgctctcagccatttggatggactctagtcaagttgtttcctgtgcctgctgttccaaattgttggtagggcagaaagtttcagaaaaaaaattccactttcatttacagaggagctgtacaaggtactttaacacagttactagttaagtaatcttacttgactaggtgtggtgtgaaattaatcatgctgtctcactggagcttgctttttcagctgtatatttcctgaagtgaccagcagtagctttcatctcctttccctcctcccgttgtgctcattgagaaaagaatgtgattattgtttaattaaatgacttgacttttatgggagattaaagcaggcaggctttgatctgtaacaccattgccaacaccttttttgaggatatgctaactaccagcagaaagctaagatccgcagattttaattaaagacttgagacacaaagcatgtaattattacgagacattttcaggggactggcaaagttgtgactgcatgcgaagtgcaggccaagaacagagcagcattagagcatcaggcacctaggcaggtgtaagatcatggccccgtcatttgcacgttctgccccttt

SEQ ID NO: 57332 - DNA, 1033 bp, Homo sapiens
atttctctcacgaattggagagcactcagtcccggctggacaatgtgatgaagaaacttgcaaaagtatctcatatgaccagtggtatgtatggcgtttaaagcttaagcatttgtacttaattctagaactctgtcttgggggtgttgtctcatagttatgcccatccagatccctttcttattttttacagatccctttctcttttttttgagacagagtctcactctttcacccaggctggagtgcagtggtgccatctcagctaactgcaacctccactgcctcctgggttcaagcgattctcatgccttgacctcctgagtagctgggattacaggtgcgtgccaccacacccagctaatttttgtatttttagtagagacatggtttcaccatgttggctaggctagtctcgaactcctgacctcaggtgatccgcccgtgtcagcttcccaaaatgctgagattataggcgtgagccaccgtgcctagctgatccctttcttatggcacattttttttttttgtgatgccttagaatcagagaatggaagacttgtatgtgcagtctttatcttctccttgtagctttaacttgggaaaagttaaggctttgtgatcccccaccgtgtttggtttttttcccagtagagtcactttcgttgtgtttttttttttttttttttttttttttgagatggagcctcactctgttgcccaggctggagtgcagtggcgtaatctcggctcactgcaagctctacctcccaggttcacgccattctcctgcctcagcctcccaagtagctgggactacaggcgcccgccaccatgcccagctaattttttgtatttttagtagagatggagtttcaccgtgttagccaggatggtctcgatctcctgacctcgtgatctgcccgcctcggcctcccaaagtgctgggattacaggcgtgagccaccgcgcccagcccagtagaataactttctttgcagttacaaaatccttctttattttactggttttt

SEQ ID NO: 57333 - DNA, 1047 bp, Homo sapiens
ctgatgttaggaatagtctatacctttcatgaatccaactcagaaataaaataagtgacctgttgtaccactatttggaagtattctttggtgtttaatggtaaatatactttatactaaaagcacatggttttttacatatattgtaaaaaagatgcaagcccttgaacacgtgcttttgtgtttgtaccccagggatgttctttattagtgatgtgactttgagaaagtatcatcgtctttttggacctaggtctcctcaaccttaaaatggaaatagtaccagcttcacagggtccttgtgaaaattcagtgataatgtgtgtatgtgtttagcactgtttctgacctgtggtaggtacctggtaaatgttaattcctttctctttcctcctattcaaattagtatccaggttacttctttttaagggaccatctttctttttattttattttctttatttttgagactgaaaataaagccaagaaatgcggtcttctttttaaaaagtaataataaattgtgtgttttgctaatgtatgaaatgttaactgtgattttgtttaaggatatttttcatttgttttcgtatcttctttctcattaggacatgaaagatcagatgtcaacttcatctgtgcaggcattagctgaaagaaaaaatagacaggtgagaaaacatcagaatataattatcaatgacagaaagcatacagttagatatttggaatttaaaaatgctgaccatccatggatcatgtaatcaagaggaagacttctgcttgcaggccctggtgtgaccatgggaggttttgtgacagtccaggcagcctgtcccagcaccctgtcaacatttccctcccctcctcttaccctctggtcttcttctctgggctccatagcaccttttgcctacccttactatagcacttatcacagagtacttttacttttttaatgtgtttattctgtacctattgaacacattttgtgtgccaggctctttgaagggctataattactgtctttctctctgctgggctcca

SEQ ID NO: 57334 - DNA, 1044 bp, Homo sapiens
tttaatattgctccaaaattttgattgactttatctttcaaacagtgtattctacttatgctttctcttttgtaggcaggggagtcagtgatactctatgcattttgtggttttttttttctttatttgcttcaacctgaagaagtaaatcgcctgtttcttcttgattaatgtccattggttatgcctttagtaagctttccttgtttagagttttgtgtatgtttttccaagcatcttttaagtctgtacaaatccagttttgctggcagtttttagtgaagaaccaaaatactcacatttttgtgtaaatagctttcatatttttgaggtaatcatttttactcttgtggagtcacctatacatcaaagattccacatgtgaaatttttgtgttttagaaatatatcctagaagtgactttggttttactttaggatcaagaggttttgcagtatatggcagaataatggtgaatataaggggtaagggaacctgagttctaggctaagctgtgaccttaataaatcttaaccatggtaagtcattcaacctccctggatctcagttttatctatgaaataatcctcactaacattctctgactttaaaagttagaactattaccctctccatgaaaaaaccgaacctgctccaatgtaagaattgtttacagtcaattgtaagtcaagatggaaatggctttggttaatcaaaaagggtgaagtatccagtgtgagcacagatgaccttgaaatgtaagaattatgagtgggaagcactggggtttatgatgtctcattcattcagcttggaagacagtgtgaaatgggaacagaagcataaataaccaggacatttgttgttcctttggcagatgaaccatattttattgggacttgttgcttgactgctggttctaaacgtcatgtgttagaaagaagatgagtaattatgtttttggcatgatagattgttataaaatgtttaaaactatttagtaacatagtttaagatcccgaattccaatatgaaggtgttgtg

SEQ ID NO: 57335 - DNA, 1085 bp, Homo sapiens
tctcttatttatgtttaaggagcacaaactagattatcttgaaagttctttccagatctgaaaattcagtgattggatttaagtagaggttgtgcaaggtaaggaggaggaggagtcaaaaatgactcttgtctagacaagtgttgaaacttggaaaatggtggcactattggctaaaatgaggaagctagaaagggaagcagatttttctattttgtttgttttgaatacattatgttttgtagggaggatatgattaatttggttttaggcaaatggaatgatcctataggcagctaaaaatataggaattaagcctggctgagtggttagggttggaagtatagtgggggagtcatcagcttaagaggggtgctttgaacttgtgaatgctgatgagcacatagaggccacaaagagtactgagaaacattgggatccagtggaggaagaggaaggagaaaactggtagaaaactagaacagcacaatgtcacagagacagagaaagtgagagtttcaagcaaatagatataatgggccatagtgtcaagtgcaccaaaaatgaggacaagttaaattcactcgtgactttgacctgcagtgtcattggtggagttgtggaagcagcagtaagttagggtcaaaaattgtatataattgtaggtaactgagtaaaaatgatgtttcattttcacaagagtaattacaaaatatgtcacagtgtggttgaatttggaaatggcaataaagtcaagtaaagggtgtgcatgtgtttcctttcaaatacaaacgatgtgaatgtagaagtcaagcaataaaaagagttcctctctttctggagagatgagtggtgaaaccaggtttgtggggtatggggcaggaaccagttggagaagagtgaggagtgggagtctgatgtgttgcagaggctcactcaacctgaatttttcatgtttcattactagaatggaaactttcagccttgactagcctcttttactgtattgatgaaatggggatccctctgtaaagacttgcagagtaggtgctgtcccagataaaagagttgtggcagattgtatt

SEQ ID NO: 57336 - DNA, 1019 bp, Homo sapiens
ctttgtagttcgcgttgacgggggtgagctccattgtccattgagtttggagcgcttgtccgcagactggcgagaccacaacaagcccagaggcgtctgagcacgtttgctgggagggaggcgggggcgggggccgttctgggaggctggggagcagggcaccggaagacaattcaatgggggagtttttactgagtaatgtgaggagaggaaagcagtcgttcatactcagtgatgatttggaaggaaaacaaaatgaaacaagccaaaccaaactttcctcagctttctattagcaaccggaattttctcacagtgctaaaggaaatgagtgttgcttgttaactccttgatttcatccaggttgtttgacaggtttctcctatttcttctgcctttcagaatagaaaggactgccttctgttcccttacaagctatcctagctcatctttgattgctcgattgtttctttggagatagagtcttcaactgcactttgtaatatccacttcgtagccattaaacacatgcaagaagatcaattctgatgtaacttttagtttcttattagaaacttgtcagttttctgttttaaatgtcaaacatgaaaaatctgaaaactgcaaagttcccaggtcagtactgatcaccacagaatgtcccttgctttttactagttgctgctagcttcctatttctgtagtggtgcaagctggccgttgtatagtcaagtgttgtagaaaatttaaatggtattttaggtgaaatactttatcgattatgcagtaaaatacatttatactacttcttaatatttccctggaaagttttttttcttcaccttactctaatttagatgggaaaatgctgagttgtaaatttactggtaatatgtgtatccctacctagaaaatgtgatatttattagaaggattgatttaggggttaatttttaaaatagatgttttttccttgattgaaagttcttaatgcttaggttggcaaaggttatctctgg

SEQ ID NO: 57337 - DNA, 1037 bp, Homo sapiens
cccggctcgaccccgctcaagaagccccgccggaacttagagcagccgccgagtggaggagaggacgacgacgcggaggagatggagaccgggaacgtggctaacctcatcagcatcttcggttccagtttctcgggactcctacggaaaagccccgggggcggcagagaggaagaggagggagaggagagcggtccggaagccgccgagcccgggcagatctgctgcgataagccggtgctgagagacatgaacccctggagcacagccatcgtggccttctgagcccttggcccccctgcggggaggaggtggagcagcgggcgtccccgaagtgagggccaggcccttcccggctgcgaggacgcccagagaccgcgggcgctgagcgcgttgggcagactggttgcctctgggcatcgcaaactgcccccgggcgcatctggcttatctggagacctgggagcttgaggctcattggaagaggacgatcgttaacttttgtgtttgtgtatgtctgtgtatgtaagtttgtcttgtggcattaagactattttgctcttctggaatgcaccactccttccccagggtttaagagattgggggcagacagggactttcctctgccggctgcgtggagaaggaagcggctaaaaggtttgggccggggagttccccattcgttctccggggagggagggactttacacctacccctcaccggaaagctagacccgcttcagggccaggagtggcgtttccgcacaggatttcctaagacgagagggatttagccaagagcacagacttggattccttctgtccctccccacctttctctcccaatgaagaaacgtttatatcctgtgattactctaggaaaggggcgtattaacggtcctttgcttccccgcaggggagaaaaagcttgacgaacttcacagaagagttcaagcttggaaataatggagtttatagagaaaagatatatttttaaaagctctaggtcagaagtactacacagtgcttttaaaaag

SEQ ID NO: 57338 - DNA, 1075 bp, Homo sapiens
tgactccacgaccaggcacattgggcctatgcccccgtggcccatttcagcatggagagaagcagaaacagagctgggccccgggttttcccaggagcctggagcagggccctcccctccctgtctccttgctcagcagtgtgcttggtgccagctggtgcccagcacaggactattgcatgaatgaaggaatgattgggtgcattccagaatgccatgcttctcaggaaggaggagaagggagtgctctcccttgttcttgggtgtctttcctaaggtcaggagaatttctaccatcatccaattcctagcgctctctccatgctcccctccttctcttctcccttccttggccccttttctagtctcttacctgggagatgaacatattattttacttttgctggctttgggatcccctagagaatgatccattcaacacttattcaccaaacacttatcgggtgccttctctgtgcttgccaagtgtgaggctctataggtagaaaaagaatgaggaaatgcacctgacccccaggagctcatgcacagggggcagcctgacaaggcaatgggttacaatggcatttgactggaggtgagtgcagtgagggacaccaggaagacttggatggatgggactcagggaaggcatcctggagaagatgagagctgagccgaggcctgagcacttgcatgaccctgggagtgagtgcccccttacactttgtgtccttagtcccagctctggtcctgaggatgggttggagttggtgggggaaaggggaagacagtgatggggaacagctgggaagtgccttccaggtaagggaagcagcttgtggcagaggcctgaagtgagccccatggttccttcatgtccacccctctggagggggcgccgtgtgtctgggacagctgctagttagtgcctgtacctcatcagtcacacccaagagccagaccattgtccccaccccccttgttaccagtactctttttggggagagaaggtagctcaaggtggcaagggactggctgttgtgggctctgacagcttctcagcctgtctacc

SEQ ID NO: 57339 - DNA, 1014 bp, Homo sapiens
gtgacttgactttgttgcacagcccttggggactcccaaggcggaccacatccattgtcttttttggtcttgtccagggcaagctgctgtgagtctcttggggaggcagactttttagaaggagtgggtggttcaaatcagagaatgttctaggggagactggagggagtctttagtttcaaactggaatctgaatccaggctgtcacctgctttgtagtgtttgctgatttctgtgacccatctgttggtaggtttcaagccaccagtgagataccacagagcaaacagctgggaagagaggcccagaagtgactctcaccaggctgtgtggtgctcccgcactccgccggcagtgtctctccctagttgtatgacctgaggcaagtgatttcaccaatgtaacctcactttcttcacctgtaaaatgggccaacaccacctctcccaggctgttcgtgtgaggattaaatgacttagtgttgtctcccacttaactacaattaattacatttaatccttagaatggccttacgcattctaattatttgattttatgtcagttttttccaatgaactgcgaactccttgaaggcagggactatgtcacatttatctttgtatccccagtgtctagtacagagcttggcacatagtaggtactcaataagtgtgtccctttcaaacccaaagctatagtcctgtgcgagtgaaacatgtggtccacccttcagcctgggccttctctgtgagcctggggagggtggacctgtggacccttgcacggatccttcccaaggagcctgcatggctggttgagatttcagcttttcaaagtccttcctgggaaccatgtgccgtctgagggctggctgttggaggatcaccctgagcacatcccctgggcacctggagccccctgccctggctgtatatctgtagaggacagtttaggggtggggtctgtatcacagacatgagcaggtccctggctcctcccagcttctcaaaattt

SEQ ID NO: 57340 - DNA, 1032 bp, Homo sapiens
cagtaagagaatgcacttttccagagcttcctttgcaagagaggatccatctcttcaaacaatctaccaccaggctcattcctaggtgggcctaagatccagaaactaccaatctattaacatttttatataaatactgctatggcatagcacttagccaaggaagccttcaataaatgtttgttgtttacattatcagagaaaggtcactactatgtcactggctaaagaaagtaggtagaaggctggggtgtgaggcctattaatcatagtattaatcataggtattaaaggtttgtgtatgagctgcctcactcctgcagtaaattccaaattacttagttcagaaatatcctcctcttcctgatgccaaatgcagggcctttggggtggtcatctgaaatgctatgtcctggaagctgctgagtttccaggttcttcccttctcttggaagaggatggttgggaatatacttagattatctgtgtcattaagtgattcactcctccaggaattgacaccattctttacaaaatcagcctgagataagctatgacatccccaaaattccttccaaatttggaattttatgctgtgaaccatcacacccaatattgaagttaagcagtttttggttaaatgtgctaccttagagggtaaaagagctcctccaacttatgactggttatttgtcatcaaggttcacagctgaattcagtgttggagaagttggaaaaagatgaacaagctgttttgttttgttttgagacagagtattgctctgtcgcccaggctgcagtgcagtgtcgtgatctcggctcactgtaatctctgcctcctgggttcaagggattctcctgccttagctttccaagtagctgggattacaggtatgcaccatcacactcagctaatttttgcatttttagtagagacggggttttaccatgttggccaggctggtcttgatctcctgacctcaggtgatctgctcacctcagcctcccaaaatgctgggattacaggtgtga

SEQ ID NO: 57341 - DNA, 1009 bp, Homo sapiens
ccagggagctctcctcgtaaaactattccccgtgaaggcggcagggcagaggtccagggcgggctttgctgggagcctcgggaccccgggttgggggccgtggggcggcacctggcgagctggcgggtgggcggcgagccgaggcttcccggcctggcggcaactcgcccctctgccctcagccctcccggctccgctcccttcccccacgccgccctgcccctcccccacgcccctttctctttctttctttctttcccagttcgcttgcccccaccccagcggcgcccgccgggctcctcgcccaatggccgcggggcccgggaccgcatcagctgatcggcccgggctcctggccgctgggagccaatcagggcaccgggggcggccccgggccgcggataaagggtgcggggctgctggcggctctgcagagtcgagagtgggagaagagcggagcgtgtgagcagtactgcggcctcctctcctctcctaacctcgctctcgcggcctagctttacccgcccgcctgctcggcgaccaggtaagcccccggacggcccggtgtcacgcaagcgaggcgcgccgcccctgctaccccgcgaggcgcgccgcccagcctcttttttcggctgcctgcccctccagtcccagccctacgctgcggcctctccggcccatgcctgagatccggcatgagtgctcctcccgcgtgcttccgccgctggtggcttggacccgtcggggctggcgctggtggggcgcgcccttggccaggctctgggaagggcggggtgagttgttttgatcttcttttcactacttgcggccgaagcgccgcccctggaggccgttgggccggcctgcgccctggggctcgcagtggtttgtttgcgctgtggatggagtggcggtgcggtcccctgtggagcgcaaacaaggcgcttggttggcgcgggcgcctggctgccttcctcgtggtggggccttcggagcaatcgtcctggtt

SEQ ID NO: 57342 - DNA, 1410 bp, Homo sapiens
actcctgggaggagtgaggtcaattcccagcttgaaagaacctaagcttggccaaaaagatgaggactctgaaatagctgttgctcctgaggggacatggagattggccgctgtagaccaaagcccccaggctgattctgaccctgtcagggtaggtctttcctggagagttttacagggtgctgcactttcaacccagtgggtgagactctccacccatatgtctggcctcctggtttggtggcatcagatttcagctccctccttgactggtggctagtgcaaagagttccttaggcgaccttcttcttggcctttcctcctggccacggcctaatccctggggtcatcactttgcctctcctggcctggactgacttttttatttgctgcgtgacatagcctcagacccaaagtcccagtttccagccaggctgtcagttctccctgtgtttaaagcattctccctttcctcaatttatctatattctgtccatacatttgaggcccagctcaaatctctcttcctccaagcagtctgccctaacaactgtgacttatatgtatcttttactcttcataaaactaagtggtatgggcgatatactgccttgaagaggtctgtatgcacacatctgtgccttccctccctaacaagcctacaaattccttgagattcctcccatcatcttgtttgctaatagcgtgcaccactccttccagggttacccaaataattagtaagcatctttggcttgatttatggcttttgtgcaggaccttggacggctggtcctctatgtggtaaagaagggaagcatctcatttgaggatctgaaagctcaaagtaatgaagaggtggttcaactttctccagatgaggaaactaaggacctcattcatcgtctcttccatcctggggaacatgtgagggactgtctgagtgacctgctgggtcatcccttcttttggacttgggagaggtaagtaaaactttgtgcagatgccacaggcctccaggatggaaagggtaaggtggtgcagacagaagtctgggctgcaaatcaggagacccaggcttttttcttagcttgggatttactggctgtgtgtccttggagagatgacttaacctctctggagtctgcttttcatttctgaagaataaggaggggaaaaaaagagatgcttgcctctcctatcatgcagaatttttgaagacatggttgtattacttttattaaaaaccaaaatctagccaggcgcggtggctcacgcctgtaatcccagcactttgggaggccgaggcgggtggatcatgaggtcaggagttccagaccagcctggtcagcatggtgaaaccccgtctctactaaaaatacaaaagttagccgagtgtggtggcaggtg

SEQ ID NO: 57343 - DNA, 1066 bp, Homo sapiens
cacgtgcatccagggctaggacagaatccaagaccacttgaagttttctagtatgcaccttgcctagaaactctttcatattggctatcaactgtaccaaactctggagttatgtgtagatgtaatctctatttatgaggaccttatttccttgggaaggtgtacaaaacaaatctttgagagtcaggggaattgaaataatttttggacagagacgagacaggcttagagatattgactgaggactaaagagtccctggctttgatttctggttgctgaattgtgctctagaaagcactactgcttaccctaagtccaactaagagtttgaggtgtcagcttcagcaatcaccaagcaagcctttctgtgaattttatgcagttttccatcagagttctggctagaatttgtactatgctttggtttgttgattttttttcttactctttttttttctttttgtcttttagtagaaacttctcagaagatgtgctggggtggagagagtcgttcgacctgctgctgagcagtaaaagtgagtaggagccttttgtgtctgtctctgggtggcacatgtgtactcatgtgctttggagccagccccaggactgctgagagcctgggcagaataatagtagtagtaataataataataatgatcccctagtgtgccagcctctattcaacatataaaggcaggtcattgttcaagaaaattatgttctaaaaatagagccattaattgcaattgctttcctttcttcttgtattccctgctgtccctccagctgacctatttcctcttctttcccgcaaccccagatggagtggctgccttccacgctttcctgaagacagagttcagtgaggagaacctggagttctggctggcctgtgaggagttcaagaagatccgatcagctaccaagctggcctccagggcacaccagatctttgaggagttcatttgcagtgaggcccctaaagaggttagagcccccatatgcccagtgaatcctcacgaccctgcctgctccttcccctctgagaatcagggctagagg

SEQ ID NO: 57344 - DNA, 4724 bp, Homo sapiens
gcaggtctggcgcgatgcccgcccggctcagcccatctccctagcaacgaaacccttccgcgccgcgaggttgctgagccccgccccctccattggcgcgccctcgccatcccccgccctggcacgcgctctgcgcatgcgtacgctcgctggccccgccccctagcgccgcggtcggagccatttcgccgattcctccatgcgagttgctgtgcgtttctctgttgtctcggtagaaggccagagtcacacacggtcctaagagctgggcaccaggaagcgaaggctggtaagggagagacgttccggctaccatgcggggcggcggggtcgcgggcgggcgccgtggaccatggctccgcagccggctttgttgcgaagcgcgggcggcggcggcggctgggggtgggggaagggacgagccgcccgcgggtccccggattgcgggttgcgtgcgcgcctcgccgcgatgcgcttgcgccgtccgggcagcctgtggccccctcccctctcctccgcccagcgtttcccgctgctgcctctagcaggcaaagcgcgcttcctcctctggcctgcgtacgccggggcaccgcggcggctgagggaagggggtgcttcgcctgtggtggttgccgccggggcgccactggcctagggctcttcattcattcaagccacgaataactggcgccgtcgtgcaggccttgtgggtagaggaaaaaaaattgaagaatgtaaagggagagcgcctttggctagtatagcgaggtaaggcgtctcgaaggagggaggctttgagctgataacctcggccaacgcgaaggaaaagcagagcctgcagaagcggaagggattagttatcgcttaagggcagaaactgggcgggagctgaaagcaggccatgtgactggagtgtggcgagaaggccttcaaaggagaatgggttttagggtggcaagagtggaaacaaaaaccgtgtaggacaatatttcactagcccgggtgtgcagtagtggtggcaggagagatggggagaaacgaatggataggggacgtattttgaagcagaaatgcgtagtggtggaaggtagtagatctggagtcaggctacgttttctggaattcttgcgcctttttttttttttttttttttgcaagagtctcgctctgtcgccagactggagtgcagtggcgcgatggcggctcacagcaacgtcggtctcccgggttcaagtgattctcctgcctcagcctccggagtagctgggactacaggcgcgcgccaccacgcccagctaatttttgtatttttagtagagacggggtttcatcatgttggccaggatggtctcgatctctcgacctcgtgatccgcctgccttggcctaccaaagtgctgggattacaggcgtgagcctccgcgcccgcccgaattcttgctcttataattaggagctctgtcttcctgaagcaagatattctttgtctcagtttccccttctctaaagggatagtgatcttacctgtacaaggttactaaggattaagtaaaatagttccatttagatgatctattatggatattgtttgacacacattaagggttctacaagggatagctatggagaatcttaagggagtggacgactctcaacttgtgccaggagtaacttggtggatgtcgtaccgtttatggaaaccgaaatgtaggggtagggtgttggaacagatttgaggggaaatttaaaattctgttttgactgagatgccaagttagcatgcaaatgggtgagttagtgccacagttggatgaacttaattttggactttaaagagaaacgacgggcgggcgcggtggctgacgcctgtaatccagcacttcgggaggttgaggcgggccgatcaagaggtcaggagatcaagaccatcctggccaacacggtgaaaccccgtgtctactaaaaatacaaaaaattagctgggcgtggtggcgggcgcctgttgtcccagctactcgggaggctgaggcaggagaatcgcttgaacctgggaggcggaggttgcagtgagccaagatctcgcccctgcactccagcctgagcgacagaacgagactccgtctcaaaaaaaaaaagagagaaaagactaaagtttaaatatatgtatttgggcatcgatagcatgtagttggtattgaacattatggggttgtaagagactagggagacaggagtttgatagtatagtccttcgtatttcatattactcattcaccatgagggcttgttgtttaattattcacgaggtggaatttccagataaacattttcagctttccacggcttttttgttaataggacattcccttcgccaaatggatgaccagagttagactgtggccactcagacgtaacaaatttatgctaggggtgcagtttgatgacgttagacttaggtgctaacaaaatgcatcaaacgtgaaacgtgaagcagacggtttaatgctggtaatgggatttcttctcacagcaaactaaattcatagcatattttattttctctggttataaatgtggtctcatatcttgcttacagtttagactcagcatttagactgataggctccatatcttgtggtattttatagacttgttgcacttcaagaaaactttaatatcctcaaattttaataaaaaggcctaaaggagagatttggtatagaacatttaagttaataggttaccgtcttcagtactgagtgcttaatgtatttgaactttattatattattaatacatggcctacaactttggggacaatatgctagtggtcataatcagaatgagaataaaacattgaatttatatgcaaatgataactttcttaatatatagtagtttggatttgaatttaggcctccacggtgggtgacttggaagttacttttttaaatcttagtttcttacttcctgaaaagacaatgatagtacccaccatatctgtgtgccattgttgtgaggatgaactgagttaaatatataaggtgcccgttgtagaatatagggccttatataaaatactttgtaagaaaagataaaaatcactcttagtccccaaagataaccattttagggggtatttctttccagtcttgatcatgtatatgtacttttcatgaagttcaaatcataccgttttgtatcctttttcttacaacatataaacgttccaattatgtcgttaaaatttatggggagtcttaatagcaacatgatagaatatcctatgtttaacccagattcagtaatctagataattggttcctcccagtttttgctattataaatgctgtttttaactgacttttgttttcttagatctgaagaagacacttgaatcatgggtgacgttaaaaattttctgtatgcctggtgtggcaaaaggaagatgaccccatcctatgaaattagagcagtggggaacaaaaacaggcagaaattcatgtgtgaggtactgaagaatacagtttgcatttatgtgatttatgaggttcattttggggttaaaagaaaaatgttttctgtttggagatgttaatgtgttgcacattaggaaacgacagttctttattgtgacttgactgctattgtaaatcattttcaagtcagcattacttttaaaacaatctgacaggtaaattattctaattagagcctatatcttcctcagcttcctcagtaccagtagtggggatgggaaaagttggatcaactgtttgcagttttataagcacgtttagaaagcagagcaattcttgattgcttcaaatcaaagtgcttaaatacaaatggagagcttgttcatggatattacagaatcagattttaatgtgaaccttctgttatatgagaaaaaaaaatctgagccacttaaattatttttggatacaacacaatttaagctttttcagtagctcatgcattctcttatttttatatttatatttatagagtatatttcctaaagttagctgtttgttgtctcttaatggactactgaattacgactttttaaaatctcagaattacccaggtcagtctcttagtacttttttttttttttaaaggttcaggtggaaggttataattacactggcatgggaaattccaccaataaaaaagatgcacaaagcaatgctgccagagactttgttaactatttggttcgaataaatgaaataaagagtgaagaagttccagcttttggggtaagtacctatggcgaagcacttgagatgtatgttgtaaagttgtacaaactcaatatgcgtaagagactcaagatagtaatttttcactgttttcagatatatcgtgtttcgtaatgaaatttggcatcttgttttgtctcagcactggacaaaatttctgaagatgtggattgcatccttattatatacctgtcttaggggcttgagaaattccattaatctttgtgtcttatggctttatttcatgtatttatacaccagaaatttcagagtctgttatgttccattcattaccaatgataatactttaaataaaatagaaaaatcagtaatattttagacatgtttgctcccattgacactccccctgccccgtaagcgatgaggtcttgctctgttacccaagctagaatgcagtgacacaaccatagctcactgcagcctcaaactcttg

SEQ ID NO: 57345 - DNA, 1030 bp, Homo sapiens
aatacgtagtactaatgatcttataagagaaaaatatctattccgtgatcatcttaataaaggcttttgaaaaagtatttgataaaattaaacactaatgaccaataaaatacttaagaaatggagtagaaagatacttttttgactgctttaaaaggtgttaaggtagtaaacactactaaaaatgagccccagagcagtgttactcaaaatgttacagtttgtgaggaggtaagtacagaaatgagtaaacatttagaaatacagtattgtgacaggttgttcccagtggattaggggaaacaaccagttcttcattgcagacattttgagatgcactgctctagagacttaacctctaaacaaagatggtaatattacaaagaaaggaggtatgacacatgggtccttttaagtattaaaagaatttactagtccccgtgaaggcaaaagcactgacagctgccttgactttttcttttgcaggtagcatctccgcccccacttactgatactcctgacactacagcaaatgctgaaggagatttaccaacaaccatgggaggacctcttcctccacatctggctctcaaagcaggtaagggacttgaatccatgcacgtggtggagaataagatatacacaatcttgatcaccatctctgtttctcgttttgggtagaaagaactgcagtaaactcttgatgttaagagacaacccaaggccttcataaatttgcacatattaccagatcatttatttttttcttagaacatgtggtacagcatagttctttgctgtcattggcttttactacatttttctctgaataaataggttttccacaggctagaatatttggtgaaagaatcttatgaattgccttttcttgttccttattcttactaaatatattgttgacttgtttgtttaccctgtggatccaggccattgcagaatgacttacagtaggtccttgaataactttgtttccttcaatgttattatcttacaacattgcttatagtct

SEQ ID NO: 57346 - DNA, 4071 bp, Homo sapiens
acagcttttattgggatgtctaccatatggtagattaggatttgggtcatattgcttaagtctcatatttactgtttattgaatagcagtagtatctacttcatatgattgctttttgaggcagagtcttgctctgtcacccagactggagtgcagtggtgcaatcttggctcactgcaacctccacctcccaggttcaagtgattctctcacctcagcctctctagtagctgggattacaggcatatgccaccatgcccggctaatttttgtatttttagtagagacggggtttcactatgttgaccaggctggtctcaaactcctgaccacacgtgatacccacctcagcgtccggaagtgctgggattacagatgtgagcctccatgcccggccataaattaggataattctttaatgtatttaggatttttctacagttatgactcattaagagaattttttttcttttaacagaaaataattctgaggtaggggcctctggctatggtgttcctgggcccacctgggaccgaggagccaacttgaaggattactactcaagaaaggaagaacaagaagtgcaagcggtaaggccagcaccgtaggttacatctctgagaatgtgatttgggacttagttaacagcaaagcttaggattaggatattcacaagttaataattgggtgcatcttttaagaggttatttgagactacttattagcacaagtcatcataaagctaaactacccatttactcttgttattcacattgcctatggaggaaaaaaacagtatttttttcttggtagtaataaaaagatctcctcttcagctttataggaaatgtaattatctcaggggaccttattttatgagcacttagagtaaaaaaaagtctttagtatagcttatttttccacttcatgtattcagtgttaaaacaagcacaaagaagttgtcattttttttttttggaagaatttaaatgcaatgtattaactaatagcttgtttatataatagggcctttagatgcaataaaaagtaattctggttcagtttttgactaggattataaactatcaaaaacagcttttgcattataaaggatagtacaaagacagtattaaaaatttctgtgccttgtttgtatacctaaacttaacacagccaaatttaattatcattgattctacagactctagaatcagaagaagtggatttaaatgctgggcttcatggaaactggaccttggaaaatgctaaagctcgtctaaaccaatattttcagaaagaaaagatccaaggagaatataagtacacccaagtgggtcctgatcacaacaggtttgcttgtttcattcttttccttctgtagtaagttaaggtggttttggatattcactgttgaatataatctatttttgtacgttgtctggttaattgtgtggattagaattgaattgttaaaagataacgttaatttgcacaagaataattattgatttgtgcagtttccatggttttcacatgagtgaattttagctgtgtaagaagttcagcgtaaatctttttgacatgctagacatttaagatgctcatttgaatctgaaaggcaaaagtcatgaccacaattgctggtttgtccctagttgatgtaaaagccagccaaaggtggtgattttttttttcaccttggtattgttagaggcagttactatttctttaatgggtcaggttagatacttaagctttgagtcccagaattagattgtattgcatctacatccacatttcacttaagccttgaaaactgccagctttcctaggagtcctagtgaaatttaagggcttatcgtaaggtcgaaaaggaacagccttggtctttgtatgtgggggtgtacttttttcctgttaaatgtataaaacaatataaagggaggtcattttaacagtatgtttctcagcctgcttgctgttcttcctgagagcattccagggtgtagtaattattactcccaggaaggctcatatggattagacttttctggggagcgatgtatttttattagaacggaggggaggttgtaatggaaacctttttgaatgattccgtttgctgtccgtacttatgaaataaattatccaaatacattaaaaatatttttctcgaaaatcaaagtgttctccattggatgcatctagcgaccctgaaataattaatattaatacaaaattttgtcactgatcaaaatgatatttagagcatggttcccccttcctcccactgttttgttcaatcctgaattctcagatatttctggtgtcagcctttttaaaaccgtcaggttgcaaaggagtgatacatttgttgatgatttgttttctttcatattttgtctttctgaacgcattgggcttggtagcacttggtgactttaagaacaatgagataccgaagtgtgcctgaagctcatcgttgcagacattttttgttatcagtatcttatcatagatttctgatacaaagcagtgaagaattcaggaaaagacaatgtgggaggcacagacagttgggggagccaggacagcattgctctttgtatgtccttttatttaaaggcataacagacagcaacaccagaggtctgtgttcatacacacatgtgctgctgcttaggctgaactaagcaatcacatgggaaactattgtaaactgatttctggtgtcgctgttccccctaggtggaggagaatgagattgagtgctgactttaagcctggctgagaaacatactggcatcgatgtcattaatgaaagggtggatgttgttcccctgaaagccagtggcctttgacccctgaagccgctgtgcctgaaggtcagttcacacgaggtataggaaggagtctaacatttatttttttcttaagcctcacctagccttttattcacaccaccaagtctaggttagaatgtatctgagcagtgaaaggaccagaatgcatagttatcaaagggcagtttttcccttgctaaaacctaaattcattttttagactctgctagcagttttagatataatgttacaacatgtgttttgttctccaggacctgatttaaataaatgtgataaaaataggctaagttttttgtcatccagggctgcttccaactgcaggcagatgtgagaactctgcctcaggagccactgatatgcacaaagtgtatgtgcatgtgtgagtttgcgtatattagcttaatagatcgcagtcattaatgggtggcctatgcaaaggaatcttaaaataattataaccgtaatgtaaaacatttggggcctactttatttcttggctccaagctaagtggaaaattccttttcattgaatgtgttctagctcttgagactccagcctttggaataagagtaagtaaatataaaatctaataccctaacgttttcctttcatgaacaattggctcatcaactttgattatagttgtcttatgccatgttgtatattatttgaagtttatatacttcatttgttctagggttgggcagaaataaatgttggtaattttttttttctgtgatttgcctaagcagttggaaagcctgcctgacttgggagacctggatttgctggtttctaacagtgaaatttctaaccttgcttgtatatgttgttacaggagctttattgcagaaatgaccatttatatcaagcagctgggcagaagtaagtgttactgtttccccaatattccaagtctctgtatagagaaggaatcttcacattttaagtcttgagtcacgtatacagaagctgtattatttgaaagagcacataatgtaagatagcatctagggtatattttagaatattagtaattatataaattagaggcaaagtctcccagtttgcatgtgaaaacagaccatgttagtgtaatctttcaaaggtaagacacagtgggatgattaggagtctgccagtgtcaattaattttaaaccttttttgttttttgagacggagtcttgctctgtcgcccaggctg

SEQ ID NO: 57347 - DNA, 3049 bp, Homo sapiens
actgctttcacacattaaaggcagagttgagtagttgtgacaagatactatatggcctgcaaagcctaaaatatttattaattgaccgtttatagaaaaagtttcccaaatcctggtctaggtaaccactctggacccaattacttttactggtttattttttactctttgtcttttcaaactatgttttcttccccattttaatgtctgatattaacagtgacaactttgttgaaataggttatttgctttcataatattgatttgtatgagtcctagtatcagccagtaatcaaaactgttggttatttagttgataagctgtttggcaatttcttttgtttagcagatattaatagaataaaaaggaactagaagccatggcataccctgtattttagggcttcttgtgtacgtaagcccatagtttcttgtgataagatgtttctttactcagatgatttctttctgtctgataatcctgaccttacattatagggatttttgcacgagaacatggatcaaataagaaattggcagcacagtcctgtgccctgtcacttgtcagacaactgtaccatcttggagtggttgaagcttactccggacttacaaagaagaaggaaggagagacagtgagtctttagatttaatagacttgtgagatagtgtgagattcaatttagctcttgtttagtgtttggctgaagaagtttaattttaagaatcttacctcaggaaatgaaaatggccctgctaatcatctctgtgtctggcatgatgttcataataggcagtgagtaaataatcattgaagtaattctctcacaaaagggaactgactattggtttaggaatattgtagacctagtgttgactgtatagtcttagccccattatagtagatttgagtagtgttgttaatgtgtgatcctttttccataggtggagccttacaaagtaaacctctctcaagatttagagcatcagctgcaaaacatcattcaagagctaaatcttgagattttgcccccggtaagcataaagctgtttagttcacatttacgtagaactctccgtagacaagcaaatcatattttttgtttgtttttcttattttttaatagcctgaagatccttctgtgccagttgcactcaacattggcaaattggctcagttcgaaccatctcagcgacaaaaccaagtgggtgtggttccttggtcacctccacaatccaactggaatccttggactagtagcaacattgatgaggggcctctggcttttgtgagtgcaatattgtttttgagatcagagtcttgtgttttactcttgagactatatttgattagtatgtctaggtaaaaaatggatttattttgaagctgaattatgtgcttttgtttgactatgttggctttttgttttacaggctactccagagcaaataagcatggacctcaagaatgaattgatgtaccagttggaacaggatcatgatttgcaagcagtaagtctgaattatttagacaagtagtgctcagagcttcagaatgttctaggtatgggtaaaaagtcaatgagcagtacattttgcccttttaaggagggcatatcaaaagatatgtaccaaactgctaatcctagttacccctgaagttagttgctatgagttgagggcctgtgagagaatttcacttcttaatgtaatttaataaaagtggagagatttaaggcagtgactccttttgttgttggtttttttgtttgttttagtgttttccaaataaaaaattaaaatgttaaaaagaatgcgtgtgcgactttcagggacaatgagaatttagtttttggacaacatcaaaagatacattcttcagaagtgtagtgaaaagaagtagttctattagagatataaatatacacattcttttttgaaaaaaacattttcatcactaagccaatggaaatgagtaagtttttatagagatggaagtttggtttttttgtttgtttttttcttgagacaaagtctcgcttagttgcccaggctggagtacagtggctcagtctcggctcactgcaccctccgcctccttggttcaagcaattctcctgcctcagcgtcccaagtaggtgggattacaggcacaccccaccacacctggctaatttttgtatttttagtagagatggggtttcaccatgttggctaggctggtctcgaactcctcacctcatgatcctcagcctcccaaagtgctgggattacaggcgtgagccaccgcgcccagtctatagagatggaagttttttaaaggatcaagacagttgcttctaatgtgttggtagacatttgactgaagtgtgacttttctaatgcagatcttgcaggagagagagttactgcctgtgaagaaatttgaaagtgagattctggaagcaatcagccaaaattcagttgtcattattagaggggctactggatgtgggaaaaccacacaggttccccagttcattctagatgactttatccagaatgaccgagcagcagagtgtaacatcgtagtaactcaggtaagtggtaaaccaaccatgaaatacctagagagcagactatttctgattctttctttgattaactaatttttgtaattatttaagattgagagagcattgtgcccttgaaattaaatttaaaaaaagaaaacataaaaacaacgtagtctttttctaatctctagtatgctacactaataagctaaactggactatgtgagggattctttttatctgggctaaagagtctctgggcctagaatcagactgtcgagattaagaattctttgtcctaaagttcatccaaatcttggtcatctctatctaaccaccttgatattgagtaaaaaccagtcagacaggtaatggttaactttcactgtatgccatgttctattctaagcagtagctttttagaaaaaactcaatcgaagttcataatgaccctaagatgtaagtactatttcacatagtatttctctttcagt

SEQ ID NO: 57348 - DNA, 1028 bp, Homo sapiens
tgtggctacagcgttcgatttgagtctatacttcctcgtcctcatgccagtataatgttttgtactgtaggtcagtaatgtattttgatttttcatttggggtttatattgtggttgtgaagaaaacttgatagcagaacagaatgactggaaagaaataatgagccagtctcagatttcttgtttaaataaaacttttggcagttttttccttcatggaaagtatgatatacccattagatcttgtagcttagagaaaatgaaatcataaaatcagtgaaaaaaactatatttcatagtacactatcactttttaatagtttaaatgtacatgtgattattttctaaaatgatgctggggtctcttagttgaaatatagataattgtccatagatttactactttgaacttttctatagtttattgattgtttttcttttcaaggtgtgctcctgagaaaattagaagcaggcattcgaggaatcagtcatgtaattgtagatgaaatacatgaaagagatattaatgtaagtaacttgagaggtacagtaaggtacttaattctgctatttctaagagaaatcagtagaatgtctttgttttccctttcccccgtttttatcattatcaaaaccatgaacttcagtcactaagatgttgaaaatctttttttagtgagattattcaatcttttttttctttattgttaaactttacagaaagccttttggaggtgaagacctatgttgtaaagtataactgcagtaatcagtattagctggcataattcagcaattgaactaatggtttatgactaaatagctgatggaatttttatgattcgtttttctttgatttggaagtttatgatagattttataatcgttttttgttttgtttttttgagacagagtcttgctctgtcacccaggctggagtgcagtggcgcgatctcagctcacagcaacctccgcctcccgctttcaagcaattctcctgcctcagcctcctgagtagctgggactgc

SEQ ID NO: 57349 - DNA, 1132 bp, Homo sapiens
gaggccaggagtttgagaccagcctggccaacatggctcggctcactgcagcctctccttcctgggttcaagtgattatcctgcctcagtctcctgagtacctgggattacaggcatgtgccaccacactgggctaattttgtatttttagtcgagacaggatttctccatgttggtcaggctggtctcgaactcccgacctcagattatctgcccgccttgacctccaaaaatactgggattacaggtgtgagccactgggcctggccaatagcactcatttctaatcacaactattaggctacaactgttctcaaaaattgttattgttatcttaaaaattgataaaagatccattgtggtcctttatcttggcacttctgtgagtcatctaagaaactgaatttaattgatgtcttatggctgtataactcttttaggcatagcttgttatataaacttaatgtaatttcaaaaattttgtgtttgttttttaatagactgacttccttttggtagtactgcgtgatgttgttcaggcttatcctgaagttcgcattgttcttatgtctgctactattgataccagcatgttttgtgaatatttcttcaattgccccatcattgaagtttatgggaggacttacccagttcaaggtaatattgtgggggtggtataggaacatcttttgtgcaatagggtttgtattttcttaatcctggagattggagttacaatttaaagaatacttaaaatacaggacaaattatagtatcaaatgtatcatagcatttttgaggagtttctcttctgttattttatacagtagtgagtacagtctgagaagtgagaccaggtttcatttactacttgagtagtttgcatatgcagtaagtttccaggcctttacttataaagccaaacttttaaaaattataaagtatagtcaaagggaaatcactgtggtgtataggtaattatgggaattactgttaaaagtttaagcagccaggatcaaattaagaatcctttttagagcctgagcaactagattttgaattaagattaaaggaagtgtatcaaggttatgtatttctgataagtgagagttctttagtatctttttgtttt

SEQ ID NO: 57350 - DNA, 1192 bp, Homo sapiens
aaatttggcaggcactaccacaggtgatcaagttttaacatcatgaggagtaagtcatattgataggatatgcccttaatatgatgtgatgagactggcactttgggagtttttggatatagagggtgttttgattataaagacattctggggccatctgagaatcttgggcataattgatcaacagatcttccagtccttgcattgagatccttcttcagattgaccagaagccattttgtgtgtgcatactgatagaggaaggatggactgtggtatattgtattgaagttacttctttccatgtataactcccacacaatggaagtgtatagataaatgtttgattgaatgttatacacagaggataccccaactggctctgggaacatgtataaaagacacctcaccctccttcaaggtctaagagagggaaacactgagtttgattaggaaaataaggttattgctactggaactttttggcatttgtgaagaatcagactagaggggtattaaagtagttttgaactatgaattagcaaatgaatttaggtctgctccattgtgaaagttgatagtacttaacctgactggattgtccctggcagaatattttctggaagactgcattcagatgacccactttgttcctccaccaaaagacaaaaagaagaaggataaggatgatgatggtggtgaggatgatgatgtaagtgaatttcatgaagaatttccattatgggcaaattgtcaatgcagagaaaaaaatgagttaatgtaacatgcaatgtattagcattacagcaaactttcttaaaaactgactgtaatgtctgcctttggattaattgatgtattttactgcaaaaaaattccaggttcagtgacaagctgttttctatcacaagttaaattatctctggcgtaaagatcaaaggaaaaagaagaaagaatgcgatgtttaaaggccaggcatggttagggacaatgctgttgtataaggttttgctactcaaagtttttcagtaggctgcagcatctgggaaactggtagaaagacagaatgctgtgccccaccctagatctactgagtcagaatctacagtttaacaagatcctcaggtgatctgtatatacaataaagtttaagaaacagcagctatagctttagctacaggagaccggtgat

SEQ ID NO: 57351 - DNA, 1124 bp, Homo sapiens
tcagaaggctccatgagagttttgagtcaaatttaagtttgtgtttgaattttagtcctatcctgtgagaaatactaattagtggaaaagttcagtatattgatgtaagctctacatttttggaaattaaatttcttctgtattctatagtgtgtgactagtcaactagaataaataatgacattacaagtaattagagtcactagaagaaatctagaagacttacctcatgagtaactgagacaatccaaaaatatgtctccctgttttttacaggcaaattgcaacttgatctgtggtgatgaatatggtccagaaacaaggttgagcatgtctcaattgaacgaaaaggaaactccttttgaactcatcgaggctctacttaagtacattgaaacccttaatgttcctggagctgtgttggtttttttgcctggctggaatctgatttatactatgcagaagcatttggaaatgaatccacattttggtatgagtctttgaattctcacatatttgagagtgaaaatgaatgtttttgctagtgccttagccagtatgtgaaaacaaaattttgtattgtttctactttcgaataaaaatatgtataatggagagctgtttgaaaccagctcctgtttttagtccctgattgttctttattgttatataggaagccatcggtatcagattctacccctgcattctcagattcctcgagaggaacagcgcaaagtgtttgatccagtaccagttggagtaaccaaggtaaatattaaacattagagtgatgggattggaagtgacgtagatactaaacaaatgttacaggctttcaaagagctacccaaaaaattgtaacccatctaaattgaggaagaaaaaaggagtcttctctttctgagcttagtagattgttgttcattaatcagttattgggtgatctttttaggacttctgtaattttcttgtcatttgttacatacataagcaaatcagtccttttaagtaactaataagaatattttctggagtgtaatttttctttcttcacaggttattttgtccacaaatattgctgaaacaagcattaccataaacgatgttgtttatgtcattgactc

SEQ ID NO: 57352 - DNA, 4735 bp, Homo sapiens
ggttatatctggccaacttgtaccccatgacttctctttataattccttagtctgtcctgacaatgaaaacaatttgctgccaacatccattttaggaaatgatgaatagcattctgtgccaatcccagtcatttagtggcagctgtctctgtatgtaacattgaaggaatctgaggttacttgggggttcaaatggaccacacaggcatcactagatacagatatcctaaaagttacactaaactttggaatagagatgacttaaataattactttcttttgtgtatgtgccatattccatttaaatgctttgcatttgttaatttatttaatgtttaccaaaaaaactataaggtagataatggcatgcaaagtttggccaaggcagttcagctgataagtggcaagtggatgttacattgccttttagtaggttgacaactaggagtttgcagtcagattgctgattcttacttgtgccattcatgaatagacatcacaagtaggtatggctttaactacatagtggaaagcattcactacttagtggatatataatagttattgataatacacatgagtcttagaattaaccactttttcctatgtaggcagaaagtgaaactcttcactgctcacaacaatatgaccaactatgctaccgtatgggcatcaaaaacaaaccttgagcaacggaaagggcgagctggccgagtacggcctggattctgctttcacctgtgcagccgagctcgttttgagaggtaagacccattcttgacctttagtaagggatttttgttctgttctctgtagggacagatgtgtgcagttatgtaaacctgccaatataagctgatctaagtcttgccagccatgttggaatcaggtgtaaatgtttcgtaagaatcttcatcacaaatcatttagagaataagccagatttagaaatatagagacctagattttaatattatttgtgcctaatacattgtataacactaagtggttactccttaggcctgcatttccctcattctataaaatattaagttacttaacctctcttgtttcctcagttgtaaaaagaatataaataatgcctaacccatagggttggtataagtattaaatgatttaataatgtaaaatactttgaacagtgtatggcacatcatgatctcccaataagtgtttgctgttgttaatttatacaggtcagatatctcttttaaaactgaaatgcttgggaccagaagtggttttggattttttttcttggtaatatttgcattgtatttaccagtcgggcatccctaatctgaaaatatgaaatccaaaacgctctaatgagcatttcctttaagtgtcatgtcagaagtcaaaaagttttggattttaaagatacatctataagagcctttctagtggcactaaaattacatgaactaggaaggtgggaggttgtagagaaatgttagtatgagttatcatcctacaaaaagtcttgttgtcgtttttaacccatgtttgtcaacaggcaaggcctgaagagaccatgggtggagctaataacattcgcgattttggataattttttcatttttcttctcagcctaaaaggctatcaagctgtgaggataagtcagaaaccactatgcaaccagattaaattttgtcaacagtgtgtatagtgaacgataaaaggtccgatggtaattgtaaaataaaaggatgaggaaaaggcagctctgtatccctgattaccttgctgcaaaaagtttattaacatctgtgtatacacaaggaggatggttattttatgcttattttctcttagacttgaaacccacatgacaccagagatgttccgaacaccattgcatgaaattgctcttagcataaaacttctgcgtctaggaggaattggccaatttctggccaaagcaattgaacctccccctttggatgctgtgattgaagcagaacacactcttagaggtacttacaaatacaaacctacttgacgcagatattaatcataccatctgtcttgttctggcagataacacttacaaatgaatcaagatgatgaagatgtagtcaacagggctgtgataataatagtaaggcctccagtcttaccttagatagttagtatagtcactgttctaatgagcaatgagaaggaagaaagggacaatgtgagtctttaaaaaagaaaagaaaacttaaaaaggcatctcttaactatgtactaaagatcagaacataacttactcatgatacccacagtatttcatatgaatctcttacaactttttttgtttttttgagacggaatctcgctccattgcccaggctggagtgcagtggcgtgatctcagctcactgcaacccccacctcccaggttcaagccattcttctgcctcagcctcccgagtagctgagactacaggcatacaccaccacacccggctaatttttatattttactaagacagggtttcaccatgttggccaggctcttctgaaactcccgacctcaagtgatccactcacctcagcctcccaaagtgctgggattacaggcaggagccactgtgtccagcctggaacatttattttttcttgctaaacttgttagaggtacagtgaaaattaagggcattggagctagatctgaatttgaattttgaatctagcatttatctactatgtaacttcagaattttctctagattttattttttttaaaacattaacagctgggtatcagacttcttatggcatgtagaaacttacgctgctattatagttaatactgtatttatagacttcatatgaattgtatttgtttttataacctacaggatttagttgtagtacctttatgttgggtgctccagattttgattttgttctatttttgagtacagagaattgttggccgtagacatggtattagcgattggcttgacaaaagaggaactctaaactgtcttaaccttaatttagagtaatgttttgtctgcctaaaattagtgttcatttgtttctgctcacaaagaactatctccccacagagcttgatgcattagatgccaatgatgagttgactcctttgggacgaatcctggctaaactccccattgagcctcgttttggcaaaatgatgataatggggtgtattttctagtaagtgctttgttttatttctcttcgttaagtggcagaataatttcagaatcttctcctccctgtaaaagcagtattggctcagatagacaaaaaaaaaatcctaaatgttcttcagggaagtaacatacctagatattgagagcagtgtaacactaaaaaaatgaacagttccagtaggtggatatctgggcccaatatggggaaaagggcactgatttctcaaaagttaaaagcaagcaggccaggcaatgtggctcacaccttgaatcctagcactttgggaggccagggtgggagggtcccttgttattaatagttggtcttgaaagagcggtgtcaggaaaagaggtttattttatcagaaaatgttgaagattaagagatttggtatgatggggaagagagaatataaaaggaaaaatatacttggtcataatttatgataaatatgtggccattagagcatcagagcatttttttctttctgattctgaagagagcagctataaagttctttgttaagccagtttcattgcaaataaaagtagaatcatagccataaagactgcaacccacagtcgacagtcctacctgagctgctggcaacaacattgtgatctagtctggatttaactgtctttgtgtatttcagcgtgggagatgctatctgtaccattgctgctgctacctgctttccagagcctttcatcaatgaaggaaagcggctgggctatatccatcgaaattttgctggaaacagattttctgatcacgtagcccttttatcagtattccaagcctgggatgatgctaggtatgagtaagatttgggtgagctgtctgtagtttctcatttgtatttagttctctggtcttagagaatgatttctcatgccaatttattttagaatgggtggagaagaagcagagatacgtttttgtgagcacaaaagacttaatatggctacactaagaatgacttgggaagccaaagttcagctcaaagagattttgattaattctgggtttccagaaggtaagacttcttccattcttaagatatctttaaagtgacatttatatagtacatgcaaattgacagcaaagtgtattttagtttcaaattttagaccctatgatttttatatattcccgactatttcttagttctcgtgaacactggtctagttcccagaatgagtactttgctgataaccttatagtggtttgcaaagtaatttattagcatttagacttgaagtaaattctaccacattaaattttaaatgactttaatttatactttcggtgtacagatgattaaaggactttatgacatctaacatagaaaaaaaccaacccatgtttcttgatgagctgtagtacttttcttttccaactaggttaaaatatagaattacttcctaaaacattgagaactggaatgcataaccagaaataagactgttgagagacagaaggtagttgggcaagatggtaaatttttaaaggctgtaattggaataactaaa

SEQ ID NO: 57353 - DNA, 1426 bp, Homo sapiens
agaccatcctggctaacacggtgaaacccgtctctactaaaactacaaaaaattagccgggcgtggtggcgggtgcctgtagtcccagctacttgggaggctgaggcaggagaatggcatgaacccgggaggcagagcttgcagtgagcagagatggcgccactgcactccagcctgggcgacagagcgagactcgtctcaaaaaaaaaaaaaaaaagtaatcaccccaagcttatttatggttgagtctataagagaatagagacgttttcgttttcttattgtggaaactcagtaacattactccttgaacttaatctgggtgtaaggattctgagaagagaaagttttacagacaggttatgtgaaaagagtgaggaagagtcagttctctgaattatcttaaatagtttgcatgtaatgtgaagatcagccagttatctgatttttgttttcactgtgctcctcttaacagattgtttgttgacacaagtgtttactaacactggaccagataataatttggatgttgttatctccctcctggcctttggtgtgtaccccaatgtatgctatcataaggaaaagaggaagattctcaccactgaagggcgtaatgcacttatccacaaatcatctgttaattgtccttttagtagccaagacatgaagtacccatctcccttctttgtatttggtgaaaaggtaagaaaagactagaaaagtttacattgaaagttgaaattgtctttacaatcattaggaacatgaattttgattttcaaagcacagtatatagcggtatttggaagttggaatgtcaaccattttgtattgtctctttctccatttgcagattcgaactcgagccatctctgctaaaggcatgactttagtcacccccctgcagttgcttctctttgcctccaagaaagtccaatctgatgggcagattgtgcttgtagatgactggtatggattttcagatgtgaactccaaactgaattcttagaattacaatatgatggaattcagctgctaatctaacttaattatatactaattatatctaacttaattatatactatatacttaatcttaaattgataccagtagaagcaaatgcattaggaatttgagccatgtctaccactaggcacaccaccactatggaatcagaatctaagtgaagcttgagtaccctttcacatactctgtatattgattcaaaactagtggtaagcactgggcaaaaatggaatagagcttaatggacagccagtaggctcagccatcatattcttgaaaacctagaaaatgccagtattctgggtctcttaaattcattattttaaagtctggatgatctggctgggtgcggcacatcacttgggctcaggaagttcaagatcagcctggacaaca

SEQ ID NO: 57354 - DNA, 1504 bp, Homo sapiens
gcaggagaatcacttgaacctgggagttggaggttgcaatgagctatcacgccactgcactccagcgagggcaacagagcaagactctgtctcaaaaaaaaagaaagtctgaatgatccatattgctggactttgttttttgtttattatatattgcatatatttttattatattttatttggcttgatagactttttggcttaagactcctgctcatagctagcagtgaattttaagaagctagtgctgattataactactcttcatatctgtgtttgcctaagtttggggccattataagtagtttttttttttaatattaatgcttaagaagttaaatttattctataatgtgccatgtgtgaagttgagagataatggtctttttctacatatactccctctcttatttttaatgtatttcgccactttaggattaaactgcaaatatctcatgaagctgctgcctgtatcactggtctccgggcagccatggaggctttggttgttgaagtaaccaaacaacctgctatcatcagccagttggaccccgtaaatgaacgtatgctgaacatgatccgtcagatctctagaccctcagctgctggtatcaaccttatgattggcagtacacggtgagtaccaatatacttcttactgaaccaagtagaggggagagatcttatgtaggcctagaattcctgaagttagtgatagaagccctattacttaagtaaaattctagatatagatagagctatatagatagagagtttgatgttctgagttctaacatactcagaacaaagaatgtcatttacttttttgttagtagttggtctgctgcatcagtgcatgttggtagtgttagaaggaacttacaaatgcacatacatagttcagagtgggtcacatgacagggaagtgacacagcccagatagccctttttccatggtactgttttggcatctctaaagaaaaatattgatgagatgttaaattgtttctgtatcaaatgtatatgtgtttttgtttatcttaaacaactagagcatggatatcttaaagaaatgagaaatttatcttaattcttaaaatttttatttgcttcaggttttaaaattttttctttgcccactaatttttatttacatatacttgatacttaccaaaaaggcaagaagagtgatacaatgtatagccatatagtctttatttaggttcactaattttcagcattttgtatttgcttaatatttgtgatgaagtagcaggcattaccacattttacatcaatacacttcatgtcttttaagaacatggccacaataccacaatcacaccccaaaaccttaagtgttttagtaatactataatatactaaggtactaaaattcttccagttatccaaaaatgacctctaattcctcatcaaaaatgatgtattggcatttgatctatctgtaagatgggtagattgttatcctcatcctctttaatat

SEQ ID NO: 57355 - DNA, 1328 bp, Homo sapiens
ccctctcctaatgcttgccttcttggaacacttatgttattgaactgagtaagaggactgtcttaaagttctaatgacatactgccaaaattcaaaacctttgagattgaaccagaacttcagaaaaacagatggatacaattgatgactgttttagaatagcagatcaattttatttcaatttctatttgtgcatttggcttcattccctttattaaattttcaaatataactaaatgtgtacatttggtaagtcgttgggaaataataagaatgctttgctaaagtgatggttttgtgcttttcctaggtatggagatggtccacgtcctcccaagatggcccgatacgacaatggaagcggatatagaaggggaggttctagttacagtggtggaggctatggcggtggctatagcagtggaggctatggtagcggaggctatggtggcagcgccaactcctttcgggcaggatatggtgcaggtgttggtggaggctatagaggagtttcccgaggtggctttagaggcaactctggaggagactacagagggcctagtggaggctacagaggatctgggggattccagcgaggaggtggtaggggggcctatggaactggctactttggacagggaagaggaggtggcggctattaaaacttggttatgtcagttcctgtgtgtagacagtaaggaaaaaaaggcatgctatgtgttacgtgttttttccagtatgtttatttgccaccaaaaagtaaatgcattttcacccattctgtggttcattgtagtttaaggaaaccaagcatatagatgcattagtgattttgtttatattatgtaaaatataacgatctcttaaaaataccacagtttgtattttttctttaaggagtaaagatttgcctttaaataacttggtattttcctggctttcgtttaatacaatagaaaataaagtattacaccgaatacttgccgtgtagtttgtttgttgacctcgtatgttagaaaattttacaatgccagctacatctgttgattttaaatgtcagagaagttgtaccctgtttcaaaagtatactaagtgatactacttgtaatagaataaatcatcttggaattgaattgttaccttttgaagtaaatactggcaagtgcacaagccacataaacctgaataaaacttttgacctagggttgaacatttggcttcctcccatattctgtctttgaataagaccaaggccagcattttcttttctaagttagtttccacgatgacaattaaaagcaataaaatcaatccatagaactcttgaa

SEQ ID NO: 57356 - DNA, 1037 bp, Homo sapiens
taagcttccagtgggcatctagcacacagtaagcactgaataaagtagcaaaataataaaaatgacaatgataataacaaaaaaacaaaaacaaacaaaagcatgttaaaaaaaaaaagccctgctatctgtattacaccattggtagaagaatggctactcaaacaccaaaaaaaaaaaaaaaaaaaggagaaaggacataaagagtaaaattcttttttttttcaaaattgagattttattggttaaggatcagttcagacatttcaatttgtacacaattcttgacatatgtaacaaaaatctaaaaagccatttattgtaattcttttttaaagttattccagtgactttccagcttaaaatttggaagcaaattttctttaagaggctataaagtaccagtatcttcacatgttggtcagctgttacatacagcccaccagttcacaactgaatagcacctacactacatattcaaatttgtaacctttcacagcacaataacaaagttattaggaaaacaggactaccacaaccaaagatgttacagagtgcacacaattctgacagggagagccatgatcaaagagtggttttctttaggaaacaattcttctaaaaaacatgggaatggaagtaatttaaaatgttcaagacattaaatgcagtactgactccatactgccatttaatatgctttgtattataggatataaaaactaaccccccacctatggaatgttaagctgatacctgagacagtcaaagcctcccataattcaatatcccacactattttctggttgtaccaaaaaataaacaaccagcaaatgatttcacctcttaaaaaaaagcatttacacttaaaaaatgggatgaggtgggattccctccttcttaaaaatgtttctagagctactaaaaaacttgcatttacaaaatagttgataaaaatattcctctggattgtacaagaagggagacagggaccactgataagacatggtatatggtattaatcagacttggcttct

SEQ ID NO: 57357 - DNA, 1052 bp, Homo sapiens
ccgcgcggggagcgggtctgcgaggccgcccttccctcccggcatgcaccacccagccgccctcccctcccctcctctcctctcccctcccctcctctcccctcctctcccctcccctcccccaaccccctcccccggctccccgcccacctcgcgcgcccctccccccgggtcgcgcgccgcgggcccgagcgcgagacgccgctgctcccgcccccgccgcctcctggagtcgccggggcggacgcgcagtccatggggcgcggtgggccggggagttgccccaggggccgcgggagttgctgagaggagacagggttgggctttctcctcgcccagaccccaccccaccctgccgaccccaccccctgctccttcctccccgggggcgcgcactcgggcacgcgctcggaagtcgggggtcggcgcggagtgcaggctgctcccggggtaggtgagggaagcgcggaggcggcgcgcgggggcagtggtcggcgagcagcgcggtcctcgctaggggcgcccacccgtcagtctctccggcgcgagccgccgccaccgcccgcgccggagtcaggcccctgggcccccaggctcaagcagcgaagcggcctccgggggacgccgctaggcgagaggaacgcgccggtgcccttgccttcgccgtgacccagcgtgcgggcggcgggatgagagggagccatcgggccgcgccggccctgcggccccgggggcggctctggcccgtgctggccgtgctggcggcggccgccgcggcgggctgtgcccaggcagccatggacgagtgcacggacgagggcgggcggccgcagcgctgcatgcccgagttcgtcaacgccgccttcaacgtgactgtggtggccaccaacacgtgtgggactccgcccgaggaatactgtgtgcagaccggggtgaccggggtcaccaagtcctgtcacctgtgcgacgccgggcagccccacctgcagcacggggcagccttcctgaccgactacaacaaccaggccgacaccacctggtggcaaagccag

SEQ ID NO: 57358 - DNA, 1009 bp, Homo sapiens
agaaacacgtgtaagtgatgtttcagaaatcaggaaagggatgtgtagaaaacttcatggcagggcagtggattgaggatggacatatgtatctggaagcaccaaaaataatgttcggtctagctaaggttttcttcatcattgagatacgtaaataggcagaaagtttcattattgtgtttaacagaggaatctatgtgtgagaaacacgtttgacttaacacttcactccccattgccttggaaggcttgattattaccagtagctggtactaatgaacttccagagagaacagactgcctcaagccattcttctgtcaagggagggtaattttgtaaggctaatatcacttaggggtgttggaaaggaacatgttgtaggcaaatggttcttttgatcatgattttgctgctctccggtacactaaactttatgtaagtatcaggattccagagaaagaattggacttaacaaaaagtactttgaaaagtgggattaaattattgtgtgtggaataagtgttagaaaagcagaattatttaacatcttatttgcagttgagtcattaaacaaatgaaacattttgaaaataatttcataaaatgatactatgaggtatctgtttttcagggattgaagaagtaaagtgcactgagttcagttttttaaaggtgcctttctgaagacatagctagtgaccgaggatttcctaagatctgtgagattgctctttattttctcctgttatattttttaagttggccaaaattatttttgaaatgtgtatctaagtatttctgtttaacttttgacttgttaaagtttctgtgttcaagtttgaatactcttgaagtcttatttttttcattttcagattttaaaattttcaaagaaaaggcgttgcctgatgtctgaaatctcagatgcctgaaattcaattgacaattactgaacaacagtctcttatttacataaaggtggggttgtcaatcttggctctcagaatt

SEQ ID NO: 57359 - DNA, 1006 bp, Homo sapiens
gagtaaagactactctggtgaacagataggatccactgctgtgtggtcggtcggttctgggtagctataacttcacccgtttctttcccaccaatcgttactataatctgtccaagactctactcttaccttctatatccagacactatgtgtcttgaatgcttatctttctctccgtcctctttgtctctgccttactgtaagttccttactgtaagttcccattgcatttcacctggattgttgccacagcctccaaataaactggtgggctttctgcctccagttttgccctttatatttgggcagccatcctttggactgagtgatgattctaaaatgcaaatctgatcatacaattttgcagctaaaaattctgcagtggttcctcaaggttttatgataaagtccaaactccttggcgtggtgtacagggtacttaggatctggacctttttgttgcttcacgtgttcacagggctgttctttggtttggaacacttctcccaggtgttaggactccttccccagtttctctctctctcccctttctgccccactccctggcttggattaagtctcccactgacgccaccctgtaggtatttatcacagtccctatcacataggattatctgtttctttacttgtctgtttctacctttaaaccatgaagtttttgaaggacgagtcaggggtttagtaatcttttagttcagttaaagatgactaatattggttaattgcttgttatgtattagcaacaatgcaaattcctggatgtgtagtgattcatgggacattgccctgacctcattcttagatgaggtgtagatgcagagacccatgtctctcgatttgggggtaggcaaatgatggccttcttagccaagtccagtccagtcctgcctatttttgtatgggctgtgaactaagaatggtttgtacatttttaattggttagaaaaaatcagaagaataatattttgtgacatgtgaaaatttc

SEQ ID NO: 57360 - DNA, 1053 bp, Homo sapiens
ctgggtggagctcaagaataaattttacatatgtaaaatttcagagctatgcatttaatatttgtatacttcattatatgtaaattattccttgaataaaaaaatgaattaagaaactttcagccaattgtagtacactataatatagttgattttgtttgtttttcatatgatttttggcttaggagagaacacaatgtgaggcttcatcatctaaaatatatttctcttagtgtctttctcctctgtaccagaagttgctggcattaatagacattaacagatatttgttgagtgatcaaatcagtgaactggctggttttaattgagttatgagcccattttcattgaagtacctgcagagccctctcatacaatcaagcttggtagacgcctcaggcagtggagcatgggaaacctggggaagagctgtcctctgttctcacctcactttaagcaggtagtggttttggttgatgcttcatcgtttgatgtggtaaaatggtaagtctgtgggttttgctgcaggtttagagaattctttaagaatgtctttgtgtggcatatgctttggtcacaatatctggtgcttaggtaacttgctatttaatttccatggtgaaatgtaaatgttccacatatcacttaaataatgggaagaccccatcttcattcatttaaacatggtctaggtaatggctttctcttattgagccttttagaaataaaaagtctgaagtttgaatcatgtggctttcttggagaaacttttatttttttttgagacagagtctcactctgttgcccaggctagagtgcagtggcgtgatcttggctcactgcaacctccacctcccaggttcaagcgattctcctgtctcagcctcccgagtagctgggattacaggcacacacaccaccatgccctgctaggttttttgtattttttttagtagagatcgggtttcaccatgttggccaggctggtctcgaactcctgacctcaggtgatgcaccctccttggcctcccaaagtgctgggattacagtcgt

SEQ ID NO: 57361 - DNA, 1265 bp, Homo sapiens
tttattatcaggattgctttagaggctcttgctgggttgtttattattgttttcagcatttttgccatacgccctgaaatagcatcaactcctgggtagacttcaggatcattcagttttgtaggcattctaatcaggtttgggttttaaacatatgtccactttagagcttttatgtcctggcacagacgtcaatggtgaatccagaccatttcaagatggacactgattctggaattaacatacttcccagatgtttgtagtacagatttgttttctgtgctgtctttcatgtgttctgctgtgtctgtctctatctgtgctttcctctgtttttacttttagaacccctggggaaaggtaggtatctgctttttggattgggaaatagaataggtattaaatttttggtaaaaacctttgagtgggtattgacatttctgtgagaggagaggctgctttgttccctcgagggagactgttggtgagggtggtgttggaggtgagactctgaatgtaactagattcggacttcttcacatctctagtggttttcaattatgaaatgggcaactgatgctctgagtcagcagccttttaaccatgcctgactgaagagaacttgtgtttgaaattcacagcattgcctggatccctgctgtctttttgtgcctcccgctaacacacagctgtttttgttcatacatcattttgtgttcaactgcctggttacttcctcaggtcccttttatggtgaataatggacacatgggagtttgaacacccaagtgtgtggttattcaaacaggaagtctcaaggaagcacagtaactttgtcagaggaacaaaagatgggacaggaaaggctattgatgattctaggcttcaaacatctgctgggaaatctgacaatttctgaaatacagatattccatagcttacaaacaagttggtttgtttatttggaacttgttccattttttaaaaatcagggtattaaatcttcgtaaaatagaagtggagggaaaaaaaaggatataatgtggcatcattagtgttaaaaagaggagagaggctctgcctgtggcttgactgggtttcaggagaaaggctggagcagctcatcttgactgaaggtaaccctgaggctgtaacccggggtgagcacataggtgggacttgacagaggctgctagagctgacagaattggattaaaagatgattttatgcagagcttttgatgattgagcactggaggaatatg

SEQ ID NO: 57362 - DNA, 1030 bp, Homo sapiens
cttatgaccttgggattccttgtttatgtgataaatgacttaccagaaatagtcaaataaatcctgattttagatttaaaaatgaaaattaaatctggaagtcaaagaagggggagctctggtttcatagcaatttatattaagcaagtggggtgatgcaaatgctacagaaaagagtactgtgtcaggcttaattaatggaagtgatagtattcaaaggagtacaagttctgtgcatcttattcccctgcctttaatttcagtcatggtaaactgttcatagtaaacatgctcccaccgtgtgggtactactacatttttttcttgactctttacttttctgttttttcctttggctacttcctaatcatctttaaaactcctgacaaatttcaactcctccaagaagattttgctaatttctaattcctctgttccctccagagcacttgcctttatgtcatttgatgtttatacgtccactcacttctaaaatccagtaagcatattgcatacctaggatgtgaggggtgctatattgtattgttttctctctttcccccattagctgagttcatcaaagacaagacgaatccatagatttcttaattcattcatttacaaagatttattaagcacctgttacacaaaaggtactgcatagtaccggagacagggcagagaagacctagagcttaagttctgggtaaaaaagcatgcagtacaaaggacctgacctagggaggatttcattggcttcccctccaccaccccactgacttttatgcccctagtgtacggcataataccttttatatggtagtaggggttcaaaaaagtttgctgaatgagtgaatttctatttctttgaggctatggacacagaatgcagatgagtgcaagaaacagcaattttgtttaggttttcccatgatggaatttgccttgtagatagggtttttaaaattgatcaggcagaataggatggctagtacatggtatagtttcctcaccagcattgttagatgaa

SEQ ID NO: 57363 - DNA, 1097 bp, Homo sapiens
aaaatagctctaaaatatcaaattaggtagtatacagatattattcacctttttggtaaaattagctaccaaattagttgctgttcatactgtttgatgcaataagtggtaatctggaaaatggaaacatttctattcataaaattcactggagatttgattaatacatgtatttccctaaaaaacaaagcaaactgaaccagtggtaactcaaggaagcattgatagagggacttgggttttgttttgttcttcataactaaatcactcaattacagagtgtgataaatttctcaagcttctgagatattttaggtcagtctttatatttttatatcaattctgtggatcatgcattttaagctcttttgtctctttctcttcaaaactgtctaacgccctctgaaaccttatttatcatctgagaaaggattgcatttaaaagacttggaacaaagagtgttgaatgtatgggaccttgttaaaatgttgtcttgtaaaatgtgatagatatgagtcttttaagttttggggatagatagacccatgtgtaatttgtctgtaaacactacagaagtagttctcaaatgagtgtggtactgtccccgtaggggtatttagtggacaggaggggattgtggggaattggaggggatgggagacagtcccatacaacaaagaattgcccaaatcctgcctaacttttggatttctcacgggacatttgtgctattaaaaaacctgattataaatacctgagcctagaacataactttgtctttacacataaacagtttttttcataactttattatatgtaatttcccatgaatacaaccaccatgtatataaatatttttttagcttaccgagagttagttcaccaattcggaaggccccatctctgccaacgctgcctctcatgatattcaagttgcccatacaacacatatgtaaatcagtctgcttttctagcaatcagagtgaatctgtgtaccaatttgtatattcttagcctctttttttctaaaatatcaaatgtaaataaaagtgttgatagtagctgaaattttgaaatttgctttcaaccatctttt

SEQ ID NO: 57364 - DNA, 1295 bp, Homo sapiens
tcttatacacggttcccatttttctgtaatgtcttcttatgtctcaatatgtaaatattttgtctttacttatactaatgtttcttgttacccaaattatctcctaagactgtttatgtagacttgaaatatttcttctgtctgtgggtgtgggtgtgagtaccttcccaaaaacatccaggaatttttgcccacctacttggtttccctggagcatgaaagaaggtgattaatggggtagaaaaaaattcacaaaaagccaccaacaaaaagctacctacatgtttacatgtattttaaaggaaaagcctgtcagctgcaatcaaagcagcaagggctcttcaaggaaggtaatatctatatgttgttctgttttataacatgtaaaattttctccccttgggaaaaaacgtctcacagaagattttcttgcaagatgactatgatatgacaggctctgtttttgttatgcataggcagttgcttctattgtgttccctgcagcctagtgcgtgtgtattttcttagactcatctggtagtgaagtggcctctagctcaggtcttcacaggcagaacatccatgctttgaggaggctgtattagcaaaataagaaacctactcagagataagggagaagcttcattgttgatgctgttattaactcaggctcagcttcctggtttgagagatgttctgaatacatattgatggatgggttattaatacattacatcatggtggaacttggcatcccagactggataagcccacttgccctgttatataccagcatttgtggtttgtattaataactctgtaatcccagctacatggaaggctgaggcaggagaattgcttgaacccaggaggtggaggttgcagtaagccaagatcatgccattctactccagtatgggcaacaggagcaaaactctggcccaataataaaaataactaacccagattgtgtgacaggagataatggaaatgatctgagtggccacctaatttcagtgaaggaactagccaaggtaagtgacttgctcagtgtaagtccacaactaatttgtggccactcaggacattgaactgggtctcggagcaaattataagataggtaaaacagaggggacacaaacgtggaatagtgagagggtgaggagagtgcagttcaggctgggatcgtgtgtggcatattcgtaggaaaccacagaatctgaagttagttaggtttggatttcatttaccacttacaaactacgtgcatcagagtaagaaatttaatttctctg

SEQ ID NO: 57365 - DNA, 1030 bp, Homo sapiens
tgagtctaaatgaacacttttctgcagtccttagtgtagtaagatgggagcttgttcagcaagataggcaagttcatgcatatgagttttatttcagagctaattgacataatttatcaaccaaagtgatttatttttaaaacacctcattagaaatactcagatctgcacattgccacaaagcaaatgaaaataagttagaagttggagttgtaatgtattgggtatacataccctggtagtgagaacttccaaggtaccttagtgaaaatgacagcctaaatggcgttgtctgttactatttggaagatgctgacatctgatgtttctaactgaccactagaacatgtgtcagcagttgcttttgtaggggccatgctattctcctgctctctcctatcattgctttaaacagtacactgtaatgtcttataaatcttccatgtattttttctgcagaaacaaaaacaaacacaggaagacagagacacatctgtctcatcaattccatttgaatcattataaagagtttagtcaaattcatacatcggatgaacttatcaaatacagagggtgcttttgcttgaaatcttccccaggtggttttgtgaggataatgctcttaattttattaattttatttttgtaataccttgctcatccatcgtaattgatacggatccctccattgcctttggataatgtttacctcgcacgtagttcattctgtgttatgataatttactttgaatgacaaattacttaaatttttattgacaggctttaagtataaaaaagacctgaaatttgaaatctgtattaggtattgtgaagcaaagtgggtaaactttattattgtagaattgactcttaaactatgaccaagtacaggcaccagccaggcagatgtgtttaggctttctctggcattggagcatggtacagggcagtaatgatgtaagtgcttctatatatatgtatatatagtcatgcattacttaacaatggagtacgttctgagaaatgctcg

SEQ ID NO: 57366 - DNA, 1476 bp, Homo sapiens
ataggagcatgaaccctgttgtgaaatgtgcatgtgagggatctaggttgcgtgctctttatgagaatctaatgcctgatgatctgtcactgtctcccattgcccccagatggggccgtctagttgcaggaaaacaagctcagggctcccactgattctactttatggttagttgcataattatttcattatatattacaaatgtaataataatagaaataaagtgcacaataaatgtaatgtgcttgaatcatcctgaaaccggttcctggtgccaaaaaggttggggactgctggattaaaggacagagtcagctggacatcattgtaacatcattgcttggtgttttagtagcattaagacttaagttttgctttttaaatttacttctatatgttgctggagaggatttacttctgtctctggtgatattcagctaggttttttagaatggtctgtctgtgggacaagaaaaaaatctcagctaacaaaataggtagggatttctggatgtaaacctaggagaagttaggaaccacagaagtaagccttaaatgccttttccaatctgaaagaaatagctataaaaacaaaggttttggcaggcttatggggagacagagtcagagttcagggcctttcaaagatatgtggtctgataacctcccaaacctttgagcttgttctctaaaaagcttttatcatctgtgtaaagggaaaacagaaatacaccattctgtgagtagagttggagccagctttgcatcacctaggtaacccagtgggcactcaagccttgaacttgtgttaaggtcaagccagtttggtgttactcccaggtgtctggtataagcaagtgaacattgttttggagcaagatactaggcctcaaagtactcatatatatgtgtatgtctgttttaaaatacagtgtccagcacatagtcaaagatggttaggcacattaaaaaatagggctataaatgaaagaaaacctagcaaaataatagacaagagaagcagatacccaaatttcaggtatagaaattacagctgtgtttagtatgcttaacagaaaaaaggacaagtttgaagatcaggccactggaaacaacaaaaaagtggcatagattacatagattagaaaacaaccttgtaattctggaactaaaaaaatccattgctgggtttaatttgcaggatttacacatgttgacctataatttttcttactcctttttcccttatctgatttggtatcaaagttatactagcttcataaagtgaaatggaaaatattctttatttttctgttctaaaaaaatgaaattatgcaattattcaaatggaatacatagtaacattagtcatatgtatcttttacagactgacaggttagtgccaccaagtattcacaagtttctgttcatagagtatttttatacaaaaaaacagtgaatttaatagcacttttt

SEQ ID NO: 57367 - DNA, 1945 bp, Homo sapiens
atcctcatagcttagctcccacatatcagtgagaacataggatgtttggttttccattcctgagttacttcacttagaataagagtcttcagtctcattcaggtcactgcaaatgccgttaattcattcctttttatggctgaatagtatttttatggccattgtgtatatatatatatatatatacagtagcacagtttttttattcactcattgattgatggacatttgggttggttccacgattttgcgattgtgaattgtgctgttataaaactgatgactagctcttaccagttttctctctcatgtgtttggggcaataagttgtctcttaaatttattcaaccctgacattatatttttcttatcccttaaaagttgtgttttgctttttgtttgcttgtgtgtgtttgtgtgtttgcattttagtgtacttataaaagcttttggttcagaaagattactcccaacaagaattttattatatttgatattcttgactagttatgtatcctgttgttttctgcatctggagataagatgttaactggaaagatatttatcacattggaatgttagttgcttttttaaatgtgcttaaggcccaaagctcagttaataagataggatcctcatatcccaaaatcttgagccaagggagggaactaaacctttaacagatgagctggtcaggcgcggtggctcatgcctgtaatcccagcactttgggaggccgaggcggtggatcacgaggtcaggaaatcgagaccatcctggctaacacggtgaaacctcgtctctactaaaaatacaaaaaaattagccgggtgtggtggtgggcgcctgtagtcccagctactcaggaggctgaggtaggagaatggcatgaacctgggaggtggagcttgcagtgagccaagatcatgccactgcactccatcctgggtgacagagtgagactccgtctcaaaaaaaaaaaaaatagatggagtaattttaactcattcttatgttgttgtttaaaggcaacactgtgagatgaaggggatcgtgacatgtaattcatgtaagaaattgtaataatagaagctttaataacatataaagaatattgagtctgggcacggtggctcacctctgtaatcccagcaatttgggaggccgaggcaggcggatcacctgaggtcagaagttcgagaccagcctgaccaacatggagaaatcccatctctactaaaaatacaaaaaaattagctgggcgtggtggtgcatgcctgtaatccaggcaggagaatcgcttgaacccaggaggcagagtttgtggtgagccaagattgcacctttgcactccagcctgggcaacaagagcaaaactctgtcttaaaaaacaaaagaatattggaaataaggaggagtgaagagtgaaaattttaatctctgtcctgctctctgggagagagagtgctctaattttagacaactagacattatttttagacagaaccattgctacagaagggcagtttgccataatttgatagaactgttgcctaagaatgttcaactttcatttgttccaattctctgcttatcaagcaactttctgatctctaatctggttttttttttttttttttttttttttttttttttttttttgagatggagtctcactctgtcacccaggctggagtgcagtggtgtgatctcagctcactgcaacctccacttgccaggttcaagcgattctcctgcctcagcctcccaagtagctgggactgcaggcacatgccactacacccagctaatttttgtattttttggtagagacggggtttcactatgttggctaggctggtcttgatctcctgacctcaagtgatctgcctgccttggcctcccaaagtgctgggaggcaattcaccttcctcagcctcccaag

SEQ ID NO: 57368 - DNA, 1571 bp, Homo sapiens
caagcgattctcctgcctcagcctcccaagtagctgggattacaggcatgcctcaccatgcccagctaattttgtatttttagtagagatggggtttctctatgttggtcaggctggtctggaactcctgacctcaggtgatccgcctcccaaagtgctgggattacaggcatgagccaccacacccaaccagaaaggtctattttctttgatcttattaaaggctgccatatacaaaggttttcttttaatgttgatctgtttttaaaatatggaagaaagccttgaaaggcatcatcataagctctacgtcaatatccagaaaatatcgtcttgttttagaattctagcctgttttgtttggtagatgagtcagtctactgtaaataaatatttattgagcacttgttttgtgccaagcacagtgccctagggattgtagtgtttttcaaattgtgggtcacagctccctaatgtcataaaatcaatttagtgagctataaccggcatattcaatcaaatggaatgaaaaatagaatatcagattgcatcatggatagtattgtattattttatcaaacttgagtttcaattgtgtatgtatgtgtgcaaggttgcaatataaagtgtcttttttacttgtgtcatggttagaaaagcttgaaaagcactattatagagcatacccaaaagtatatattccttgcttttgaataagttaaactcttgttggagcaagaaacacaaaagaataaatactcaagtagtgaattacaataagtgctatgtgttcggaaaagtaagatgataatacaagttgaaagtggcatggatggatatggtggaacttgaaccaaatctggaaagatggatagggcttggaaggggtgaagactagagaatggcttaaaggtgagacgtggcatatggataatagggatggcaagactggaacagaggtttcagtttacattagagaactgtaggatatagtttggagatagaaaatgaagcacaattgtccagacttatggatgccttgtgataacatgcctgaggagtgtgtattagatcaggtaagctgcacagattcttaagctggggagtgataatgatatagggtgggtttatagaatactttccatcttcttcctaactcctctttagtcatggggagctcctaagggaatttcttctaggtaggtgttggataccaagtctctggcatcagatcaaagagagccagaaaggactttggctgttctccagaatgtaaatagaaaggtagaacaagtcccattgtgggtgcatgtgaaatactcccatggaggagaactgcagtgctgtctgtttgaaatacggcaaagaatggattgaagaacatttcttctgatatcactgtttaatgtttgctctcaatgtaaagggaaaagcagattaaagggcccatgtttttgaagtactgggaacctgactgacctacctgaaatatgctatgtaaataatttgtcatgtgatctccttaccctcaagacaccttcactgaatatgctatatacataatttataaa

SEQ ID NO: 57369 - DNA, 1044 bp, Homo sapiens
agaacttttttgtctataaaaccaattcctctgctcagctcattggaacacttattctattttatagagtaagatgttgctcaattctggaatcacaaataaaagccaattaagacctttaaatttgttgtaattttatttcttaacagtcattagaaaaaaaaaagcagatgcatctaggattgcaagattatttacatgtagtccagggggattacatacattttagctattttgtagaaggtataatttaatcaggaacacaagttcaagcacagcccatgagagatgaagggatatgaagaacactaactttggtttctaaaggaaagtgtgtagagtgtacattcttactcgtctgcaaagagggtggatgaatgaaaaatgaagaagggggtgtattcgtttatacttatgaaggcatctgctcacaatcagtcacttgtagagagagtgccagctggcagggtacttgcgtgatgtaaattgtccatccgctcagaagagcagaagtacaaggaggccttgtgcaaaggactgaattcctacccagaggacaagggagggaggttcttgtagatatctaaatgagatctacttccattttccactttatttgcagttttcaacatgtcatttttcctgctgtcccagctacgattactgtttgacttgagtaatcagtttccccccttcactgcaactgctgcttattaagcctctgcctggtggggggagggtgggtataggaggggacactgctggaaaaatggtgtcactttttccaagagtgttgttttccttgtctttctgcttcactggttcatttttgtgagctgtataagagctaaaggttattattacagatttcattttttgaaatgcatcaaaatctccatcccctcccctacctgctaatctttttgcttgttaagaaagaaagtgcttctttctgtgaaatcatagataattctaggggtatcaaatgtaatggaattaaatcttataaaatttctgaatggacttccttctgcttttttttca

SEQ ID NO: 57370 - DNA, 1097 bp, Homo sapiens
ataaatatttctatgctagtctgtagccaacagaatgtaacaccctccctgaaaatgccaacattacccgacacagactgggattaaacaagtctaggcttctagacaaagaagaaacagtgttttcttatctttttgagtgtactgaagcagaagttaactctttgctttcagatgtgtcccttatcatcgagaattgctggtggtcctgtatcattttattataggaaggaaggatggacaccagagagggtggggaatttggtttacagggaatcttgaccagtgcctgcctataaagggtaccactgtgaaatccccagcagtaagtaggttttctaaaaatcaagtgtgtatttctacttgcctaggttttagggccttgtgaatgcaagtcgaatgatagaggaaattggcttggaggaaaatgttggggagtttgggtttagctgggtgcagtcacccctagacttggatgtggagtgagtacccctgttgactttaacatctgtgtgtgtcttaaagaagactgctacttttctggtttattgtctatgcctacagatgacacgtggaataaattgcacattaaaatgtctgacatgaaaatcagaagagcttaagttcattccacagaagccttttgttagaatcttcaaaggatgagaaccaggatgaagaagagtttacagtagggaagtatttctcaactgtaattgtacataaaaattgcctatggtgctttaaaaaaatacagagtctggggacacatgttctcgggatctcctaagggctgtcacagaccataaagtttaagaagaaaaaaaaaaaatacagagtttgggacctcacccaaaacctaccaaaatgaaacttgtggagatgaggctcaacaatttgcattttcaaaagctctgtgggtgattctaatagccagtctgggaccttattgtgggccagattatgagaactactataacaggaagacatagacctgggctggctctaatggaaaggggccttctagagcgcctgggggttttgaactgtttgggtacagataactctttttagtctggatacttacagtgatcctg

SEQ ID NO: 57371 - DNA, 1038 bp, Homo sapiens
tatcttctccaaaatcatactgtctatttcagaacttttgttttcctcttagctccatagtgataatcataccattatttttataatagcttttgatacagaattctgttagctttaaaaaattctaaaatgatatcttctattttacctacctgctttgttatatttcactgtggcaacatagaattgagactttccatattccatctctgttcatcttagttagcgtgtctttccgttattaacaatggcccaagtgtgataggaagtgcttattgcctgtactcagaaaacatgactgttgaagccctttgttcattcatttgaaagggatactttctcaaattgtaagttccattgcatttgttgtcataaatttagttaggaattactattttatacaaaactgtaaaggttatttgtctgcatttttaagttgtgctgatctaaatatactttctaagggattgtcctcttgcactgttggcatttgaccgattgacaagggggaggccatgaaaagggagtacagaaatttaggggaaaggaacaggataataagtttttaaaaacaaacaattttgaagataagttttagccaatagaaactagcccttcaacaggcaataatgaggactgagtttttcagcatctggagtgactgcactgtaccagaccatcttggtatattccttatgtgcttagttgttctgtagtgcttccgatcatctgcctgtgtctgcttgaggatcccacagtcagtattaagttggccttgggtcgtcttaatcagtgaggctctatttgtgcaatccatccgctgaggtggaacaataacagctggtttgcagctggatatgttgtcctgggaactcttgtttcagccagcagttatgctaacaaaattgaaaacattttcaaatagttgctttctgtgactactgtttgtgttaactgtttggagatcccatttagtagcctaaacacaccccatctctaattgactttgtgctacaactttattaaagttttatatgc

SEQ ID NO: 57372 - DNA, 1168 bp, Homo sapiens
ctctactaaaaatacaaaaaattagctgggcgtggtggcgggcgcctgtagtcccagctactcgggaggctgaggcaggagaatggcgtgaacccaagaggtggagcttgcagtgagctgagatcacgccactgcactccagccagggcgacagaacgagactccatctcaaaaaaaaagaaaaaaaaggacaggggcaggcaatgaccagcatctctgatccaaatgtggtgccccatgagctctaagctggtatcccttactggatttggggtccagatacaggatggagggaaggggcatgtgtatcgagtccctaatttatgctgcacattatattttatttaagcctctcagcagccttgcaaagaaattagttattatccttgtttttggagactccgagtagtaaagtaacaaattaaagaagggaagagtcaagaaggagaaaaatattagaaaattaaagaagtcattgagtattataatagatttagtgctaaagagggcgtaagttaaatgataataagttagtgatttagaacattttgtcacatttatatcattttcagtccctccacttctcttttatgtttctatttttgcttcctgacaggaatgggtaactgccactgacatcagagtaactcttaatcgcctgaacacttttggagatgaagtgtttaacgatcccaaagttctcaagtcctattattatgccatctctgattttgctgtaggtggcaggtaagtaaactattaaattagtcttgaaagtgtttggagcttttgcatagaggtgaatctagcaacttgtttacaactatgttaataccgttgttagatgttttctttaccaagaataggagcggcagtccttcctgtgtgataatgcttagctgaaaagacagacagcagcctaggatattttcactgtgagatcttcttgttgttctggaaactaagcatgtaggttttccaaaaccttgtcaaatccacacatttagtgaattcttattgacaatttaagtgcaagggcactgtgaagcacttgaggaagggtaagactcaccttatcctacggagaagtcctgaccttcttggatcttacacatgaacagggtaggcaatgtatgaatatgtgaaaactgaaatacttgtaatcacc

SEQ ID NO: 57373 - DNA, 1161 bp, Homo sapiens
ttattttgtggttttgcaatcctgagcacataaataaagcactccttgatcttcccaataaccttatgaaataggcattgtcatcatccctgttttacaggcgaggcacagaggttaagttacactggtaagtgacagggaagggtttcaaacccaggcagcctggcttcagagtccatgcttttctgaaccactatattctgctacctcttgacacacaggtttgacttcaggaattgatcctacaggtagcctcagaaattgttagggactttcttttcatacctggttaatccctacccctgttaagtaaagctaccttgtttaattttttttatccttaaaaattcagacatccattacttaatcttgctcagttccccagtttacacttttgaatggtaaaacttacttctttgtgtacatagtttttctgtgtgcatttctgggactttgcagctgttccattttttggagtatctcttctctccccagatgtaaatgtaatggacacgcaagcgagtgtatgaagaacgaatttgataagctggtgtgtaattgcaaacataacacatatggagtagactgtgaaaagtgtcttcctttcttcaatgaccggccgtggaggagggcaactgcggaaagtgccagtgaatgcctgcgtgagtgccccatgacgtcagtctgtcagttgtcttaaggacttccaagggtggaagaaggaatgggtgactttcttttattcctccttgaaaggaaagctctgaaaggccagctttttgtgtaatttgagtagtattcaagtcagaggaaagtcatagatgagggcaattcactgtaaaggcaaactgagggttttgtgtttccttcatgaacacatgtcccagagttggagcagcatctgcaaggtttagaaatttgtttggatccaaatactgggccagtgtagtctactccggaatatggtttctctagtcgtatttgttcccctttaaaatactattatttttatcaatgctcaggcatccaaggtaattaacatgtatcaaatataatgagttctaggctaagagggccattccaagattatttcttttttcttttctttttttttttttgagactgagtctcactctgtcagctaggctggagtgagtgatc

SEQ ID NO: 57374 - DNA, 2221 bp, Homo sapiens
ttttgttggtggtggttttttgtttgtttgtttttgagacagagttttagctcttgtcgcccaggctggtgcccagtggcgtgatctcagctcactgcaacctccgcctctcaggctcaagcgattctcttgcctcagcctaccaagtggctgggattacaggcatctgctaccacacccggctaattttttgtatttttagtagagatggggtttcaccgtgttggccaggctggtctcaaactcatgacctcaggtgatctgcctgcctcagccttccaaagtgctgggattataggcatgagccactgcacctgaccttcttgttgttgttaatgaacagtgcatctggtaatcattcttagtctaccaccatctgtctgtctcagagatgtgggaaattatgtttggttttaagtcttaaaatgctcttcttaaaggtacccagatctgatgtaactcgtgtgttttgactgacagcctgtgattgcaatggtcgatcccaggaatgctacttcgaccctgaactctatcgttccactggccatgggggccactgtaccaactgccaggataacacagatggcgcccactgtgagaggtgccgagagaacttcttccgccttggcaacaatgaagcctgctcttcatgccactgtagtcctgtgggtaagtgacaggaagatggattgaaagacaaaatgatagttccgtggacccccggaaaggaaagctttgtttccaaggcatttggacaactaaatgtggagatgtatacattattgtaacacagaaatcagtcaagatctgtctctaccccatgcctccaccttttttaaccaagttgaactttcagatgagtttctggtgtgtaagaggggggtggtggcctgagtaatggttctgcaaataattagcagcaggatcatagagacaatttgaactttgactgtaaaaggttaactgctttgtgagttcttccttgttgatgattttgtttagtctaatctccttagagtgctgaaatattcttagcatgtttgcgtgtgtacagagatgcacagcattcttagtctagcccattcttcaagagtttaacctttatatttgtcatttaggcctatatatacttaaattctagacatgggccttaaggggctgtgatcacccacagagaagtaactgatcttgtgtgcagtgtttcattgggtacaaagtgattttcaacattgatgagtaaattcatcttagcatgtgtctagaaacttaaaatgccatgacttaaagggtcatgattttgagaaagttctgatttaaaatttggtttttattacctttgtgaccatcaggagattgcatactggttctcaggcattgcttttaattaccagttatctttctttaacacattgattttacttacgtatctggccgaatttttgtttgacaataggcattttacattttaggctctctaagcacacagtgtgatagttacggcagatgcagctgtaagccaggagtgatgggggacaaatgtgaccgttgccagcctggattccattctctcactgaagcaggatgcaggtaaaatattttcaaagccagaagaagggggcagaatctatatatagtcaacacatattaatagatcttatggcttattggcagcagggtaaacatttttcctgtaataattgtcaacaagactgaggactagctgtaatggtgagccacaaggggtttggcttgtacagagagtaagcagagttttaatgggatgactatcttaaactgaaaccaaatataaaaatgactttaggctcacacctgtaatcccaacactttgggaggccaaggtggctggatcacgaggtcaggagatcaagaccatggtgaaaccccgtctatactaaaaatacaaaaaaaattagccaggcgtggtggcgggcagcagtagtcccagctactcgggaggctgaggcaggagaatggcgtgaacctgggaggtggagcttgcagtgagccgagatcgcgccactgcactccagcgtgggtgacagagcgagactctgtctcaaaaaaaaaaaaaatgactttagggtccattttgttctatgtgtatttcttttaaaaaagtctgttggctgggcgcctgtggctcacgcctgtaatcccagcactttgggaagccgaggcaggcggatcacaaggtcaagag

SEQ ID NO: 57375 - DNA, 1184 bp, Homo sapiens
agaagaccttgtgcttgagggagctggcttaagagtatctgtacccttgatcgctcagggcaattcctatccaagtgagaccactgtgaagtatgtcttcaggtaagatagccttctttgtaaagtgagacttgacgaacattgtgaaagtggtgtctttatttaagtttaactggcctctagatgtattttaaagaaaaacttctgggttattgtggtgattttgtaaaagggagccttcctttctttacctttatcttttccaattgtactaccaaaccaatagtcttattttttatttgatttgattgttagagcattgcattgttggggcataaatgaataagaaatatttccccaacatccagaattgtccttacagaggttaatgtggccctttctttctctccaggctccatgaagcaacagattacccttggaggcctgctcttaccccttttgaatttcagaagctcctaaacaacttgacctctatcaagatacgtgggacatacagtgagagaagtaagttatgatataatttaggagagttgtttaaaaagatgattggttagaaagattcatgataatgcaaaagtttctctttcctaataatataacactgagaagtgtataacaactcacattatacatgaattatatataaagacaatgcattttttaacggctttcaaggacctggaaaaaatttggtaaaattagtaaatagtattatttactaattgattactcaattgatcagtaggtcaattgaggttacattgtatataaatagattttctaaaaaacctaattataggctaggcgcagttgcttacacctgtaatcctagcactttgggaggctgaggcgagcagatcacttgaggccaggagtttgagaccagcctggccaacatggtggaaccccgtctctattaaaaatacaaaaattagccaggtggggtggcaaaagcctgtaatcccagctacttgggtggctgagggatgagattcgcttaaacccgggaggcagtggttgcagtgagctgagctcatgccactgcattccagcctgggcgacagaatgagaatctgtctcagaaaaaaaaaaaaaatctgattataattctactggctcaagttgcctcatcttcatttctttttatttactgttgtgtaatt

SEQ ID NO: 57376 - DNA, 1482 bp, Homo sapiens
tgaaaccctgtctcttctaaaaaaaaaaaatacaaaaattagccgggcatggtggcatgcgcctgtaatcccagctgcttgggaggctgagacaggagaattgcttgaacccaggaggcggagattgcagtgagtcgagattgcaccactgcactccagcctgggagacggagtgagactccatctcaataaataaatatatatataaacaaacaaataaattaataaataaaataaaagtttgctataccaccactccagatacttagcactcagtaccacatgattgttctaaatgctgttttctaattctcttctccagggtgtagacgtggatatctcgtttagtgtatcagagcccagttaagcaaatggctaattttctctggaatttggggtctagttactttttagtgttactgactttacacaaggtttggaaaacaagccagttcagtgattttcttttcctcactatacacaggtgctggatatttggatgatgtcaccctggcaagtgctcgtcctgggcctggagtccctgcaacttgggtggagtcctgcacctgtcctgtgggatatggagggcagttttgtgagatgtgcctctcaggttacagaagagaaactcctaatcttggaccatacagtccatgtgtgctttgcgcctgcaatggacacagcgagacctgtgatcctgagacaggtgagatgatctttggcagctcttagacctaacttctctttagcaattgtgtagaaagtgctcattgtcttatatacttgtacatttgcctgttttctcacgcctgccttccaaataggtgtttgtaactgcagagacaatacggctggcccgcactgtgagaagtgcagtgatgggtactatggagattcaactgcaggcacctcctccgattgccaaccctgtccgtgtcctggaggttcaagttgtgctgttgttcccaagacaaaggaggtggtgtgcaccaactgtcctactggcaccactggtaagtctgctcgcttcatctgctttcagtgttcccttctataaaaagacctaggggaaaggggcttcggagttgttttggatctttgtgtttggttcagtttcagtggttatggttttcctaataggaagctgaggctcactctccttgtttccttccatctctcttttgggtatcccctgattgtctccatctgtcaaccaagggctttcatgtcaccttgatctaccgtctcccctttaggtgatcaaatctcatcttgaggcttcaaaagcctttctatatctatgatagctaagtttgtatttccagccctggcacctctcctgagctacctacttgccatttccacttggatggtgggctagaagccttccacttgcctttccacatccctgttcacctttctgcaccctgactgagacctgcatgcactacatcaaatgtcaggctccatttgcattcagac

SEQ ID NO: 57377 - DNA, 1080 bp, Homo sapiens
catgccctgattctgtaccaattgatactgattaacaaggattagcacatgcctcttacattttaagagaatggttctgctcaccctgttgtgtgggaaacttacagtgtcaagagtggcacttcacctcttttaatatcatctgccaaaacaacatatatgaatgtgccatcctttgagactggagaagtttataaaccttgggcttgactcatttaccgagcacttttaatacatgatttgggttgattgtcacaacaattaaagtgaagtaggcagaccaggtgcttcctgtctagtgaggaaatagagatgtgctcaaggtcactctggtggtctggccccgtgccagggctgcagcccaggtcctctgccctccactgcaccatgtcttctctcatgtgatgattacactagattacctgtagccagtggtaatctagcaccaaaaatgtctaaggcctttctttcataacatcagattgtctcatccccaggtaagagatgtgagctctgtgatgatggctactttggagaccccctgggtagaaacggccctgtgagactttgccgcctgtgccagtgcagtgacaacatcgatcccaatgcagttggaaattgcaatcgcttgacgggagaatgcctgaagtgcatctataacactgctggcttctattgtgaccggtgcaaagacggattttttggaaatcccctggctcccaatccagcagacaaatgcaaaggtaatcagcctttgatcagattctgtcacagctaaatgcccctttattgtgagaattcttgtgtgtctcttaaaatatgtatagttgtttagtccaatagaaatacattgtgaaccgcttttgtcttttaaaattttctagtcaccacattaaaaaagtataaagaaggacagtcatggtggctgacacctgtggtcctgtaaaaagaaacaggtgaaatgaatactaatgtattttatttaatatatccaacatatgatttcaataagtaatcaataaaaattgttaatgaaatatatgttttttctcacgctaagccttcaaaatccagtgtgta

SEQ ID NO: 57378 - DNA, 1034 bp, Homo sapiens
cagttcagagaacacagtgaataaacaaactataagataatgcaaaagaagcattagcatttgggttttctagttccttagagaaatattaaacagtggagaattgaaggtagagatgaatccttgaagtgcatgaaacgagcactgatagtttcataacttctctaattgctaagtaacctgaagtgtgtcccaaaggttgcacgttttactttaaagctcattttgacttttaaaaatgtcagttttctctgctaaacagacttagccatttaagatctcataaatagtcctgtttttcaaaaaaattatgacagtatagtcagcttatagtcagcttattgttatcagtctgaattaagagatatactcttccttcttttgctaattatgtattattttctccttattctgcagcctgtgactgtcatcctgagggatctctttcacttcagtgcaaagatgatggtcgctgtgaatgcagagaaggctttgtgggaaatcgctgtgaccagtgtgaagaaaactatttctacaatcggtcttggcctggctgccaggaatgtccagcttgttaccggctggtaaaggataaggtaagctgtcaatagtgcattcattcattcatccagcagacgttgagtggcaacttactgtgcactaatctctatagaaaaagtggtgaacaaggtagatgtggtccctgttcttaaagacttatgttccagttgggaggcaaataataaaaaataaataaataaacaaaacaaacactgagataagtgccaggaagaatacaaatggagaataactgggggaaactactttatgtaaggcctctctacagaattcatctaaggtgagatctgatggatacaaaggaatgagccgagtgaaaagtaatggtaggtttgttccaggcagaaggaacctggtatacagaggcctgaaagctggagagtggctggagcctgctgagtgcagagggtgtgttctgttttttaagacgggagaggttggtacggacaggttat

SEQ ID NO: 57379 - DNA, 1014 bp, Homo sapiens
gtcagagcttaagactcatcagcatacagtctttaaagtcaaaggaacagctctgaaggttttttttgaagctggaaaaataaactagccacgtcttctcttcagaagtagacatgcatggagtggatagaactacatattcatgcagcacaccaacatggcacatgtatacatatgtaacaaacctgcatgttgtgcacatgtatcctaaaacttaaagtataataataattaaaaaaaaaaaaaaagaactacatattcatggagtgcccatgattcctgcaggaagtgtgattgagttcttcaggaatacttgtgtgtcctacctttcccttttctttcttctttatgtttaggttgctgatcatagagtgaagctccaggaattagagagtctcatagcaaaccttggaactggggatgagatggtgacagatcaagccttcgaggatagactaaaggaagcagagagggaagttatggacctccttcgtgaggcccaggatgtcaaaggtacgcatgattgaacagtgcatgacttctgtgagatggaccaatctttagatgtggctcctaaagcaaggttagtatagttttataaaattctttctcagtttttaaactactcatagattataaatcatttcattttttaaacactaattcaaaaagcaacctgacaaatttactgctttaagctacagtaagcatagggtgattttccaacaaataaaaaactattcgatattcaaatttcaagcattttatgaatctgttctattacaaggtgtcttaaaatattaaaatagttttaaaaatcattaaaggcatgcgtcttcataagctttttttttttttttttttttttgagccacaatcactctgttgcccaggctggagtgcagtggcgcgatcttggctcactgcaacctccacctcctgggttcaagtgattctcctgcctcagcctcccaagtacctgggactacaggcacatgcccaccatgcccgggg

SEQ ID NO: 57380 - DNA, 1008 bp, Homo sapiens
gggtggcaaaagagtctatttagtttaaaatacaaaatgagtttaatttgtcatacttcaacttatgttttaaacctagttttttctgggttttgaaaaatgttcggcttttagggctggcagcatttttaacaacattgtagatttatgactaaattgcatgtgctggtattaaagtcagtcattctcaccttcattaaacattccttgggtgtcttctctttgccaaccactgcataagaccagcgatatagtggtgagtaagaaagagttcgtagtcaagtggacagatggacgcacggttggaggtgtgatgagtgcacagtgaaggacctactgggtgtggtaaaggctgtccagctatggcaggggctttgtggaaacctggcagaaagttgcgatgtttagaagagtagagatacatagggcctcagatttcatgtgagatgatatgatcctcttcagataatttacagactttcttctgcaaaccattttagatgttgaccagaatttgatggatcgcctacagagagtgaataacactctgtccagccaaattagccgtttacagaatatccggaataccattgaagagactggaaacttggctgaacaagcgcgtgcccatgtagagaacacagagcggttgattgaaatcgcatccagagaacttgagaaagcaaaagtcgctgctgccaatgtggtaagtgattgcaaacgtctgaggtggggatgggggaggcccctggggtttgtagcaagtctgttactggcagtggagtgcttcttcaactaaattgactccatgcatctttttatttgtccctaaatatggggcagaaaagccacattgctcatagttggcatgaaacagttattaaaaactggataaaaaccaagggacatctgggttatttctctagctttgttccttctatggaactaggcagtttaatcttcctttatcctttactgaaaatagaatctgcaatcaagggtgctgat

SEQ ID NO: 57381 - DNA, 2026 bp, Homo sapiens
caaatgaatgacgttttctaatatttgtagaattgttgcccatgttagtatatgtacatataataaagtaggccgggagcagtggctcatgcctgtaatcccagcactttgggaggccaaggcgggtggatcacctaaggtcaggagtttgagaccagcctggccaacatggcgaaacccatctctactaaagatgcattagctgggcatggtgtgtatgcgtgtaataccagctactcaggagactgaggtaggagaattgcttgaaccgggaggcggaggttgcaataagccaagatcacgccactgcacaccagcctgggtgacagagcgagactccatttcaaataataataataataataataataataaagtaagcattacctgaattttacttatgtccctatcagatggttgtttcatggcttattttttgttttatctgtatagtcataaacaggaagctgatgacattgttcgagtggcaaagacagccaatgatacgtcaactgaggcatacaacctgcttctgaggacactggcaggagaaaatcaaacagcatttgagattgaagagcttaataggaagtgagtataatttgaaagtggtttacaccccttcaggtgttctggtaagtaacactagttcaatgaaaaattaaatgctggtgcattcagggcatacattcatgcagtaagatttcctttgttaatcatgcttttgaaatggaaaagtaagtagagaagggcatgtgaagccacagagatttggtttgattcaattactgtaactacagagaatagtaacaagatgagccatgatacttaaaattgtgcacaaataaagaagaaaaaatataatagagtaagtagaggaaacataattgaactacaaatctttaaagggtgtctgaaataagaaagtatatggtaagccatacattatagaaaattttttcttttttttgttgtttttgtgagatgaagtctcactcttgtcccccaggctaaagtgcaatggcgcgatctcggctcactgcatcctctgcctcccgggttcaagcgattctcctgcctcggcctcctgagtagctgggattacaggtgcctgccaccacacccagctaatttttgtattttcagtagagacggggtttcactatgttggccaggctggttttgaactcctgacctgaagtgatctgctcacctcagcctcccaaagtgctgggattacaggcgtgagccactgtgcccggccaagccatacattataaatagaaatgataaaagaaaatgtaaatatgcaaaatgttggtattaaaatgcaagcattttaatgtagcatttcctttgaggttttgggcgtattatcacatgatcatgttaatctggttaacattaagatgctaaaagcagctaagattgtcattaaaccacattatttgtgtcttaggtatgaacaagcgaagaacatctcacaggatctggaaaaacaagctgcccgagtacatgaggaggccaaaagggccggtgacaaagctgtggagatctatgccagcgtggctcagctgagccctttggactctgagacactggaggtatgggggcagcctgtacgcacagccccaccccgtctctcccccaagtctatgtgagagccgactgctctgcacctccctctgtcctcccactgactcgctggtaaagttgagtcttatttcacatacgctaatagaacttaccaaggtagccagatgtggtggctcatgcctgtaatgccaaccctgggaggctgaggtgggaggattccttgaggccaggagttcaagaccagcctggtcaacatagtgagaccccatctcttaaaaaaacaaaaacaaaaacttaccaaggtaaagaatcctgtgattgtaaacattaaatagcaaagactactttaatgatatgaacaatcactcctaagtctttagtgcaaatccaaattataataatacatttgaattgcttaaagcagagtaca

SEQ ID NO: 57382 - DNA, 1485 bp, Homo sapiens
gcttgaggtttactaagtttcacttcttatatctgaggtgttgacttgatttttaccataaaggtttaggtctctttagatatgtacagattgtctgattctatatatttataattagaaaataggcagaattagtctatgatgataaaaatcagaacaatggcaggcacagtgttggaaaggtagagtagagatcgggtggaaagggagaaaagggagcttcttgggtgatggaaatctgtattttgattggggtgttggttatgcagaaatgcatttgtcaaaactcatcaaactatatgtggattctgtgaacttcagtgggtgtaaagtatatctcattttttaaaaaagtccataaaatcttgatctgtgcagttcttttaaaaatatcattgagtattaggtgttacagagttcctaagcctaccttttcattagtttaaatgttttatccaaagtgtagtgatcttacttgcttttcacagaatgaagcaaataacataaagatggaagctgagaatctggaacaactgattgaccagaaattaaaagattatgaggacctcagagaagatatgagagggaaggaacttgaagtcaagaaccttctggagaaaggcaagactgaacagcaggttggtttgatttgcaggtcgcttcatttcttgaggcaacatttgaacagtccaaatgggtctgtgatgatgccgtactttcagagacagcagaccccagtgctgagagagcagcctaacagattttatgctggcaagtctcagggtggcacctctggagagccttgtctgtccaggagacagaagggatttgctttgagggttcatcctctcatctgccatgtgtttgcagaccgcagaccaactcctagcccgagctgatgctgccaaggccctcgctgaagaagctgcaaagaagggacgggataccttacaagaagctaatgacattctcaacaacctgaaaggtagaaaaggctgagataacaggggcaaatgcttccgccactagagtgatttttttttttaatcatgacttttaccatatttattacttcatccccaactccctactttttttatgctaaagtatttcaaagggaaatcccagagctcctgtcattttatccctgcatacttcagtatggatttttttttaaagatgttttcttattaggcaaactcacataaccaagatgcctatttagagaacttatataggtaaatggagattatctttcattttctctgccagtggcatctgattctttgttgttgtttttttttcttcaccccagatagaagagaaatgtgaccaattcactgagcaactgtgaattcttgtctgataaaacagtcataggttctataaatagagaagctttacaggatgctttacagggtactagttgaaaatatgggccaggcacggtggcctgtaatcccaacacttcgggaggaaggatca

SEQ ID NO: 57383 - DNA, 1092 bp, Homo sapiens
ctctcaaaaaaaaaaaaaaaaaaagtagtagttcaaaatatggactctggtgtcagtgggccttggttcaaaaccctgcaccctgcaccacaggtcatgtaacttctttaatcctcaattttcttataaaaatgatacagcctattttatgtcaaagacacaaagctcttaactcagtacccgacacacagtaaacactaaataaattgcagcttttaataatggttgaggtagtggtaatgggatgctcagcgctctgcattttaaagcacattgttgaagtaagaattctatttccagaaacggaacatttctataacactaactgggagacctattctgtagagatgtgtaatttctaaaatttcagcccatgctctcttccattttttaccctgacttccattgttcataaaacaaaatccagttggaactccctgaaaggccccctttttacttgttgggagtttagctcaaatgtgtccttgaacttgtttcagattttgataggcgtgtgaacgataacaagacggccgcagaggaggcactaaggaagattcctgccatcaaccagaccatcactgaagccaatgaaaagaccagagaagcccagcaggccctgggcagtgctgcggcggatgccacagaggccaagaacaaggcccatgaggcggagaggatcgcgagcgctgtccaaaaggtgtgcgtttcctcttctccaagagtccctgcccatatctttctctggtcactttccagtttctttccagaccctcagagcccttgcagatttttttcctgaacttcagtaaaattgtcttaaaccatatttgtctttttttttttcttttgactaggcatgagagtaggtatccacattgaggaggggaactcagtaaaagggtgctttactctaaaatttctactatgtctcagtgtgaggtctggcttcagaggtctatagagcccattcccacaaaaaatcagactttttctaaataaacattcttctttgacctagacaggtggtatttatttcaatactatgtagtgtgccttatcaatataactttcaagtccccctttcaagta

SEQ ID NO: 57384 - DNA, 1773 bp, Homo sapiens
aagggttttggtttagttcaaagggtgaaagaagatcttttattattttggtaaataacttctaaggaaacaaaccaccctcacatgcactatctcatttgtatttctgtcaattctgaaaggccagcatttggccagtattatttgaatctgtattgtattttttaaccagaagaatgaaggtttatagcttcattcttttggaagaggaggctggagaccacaggttaaatgcaggtgcatcgctcttggccggccctggcagggtcctttctccctccttttacactcgcagacaagcttgtggatgctcaataaggacagctgccgtttggacagagattaatcatttatttgtgaaggttttttctgccttgctttcttgttcttttttaaatcttcacattgttttgatcccaaaatgtttgtgttgtccttactcaaaactaggaaaaacaattatgtggtaagaggctcagagccacttacttaaatctcaactagatttatttgtgagaacatctgttttctgatatttagacacttcctcttccattgctgtttcctatgactcatgcacagttatttgttcaggtttcatggaatttcccaagtgtatttacctttgtttggtttttaaaatgtaaattatattgccccaataaatgagtatgtgtgtcagggggactgtggctgggtcattgcatgtggagggggagtttacagaagagaactcctagaagagctttacttaactatgaaaattttcaaagaataggacatttctaataagtccctaagagtgtcctgaaggacatgttttggttctgaaacatagtttctataatcatccttaaaaaataacttgtttctgcttaataggctttactatgaatatacctccatatattattgagttagaatgtgagaaaaggagattaatttttgaagtacaaatatagtgagttagtgagtgtaggcatcctgactgcctagtcataactttgatgaagtagaaataccaacatcctcaatatgaagatatgcagcagccccaccaaaaaaaaaaaaaaaaaaaagcaatgagaggtttcaatttcctaagttagaaaagggaagaaaatctggaaattagatttgttgggtcattgggaaaaaagatttaaagaagatgaaaacatacagtcaagactctttgcctcatttttcccttacaggcttcacaggctgctcaagaagccgagatcaatgccagaaaagccaaaaactctgttactagcctcctcagcattattaatgacctcttggagcagctgggtacgtagccatagagtcatttttgtcagtctctgaatcttttgtactgttcttaggatctgatatagtacagttgactcaaaagcagatgatataggtttacatgaatcccttttaagtcattaattaaattattaatatttccttttgctgttgcttatttttgaaagccttataaaataaatgtttgtcttgcatgacagggtctttaagagcaacttgcttctttaccatacttattatttgtcagctttacagtgtgacctgaatcatgactttaggctgtgttaatgtgacaagtacttactaggtgccttctgtggaccttgccctaagtagaacactgtggtctgaggagtttctttttatattttgaagatatattgccagctagggtagcatttatggtccagtatcattgtacaactaaacagtgatttttcttaactcatcttg

SEQ ID NO: 57385 - DNA, 3897 bp, Homo sapiens
aatagtgtctaactcctgaaagcagaaagtgaccttcaaaactgacccatcttccctggaatctctctaagagctgagggattagggttcttagagatttgtgtatctttgatggcactaaaatgacatagagtttacatgtatacacctggaaaaggtattaaatgttatcagatggccctcaaaggtctagaacatggtagctgtgcattgaggaaacattctgcaaaaaccattgtctcagaaagaaacatccagctctatattaattgtatgctcagacccatccctgctgggttaggtcagcatttgtacttggtttgcatattttataccattgtgtgacatcaacaatctgcaagtcacatttgccgggctgcctgtgcagaatggcagctgctgggcctagagtctagtgcaggtacttgtgaagggatcattcttactgaatatgtctgttctcttctatgtactttctgaccctccagggcagctggatacagtggacctgaataagctaaacgagattgaaggcaccctaaacaaagccaaagatgaaatgaaggtcagcgatcttgataggaaagtgtctgacctggagaatgaagccaagaagcaggaggctgccatcatggactataaccgagatatcgaggagatcatgaaggacattcgcaatctggaggacatcaggaagaccttaccatctggctgcttcaacaccccgtccattgaaaagccctagtgtctttagggctggaaggcagcatccctctgacaggggggcagttgtgaggccacagagtgccttgacacaaagattacatttttcagacccccactcctctgctgctgtccatgactgtccttttgaaccaggaaaagtcacagagtttaaagagaagcaaattaaacatcctgaatcgggaacaaagggttttatctaataaagtgtctcttccattcacgttgctaccttacccacactttcccttctgatttgcgtgaggacgtggcatcctacgttactgtacagtggcataagcacatcgtgtgagcccatgtatgctggggtagagcaagtagccctcccctgtctcatcgataccagcagaacctcctcagtctcagtactcttgtttctatgaaggaaaagtttggctactaacagtagcattgtgatggccagtatatccagtccatggataaagaaaatgcatctgcatctcctacccctcttccttctaagcaaaaggaaataaacatcctgtgccaaaggtattggtcatttagaatgtcggtagccatccatcagtgcttttagttattatgagtgtaggacactgagccatccgtgggtcaggatgcaattatttataaaagtctccaggtgaacatggctgaagatttttctagtatattaataattgactaggaagatgaactttttttcagatctttgggcagctgataatttaaatctggatgggcagcttgcactcaccaatagaccaaaagacatcttttgatattcttataaatggaacttacacagaagaaatagggatatgataaccactaaaattttgttttcaaaatcaaactaattcttacagcttttttattagttagtcttggaactagtgttaagtatctggcagagaacagttaatccctaaggtcttgacaaaacagaagaaaaacaagcctcctcgtcctagtcttttctagcaaagggataaaacttagatggcagcttgtactgtcagaatcccgtgtatccatttgttcttctgttggagagatgagacatttgacccttagctccagttttcttctgatgtttccatcttccagaatccctcaaaaaacattgtttgccaaatcctggtggcaaatacttgcactcagtatttcacacagctgccaacgctatcgagttcctgcactttgtgatttaaatccactctaaaccttccctctaagtgtagagggaagacccttacgtggagtttcctagtgggcttctcaacttttgatcctcagctctgtggttttaagaccacagtgtgacagttccctgccacacacccccttcctcctaccaacccacctttgagattcatatatagcctttaacactatgcaactttgtactttgcgtagcaggggcggggtggggggaaagaaactattatctgacacactggtgctattaattatttcaaatttatatttttgtgtgaatgttttgtgttttgtttatcatgattatagaataaggaatttatgtaaatatacttagtcctatttctagaatgacactctgttcactttgctcaatttttcctcttcactggcacaatgtatctgaatacctccttccctcccttctagaattctttggattgtactccaaagaattgtgccttgtgtttgcagcatctccattctctaaaattaatataattgctttcctccacacccagccactgtaaagaggtaacttgggtcctcttccattgcagtcctgatgatcctaacctgcagcacggtggttttacaatgttccagagcaggaacgccaggttgacaagctatggtaggattaggaaagtttgctgaagaggatctttgacgccacagtgggactagccaggaatgagggagaaatgccctttctggcaattgttggagctggataggtaagttttataagggagtacattttgactgagcacttagggcatcaggaacagtgctacttactgatgggtagactgggagaggtggtgtaacttagttcttgatgatcccacttcctgtttccatctgcttgggatataccagagtttaccacaagtgttttgacgatatactcctgagctttcactctgctgcttctcccaggcctcttctactatggcaggagatgtggcgtgctgttgcaaagttttcacgtcattgtttcctggctagttcatttcattaagtggctacatcctaacatatgcatttggtcaaggttgcagaagaggactgaagattgactgccaagctagtttgggtgaagttcactccagcaagtctcaggccacaatggggtggtttggtttggtttccttttaactttctttttgttatttgcttttctcctccacctgtgtggtatattttttaagcagaattttattttttaaaataaaaggttctttacaagatgataccttaattacactcccgcaacacagccattattttattgtctagctccagttatctgtattttatgtaatgtaattgacaggatggctgctgcagaatgctggttgacacagggattattatactgctatttttccctgaatttttttcctttgaattccaactgtggaccttttatatgtgccttcactttagctgtttgccttaatctctacagccttgctctccggggtggttaataaaatgcaacacttggcatttttatgttttaagaaaaacagtattttatttataataaaatctgaatatttgtaaccctttatatttggtgtggcctgagtgtggtactggggacataagatgttttaaaaggtataatgaatgaaaagccatacataataccttctttgggtgacttattttcttgagaacaattcagtatacattttatatatatatatatatgtatgtatatatgtatatatgcctctctcaagttgggatactgcagtgtagtctggaagttggtgaactttttctataaagagctagatagtaaatgttttaggctttgcaggccatgcgcctatgggctgtagtttactggaaccccagtgtagcctcaatactcagtgacaactgacagtcaggcacagtggctcatgcctgtaa

SEQ ID NO: 57386 - DNA, 1019 bp, Homo sapiens
tgaagagtaaatgatgctgtcttgctaaaagggccactgaatttttattaaagatgattaagtgagaaagataatctacaataaatggacacatttccttagctaggaaatggcacctacaacacagtcttatttattccttgagcagcttttccttttgagattatactccatgctagcctgtctgagtcatcatgtattctattaattccttttttttttttttttgaatttcacatgttgggtcctcctaatctcaactggaattatttaacaagagttccttaagcttttctgcactcactcacctaaaaaggaagcgtggctagcatgcaccatttccatgtcactgatgcagtaaataaagtcggaagcagaaaggtgtaacaatgtattgactcttactgtatgccagatagattataatatatgaattatctaatttaattttcacaacggacataagagataaataccaccgttacttcttgtctatagttgatgaaacacagtcatggagaggctaagtgacttgcccaatttacacagctagtgagggtggattcagaatttaagccctgggttttctgaccccagagcctgtgtgctcagtcacagtgggagactgccatacctctctacatggcatgatatatgaacaccacctgtctttgttagggagttaagaaaaataaaatcccaagagagatctgacttgagatctttagactgtaccacttgcaacttctaacctgttctctcgattgcaggtactgggtacattgacaatgtgaccctgatttcagcccgccctgtctctggagccccagcaccctgggttgaacagtgtatatgtcctgttgggtacaaggggcaattctgccaggattgtgcttctggctacaagagagattcagcgagactggggccttttggcacctgtattccttgtaactgtcaagggggaggggcctgtgatccagacacaggtgagtgaaatgacacctggaccaggtggc

SEQ ID NO: 57387 - DNA, 1357 bp, Homo sapiens
gttggagtgaggacctgtaaggcaggcccattcagagctatggtgcttgctggtgcctgccaccttcaagttctggacctgggcatgacatcctttcttttaatgatgccatggcaacttagagattgcatttttattaaagcatttcctaccagcaaagcaaatgttgggaaagtatttactttttcggtttcaaagtgatagaaaagtgtggcttgggcattgaaagaggtaaaattctctagatttattagtcctaattcaatcctacttttcgaacaccaaaaatgatgcgcatcaatgtattttatcttattttctcaatctcctctctctttcctccacccataataagagaatgttcctactcacacttcagctgggtcacatccatccctccattcatccttccatccatctttccatccattacctccatccatccttccaacatatatttattgagtacctactgtgtgccaggggctggtgggacagtggtgacatagtctctgccctcatagagttgattgtctagtgaggaagacaagcatttttaaaaaataaatttaaacttacaaactttgtttgtcacaagtggtgtttattgcaataaccgcttggtttgcaacctctttgctcaacagaacatatgttgcaagaccctcccatgggggcacttgagttttggcaaggctgacagagctctgggttgtgcacatttctttgcattccagctgtcactctgtgcctttctacaactgattgcaacagactgttgagttatgataacaccagtgggaattgctggaggaaccagaggcacttccaccttggctgggaagactatggtgctgccttgcttctgtatttccttggattttcctgaaagtgtttttaaataaagaacaattgttagatgcctggggtcagtttctgatttactaaactctaagcctatgatggtaccaaagtaatggaaatgaaaatgccacagaaatggcaataggtcctagagttagcatcttcagttcccacttctgagcatcttacttcgcccattccaaccatacaggattgatgatgctgtcaatgagatttttatgaggtttaactgatgctgtcttctaagcataaagctttatttctagaaaaactctagctgggtgggggggatatagttaatattcttatctttttcatcagctataaaatgaaggtaaaattaatagtttgtggtgcatatgtcatgctttttaagaagttaaaatgtactaaattaagatcttgaattggtcatctacgcaagcggctgaggaaacaattctgcttctgtccattgacccccagattctga

SEQ ID NO: 57388 - DNA, 1052 bp, Homo sapiens
gaacttgctgttcaaattaagtagaaagtgagactcaataataactgaactacagcaaaaggcagagaattacagggagaaaaaacttgtacttaccagcccaattctactctcctcaaactgacacacacacacacacacacacacacacacacacacacacactcttttaggggactaagagagagaagcatgttattacattttactcatccaaacagtaatgcaaaaataaaacggtagaatatgaaaagctcaggatctctcccaaggctacctactgcaggagggccaacaggtgagatgggaagaatggaaacagggaccgattttgtagctcatacaattaggacaccttaggaatagcattgtagtaatggtgatgaatatgctctgccaaattcatccagtctgcaccatcttatagctgcccagcacactcgactgttcatgtggtctctttgtagtgtgagtttggagtgtcctattagcctgttctggttaggaatgagttaacggctctttccctcaaccttagtctagtcccagggctgaggattcagctggatccacatggtcttgagggttggcatgaggagggggaagcttttttgaatcgctttttgatcacataatctgccattttaagagtaagatttgctttatggaaatcaattcattaataaaaaatgatattcaagttgcaataccatttcacagtgaaatattttgagtacaattttgttgctagaatagtcatgggcaagagttttatgcaaaatgtttcaattatgttaataaataagacaatgctacaagagtcttgtgtcttggtcaagaactttctctgtgaattgcagcattaatcactttttcttcataattttacttgacaggagacaacagttgtaaaaatgtacttagaacaagcagtttcctgcctggttcagctgatgccacatgtgttatataaaagtatgtacagccacatccaaggatgataaagggaagaataattagcaaatttgtaaattgtgcctccgttttcttag

SEQ ID NO: 57389 - DNA, 1717 bp, Homo sapiens
gaatattagcagcttaggtaattgtccatgtgatttaaagcaacaattcccaaaggtgggtgcacatcagaaggattagggagctttgttaagagagaggctgcagcccctcgacacatgctatatcaaaatttctcaggtgaggtctggggaatatgtttgttgttgttgtttattttcttttatttttcacaaataatactttttatttgtcacccttaaaagtctgaatttttacagagtcttggtccagtggcttttatccaccagcttgttcaactttagcccctgtctctcccccagtggtttttccagagccactaccttcaccacatcctctccccatccctatcccacgatgttagtgaaaacatcgcggacaggacagattggcaagccttttctgttttccaatgctgtctgggatcaatttattgaccacttctttcaaatcatttgtctacaacaactcctctgccccctaccccgtcatgattaccatcatcttctcctagatttggcagacctgttggtgctgagcctaagaggtcttccatatccgattgttgcctctttttagtaaaaccaacgcagaatagatgaagcaaatagccattggtagtcttcacatcagcctgagcttcaatcatggtctgccattttttttgacaatagaacgcattttgtcatgggtaagatccaggccatggaagtgagtcaggcagtttttgccctggagatcttcagtaattagcttgaattttctaaatgcaacttcagccttctgcagattagcaagactcacttcaaatgcacaacccttaaggctatcacaaccccatgcaattttggtttcttgcatccttgggactggtgtttttccgttatttcttatatggaacatatagctggtgtttttacatcataccagtcttataaaacgaatcaagcactcacttcttggctccctttttgccaccttttgtaaagcgactattcttgccaaccaccttagtgctgcttagagaaccaaaagggtgaaagtgcaactctggtgagaatttaggcttaaggggtgggagcgcacaagggatgcaggtttaattagggtggccagacaggatctcaccaagaaggtgacatttaagtgaaagattttgagccaaggagcaacataatttggcttatattttaacataatcagtctggctattgggaatagactaaaaaaggcaagcaaataacagggagaccagagcaatccaaatgagagatgacagaggtgaactagtttcctagttctgcaaacttggtggcttaggataacacatatgtattctcttacagtcccagaagtcagaagtctgaaataggttttattgggcccaaaccaagttgttggcaaggccaacaactccagagaatctaggggaaaattggtttccttgacttttccagcttctagagctgcatttgtcgcattcattggttaatggtcccttcctccaacttcaagctccacagtggagcatcttcaaatctctttctactccatcttcccattatcttctctcttctgggtccaatctccctctgcctcttgtaagggtacttgttactgcatttagggcctgcccagataacccaggataatctcaagatccttagtttaatcatatctgcagagtctcttttgccatattcacaggttccagag

SEQ ID NO: 57390 - DNA, 1050 bp, Homo sapiens
ctttttaaggagggaagaggatataaaagattcggtggggggaacaagacctttggggagatggttctggttggttgaaataggtggatcctggtatttatttgggaaggtattaacttttgagcaagcagcaaaatcattaagtttaatgattacatgtattagctgctctcaagagtatttgcatttcaaatgagcaagagtcaatatttaacccaaaagagtaaaaacttggggatggaacatcagccaccagagatggccactgagggaattgttttatctttttttctttttgcgctcctcaaagcccagcattccacaggctggttctaattggctgtatcctacatttttccagccaaccagccgtgggctaactgcttcctacatccatcagctatgggaaaacaaccaaagaaaataaacagaggaagagcctcgggcattagccactccagaagaaatcccagggccccaggataaatggaacaaagacaaactttggctattcaggctcagatggtttttatcagacagtccagctccagccaggaagcctgatggactcttgcaccccagggattaggcccccacactgatacgactgataccaaacgataccaaattacagtctcaggggaaggaggctcagctcctgccaatgggggattctggctgttctcatgtgaaaggcactgttggtttggtttccaggctgttgacttgagtctggaatcccctgccttcccacacccccagttaagttggcagtgggagtggggatgatttcatctgggaagcccctcttaagaatggttctctctctttttttttttttcattaagagggccatcctggaaatgcatttccacctgctggactctgaccttactggtttcctcccagcctttcctccagagagtggcaggggctacagcaagggtggaggatcctttactgaaatggagggagcatgtttcagaagctgctcatatactgcatggcttttgtcacaagttctctctttgcatctttttaaactcatcc

SEQ ID NO: 57391 - DNA, 1037 bp, Homo sapiens
ccccatggcaggctcagtaagaaattgctaaaagctattcttatccagccgaagattatccaagtaggtctcctcccacacaggttttaacagatagtttccaacctctcctgaatgacttggaggaatgtacactttaatgggttaaaatggaccattttacctaattaagagtccagatcagggaatttaaaatatcctatttcctcaatgctaagatatatgactttcatgctgagcatttctgaaactgcaataaattttataatatttatcttcaatttagtgtttcttcacacacacatacacacacacacaattaaaatggatatttgtttgaattaaaggaatacaacaacatgattgttactctagtttatgctggtagggggatagaaatcatgaacccccataggcagaaatgggcttcagggaggctaggaaccctgatttggaaagctgtagggaacccttgcagtatgtctgtctctcatctttgcctctttctctgtagctgatacattgtttgctatttctaccgacttgctacctctgctcctctacctctgctacctctgctacctctgcacagcacaaaaacagacaaccacagccccacagaaggaccaaatctctctgtctccatgtttctctgtctctctctcctgcaatccaaataccgggggaaggatttctattggcttttatagtccaatcaactgatgttggaatgggaagtagggtcacattttacaaggtggctaccaactattactgtgagtccacaggtcaggctaggagactctgtagattgcggcagacattccacaagatcttcctcacaggaggcaaaggtttgttggtgcagaacatcattcccatggcactaggtgttgaggttgggaggacagtaggcagggctcctagagacaagtcacctaactagagccaggaggattgctagctcctgacaccaagcctgatggtcagatcagcagtgaccatgctgactcatggggctggctagggctttgtcc

SEQ ID NO: 57392 - DNA, 1024 bp, Homo sapiens
aggctgagaatttcccctggtaagtctgaatccctagagaaattgctagatccaaggaagctgtgccacttcctctggtccagagtagtttaaaagtgaattggggtggccctcctgggcttggctagcatgttgccagtcagactgaaaggcaggcaagcgtctttttggctttttggaatctcctccactgcccccatgtgcagggttggctggtgactgtctgattgcatctcactttcaacccatgtgttcctataaatctcaaacctcattttaagccttttctccattctgtttgccctcattatccccctctctttggttccagtctatgtgactgagtactctaatttattcagcatttagtgctttttaacctgagtattcacaatgattaatatcacattctgcctcttataatttaattctgaggcgcatccagggttatcatttccccaaaagacagttaggtaagacaaagttgtctattaaaaaatctcacattggtgagatcagagaacacacaaaggagcaggcttaactttaagactctgggccctgctgagtctagaaaattctagaaaaggcccactggctttgtgtttatgttaaaaataaacagttctctaacagaaagctggccctcctggctgggaggtatgcatagtgctttggcagagcttgcatctgaggacacaggtttgatatggagggctacaaaagtgtgcaacatggaggccaggcatggtggttcatgcctgtaatcccagcactttgggaggctgaggcgtgtggatcacgtgaggtcaggagttcgaggccagcctggccaacatggtgaaaccctgtctctgcaaaaatacaaaaattagccgggcgtggtggcgagcacctagaatcccagctatgaggctgaggcaggagaatcgcttgaactgggaaggcagaggttgtagtgagcccagattgcaccactgtactccagcctgggtgacagagtgagactccgtctcaaaaaata

SEQ ID NO: 57393 - DNA, 1097 bp, Homo sapiens
ctcagagttgccgtgagaaggggtctcacagccaggacctggaagtgttccccatgcccgtgattaggcagctgtcaggacagggagtggtgactgtgcattttaatagaagagctctccctgcccatgttgagcagcaaggttataaatggaacactgcttgctaaattgccccattttgcacagactcacttcatgagttgccggctctgatgtgtggctgaatttgatgattaagcaagaacaaaagaactatgaatctactggggaatacatccaattaagtggtatcaacgcaggatgactgagaagagaatggtgtgttaatgttttcaccggccttgccaacaaatatttatggagtgtcaatagggaggcaagaaggtgcttagaaggtgctgaagcaaagtgcttagagttgagatcaggaatggctagtggcatgttatgggacagaggagggaagacagacacacacggtcaatctggagacagaattagcacccttgtaagcggttgagctccttcagatcttcagacttctttatgtaattctccccaaacaccccaattctgttcagatcaatggcatttattgtgtggtgtgtagaggcctcaggagctcaaaagagatgagacagcgcagcccaggggcagggagtggtcaagagaaaagacttctctgtccttattccggcctccaggaaccctctgtagtccactgcagccatgatgttgcccttaattctgaacccagaggaccctgtcactctgcagggacttgctctgcaaagccctccgagctaatggctctaagacttgctgtctgttctagtgcttctcaagctctctgtggtgaaagaccaggtttttattttgatttcttttcagtttccaatccactgtgggatcaatacttttatataataaatattaattcctaaatttgtttagtaaataaattagaaattgaaataagaaacaaagagatacaaaacacaagaccacgtttaattatcacattcagcagacatacatagacctaccaaaatcactacagaagtttctagatgcttgctctccatttctttgcttat

SEQ ID NO: 57394 - DNA, 4740 bp, Homo sapiens
ccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgagcctgcagagcgcgcagtacctccggtgagtgccgaggccgggctggtacgtagggggagcgggccgcaggttggggcatggagcaacagacaccgaggtaagtccggggtggcgggggagttgctgcgtcctctcctcgccgggcaggtcggcggagactgcaaggggatctgcgggagggggcggaacgggtatgggtgcctagcccctaccgcccgggctgagctctggcgaagccggctcgtcccggtgcgaggagggaggttggggaagcgtgagaatgtgcgcgcgcgcccttggtctcgggtttgctagcgaggggtggagagaaacgtccggggaggcggcggcgaccccgagtggaggtgggtgtggaggagtctgatccccgtggcaggggactcgtggtgtggcgtgggattggttggagcgatgcatgagtagaggacggggaggaagtctgcacacctggggtgttggggcgggggaaccgcggagggcagacagggggagagggagaccgcaggaaactggagcttgttcttcattctcgggttgggagtattgaggaataatgtcatctgtagttagttggcggtgtggggaggcgtgaaggggaatagatggggaagtgaggaaagagggaggcactgtggacaaggttgggtttttcagaagaaactgggttagaatcagtgtagtcggaagataccattctgagagtcgtgtgtattcattaagagtggtgtaaggaacttgtatgtcagaggtagagtgacacatgggaatagtgtgtgtgtgtgcgagatgtgtgtctggggtggggggcgcggcgattgatgcacatttcaggatgaagatgtagataggttgaacttagtacctgatggcgagaacatattgaatggaaggacaccagcttttgtgtcagctgaaaggttccatggaagctgagtaagagcttggaggcagaggtaaagtgggtcaaaaatcttgatagagaaaagtaaggttgttagatcctgaaattaactggggagtgactactgcttagaaaaggggaagactttaaaattggtcctttttgtctttcaggagcagaactaagaaagggaggccttatggaaagatgttttttaaaaaattgtttcataccttgcggaggagggagttggatgaggtggaagtctgaaatgagtggaaaagtcactttagctgtttagtgacatgaaagtattgacgtgtgtggatccctatatgtatattgcaagaggtgtgtagttacctgatacatagggtggccattataatttttaaagtagtaaagttttattaagcataatagggagagaagagaatgatgagatatttgaacaatgcttgaatgcttgattttaacacaacatatatgcccagtgaccacaggacagttggaatgatgtctgtaatttgaggtcctttttttcatcttagatatccctttgttgtttaatatttcaaataaatatagctatgacaaagatctgttgtaggtgctatagagagatggaaaccatcagggtgctgattagtcttaaggaatttgcagttgagtatctgttaggcaagtaaattaaacagcacagagtgtaagtaccatgaaagataccaaacgttgccgggcacgggggctcacgcctgtaatcccagcactttgggaggcctaggcgggaggatcacctgaggtcaggagttcaagaccagcctggccagcatggtgaaaccacgtctctactaaaaatacaaaaaattagctgggcatggtggtgggcgcctgtaatgccggctactcgggaggctgaggcaggagaatcgcttgaacccgggaggcagaggttgcagtgagccgagatggcgtcattgcactccagcctgggcaacaagagtgaaacttcgtctcaataaataagtaaatacataaataaaaataaaagatacgaagtgttttgagtccaaaggcaggagatcacctgagcaatgggaggaaatcaggaaagactttgtttatttgctcattcatgtactcatgattcattagttgttttgttgatcacctgtatgggaggcattgtaccaacatctgagaatagaaaaagaacaactccaccctccttttacagagcttacactttgttagacttcaagaaaatggcacttaggatattgttcatccttaatgttcattttgacagatgtggattgagaagcggggaattccaaatggaaggaaactgagcagagttatgtaggtagggaagctggggggaagggaggtattcagtccagttagacaacaaggtagtgtgatatagctgagaaaacttaagagttgtagagattatcaagtttgaccctttccttttacacatgaggaatgtaagcccaaagaaggtaaaattgttgaggctcatatagctggtatgtggaaactaactgaaatgtaggtcttctaacttcaagtcagctgtagtacactgcatgtcagtattcatctgttctttccacaaatataagttgagaacataatatattctagtgttgagggtacactggtgaataaaagggtgaacatgggaggatatattatagtagaagggcacagtcagtaaacatagcagttaaatatatatcaggtggtcacaagcactaggaagaggaataaagtaagacagggatgtactgttttatctggacaaagtggtcggggaaatcctatttgataaggtgaccatatttaagaggatcctgaatatcatgttccataatttatagttaaaatgggtagacaatggagaatctgagatgatttgctagaattaatatgttcacagctatgtgttaggaaaatgactctgtgtaatgtagtggtggataacagagaaaagtaaggttgttagagcctgacattaattggggagtgactactgcttagaaaaggggaagacttcaaaattggtcctttttgtaaggttcttttccttacaaaagattccctttgggactttggtcctgaataaggtactggcagtggatctagaaagttatgaaaaacaaattggcagagtggtggtacttttaatggggaagatcagtggactttgagaggcttcttgttaatgtgccttatattttatagcttgacatggtagggaagacttccttagatgtggaatcaatgatagtttgagatgaacttagttctttgaagaagggagaaaaaaaatgaatacaatgatatttttcagctaaaattgagcaggcaaaatgggggaggcataggtcctggggtcccttaaagattcctggagccagtcttgtctcaatcttaggcatttgtcctaagtaaattaaaacaagtgttagaagtctgagacctaggtggtggttgtgggaatcataaaggcttgtgccagtctgaatttccctcctcctcttttagataatcattccatttaaagtctgcagtggggacactagagaatgtctttagggaagcattatgttcacgttctttgaaaatagaactgttggtttttatagacacttcagggaggatgccgagtattgctgaatggatgtggttggggggtgtagcaattgttttcgtgaccttgacttgaagaattttcttgcctacctttgtcagtggtggaagatcatgactgggcaatttttaatctctatagctacagatcctgcctcatgtagatgaaaattagttttgtcttggctgaattttaatttgttagagtaaatgagctgggatgtctggcattgaaatggtggggtggtgggaaaccaaggagcaagatggctgtttcagaagggtcagaaatgaagataggaggcaagaagtcccagtaagaccaataaagagagaattcaacatcaagggaactgaattagtctcaagttataaaaatagagcagagatgaaaggaagaaaacctatcttctatgtgggaaagatgatgatattctgggcaggaaaggataatgaaattttttgtttgttgaaaggtaagtatctttttaatacactgacaagacttctaagagaatcagttaagttgaaaatactttgttatgttttataaaaataaaaatatgatcttaaatatgagggttctaggccgaataacattgggaatttattactcaaattgaaggagaattcagagtattttctcttttgatttatgacagaatgaaagattttaaaagactttgacacctctgttgagtaaaagaaagggtgtattgaatacaattcatttgatgggggtaggagaaggttaggataggccgcaggtgaggtataatattatgctttaaaataatggcattttgaaaaaaagaaaagtggaaattaacatatcaaagttggaaaagcaggagtgggggaagtattaaagtaccagacagagaagacatcaaagttgttttggaagatgagaaagtagaataatcatagctatagggaataccagt
